United States Patent 7,560,542 (NUCLEIC ACID MOLECULE SEQ ID NO. 68811 AND OTHER MOLECULES ASSOCIATED WITH PLANTS) - sequence listing, part 10

SEQ ID NO: 57852 - DNA, 372 bp, Zea mays
  unsure at all n locations
  Clone ID: LIB3069-015-Q1-K1-D11
cgcccgcgaggggccggggtcggggtcgcctgggccatgcgcgcgggctgggcagggggcgtgcggtgcgcagagcggagcggcctcggagcctgagccgcccggggccggggccggggagccgcgcggggccggccggccggggggaggggagcgatgcggcgccggcgggcggcagtggccgcgggtttctgcgcctacttcctgctgggctccgtactcaacgtgctcttcgctccgggctcggagcctncgaggccaggccagtcccctgagccttcgccggccccgggtccgggccgtcgcggaggccgaggggagctggcccggcagatccgggcgcgctacgatgaagtgcagcgctattcccgc

SEQ ID NO: 57853 - DNA, 352 bp, Zea mays
  Clone ID: LIB3069-015-Q1-K1-D12
gtgtgaaggcgtctcaaacaggctttgtggtcctggtgctgctccagtgctgctctggatgcaaactggtctgctactacaccagctggtcccagtaccgggaaggcgatgggagctgcttcccagatgcccttgaccgcttcctctgtacccacatcatctacagctttgccaatataagcaacgatcacatcgacacctgggagtggaatgatgtgacgctctacggcatgctcaacacactcaagaacaggaaccccaacctgaagactctcttgtctgtcggaggatggaactttgggtctcaaagattttccaagatagcctccaacacccagagtcgccggacttt

SEQ ID NO: 57854 - DNA, 430 bp, Zea mays
  Clone ID: LIB3069-015-Q1-K1-D2
gctcgatccatctcactctccgctggtcgctcactcttgcagctccacccttcactcagtcttagtctcttattagctctaggctctagctagccgcgccactccttcgtgtagccatcagccttctcatcgccaccaatggccactgccgaggtccagaccccgaccgtcgtggcggccgaggaagcgcccgtggtggagaccccgccgccggccgtcgtgcccgaggagtctgcccccgccgaggccgaggccgaggccgaggctgctgctcctgctgatcccgaggagcttcccgcggccgagcagcatgcagccgccgaggcggaggccgcggctcctgctggtgccgaggagcccgtcgcggccgaaccggccgccgaggcggaggctgctgctcctgctggtcccgaggagactcctgcggtcg

SEQ ID NO: 57855 - DNA, 201 bp, Zea mays
  Clone ID: LIB3069-015-Q1-K1-D3
gccggatctataaccctaggtgcagcggcctagattgcccccaagcgctcggctccacctgcggcgactgacctcccgggtgcctcctacgaggagaccgactatggttcgggctcctacgaggaggaggaggacgatgaggacgacgatgatttgtagaccgatctctcaccgtctaccgaagatatcgagagcgatgct

SEQ ID NO: 57856 - DNA, 432 bp, Zea mays
  Clone ID: LIB3069-015-Q1-K1-D4
gccacgcgtccggtaccatatgtatctgctgttcaactcttcaatcaacctaaaagaacgagtggtggaagcattgataaggaatcaatccataaggacgtgacatgtgaaacatcttcacagctgaacctgcccccaatattcgcaagagctttttccaaaacaatatgttccagtaaataaaccatctactctgcgtactgaagatgatcaacagtcagcagatggggaactggtattcgaattttttgaatatgaacagccatactcacggcgacaattatttgacaaggtaaatgacctgattgccggagccaaaccgtcaaactgccaaatatatggcgacccaaacaatctggaggccagcctgcatgatctccatccagcgtcttggtattgcgttgcatggtatcccatataccggatacctga

SEQ ID NO: 57857 - DNA, 360 bp, Zea mays
  Clone ID: LIB3069-015-Q1-K1-D5
gcgccgccgtcgccccatccggcatggcttcgaagaaggataaggccccgcccccgtcgtcgaagcccgccaagtccggcggtggcaagcagaagaagaagaagtggagcaagggaaagctaaaggagaaggtgaacaacgcggtgctgttcgaccaggctacctacgacaagctgctctctgaggtgcccaagtacaagcagatcaccccctccatcctatccgagcgcctcaggatcaatggctccctggctcggagggctatcaaggacctgatggcgcgtggcctcatccggttggtctcggttcactcaagccagcagatctacaccagggcaacaaatacctaaggatgggatt

SEQ ID NO: 57858 - DNA, 461 bp, Zea mays
  unsure at all n locations
  Clone ID: LIB3069-015-Q1-K1-D6
gctcgagcgatcccactcccgatcagcagctgatcgctcactcttgcagctcgatcgttgtttagctgctctagctctagcctctagccctagctagtagctagccactcggtcgtgtagtcatcagccttctgatcgtcacccatggccactgccgaggtccagaccccgaccgtcgtggcgaccgaggaagcgccggtggtggagaccccggctccgcccgccgtcgtgcccgaggaggctgcccccgccgccgaggccaaggtggaggagccagctgccccggcggagaccgagccagctgccgncgctgagcccgaggcggcccccgtggcggcggaagaagagacgccaaaggaggaagagacggcaaaggaggcggagccggagccggagccggcggcggctgaagaggtgaaggaagaagcggcagcgcccgctgccgagacagaagcagaacc

SEQ ID NO: 57859 - DNA, 404 bp, Zea mays
  unsure at all n locations
  Clone ID: LIB3069-015-Q1-K1-D7
gctccgcgagcccgtcctccgcggctcggctgcggcgatcgtcgaccacgcgtactactggccgcacttcacgcacatcccggcgccggccgacgaggacatcatgatgttcaccgtctccaagccatccggacatgccggaagcagattcggatgggcgctgatcagggacgacgaggtggccaggcgggctttagagtacctgagggacagcaacatgggcgcgtcgcgggacacccagctgcggatgctggggatcgtcaagttcatgctggccaacctgcgcggcaaggacgacatcttcgccttcggccacgacgtgatgaggagcangtggctcaagctgagcgcccgcgtgtcgcggacccgccgcatcacgctgcagaagatcngcgcccagtact

SEQ ID NO: 57860 - DNA, 456 bp, Zea mays
  Clone ID: LIB3069-015-Q1-K1-D8
acgccttggagccggtggcgctcgctgccctgagagatggcaaggtcgtcccggggttcggaccggtgtacgccattggcccactcatgtcgcagcaacactcagttgacgaaggtgggaaggaagaaggatcgggctcccccgttgcctggcttgacgagcagccagcgcggtctgtggtgtacgtcgcgttcggcaaccgctgcgccgtgagccatgaccagatcagggagatcgccgccgggctggaggcgagcaactgtcggttcctttgggtgctcaagaccacaacggtggatagggacgacagcgccgtgctgacggaattgctcggcgaggggttcctggagcgagtgcagggtcgcggcctcgtgaccaaggcgtgggtggaccaggaggccctgctgaagcacccggccatggggctgtttctaagccacagcgggtggaactcgg

SEQ ID NO: 57861 - DNA, 437 bp, Zea mays
  Clone ID: LIB3069-015-Q1-K1-D9
ggagagatgaaggatggagtcccagagggagcacaacttcagggaccggttcatcgaaatgcaacttaccgcccaaggtaccgtagcaggggacctcctcgcccacgacctgccccagcagttggagaggctgaagataaagaaaatcagcaagccaccagtggtccaaaccagccgtctgttcgccgtggataccggcgtccctacaattaccggcgtcgcccgcgtcctcctaacgctccttcacaagatggcaaagaggccaaggcaggtgaagcaccaactgagaaccctgctccacccacccagcagagcagtgctgagtaacaccaggctcctcaggcaccttcaccatcggcaggtgacctaaagaattaatgaccattcagaaataaagcaaaaagcaggccacaaccttaaccaacaccaaagaaaca

SEQ ID NO: 57862 - DNA, 342 bp, Zea mays
  Clone ID: LIB3069-015-Q1-K1-E1
gagagttttactaatgggaatgttcgattactgaagcatgaatgtagcattgtcgcagaggatgatcttgaccagcgatggcaggaagccactggagagtctgtttctgaggtcatattcctcagcaaacacactgcagtctccaaacgtccagcactcacagtgcatccaattggtgtgccacatctgaaggaggatgaaaccccaccccaaggaggaactcctggatgggcagcaattccaagtcctcgaattggaccttggctccggttgatgcaaaagatagctgtagaacaaggccttgttccagagtttgaggttacgcttgaggctactcaccat

SEQ ID NO: 57863 - DNA, 435 bp, Zea mays
  unsure at all n locations
  Clone ID: LIB3069-015-Q1-K1-E10
cccttcccctttagggaggtccagcctcgcaagctgaaacctcccctcggctcagggctgggccaggcggccacagcaggactggccacacccacgccgcacctcatccgtgcacgcgtcggagcacggccagccttccgccacgagccagctgggaagggccgcggctgcctaaagccccagtcaacccagcctgtgtctgagcagacagggcgaacaagcaggccacaccgtctcgagggaggaggccagatgcggccagcgtctccaacagggtgaccatccgctcggcttgctgagcgtttaaacaaatgtttagacaggctgtggggactcccctgagttgagccctggccagnggtccggtgctgtcgcgggaaacctncagcctttttcttcaaaccactcagctcatgtgttttgcactgactagta

SEQ ID NO: 57864 - DNA, 441 bp, Zea mays
  unsure at all n locations
  Clone ID: LIB3069-015-Q1-K1-E11
acgatgccagagagaacttacagttgtccccggagagaggtttgggaagctggcggggaggaacgctctctgcttccagcctctttccattgccgcagcatgacagacctccagcatcacgcatctcttggtcccaataactgcctctagatacatagccatactgctagttaacccagcgtccctcagacttggatggagtttctgggagggtacacccaaatgatgcagatacttgtatactttgagccccttagcgacctaaccaaattgtaaaaatactatttaccaaaggtgctattactctgtaaaacacttttttttggcaagctgactntattcttcaattattatcattatattattgctttttaatattntattttcttgactaggtattaagcttttgtaattatttttcagtagtcccaccacttcata

SEQ ID NO: 57865 - DNA, 280 bp, Zea mays
  Clone ID: LIB3069-015-Q1-K1-C8
accaatcttcatttactatacaaatttatttttaaaacttcacccttcactcaagggtaggttcttattatctctaggctataactcaacactccactcttattacataccatcaaacttatcatctacaccaaagaccactttcatagtccagacatcaaccttcacgacgaccgcttaatcacccattgtgcagacatcaacgactggcgcattgcccgagcagtctactcccaccaacgcccaagcccataccaacgctgctactactgctcatccc

SEQ ID NO: 57866 - DNA, 302 bp, Zea mays
  Clone ID: LIB3069-039-Q1-K1-B9
ggaggaagaggtgaaatggtgaatgccgcgacgtggctcctcgatcggctcctctacgtgctcaagcaggacaagggcaacgacgccaacaccgggcgtgaccgacggcgaaagaagcgtgctccggccggtggcgccgccaacgccgttggaaacgatgatggcgaggagcagcacctcaacacctttctcgacgctgcgaatgcgtcgtccgcctcctcaagggtgcagttcaagaatatggcgtcgcgcgcgcggtgggtggaagaagccggcgcttcggaggtggtggagaacaaggg

SEQ ID NO: 57867 - DNA, 407 bp, Zea mays
  unsure at all n locations
  Clone ID: LIB3069-039-Q1-K1-C1
ctccgagggatccaaatccagtcgtggaagaagctgagcgagctcagcctcgcggacaatggctgcaccgggtccataccgccggagctcggtgacctgccggtgctcaactaccttgacctctccggcaacgagctcagcggcgaggtgccgatgcagctggagaacctgaagctggaccagttcaatgtgtccaacaaccagctgcgtggcccggagacgtaccgcagcagcttcttgggcaaccctgggctttgcctggatgatgcgctccatcttcatgtttgcagctgccatcctggtcgccggagtggcgtgagtctatcggcggtaccggagcttcagcanatcgaagctgcgctcggaccgctcgaaatggacattgacgtctttccacaagctcttat

SEQ ID NO: 57868 - DNA, 366 bp, Zea mays
  Clone ID: LIB3069-039-Q1-K1-C10
acgagacaacaaatctcctcctcttcctctccgtatccgcatcagtccatcaccttcaatggcggcggcggcggctgctgccacctccttcaccaccctcgccgtcgcgcgttcggcggggcagcggtccctccttgcctccaaggccgcaccttcgccgctcctctccctccgtggcgcccgcatcccctcgcaggccgtctccttctccgggggccttgcggcgtcgccctctcacagccgcgcgcgcttcgctacatccgccagcgccgagcccaaggaagcagatcttcagtctaaaatcaccaataaggtgtattttgacataagcattgggaaccctgtggggaagaaatgttggaggga

SEQ ID NO: 57869 - DNA, 319 bp, Zea mays
  Clone ID: LIB3069-039-Q1-K1-C11
gactcatcctttggaagaagagatgctagagttttacatgatcaagtagtgatatacgcgaccctacacatgtgagttttcacttgtattgactaagggaatgcttagacttctgtccccttgtcaatattgggttgttgaatacttagccatttggatgtagaaccccaggaaatggtgcagtatgcgatttggagtgctggcagcttgtaaaacaaatctgtgctagcagtccaccatttgtttacatctccaaatcttgtttgaaacttgcatgtgaacgcaggccttcgtctcaaaatataatttgttttagatt

SEQ ID NO: 57870 - DNA, 429 bp, Zea mays
  Clone ID: LIB3069-039-Q1-K1-C12
cttgtcagttccaaaagcgaccagtgtgaaggctatagccgaaatatttgctgacgctgggttttcagatgttacaaagaatttcttggctgtcctggcggacaatggcaggctgaaatatattgaacgcattgcggagagatttgttgatttgactatggaacataagggggagatgaaggttgtggtcaggacagttatttcactcaccaaggaggaggagaaagaactcaaggaaaccttgcaggatatccttggggaaaacaaaactattttggttgaacagaagattgactacagcatcatgggaggattagtgattgaattcgggcagaaggtgcttgatatctcaatcaggaacagggcgaagcaaatggaggcgttcttgaaggcaccacttgacttctaacaacctttttgataaaagca

SEQ ID NO: 57871 - DNA, 359 bp, Zea mays
  Clone ID: LIB3069-039-Q1-K1-C2
cggacgcgtgggcggacgcgtggggaaaggtttcaggagaaactggcgtgcacagaatcagcagttgctgaagccaaccacgctgtgcaggaggcaaaggccgagaaggagaggcttcaagagaagcttgcacacacggaatcagaggttgctgtggccaacatggctgcacatgaatctaagattgagttcgacaggcttcaagagaaacttacatacacagagttggtggttgctgaagccaacaaggctgtgcacgaggcaaaggctgagagttcgcatctgaaggagcggttacttgacaaagagaatgcattgcagagcataacccaggagaatgatgaattcaggatgccaga

SEQ ID NO: 57872 - DNA, 392 bp, Zea mays
  unsure at all n locations
  Clone ID: LIB3069-039-Q1-K1-C3
agacaatctaaagtcagctctacggcaatttggtatattgaaagactaaatctttgatctttgctggtcagcagaggaatcaaagcagtaggaatgtaggatcgaggagagtgacaggacttcccctctgtgcacttcgccgaaaagtaataatgggattgctatgcatggcccttgttgtacactagaaaattgggcacgcaaacttgtgtcagtttttccgctgttgcgaaattcagtgatggtgtttttgtaactataccaacctgtgtcagttttgccgttgttgcaaaactcaatgatggtgttttttgtaattattatacatccgaataataagactggtgtttccagacagactatgcangctaaagggaaatcacgatttttct

SEQ ID NO: 57873 - DNA, 202 bp, Zea mays
  Clone ID: LIB3069-039-Q1-K1-C4
tcgcccacgcgttcgcccacgcgttcgtccacgcgttcgcttgatcctaagctattcaaagggataaaaaaagtagtcaatgcagtctctgtcatagtggggccaaaggaaagtgatacgccagacaggcagaagttcaaacaagggattaaatttttcgaacctgagatcaaaggacctttacctgaaatgggtgagtaca

SEQ ID NO: 57874 - DNA, 283 bp, Zea mays
  Clone ID: LIB3069-039-Q1-K1-C5
cccacgcgtccgcccacgcgtccggtgcgcttcaacaaggagctgtacaaaggttcataagcaaggagttgcgcttggccggtccgtggacctttctaaattcaccgactacggagagctcaaagcggaacttgacaagatgtttgagttcgagggcgaattggtatctgctaaccggaactggcagatcgtttataccgacaacgagggtgatatgatgcttgtcggagatgacccgtgggaggagttttgcaacatagtgcgcacgatctacatatacacg

SEQ ID NO: 57875 - DNA, 285 bp, Zea mays
  Clone ID: LIB3069-039-Q1-K1-C6
gggactacgtcaacgccgtccgcctcggcagcgtcgcctcggcgtagcttttggattgcgtgttcgtttccatgcatgtgtatcattgcatgcaataattggatgaaataaacagcaataagcttcatcagtattaaaaaaaaaaaaaaaaaaatataaaaataaaaaaaaaaaaaaaaaaaaaaagacaaattgattcaaaagaaaaagtatttaaaaagagataattaaatttaaaaaaaaagtatgatttataacaaagttaaaacttaaaaaacgtttgtt

SEQ ID NO: 57876 - DNA, 276 bp, Zea mays
  Clone ID: LIB3069-039-Q1-K1-C7
caaaccatgggacgatgagactgatatgaagaagctggaggaggctgtccgcagtgtccagatggagggtctgacttggggagcatcaaagcttgtgcctgttggatacggcatcaagaagatgactatcatgttgacaattgtcgacgatcttgtgtccatcgacactctaattgaggaccaccttacgcaagagcccatcaatgagtacgtccagagttgcgacattgtggctttcaacaagatctagagttcagtttctgagattgggcaacg

SEQ ID NO: 57877 - DNA, 431 bp, Zea mays
  unsure at all n locations
  Clone ID: LIB3069-039-Q1-K1-C8
cccacgcgtccgaggcggcgcagcagcatcgccaccaccgtccaaagatggtgaagttcgtcaagcccggcaaggccgttatcctcctccagggccggttcgccggccggaaggccgtgatcgtgcgcgttttcgaggagggcacccgtgatcgtccctacgggcactgcctcgtcgcgggcctcgccaagtaccccaagaaggtgatccgcaaggactccgccaagaagacggccaagaagtcccgcgtcaagtgcttcatcaagctcgtcaacttcacgcacctcatgcccacccgctacaccctcgacgtcgactttaaggacgtcgcatcgggcgggcccgacgcgctcttcacccgggacaagaaggtcgaagcctgcaaggccgncaaagcgcgcctcgaggagaggttcaagaccggcaaggac

SEQ ID NO: 57878 - DNA, 433 bp, Zea mays
  unsure at all n locations
  Clone ID: LIB3069-039-Q1-K1-C9
gttagcagcggcgatgggaatgggttgctatgctccaaccacactcattcccctcacttgcaatatcccaacagaaagcattggtgctcctgctggtgaagagaatgtacaggatgctaggcagcaaaatgtacctcaaagacaagttgttgtgaggaggtttcacttcgcttttcagcttgacttgaccctgatcatcaaactagctgcagtggtgtttctctttagccaggaaggctcaaaacaaaggctatttcttctcatactgtttgcatcattgatttacttatatcaaaccggagctattataccttttgttagatggcttcagcgggcgggaggtgcagctgctcatccaccacaggctcctngctcggccgagaaccgtgctgctctgcctgcccaagatgatggcaatgagcagcccaatgac

SEQ ID NO: 57879 - DNA, 202 bp, Zea mays
  Clone ID: LIB3069-039-Q1-K1-D1
tgcatgcgtacgttcacgcattcgactgcgatcgcgctgctgctgctcatgatgcgtacgagggttgataagttattgagacaagctgctggcataatctggttggctgatgactatcttatggaccctattgattatcccatggaggggttatccaaccttggaaccttaccttaaccgttccattgattcttaccctttc

SEQ ID NO: 57880 - DNA, 454 bp, Zea mays
  Clone ID: LIB3069-039-Q1-K1-D10
cccacgcgtccgagggtgcatctaggagctctggtaatggtggaccaactcaaagggcatgtgcattagcagctctatcatctgcattcaatccatcgtctcaacaaaggctctctaatgagaggcttaaaagcacaggcgatggacccactcaacgcgcctcagcactggctgccctatctaatgcattcaatccatccttaaaacccaaaacaccacttccatctcgctcaggtcaaggttcccaaagagcagctgccgtagctgcactatcctctgtgctgactgctgagcaatctggatcttcagaaaatctacgagccaaagctagcagcacaggagataagactgatgtcgataggcctgtcataactccagctggaccatctggtccatcttctcctcagtctgaagctggggagtccaatgtgtttcgccaggaaaaagatgctgc

SEQ ID NO: 57881 - DNA, 303 bp, Zea mays
  Clone ID: LIB3069-039-Q1-K1-D11
ttctcatttgcagacccaatccattcccagagcaatcaccaagcctggcagattagatttgcaccctcacatggaggaaaaatccaaccttcgcatgtgacctctatttaaatccccgcaagaatcgatcaatcaatccaaaagggtgcaggaaaacagagcaatcccgttgcttagcgtgttcgccttgccgttggcgtctcttctccgttccttcgcacgcgtaggcccataaacctccgctaaagctcctttgtcgcgcccatttcgtcagccatttcccagattccccataagcgaagg

SEQ ID NO: 57882 - DNA, 415 bp, Zea mays
  unsure at all n locations
  Clone ID: LIB3069-039-Q1-K1-B8
cccacgcgtccgcccacgcgtccggcggaagacaggtcgcttgttctacttctacctggcgtcgcaggcttcgcaaggcggccacacgccgatacctcctccttcacccgctccgtcgtcccccccagccggccacgccaccatgctgccaccggccgcgcgccttgcggcccgccgccttctcggcctcgcctccgcatctgcgtcggaagccgccggccgccgggtagcttcctctccgatcgcttccgcaagctactccgncgncgcgtccaggggctccgtcttcagcaccaggcccttctncacggctcttaactaccaccttgattccccggagaacaagccggacatgaaatgggaagtctcacaagcgaatatgaagaaagtcaatgagattcttgctcactatcca

SEQ ID NO: 57883 - DNA, 397 bp, Zea mays
  Clone ID: LIB3069-039-Q1-K1-D12
gcgccacgcaccgacaccaatacgtcatgggttccatcatggagcaacgctgcaacaacgatccgcaggcgctgctcgacgctcagctcgagctctggcacagcacgttcgcgttcatcaagtccatggcgttcaagtcggcgctggagctcggcatcgccgacgccatccactgccacggcggcaccgccacgctcacccagatagccaccaaggccgcgctccacccgtccaagacaccgtgcctgcgcaggctcatgcgcgcgctcacagtcgccggcatcttcagcgtcgccaagaactcgtccgacgatgacagcgatcagcacgtctacggcctcactccggcctcccgacttcttgtcggctcgtcacagaacttggctccaacactgag

SEQ ID NO: 57884 - DNA, 404 bp, Zea mays
  Clone ID: LIB3069-039-Q1-K1-A2
gcaggagttgatttattgagcaaatctttttaggacaccatgcttgtggtcacaggcaattttgatgcaaattgcagtgatgaaaagagttggtagtggttcaacacttctacgaactaaagaggtacactggagcgaagcgtgtcatgctcatgccatatctgtggcctcgtttctaagctattggaaaccaagtcggtgaccactggacgtcttgcaatagcttaacatatacgactttattagccattttttgttacacggctttttgtattcttgagagccttaagcaaaatctctggtagtggaatcaggcttagacttttacatttcttgcagaaatgctgcaccattgatggaatatgtaagctgcaccatggaaatgtgactgcagttttatggtt

SEQ ID NO: 57885 - DNA, 393 bp, Zea mays
  unsure at all n locations
  Clone ID: LIB3069-039-Q1-K1-A3
aagatgtggatggttcatgtatatcagaagaagaagatggtgactgggatgtagatgagccagatgaggaggacatcatttacgtaaaatagcccattgtcttctaggaacttggtcatcattcatccagaacacagcaggtgtgcttctactgatcgaaaatacatcttccaaataactatgaggacttaaccaagcaccattcaatcttcatttgcttctatagtttgggttgcgttctgcatacataatattgcctatcaaggtagatttgccagagcagacttcgatcttcttaatctacctgacagtttcttaccatcatttgattntattgatggacatgttaagcctgttctagggagaaagattaactggatgaagacagggatc

SEQ ID NO: 57886 - DNA, 437 bp, Zea mays
  Clone ID: LIB3069-039-Q1-K1-A4
cccacgcgtccgcgcttcttgaggagtgtggtttggattgcaactaggatgtcagtgcatcagctcccccaatctgcatatgcttgaagtatattttctggtgtttgtccccatattcagtgtctgtagataagagacatgaaatgtcccaagtttcttttgatccatggtgaacctacttaatatctgagagatatactgggggaaaatggaggctgcggcaatccttgtgcagttgggccgtggaatacagcatatgcaagtgtttgattgtgcagcattctttattacttggtcgcaatatagatgggctgagccgaacagcaaggtattttgattctgcactgctcccgtgtacaaacttggttctcaataaggcaagcaggaatgcatctgccagtggaacagagcaacctgcacattatttatgtatgcct

SEQ ID NO: 57887 - DNA, 301 bp, Zea mays
  Clone ID: LIB3069-039-Q1-K1-A5
gcgtccacgcgtccgctcttattagctctaggctctagctagccgcgccgctccttcgcgtggccatcaggcttctcatcgccaccaatggccactggcgaggtccagaccccgaccgtcgtggcggccgacgaagcgcccgtggtggagaccccggcgacggccgtcgtgcccgaggagtctggcctcgccgaggccgacgccgatgccgaggctgctgcttctgctgatcccgaggagctttccgtggtcgagcagcaggcagtcgacgaggcagaggccgctgctactgctggtgccg

SEQ ID NO: 57888 - DNA, 471 bp, Zea mays
  unsure at all n locations
  Clone ID: LIB3069-039-Q1-K1-A6
attacctcgtcgtctgcgcagcgctcaccgtcgcgtgccgccttatcggtgaggaggccatccctgccgtgctgccccaggttgtagagctgctcgcgcaccccaaggaggctgtgaggaagaaggccgtcatggcactacaccggttctaccagcgatcccccttctncgtcttccacctcgtctccaacttccgcaagaggctctgtgataatgatccangggtgatgggtgcaactctttgccccctctatgacctgattttggaggaaccaaattcgtacaaggatttggttgttagttttgttaacatcctcaaacaagttgcagagaggagactaccgacttcctatgattaccaccaaatgcccgcaccgtttattcagataaaactattgaagatactngctggacttggtagtggcgataaacaagcaagtgggcatatgtacactgtattgggtgacatat

SEQ ID NO: 57889 - DNA, 399 bp, Zea mays
  Clone ID: LIB3069-039-Q1-K1-A8
ctcactctccggtggtcgctcactctcgcagctccacccttcactcagtcttagacggttattagctctaggctctagctagccgcgccactccttcgcgtagccatcagccttctcatcgtcaccaatggccactgccgaggtccagaccccgaccgtcgtggcggccgaggaagcgcccgtggaggagaccacgccgacatccggcgatcccgaggagtctgcccccggcgaggtcgatgccgaggcccaggctgctgctactgctgatccagaggagcttaccgcggccgagcagcaagcagccgtcgatgcggaggccgcggatactgctggtgccgaggagctcgtcgcggcctaaccggacgacgcggcagaggctgatgatcctgctggtcc

SEQ ID NO: 57890 - DNA, 393 bp, Zea mays
  Clone ID: LIB3069-039-Q1-K1-A9
cccacgcgtccgcggacgcgtgttcgcggtcccatcctgctggaggactaccacctgatcgagaaggtggcgcacttcgcgcgcgagcgcatcccggagcgcgtggtgcacgcgcgcggggcctccgccaagggcttcttcgagtgcacccacgacgtgacgtcgctgacgtgcgccgacttcctgcgcgcgcccggcgtgcggacgcccgtgatcgtgcgcttctcgacggtgatccacgagcgggggtccccggagacgatccgcgacccgcgcgggttcgccgtgaagttctacacccgcgagggcaactgggacctgctgggcaacaacttccccgtcttcttcatccgcgacggcatcaagttccccgacgtgatccacgcgttcaag

SEQ ID NO: 57891 - DNA, 248 bp, Zea mays
  Clone ID: LIB3069-039-Q1-K1-B1
aattcccgttctactccacgcgtccgattcgaaatagctcaggctgactttcacctcgactactactagcaccgaactttgcgcgggaatggacccccctctgcaggaccgctaccagacacacttgacggatcacatatggactctgggaaccaacaggcggtgctgtaccgtcagctactattcttgatcccctctgagccctcttcttcatctcatgcttaaatatgcacacatgcttccgtaac

SEQ ID NO: 57892 - DNA, 330 bp, Zea mays
  Clone ID: LIB3069-039-Q1-K1-B10
tcccatgcacgcatcggcatatatcaatggcgagctcctcctcctccgagcaccgagctgaaacacacatcaagaaagcaagaaagaaaagactgtagctagctagccaccgcgcgcgcgcacgagtagtctagctagaatacactcgcgttcaaaacaaacacacagcgtcgtgctgcgtgatctctgaccgcgtcgacaactaccgcagcaccaagcagctgatggcggccaccgtatcttcctgcctgagcctcgtccccaccgtgcaccaccgggccggcgggttccccagtgtggcactgacgaacacgcttcagcgccgtcgtc

SEQ ID NO: 57893 - DNA, 425 bp, Zea mays
  Clone ID: LIB3069-039-Q1-K1-B11
gaccgatgtaatcgtcttctgtttcggcgggttcgagaatccaggcactgcgaaatcagaaggagagctgctttcccagcttgtggactcgctggacttgtcgggagccaaatacacggtcctctatgcgtcccaaccgtctggtttgctggagagcccttcgggcttgccgctgggtaggcatctcgcggagaagaagactaacggcacgaaaactgtccagggcgaaaaatgcgatggcgagtgcctcgtcaaatcgagtctcctcgaaggaactttcgttgggatagtgcttctcatcatcctgatatcaggactcatgtgcatgatgggcatcgatactccctcgaggtttgaagctccccaggagtcttgatctctcccttggactgcagaatccgcgggggggttgtgacgagggcacg

SEQ ID NO: 57894 - DNA, 224 bp, Zea mays
  Clone ID: LIB3069-039-Q1-K1-B12
tcggaccgacgtcatcgacttctgtattggcgtcctcgataatacaggcactgcaacggcagagtgagagctgctttctgagcttgtgtactcgctgaacttgtcggtagccaaatacacggtgctctatgccttccaaccgtctgatgtgctgaatagccctttgcccttgctgcttggtacgcatactccctagaagaacactaacttctccaaaactgttc

SEQ ID NO: 57895 - DNA, 446 bp, Zea mays
  Clone ID: LIB3069-039-Q1-K1-B2
cattgcttatatatgtagcatgaactcgtgcatcccattcccagcaactaagcctaaccgtctgctccaccacttctgttccttgtataccttagtcaacaatgcacacacttgccatagcagctctgcacctgttgcagcttctagcaacaataccaacactatcctcacaagacacagaggcaattcccggttgcacctccagatgccacaacataagcataccttaccccttcggtatcggcgatgagcgatgctacttacatgaggggttcaagctcgcgtgcaagacggaagaacagcctccggtgctgtacatgaacagcgctggatatcgagttgtgaaaattaagctgaaccctagggtcgtgtacctcgacactcgtttccaccaactgttggggaaaagcagctatggcgagagctggaacctcagcctggacaac

SEQ ID NO: 57896 - DNA, 378 bp, Zea mays
  unsure at all n locations
  Clone ID: LIB3069-039-Q1-K1-B3
gagatatcgaagtgtttcatgttagcaccgagaaccagctagccgatatcttcactaagcctctagatgagaagaccttttgcaggttgcgtagtgagctaaatgtcatagattcgcggaacctggattgaattgtagcatacatgtacttatgcttttgatcatgttcctttttgcattttgttgcttattatggtgctcaagttgtacaaacactccctggacctcacaagtccgttgcaaagtgatgcacatgtttagggggagatgtgctacaacttgaccctttgagactaaccatgtgcttgagtttgataatttagtctcgaatgatgattganaggggaaaagtggacttggaccatgnaagactttcac

SEQ ID NO: 57897 - DNA, 469 bp, Zea mays
  Clone ID: LIB3069-039-Q1-K1-B4
caatcacttggagctggtgccattctagtaaacccttggaatattacagaagttgcagactcaatacggcatgctttaacgatgccatccgatgagagagagaaacgacacagacacaactacgcacatgtcacaactcacacggctcaagattgggctgaaacttttgtatttgagctaaatgacacggttgctgaagcactactgaggacaagacaagttcctcctggtcttcctagtcaaatggcaattcagcaatatttgcgctctaaaaatcgtctgctcatattgggtttcaattcgacattgactgagccagtcgaatcctctgggagaaggggtggtgaccaaatcaaggaaatggaactcaagttgcatcctgacttaaagggtcctctgagagccctctgtgaggatgagcgcactacagttattggtcttagcggcagtgacagggagtgtcttgatg

SEQ ID NO: 57898 - DNA, 133 bp, Zea mays
  unsure at all n locations
  Clone ID: LIB3069-039-Q1-K1-B5
acggntcgagatagctcatgttcgatttcagctcgacttctcctggatcagacctatgagctgggaatgcacctacctctgcatgatagctaaccgagacgcacgacgtatcattatatggactctggcatcc

SEQ ID NO: 57899 - DNA, 284 bp, Zea mays
  Clone ID: LIB3069-039-Q1-K1-A12
agcaagggaagacgacgcagatctttccacgcgaacacagttagatcgagggagtaagtgagagtgagagccatgacggagctgttcgacacggtcgtgaccagcctcctccacctgccggaggtgctggaccgcctcgccgacgcagacggcgaccggcggtcggccggccaccacgcggcgcacggccacggccacggacgcgtccacgggctcggcggcggcggcggagcgccggtggacatcgtggagagcccccgcgagtacgccttcgtgctcgacgt

SEQ ID NO: 57900 - DNA, 189 bp, Zea mays
  Clone ID: LIB3069-039-Q1-K1-B7
cccacgcgtacgcggacgcgtgggcgagcggtgcctaggagatgacttgcggcaggtcgaagttgaccccggatgatgtgcggatggcggtaacgtatggctggtaaagtggctcgacactctgccgcccacatctaacagcgtagacacccattcaaaggcagagcctaatgctggacctttttagtg

SEQ ID NO: 57901 - DNA, 423 bp, Zea mays
  Clone ID: LIB3069-038-Q1-K1-G10
cccacgcgtccgcccacgcgtccgctcaagttctcgcgcccacagccaaatttttctccactcaatcgcggcataagctgcactgcagccatggacgccagcggagccggtagcaaggcgaagaagggggcggctgggcgcaaggctggcggccccaggaagaagtcggtgtcgcggtccgtcaaggccgggctgcagttccccgtcggccggatcgggcgctacctcaagaaggggcggtacgcgcagcgcgtgggcaccggcgcccccgtctatctcgccgccgtgcttgagtacctcgccgacgaggtgctggagctggccgggaacgcggcgaaggacaacaagaagacgcgcatcgtcccgcgacacttggctctggcgattccgaacgacgttgagctcggcaagctgctgtctggc

SEQ ID NO: 57902 - DNA, 333 bp, Zea mays
  Clone ID: LIB3069-038-Q1-K1-G11
cgcgctcctttcccacgtctggcgctccgttcccctcccaggatggcgctcacattccatcgacgggcctcaccttccatcgacaccgaggaagttcctgttcccgcatcgcgtggcgcgtgccaccgtttctgcacgaacgccatgtcgggtgtcggcccacctctgtgaagcggttttgccgccggctatggaaggggatctgtgttcgttctcattcctctattcccctcccagatcacgtgctgattccagccggtccctcaatcaacgccattgcccccgcaatcccctttcaccgacggcgcggacctttcaacgacgaagccgatc

SEQ ID NO: 57903 - DNA, 227 bp, Zea mays
  Clone ID: LIB3069-038-Q1-K1-G12
ctccgggagcgcacgctggcggccatgctttaggccaaggacgcgctgcgcgagggcggtgaatcggaggccacactggccgggctggtggacgactggaaacgtacttgacgtggttgctgtggattatgttggaagggggtgggggttacgcgacactgttcgccatctatggactttacatcggaacgagaccttctagatgatcaattatgtcctggtaccag

SEQ ID NO: 57904 - DNA, 99 bp, Zea mays
  Clone ID: LIB3069-038-Q1-K1-G2
caatgatgtgcatcactgcattatgaacgtacgtttggtaattgttgtgcaattctttgtacttgtggacaagtgctgtattctacacattgtttgcat

SEQ ID NO: 57905 - DNA, 105 bp, Zea mays
  unsure at all n locations
  Clone ID: LIB3069-038-Q1-K1-G3
accagaagtttgctcggcggtatggctntcttcttcttgaggatgttgcatctcaggatccactcagtgtttcagttgcaattcttcatcaggtcaacattttac

SEQ ID NO: 57906 - DNA, 185 bp, Zea mays
  Clone ID: LIB3069-038-Q1-K1-G4
cgggccgacccacgcgaccgggaaccgagcaaggatacaattccaggcaatgaaaagccgacaaaaaccgcgggagcaccggccaacgaaacaggcctacccagggcagacgacgaacgagaaaagagagcaaggacaatctactgcacaaacaaagacaagaaggccacacaagcagaactaaa

SEQ ID NO: 57907 - DNA, 203 bp, Zea mays
  Clone ID: LIB3069-038-Q1-K1-G5
acggtgttggcttctactgccctttcggttctgtttctggttcgtgaggatatccggtgatcggtttcgtgggcgagctgatcgagatggccattttagatggtgattaccgctgcttgctcacagactcgcctgtgccacctacgaccactggctacacaacgccttcatcacctacggctaggcactcgagtccaagatca

SEQ ID NO: 57908 - DNA, 463 bp, Zea mays
  Clone ID: LIB3069-038-Q1-K1-G7
ggaaccgtgcttggatattattctgtcatggttctgccgtcaaaaactgccattgcaccggtcaacgaaacattcctacccaggtctgacgatgaacgtgaaatgtgtgcaaggactatctactgcacaaacattgacaagaaggtcactcaagcagatctaaagttattctttgagtccatatgtggtgaggtctttcggctgaggttgcttggcgactaccatcattctacccgcatcgcttttgtggaattcgtgatggcagaaagtgctactgccgctctcaactgtagcggtgtggtactgggatccttgccaataagggtgagcccgtccaagacgcccgtgcgtacccgcgcccctcgccagctgatgttgtcctaggtatacatacaggaggtgctgacgatgccactgctcatatataagtaatagagatagacatgtatgaaaagggtctttt

SEQ ID NO: 57909 - DNA, 349 bp, Zea mays
  Clone ID: LIB3069-038-Q1-K1-G8
cggacgcgtgggttacagtgcagattttgttaaagagttatgatgctgatgccgatgcaacggacaaatgcatttggcatgtatcatcaggggagcccagtcagatgcgatgcaaaagcgagaaaggaaccagctatttatgttcaggctacaggcagcttctcttttttctttctttctcgtgttcacaattttagtgaggaggattgtcgagctgaccggtgggagaaaccagtcgagcatttagtagctttgcaccagatgccatttgcttctgtaaaccacacattatctgcttccgtgtgtcttagaatggtaataactcgtccaatctgttttggtttcatgt

SEQ ID NO: 57910 - DNA, 142 bp, Zea mays
  unsure at all n locations
  Clone ID: LIB3069-038-Q1-K1-G9
cagacgccctctacttctctctagttagtgttcatttcaaactcttggccgncgnctcgctctctgttcgccgcgccccgccgcagaaatggcgctgccgaatcagcaggttgtggattaccccagcttcaagctcgtcatc

SEQ ID NO: 57911 - DNA, 354 bp, Zea mays
  Clone ID: LIB3069-038-Q1-K1-H11
cccacgcgtccggaaccagcgccgttggtgccgacggcaagaagaaaaacaagatggggatgggaacggggctggcagtcggcgcggcggccggcgtgctcggaggactggcgctggccggtggggcgagctacctggaggacaagttcgaggagcgcgtgtcggagagggtggaggagaacctggagagggaagattcgtacgggggcggctacgacaactatggcggcgacgacgactactgatcggatctgatcctcagcttccaataatttgctggcttgtgggcttggcttctaacctcaaccttcgttctttccgggtgtccaaattaataattacttggtggaaccg

SEQ ID NO: 57912 - DNA, 384 bp, Zea mays
  Clone ID: LIB3069-038-Q1-K1-H12
ccttggtatgcattacatactggtatgcaagtgttcaatgaagaacctgctttagctctaatagtaaaaatttgctctatgctttcaagtgttgactaatacatgtttttatgttatcacgatgaatggagaactggcttgaaagctcttcgagctgacagtattagtaaactgaagaaagcatttccagaactggtccaagaggttacaaggccatccaatttccaggatttctacatatatgcatttcgttattgcctcacagaggataagaagaaatgtatagaaataccagttgcttgtgagttgctgaatctagtattaggcttgcagttccgccctcaggttgacaagcttaataattacctcatgtaccaaaatgac

SEQ ID NO: 57913 - DNA, 250 bp, Zea mays
  Clone ID: LIB3069-038-Q1-K1-H2
gtgggttacattgcagagttagtatagagttatgatgcagatgccgatgcaggggacatatgcatttggcatgtgtcatcaggggagcccagtcagatgcgatgcaaaagcgagaaaggaaccagctatttatgttcaggctacaggcagcttctcttttttctttctttctcgtgttcacaattttagtgaggaggattgttgagctgaccggttggagaaaccagtcgagcatttaatacttttgacc

SEQ ID NO: 57914 - DNA, 453 bp, Zea mays
  Clone ID: LIB3069-038-Q1-K1-H3
cgaaaaacattgtgcaatacattagacagatggatgactcaaagaaggttctgttggtggatggaggcgacattgataagaagctaaagttggccactcaaaaccttcactacgttaacgtacttccttccattggcctcaacgtctacagtatcctccagcatgacacccttgtaatgactcgggccgctatcaacagaatcgtcgagcggatgcatacccccatcaaccgctagctaggagggtttctgagtcgcaccactgtttcttacagccagcaacctgtgctttttcgttccctgttaaagctcgaaggtttcctgttatcttggtgctaacatggagctgcagcgtcagctgtttattttctgtcagactgaaggcaccgaccgaggtaagagggaaatgatcgggccttttgtaagcaagtcattggatgtttattttagatta

SEQ ID NO: 57915 - DNA, 270 bp, Zea mays
  Clone ID: LIB3069-038-Q1-K1-H4
gcgcgacaggatactgagcatgctaaggttgagcctgaaggaggaggatgtggatttgttagaagaactgttcgtgaaggaaggcatcatcttcgatgccagttccgtcgtggacatcgactcggtgttccgggacactgcaagcgaggagatctcgttgctgatgcaagccgtcgaggagctcaaagaaactgtggaagaagcgttgcagctcacggacgagaacgaaaagcttagacgcagccttcaagtcgcacaggagatgaccac

SEQ ID NO: 57916 - DNA, 443 bp, Zea mays
  Clone ID: LIB3069-038-Q1-K1-H6
gctttctgtggtatgaatacatatacaagttagacaattttacatacaacaagtaccatccctacacctcatggatccctataactgtttatatctgcctgcgcaattgctcccagcagttgaggagtgcctctttggtccttttcgcatggcttggcaagattacactagagacttatatctctcagatccatatttggcttaggtctagcatgccaaatggacagccaaaatggcttctttgtttcataccagaatatcctatgcttaacttcatgcttactacggcgatctatcttcttctatcataccgtgtgtttgagatcacgaatgtcttgaagtcggcttttatccccagtagggataatagccgtctgtaccaaaatttcgttgctgggatcgccatctctgtgtgcctggatctctgctcacttattcttctg

SEQ ID NO: 57917 - DNA, 286 bp, Zea mays
  Clone ID: LIB3069-038-Q1-K1-H8
tcggcgcgacaggatactgagcaagtctagggttatttctgcagaggaggatgtggattcgttggaagaactgttcgtgaaggaaggcatcatcttcgatgccagttccgtcgtggacatcgactcggtgttccgcgacactgcatgcgaggagatctcgttgctgatgcaagccgtcgaggagctcaaagaaactgtggaagaggcgttgcagctcacggacgagaacgaaaagctatgacgcagcctccaagtcgcacaggagatgaccactcatgcccagctc

SEQ ID NO: 57918 - DNA, 422 bp, Zea mays
  Clone ID: LIB3069-038-Q1-K1-G1
cccacgcgtccgcaaaaaaatgatgatggattgagtaactccagtcaaatgaaattcaaagatattaattatgtgaggaaaaacttttggaggtcaatgcatgaagactcagaacaggagaatgctgattcagaatttaaggccactgtttcacaggttcttactaatcaccaggaggataaggtgctcgacaacactgaagttcctcaggcatcaatctatagaaacttgtggattgaagcagaagcttcagcttgtaaactcaaatacgagcttcaacatgctctcctgaagctcgagacagcaaaaggccttaacgacacaataaaagcccctgactcattggaagacagtaaaagctctaactcatacattttcagtaacaaaccacagaaccatgggaaaggaaccgttacatgcgc

SEQ ID NO: 57919 - DNA, 305 bp, Zea mays
  Clone ID: LIB3069-039-Q1-K1-A1
tccacgcgtccgctcttattagctttaggctctagctagccgctccactccttcgtgtagccatcagccttctcatcgccaccaatggccactggcgaggtccagaccccgaccgtcgtggcggccgaggaagcgcccgtggtggagaccccgccgccggccgtcgtgcccgaggagtctgccctcgccgaggccgaggccgaggccgaggctgctgctcctgctgatcccgaggagcttcccgcgggcgagcagcaggcagccgccgaggcggaggccgcggctcctgctggtgccgaggagcc

SEQ ID NO: 57920 - DNA, 414 bp, Zea mays
  unsure at all n locations
  Clone ID: LIB3069-039-Q1-K1-A10
tgatattgtgatatcagctgctggtagtggccaatcttgtaaggggaagctggttaaagcaaggtgcagtggtgattgatgttgggacaaatccaatcgaggatccaaccagtgactacggttatcgcctaactggggatgtctgctttgaagaagcagtgaatgtggcctctgctataactccagttcctggcggagttggaccagtaacgattgccatgcttcttggcaacacacttgattcagcanaacgcgtttatggcctaagtgactgaactgacccccctctgaactgtaattctgtcgtgcttgtcctttgtaaactagttctcttctcttttcatccttccgtcgctctctattttagctgtaagaagaaggctgggatgtaccatattcttgctcaataagtat

SEQ ID NO: 57921 - DNA, 433 bp, Zea mays
  Clone ID: LIB3069-039-Q1-K1-A11
cccacgcgtccgcccacgcgtccttccacgcgtccgctcaaatctgcccttgccgccgccactgcccgatccaggtgtgcagactgctccctcctcctctccgctccgaatggcccgcacgaagcagacggcgcgcaagtcgaccggcggcaaggcgccgcggaagcagctggccaccaaggcggcgcgcaagtcggccccggccacgggcggcgtgaagaagccgcaccgcttccgccccggcaccgtcgcgctccgcgagatccgcaagtaccagaagagcacggagctgctcatccgcaagctcccctcccagcgcctcgtccgcgagatcgcgcaggacttcaagacggacctgcggttccagtcctcggccgtggcggcgctgcaggaggccgcggaggcgtacctggtggggctcttcgaggacacc

SEQ ID NO: 57922 - DNA, 437 bp, Zea mays
  unsure at all n locations
  Clone ID: LIB3069-019-Q1-K1-A12
aggcgttaaagtggggtgggtttagggtgttatgggaggacggattcaaaaccctatccgggataccatgtgggagaccctaaccctaatgagggggtgagtgatgtattaatagactgtgttaggtgggcctggcccattaccggcgtgagatagtaaatacacggcgtagaaccctaaaccggtacattaacatcacccactgtgtaatctctttgacgaatagcaacacggtaagtagagcgatcaatacgataatggcgatcacgaagagaagtccacatctgatgagactaataaaagtgaacaatcttggtagcacattgatccttcacactagcagcaagaacaaaacttgcacgagcatnctcatcgaaccacaacttgtaagcatcgaattgagactcatgatgccatgggatgatcaaaatcagcaa

SEQ ID NO: 57923 - DNA, 444 bp, Zea mays
  unsure at all n locations
  Clone ID: LIB3069-019-Q1-K1-A2
ctttgggctgatttatgtgcttgtctagacccggggagcatcggagcagtaaggccattcatccgcatgatgcatgttaacgtgattcgcgcagtcgcgagcagctcaacgccgtagcgatacgcaacggtgtatttttgcttcatcaatagacgtccatcggagaccgttacagtcgactccgcaacccgccacagggtagcacgaacacacccacggcagtccgaactcacccgcggaccaaaaaaaaaaaaaaaaaaaaaaaagggtggttgtctcagaggacttaagtccatgcatgtgcgtacgtgatgctacagtctcctcacagcgctattcaaacctaacctatcggttgctgccccataatgctgcgatcgggaaaatttcggtgccatttaatccaactgttccgtagtatacnttttccctgttagtcggtgc

SEQ ID NO: 57924 - DNA, 450 bp, Zea mays
  Clone ID: LIB3069-019-Q1-K1-A4
aacctttgggctgatttatgtgcttgaccgagcgacgggtcttttaaacccgcttgcctcgccggcgcctccgggtctcataagggagaccggcttctctcggggctgctagaccttccacattacgacgaagcccgtccttcccgagattactgccgagtccactcataagtacgtcgcgttcgccttgaagctcgagcgtagtaagatcatttagccgggcaccagtcccgtcggcggccatgccgttggcgctcctcgcgtcaccgacctctatttggtcgataattccgcgctcccttcgaataacgttaagggagtcatagcgggagacgtcgccaagaagtccggctctcggggctctcctatcagaggatccttctcctgcactgctacgaccggcatttccatcggcgtctagcggggaacccatgacgtacctaaagcgac

SEQ ID NO: 57925 - DNA, 405 bp, Zea mays
  Clone ID: LIB3069-019-Q1-K1-A5
cttaagaagtaaaggtgaccccttccgccgatcctaaagcggataggaatgaataaggctgcctggtaatgggtgatagactcggtcctgtcttgattcatcatgaccattttaaacgcaagcagtattaatgaatcttaactctccaaagtccatacagatgaatagtgagaatagacgtaaaacactacaggggccacgtaaaatgaccgcaggagatcagcatgcgtacccgacaaactcagcacagtaaaccccttcctatatgaggccgaaccaggagacaacatatgcaacatactggtcaaaggccgctatgattagctataatttttccacgggacgttgacggatatgcatttcgagtaaatgtaaactggtagcaaattagttgactcatatacg

SEQ ID NO: 57926 - DNA, 365 bp, Zea mays
  Clone ID: LIB3069-019-Q1-K1-A6
ctttcggctgatttatgtgcttgtttatgtgcttgtttatgtgcttccccatgcgccgatccatatgcggatatgaatgagaggcgagtacggtaataggtgatcgattcggtacggacttgactcatcatgacccttgtatacctagtactattaatgtatcgtaacatcccaaagcctctacccatcaatagtgagaatagacgtatcaacacaacatccgccacgatgactaatctcaggagatcggatcgttacccgacgcaatcagctcaatatatcgccacccatatgatgatcatccaggaaacaccatatacgacatacttaccatagaccgctataactaggcataatttttccac

SEQ ID NO: 57927 - DNA, 467 bp, Zea mays
  Clone ID: LIB3069-019-Q1-K1-A7
gatttatgtgcttgtgttctcgaaagcctggagttgttggtttccctgttctttctcttgttctttgcgtttaaggttaacagcccctaagcggtaacggtggattaggtcaattaatttatcgcttcctacaagtctggcggttagccttattcgtgtctgactactctcgaaggcgcatgggtttgcaatacacgtttactcgctctactccacgaaaggagacccgttataaggaatcatacgatttagagttcccggggtttcctaacgctcgccagtggcggtactaacgctttagcgacgtagattttgtctcgcgtcaacgtcttcgtcgagaaaggaggtaagaatcctacgaccgaccctacgacgggtggcgccctagtcgtcggcctaaagatcgtcgtcgtctttactgagtgcgcgaagtcgtccacctagaattaagacgagacgaccaagct

SEQ ID NO: 57928 - DNA, 442 bp, Zea mays
  Clone ID: LIB3069-019-Q1-K1-A8
tggttggaacctttgggctgatttatgtgcttgtttatgtgcttgtttatgtgcttgtatttgcacagggtccgtgcccgatgcaacgggctgcgcgttacatggaatactgccctcggacaaataggttgaagaaaggcttcgggatactaattcaggacggcctccagagttagcggcctgcggcgatcattttcctcttacgagactaccggtcagggaatgatcatttcctcctaaggatgagtagaaggagaagtctgttggccttcacaatacgccggggccaaatcatcatattctatggcctcttaaaaatactgacactctattaaatcatctattcgcgtctaatatcgatgatgttcatgttagctaagaagccaatgggttcgatgggaagtttaccggcttcttcacgggaaacttacggactcatacg

SEQ ID NO: 57929 - DNA, 433 bp, Zea mays
  Clone ID: LIB3069-019-Q1-K1-A9
gggaggtggctgatgtcgttgtgtgatgttttctggaaccggcaagatacctaaaggcctgctgcaaatgttgttgacaaaatcctccctgcgtgatctccctgcgagcccttcatcttcaacattctgagccaatctagagggcggcaacagagcagcttaattccatgatggatcttggaagcgatgttcaagttcgtgctgctggaggtctcctagcaatattagacaatgagagacttcttgacaccattgagcagatggaaggtggagcatccattgcgatcgattctgtggtacagatctcattttatcctctgatggagataaattgaacacactgatgtgctgagatttaattatatcttctgtcatgggctgggcttatggccccagatggcagtatgccagatcagatccgaccttatatact

SEQ ID NO: 57930 - DNA, 422 bp, Zea mays
  Clone ID: LIB3069-019-Q1-K1-B1
tggctctttgggctgatttatgtgcttgtactcctcgttcgttctggtatttgggttcccgttccgcgaataaaagctgctgtgccttctccggtcgacgaaacttctcctctgctcagactcgagttcttgttcgctccctggactagacgtccggcttgactgaataatggcgagctccgtctcgccacccgaccgcctcaaatgtacggccccgcccccgcgacgacgcgtaggccttgactcgccctgcccgaccgacgagccgatgtactggtctgaaatgaggtcgtacggcccccgcgttcggaggccctcgaccagtgcgcccaaggaaatcgggcgttataacccgccgtcagaagcgtctgacttgctgaaccgacactcgttgagtcgtgatgccttgggggactcggact

SEQ ID NO: 57931 - DNA, 429 bp, Zea mays
  unsure at all n locations
  Clone ID: LIB3069-019-Q1-K1-B10
cgtgtgcggacgcgtgggttnattttttttatttcctctttaactcatccatcagtgactacgccatatgcgaagatcaacatttcttggcgcaaagtaacaataaagccatgtgtgtttgttatgaaaatcacataatgcactgacaaaatcctatttttcttacccaactagcactatactcgttgatgatgttggtcaggtgcaacaatgctgttcaatttcaagccggccatagataacatggcggttgatctgcagaaggggcctaaatcatctattatgatccacgaaattcttgcaccttagcaggcctcggcaatgtccaagttacacgctttgcacacactgaccatgcatgcccaacttccctcaacaaaggcttgattcaaaatgacacaaatccttcaatgattcaacgtcctcaat

SEQ ID NO: 57932 - DNA, 474 bp, Zea mays
  unsure at all n locations
  Clone ID: LIB3069-019-Q1-K1-B11
ccggctcacgcgtccgaccagcccagctcgctcgtcccagctgatcttgtcgagcacctagtttcgacctgctcgagcatcagtgtagagtgtcggtaggtgtctgtctctcttggtggctggttgcaacggtcatggcgacgtcgtctcgtcgggtgcccttgctgctgctgtgcctgggcgtgctggtgtcctgctccttcgcggcgggcagcttggaccaggagctggacatcacgtggggcgacgggcggggcaaggtccttgacaacgggcggctgctgacgctgtcgctggaccgcacgtccggctccgggttccagtcccggcacgagtacctgttcggcaagatcgacatgcagctgcggctggtgccgggcaactccgncggcaccgtcaccgnctactacctgtcgtcgcagggcggcgcgcacgacgagatcgacttcgagttcctgggcaacgtgtccggcg

SEQ ID NO: 57933 - DNA, 398 bp, Zea mays
  Clone ID: LIB3069-019-Q1-K1-B12
tcgactgcacgcgtccgccacgcgttctccacgcgtgaactgacttattcgcgcacccattttcctccatccatagcgtcactgcaaaggggacatttcacacagaatcaagtaccatctatatgcaaaacaaacatacacacctagacaatactttcattacatactcatgacaatctctaaaacaactcaccaacttcttgcacccatatagcatggatctcgcgcaggccataacactcaatcgaagacccctctacgaacgtcggctaccaataactatctccaacccaactttaaccatcaattcatatcccccatatactctaccaaccattacacataatcaatgatcaacatctaattgaacattcatccattctactatccctgcaata

SEQ ID NO: 57934 - DNA, 487 bp, Zea mays
  Clone ID: LIB3069-019-Q1-K1-B2
ggaactttgggctgatttatgtgcttgaaacctcgctgtcttaacctggatgaggagcacgttgcggactttctcgactaggccttttgggtggaactctaaagttttactcttacttgtgttagtggtgctgtaatttgtagattagtatgtgatttctacgccttggccaggaggcttagtcctatcttccttcaagtgtaaattttcgatcgaagaagagaccgaggtcaccacgtcggggggtcttacccgacactattctacacgaaccggaaacctcaggaatactaacaagaccgcacatttgaatccaccgttcccgattctcgaaagagcgccaccgaagttacgctgacacggaagcgcgcgccccccccaacctagctcggaagccggtcgccgagatacttacccttagcatcttgtatacgcaatcgagtaaattgcgaatatacccagccttccgtagaagcgccgagtacga

SEQ ID NO: 57935 - DNA, 328 bp, Zea mays
  Clone ID: LIB3069-019-Q1-K1-B3
aacctttgggctgatttatgtgcttgggacatttccaccgaggatttcgctagttccctcggctagtctgccgatagtcctctggaggtggcacacagtaaaaagtggatgttcctcggccctcgtacggattcgcggtaccgaagtattataagtattcattgcccgtccccgcaggagtatatacctcggtttacctccccgccgtagactggcgtaccgacctcctaccgggaaccctgtcgaaacacccgatccgtatacacctggcgaaatccaatcccctaacgatagcagggcaaaccaacgggtaaccctcccgcccttc

SEQ ID NO: 57936 - DNA, 418 bp, Zea mays
  unsure at all n locations
  Clone ID: LIB3069-019-Q1-K1-A10
gtgttagctcggtaatggatttaatgtttgtaaatttagactgatttaagggctctctctctgtgagcaccaagagaccatgaagaaatttctctntacttattgggatcccttacttatttgaagaagaacaagtgacaatgtagcaccatacgacactaagctgaatggctgatattgtgtgtgggcagcgagatgaccaaggactgatcactggttactgagaatgagtaagaagcaattgtgctaggataggccatagatgtattgtcgctcaatattgtttgtactgcactaggctgtgtgcatattctttttggataatatatgtttgggacattgaattttttatttgcaattgtctttggtgtaaagaaatagatagttcgctttgctgtgtgaataaaatggggctctg

SEQ ID NO: 57937 - DNA, 388 bp, Zea mays
  unsure at all n locations
  Clone ID: LIB3069-018-Q1-K1-G1
cagaggaagaacgccctggttagcctgcgcttgtggagtgaagtcttcttgcaagtcggcgtgtagatgctgtacgcatcgatattgccttcctcggcctcggcgatgtcgaagaccttgttgcactccttcgacgcatgctaatcagaggaagaacgccctggttgcccagagggtacgatccctgcacggagaagtactccacgaagtactacaacttacctgaggtgcagagagctctacacgccaatgtcaccggaataccgtatccctgggtaacctgcagtgacccagtgtatgatttttggaaagattcgccgaggtccatgcttcctatctaccgtgaactcatcgncgcgggcataaggatatgggttttcagtggccg

SEQ ID NO: 57938 - DNA, 187 bp, Zea mays
  Clone ID: LIB3069-018-Q1-K1-G2
aaaaaaaaaaaaaaaaaaaaaaaaaaaaaattaaaaaaaaaaagaaaaacaaaaaaaaaggggaaaagggtcctcagctcttgcggtatccaggtcttactctacccctgcatgcggacctcatagtcgattcaatggatggcacctaatactcaattacactgaggggcagacttacaacgttaca

SEQ ID NO: 57939 - DNA, 388 bp, Zea mays
  unsure at all n locations
  Clone ID: LIB3069-018-Q1-K1-G3
gctgggacttaaggactttgaggcctctctgggaaaaaagagtcagcccaaatgtcatctacagcacacgtcatttgcccggtgacacggcaacgctggcagttggaggcattgacggcgtgctccgcgttatatgccaaagaactggtgacatcattcgcagtcttgtcgttgacgcagatctcccagcagaagccacatctagatcccggcagcaaatagagaagaaacgtgttcgaaggattgaccctgatgcacagttggacggtatcccgaggcgtctgcgccctcaaattaccagcctatcggttgggatgaagaagatngtgaccacgcatggtgaaactacnattagggtttggaagtttcgcatgaaaagttcgtaaaa

SEQ ID NO: 57940 - DNA, 425 bp, Zea mays
  Clone ID: LIB3069-018-Q1-K1-G4
gcttccggcagaaatcaaggcagtattaggatggtgaccccgcgcctcttcgcgcgactctaccggcattgcgtcggcgcagcggctgcgtcatcagccgcggggcggcaccggggggccctggcagcggcggccgtggagcagttcgccggttcctccctgcctgtcggggttccaaaatttttgaatcatcatttcagatactcaaccagcatttttcaaaagattggtttctcgtctgtttcaccacaacaaagtgatgatgatgttaatgagctgaaagaccacgaaagggccttagatggatcaagtgaagattgtccatctggaagtattgaaggccttgatctgtcgagagatgatttggtgaagctagttcgtgagaaggatggattgttgaagtccaaagatggtgaaatcaaaga

SEQ ID NO: 57941 - DNA, 408 bp, Zea mays
  Clone ID: LIB3069-018-Q1-K1-G6
cccacgcgtccggttcggctgtgtgcaccaatgttaagggggagctggggagcgggcctgcccaagatgagcaggtgaagaagaagcggggtaggccaaggaagtataagcctgatggggcggtgactctcgggttatcaccctcttcatcattaacacctcactcggccagcttggggatgggaaccatgattagtgctccaggttctggatttgggtcggagggatcaggggcttcaggcttgggtgcgccatcagagaagcgtggcagggggcggccacctggctctggaaagatgcaacagttggcttcgcttggaaagtggtttctaggctctgttggaactgggtttactcctcatgtgattattattcagccaggagaggacgtttgctgccaagaataat

SEQ ID NO: 57942 - DNA, 355 bp, Zea mays
  unsure at all n locations
  Clone ID: LIB3069-018-Q1-K1-G7
catttgaaatatatatatatatatacatgtcagtctctccccctgcagccttcaccttccacttcagcttcattccacttccacttggatcgatcgatcgcatatggcggtactgtggtggtggtcatcgtcctgcttgtcctcccgcgccgtcgctgctgcgctgctttgcctgctggtggctcacggcagcgatggaaccaggcacaacagcaacaatggcggtggtagtggtagttccagcagcagcaagagccacaagcaaggcggagggggacgagcccatgccgcgccgacgacaccgtctncgtcttcgtatccgtctccggcggctggcaacaacagcagcagcgac

SEQ ID NO: 57943 - DNA, 343 bp, Zea mays
  Clone ID: LIB3069-018-Q1-K1-G8
gtgaccgggaacaacaactgcgagatggccacggtggagacctcgggcacggcgatagggtcctccgggagatgggcactacacggcaagacagccctcgtcaccggcggcacccgcggcatcgggcgtgcggtagtggaggagctggcggcgctgggggcggccgtgcacacatgctcccggaaggcggaggagctcggcgagcgcatcaaggagtgggaggccaggggattcagcgttaccgggtccgtctgcgacctctccgagagggaccagcgggagcggttgctccgcgaggttgccgaccgcttcggcggcaagctcaacatcctcgtaaacaatg

SEQ ID NO: 57944 - DNA, 424 bp, Zea mays
  Clone ID: LIB3069-018-Q1-K1-H1
cccacgcgtccgcccacgcgtccgcggacgcgtgggtgcgcctctacatttcttctctctctgctcctccgcctccgcctgatccatccaagacagggatcgccatgtcggactcggaggagcaccacttcgaatcgaaggccgacgctggggcgtccaagacctacccgcagcaggctggcaccgtccgtaagaacggcttcatcgtcatcaagaaccgtccctgcaaggttgtggaggtttctacctccaagactggtaagcatggccacgccaaatgccactttgtcgccatagacatattcaatgggaaaaagcttgaagatattgttccttcatcacacaactgtgacattccgcatgtgaaccgtactgagtatcagctgattgatatttctgaggatgggattgtgagccttcttac

SEQ ID NO: 57945 - DNA, 417 bp, Zea mays
  unsure at all n locations
  Clone ID: LIB3069-018-Q1-K1-H2
cccacgcgtccgcccacgcgtccgcagaaacgagagggccggagcagccgcagtcccggcgatcccgccgccggtcgccctcatacttcctcgtcactgccttcgtttctctttccaacaatcaagatgagccgtggcggtagcgcgggtggtggtcaaagttctctgggttacctctttggaagcggtgagccccccaaaccagcagtggcaccagctgtaagtgctccacctgctgctgcaggtgctccacctgctgagaaaccacctgctgcaaagcctgatggcaccagtcagattgctgctggggttaccagccaaaccaataactaccacagggccgacggtcagaacaccggaaacttccttacggaccgtncttcgaccaaggtccacgcttgctcctggcggtggctc

SEQ ID NO: 57946 - DNA, 308 bp, Zea mays
  Clone ID: LIB3069-018-Q1-K1-H3
cccacgcgtccgcccacgcgtccggtaaaattcaagaacacggcgctgctggcgccccggagagcagcagcgggcgctgggatatacgacgtgaacggcctgagcctggtggccgccgggccgaacagcgtgaagacggtgtccatcgggcagatcctgagcatgaagctggaccgcgagctcgagatgacgaggacgaccacgacgagcgcgaggaagaagaaggtctctctcgggcagatcctgagccagaagtacgagatgttctccccgctgcggatcgaccacgactgtgcctcgcacaggca

SEQ ID NO: 57947 - DNA, 428 bp, Zea mays
  Clone ID: LIB3069-018-Q1-K1-H4
gtgtgaacctgctggtgatatccttgtattccttacaggagaagaggagattgaggatgcatgccggaaaatcaacaaggaaactaataatatgggagatcaggttggcccagttaaagtcgtgcctttgtactccacactgcccccagccatgcagcagaagatttttgaacctgctcctgccccattgaaggaaggaggtcctcctggaaggaaaattgttgtgtccaccaacattgctgaaacatccttaactatagatggcatagtttatgtgatagacccggggttttccaaacagaaagtttacaacccaagaataagggtggaatcccttctggtgtcacccatttctaaggcaagtgctcatcagagagctggtcgtgctggacgaacacaaacccgggaagtgttttaggctatacacg

SEQ ID NO: 57948 - DNA, 261 bp, Zea mays
  Clone ID: LIB3069-018-Q1-K1-H5
ctcccccgggaatggtatcgctcgctgggatatacgacatgtaccgactgagcctgctggcccccctgcccaacagcttgaataccgtgtccatacttccgattccgagcattaagcttgacccccagcttcagatgaccaggactaccacgtccagcgcgaggaataataatggctctctcgggcttatcctgtgccccaaataccagatgttcttcccgctttggatccaccactactgtgcctcttacacgccgtttc

SEQ ID NO: 57949 - DNA, 227 bp, Zea mays
  Clone ID: LIB3069-018-Q1-K1-H6
gaagaaagagtgcaaggtctgcttgagacctgaaggaccggaggatgttcgctttcgatgttgttagttggagccgaagatacagttgtttttggttgcgactttgctagatgtctctctatatactgcgactgatatcccgtgtacttttgaagtgatgcgtatattgacatctggaataacaatgcctttcaatttcattatctcaataatggcccttcctgtgc

SEQ ID NO: 57950 - DNA, 246 bp, Zea mays
  Clone ID: LIB3069-018-Q1-K1-H7
gctgcatattatccatttggagtcgatgtgtacttatcaccacagaaactcaatcatatatctcgatttggccaactttctggcattcaacttttcaaccaggttccaacttttttggggggcaaaggacaaggcccaatatatcccggttcaatatttcaaaaatggaacaattgggaaagggataagcttttgtttgtactttaaggctttctgatggttacttgaaaagagctttcacattca

SEQ ID NO: 57951 - DNA, 419 bp, Zea mays
  Clone ID: LIB3069-018-Q1-K1-H8
gttagtccaaaacttgcttgttcttcgatttgccaaccgattggtcttgcctctttggaaccgcgacaatattgataatatacagattgtattcagggaagactttggtactgaagggcgtggaggatattttgaccaatatggaatcattcgtgatatcattcagaatcatttactgcaggttttgtgtttggttgcaatggaaaagcctgtctcccttaagcctgagcacatcagagatgagaaagtcaaggttctgcaatctgtgaaccctattatgcctgaagaggtagtccttgggcaatacgatggctacaaggatgaccctacagtgccagatgactcgaataccccaacttttgcatctgctgttcttcgggtacacaatgaaaagatgcggaagggtgttcctttcattc

SEQ ID NO: 57952 - DNA, 436 bp, Zea mays
  Clone ID: LIB3069-019-Q1-K1-A1
ttggtcggaaccattgggctgatttatgtgcttggtaaagaacaatagagacaacgtaaacgacctcccaccccatggcggccgtcgccggttggcgtccgaatagatattgctatgtcaaaatgcctccgatacccgatacacatagttttgatcaagaggaactccgtagaatcggacggtaagtgaagccccggacactccaagcccgccctgctttagcccgaagagccctcagctaaatcaggggacacgtaccgcaggtagaacgtaggctatactccccccccccgggcgggcaggcaggaaagcgtcgtcccgtccatcgcgcggtccgcaaagttagaacgcaagacatacgggtggtagtccatgccaggacagaccgagttagctccattacctcccccgaaggaaacgtacccgtactcgacgc

SEQ ID NO: 57953 - DNA, 436 bp, Zea mays
  unsure at all n locations
  Clone ID: LIB3069-018-Q1-K1-F8
cggacgcgtggggcccccgcgggaccgaaaccctagctagggttctgcccgccgccgccgccgccgccttcgatcctgacgcggccaggcttcccgcaacaccgccatggacacggggcgcaagcggaccgcaccggagggcgccaacggcgcgggcggccccaagcgcgcgagagaatcggagacaactggtgtaggaagcaaatccaagccgtgcaccaaatttttcagcactgcgggttgcccctttggtgcaagttgccattttctccataacttcccgggtggctaccaggccgtttcaaagatgaccaacttgggtggaccgcctgttccggctccaccaggaagaatgcctatgggacctggtggtcctgatgggccaccttcacctgctgtgaagactcgcatgtgtaacaaggtttnaaccaacact

SEQ ID NO: 57954 - DNA, 394 bp, Zea mays
  unsure at all n locations
  Clone ID: LIB3069-018-Q1-K1-D7
aggatcctgatgaagtacttgtgaaatatgaggcccgtctggaagatggtactgttgtatccaagtctgagggggttgagtttactgtgaaagatggctacttttgtcctgccctggccaaagctgtcaaaaccatgaaaaaggcagagaaggtgctccttacagtaaagccacaatatggatttggtgagaagggtagaccagcagctggagaggaaggtgctgtgccgccaaatgcttcgctgctcattgaccttgagttgatttcatggaagactgtcacagaaattggggatgataagaaaatccttaagaaggttctcaaggagggagaaggttatgagcgtnccaacgagggtgcttgtgttgaagtcaaaattatcggaaaagcttc

SEQ ID NO: 57955 - DNA, 204 bp, Zea mays
  Clone ID: LIB3069-018-Q1-K1-D8
aagatccttatgacatactcgacttctattacgaccgtctcaaatatattactggcgaaggtaactttcataggggtgcgggcacattcaaagactgctacctcctctatcgcctctagctaacactgactgaaccagtccaacttctcataatgctactcctctcatggaatccacactatgaatatgctgagatagctatac

SEQ ID NO: 57956 - DNA, 351 bp, Zea mays
  Clone ID: LIB3069-018-Q1-K1-E1
ggcccccgccgccgccgacggcttcccggtctccccggacgcctacgcgccctcccccttgggcatgccccactccaacggcgacctccacgacgaccctttcgccgcatctgctgactccaacggtgggcccatccttccgccgcccaccgagatgggccgcgaggagggattcctgctccgcgagtggcgccgacaaaatgctattcaccttgaggaaaaagagaagaaggagaaggagctgaggagccaaatcatcgttgatgctgaagagtttaagaaagcttttgttgagaagagaaagctcaatgctgagacaagcaagggccaaaaccgtgacagggagaagct

SEQ ID NO: 57957 - DNA, 391 bp, Zea mays
  Clone ID: LIB3069-018-Q1-K1-E2
cggacgcgtgggagaatgtatacaaatcttttgtgagcgaataccccattgtttcgattgaagatccttttgaccaggatgactgggttcactatgctaagatgactgaagaaattggagagcaagtgcagattgttggtgatgaccttctcgtcaccaaccccactagggttgctaaggctatcaaggagaaatcatgcaatgcccttctgctcaaggttaaccaaatcggatctgtgactgagagtattgaggctgtgaagatgtcaaaacgtgcgggctggggtgtgatgactagtcataggagtggtgagactgaggacactttcattgctgatctggcagttggtttgtccacgggtcagattaagactggagcaccctgcagatc

SEQ ID NO: 57958 - DNA, 342 bp, Zea mays
  Clone ID: LIB3069-018-Q1-K1-E3
caaaaccatccatcgtctctgcccgccatcccatttgccaatcgcctccaaccccccacaggccgcccgccgcaaacccctccatttccgccgcatttccctcgctgtcccagctcaccggtcggtcgggtgctggggctcgcggctcctctcttcctggggcctggaagggacggtgaaggatgcatgccgcgaccaggagcgtctcttgcatcggcgcgcagccgtccgtgctcatccggtgcggcggtggtgcgctgtccgcttcgcccggcggcctcggaggagggggatgcaaggtccgggtcgtcgccgtgctgcggtgctgcgcacaggagaagc

SEQ ID NO: 57959 - DNA, 423 bp, Zea mays
  unsure at all n locations
  Clone ID: LIB3069-018-Q1-K1-E4
cccacgcgtccgagaaacggcaacgcaataacgcaaagattcggctgacaatggggaaggggttcgcgtcgtacttggcgatgaagacggggccagagggcggcgacggcgcggcggcggcggcgcagcaggcgctcatcgacgctgacctgcggaacctcgccgtcgccgcgcgaaagctcgccaaccacgccttcgtcctcggcggcgggttggggttcggcacttctttcctcaagtggctggccttcctcgccgcagtgtatctcttgatattggaccgcacgaactggaagaccaacatgctgacagctctcttggttccttacattttcttcactctgcctaatgtgctgctttctatgatcagagganaggtgggggaaatggattgccgattatttgcttggtattctgcgacta

SEQ ID NO: 57960 - DNA, 320 bp, Zea mays
  Clone ID: LIB3069-018-Q1-K1-E5
gacaatggtcacgatcctcttctccgtttacactgatgggcttctcaggaaccgagttgcggagttgagcaggatggtcaaggttactcatgcgatgaagaggctgtgaaaaagccagtttggatggatagccacgatgcccaaggttcagatatctctgctgccactattgcttctgtgggagatggctctaatggtttaagcatgtcacagcctaatgccactgaacctactggttgtcctcttaccaatggggttatagacaaagacatcagctcttcactagatgaaataagatctgagaagactgacgatatttt

SEQ ID NO: 57961 - DNA, 434 bp, Zea mays
  unsure at all n locations
  Clone ID: LIB3069-018-Q1-K1-E7
agacacccaagaaacacacagaagcgaggagcactacttgttggttggattctcttcagtctagcagctagtccagttaagtttcagacacacatggggagcattggcagaagcacggccaactgcgccaccgtgccgcaaccgccggcgtcgacagggaagctcatcacgatcctgagcatcgatggcggcggcattcgcggccttatcccggcgaccatcattgcgtacctcgaggccaagctccaggagctggacggcccggacgctcggatcgccgactacttcgacgtgattgccgggacgagcaccggcgccctgctcgcgtcgatgctggcggcgccggacgagaacaaccggncgctgttcgccgccaaggacctnaccacgttctacctcgagaacggcccaaagatcttcnccccccacagaaa

SEQ ID NO: 57962 - DNA, 393 bp, Zea mays
  Clone ID: LIB3069-018-Q1-K1-E8
gaagaagctttccgcggcgaagaagccggcggcgcaccctccctacgctgagatgattgtagaggcgatcgctgccctcaaggagaggaaggggtcgagctcggtggccatcagcaagtacgtcgaggggaagcatggcggcaagctccccaccaacttccgcaagcagctcactgtgcagctgaagaagctcgctgccgccggcaagctgacgagggtgaagaactccttcaagctgccggccaccgacgccaagcccaaggccgtcaagcccaaggcacccaaggccgcgcccaagcccaagccctcgccgaaggcgaaggccaagaccgctgcgaagcccaaggcggcgtcgcccaaacccaaggccaaggccaaggcccaagcctgtcg

SEQ ID NO: 57963 - DNA, 390 bp, Zea mays
  unsure at all n locations
  Clone ID: LIB3069-018-Q1-K1-F1
cccacgcgtccgcccacgcgtccgcggacgcgtgggatgaagaacattctgcgcatcggaaaagtcaacgtcattggagatgtcatcctcttcctgggaaaactctgtgtgagcctattctgtgcgcttttcgcctttctgatgttagacacccacaagtacaagtccgcacacaacaagatatcctctccagttatccctgtcctggtaacatgggccctcggctacgtagtcgcgaagcttttctttgcggtggttgagatgtcgatcgacaccataatcctctcgttctgccaggacgccgaggagcaccaggggaacgcgcagtatgcgcccncagctctgatggaaactctggacgaacaaggcgaactgcagagactaactcaa

SEQ ID NO: 57964 - DNA, 418 bp, Zea mays
  Clone ID: LIB3069-018-Q1-K1-F2
gcaaggaaagcctcttgagagtgttaagaatgccctgtccactactctctctgatcttattccaggagattacttcaacataataacatttaatgatgagcttcactcattctcatcgcgtttggagcaagtaaatgaaaaaacaattggaaacgctattgaatggatgaacttaaactttgtcgctcagggtggcactaacatcatgcatcctttgagtgaggcaatgactttgctgtcaacttctcacgatgcgcttccacaaatctattttgttactgatgggtcagttgatgatgaacggaatatctgccatacattgaaaactcaacttattaaaagtggatctaagtctcctcggatttctacttttgggctaggttcatattgcaaccactatttcttgaggatgttggca

SEQ ID NO: 57965 - DNA, 413 bp, Zea mays
  Clone ID: LIB3069-018-Q1-K1-F4
gtcgcttccagccgccgccgcgtccgcctcgccaagcgcagcagccgccgcagcacatcgctctcttgatctcagccatggcggaggtggagcagcaacaggacacgccgaagctcttcaaccgctggaccttcgatgatgtccaggtgaacgacatctcgctgaacgactacctcgctgtgaacgcgacgaagcacgcgatgtacctgccgcacaccgcggggcgctactccaagaagcggttccgcaaggcgcagtgcccgatcgttgagcgccttacaaactccctcatgatgcacgggcgcaacaacggcaagaaggtcatggctgtccgcatcatcaagcataccctggagatcattcacctgctcaccgatgccaacccccatccagggtcgtcgttcgacgcgatc

SEQ ID NO: 57966 - DNA, 377 bp, Zea mays
  Clone ID: LIB3069-018-Q1-K1-F5
gaaatcgattcccccagcatctgatctcttcggtgctagagaaatataggccgccgccgcctcctcctcattcggtgaaaggtgcgcagttagggttgggagatctcttgcctcacgacacgagcagcagaatttgtcgagggccgctggttgctgcgagaggtccgggccttcgtgggatcttgaaaattgaatgttctaatggagtccaagggtggcaagaagaagtctagcagtagtcgttcctccctgatgtacgaagctccccttggctacagcatcgaggatatccgccctgcaggcggcatcaagaagttctccgctgcttactcgaactgcgcgaggaagccatcctgatatctctggtgtcatcccca

SEQ ID NO: 57967 - DNA, 411 bp, Zea mays
  Clone ID: LIB3069-018-Q1-K1-F6
cctggtgcctctcacggccgcattcgcaccgcgatgaactacgccgcagccgccactaacgcccccgcggcggcgcccgcggcagcgccggcgtcgggcacagaacacgcccactacccgtattacgctggctattcttatccctacggcgcctatcaccaacctgccccgcccacgtactcctccgccgtggccgccgcctcgtcatcctactactaccccgtccctgccgccgcgtcgtccaccgccgcgcagtacgacccctattcgggttaccagcactacagtcacccggagggaggaggctcggcgggggctggcctggtgggctgctacagcaccgtcggcgaggcgttgcagcaggccgcggtagcatcgacgacgcaggcttgctctggaggcgaccacaaa

SEQ ID NO: 57968 - DNA, 380 bp, Zea mays
  Clone ID: LIB3069-018-Q1-K1-F7
cccacgcgtccgcaaaaaacccgtatgaattaaagccattgtctttgtctcagggggaaaggtgctttcacacattcgggtaaaaggcgtaccttcgagacataagatcatgatctctctacgcatgtcagcacgtccttggactacatgctagtaggatcaaaggtcgtctatggtgttccaaaacatggaaagaagaagaagtttatggaagtaagcaaacattatgatgcaggccaatctgacaagatttctgagggcaattcatctaacagattcgtgaaacatctgatgccacaattgccaaggccacgtgaaaatgcttccaaagttgaccctattagaggaaagaaagtaggtgaaacaaggtctagattacc

SEQ ID NO: 57969 - DNA, 401 bp, Zea mays
  Clone ID: LIB3069-018-Q1-K1-D6
actagttctagaccgcgctctccgcctgctccgtcgcgaccaagctcatctcctccgcattccgccgctgcagaggcaagcaccaggacagggcctcccccgacgatgatgccgctgcgaccagagacggcggatgtcgcgccgacggcaggagggacctataatgtactgcagccgcactatttttgaggatgctactcctgaactggttagagatttcttctgggatggtgattttcgtctaaagtgggatcccatgcttgcatattgcaaatctttggatgagttccctcagaatggagcaacaattgtccactggataaaaaagttcccgttcttttgcagtgaccgtgaatacatctttggaggacgcatatgggaaatctgggaaggacttacta

SEQ ID NO: 57970 - DNA, 293 bp, Zea mays
  Clone ID: LIB3069-041-Q1-K1-G7
tcggtcagttctgctgctagctacagacaacggtttttatattgcactcatgtcaggacgcacggcatatacacagcagtcttataaatacagtgattcctttccatttaagccaatatacaacaattggagagcaagcttccatgtaactgcgatgtcaacatcatccaatcgatcggctatattcatgtcccgaaatactggattatctgaacactttgttgagttcgacttcttgtacccaaccgagggtatccatagacgcttagacaatggcttacgtattactgcaa

SEQ ID NO: 57971 - DNA, 344 bp, Zea mays
  Clone ID: LIB3069-041-Q1-K1-G8
cccacgcgtccgggaaaaaaaaaaaaaaattaaaaaaaaaaaaaaaaaaaaaaggaaaaaagaaaaaaaaaaaaaaaaaaaaaaaaaaaaaaaaaaaaaaaaaaaaaaaaaaaaaaaaaaaaaaaaagggcggcagtttttaaggtttaaagtttacttacccgtgatttcaagatatttgtttttttatagtgtaactaaatttaaattaactggccttctttttaaatcgttttgactggaaaaaccttggcgttaccaaatttaatcgctttgaagaaaatacccttttcgccagttggctttttagcgaaaaggcccgaacatatggcctttccaaaaat

SEQ ID NO: 57972 - DNA, 180 bp, Zea mays
  Clone ID: LIB3069-041-Q1-K1-G9
cccacgcgttcgcccactcgtcctaaaaaataaaaaataaaaaaaaaaaaataaaaaaatttgaaaaaaaaaaaaaaaaaataaatatacacattactgaaataaaaaattaatagtaaaaattatattcaatatcaaaatttatggtctgacaaattacattttaagcttttcctattg

SEQ ID NO: 57973 - DNA, 449 bp, Zea mays
  Clone ID: LIB3069-041-Q1-K1-H1
accacgcgtgcgcccacgcgtccgatgaagcagctcacttttatggttggcctggtagtggacggtcagcaatatatgggaggcatggtaggatggcatacccaagagctgttatccctggtggttcctttagagggcgtgctccgatgaaagctggtgctagaagtttacagtggaaacgggagccttcaggcactgattcaagtgcaggtgcgaaaactgacatgagtgtggcattttcctctgaacaggtgcttccacgtgcaacatatgggagtatgttaccgctgagctgatataatgagaaccaagtggtatcccactcgtcgctcctggccctaatggctgaatatggacagcaagctgagaagattggtccttcctgctgcactgtaaaagaaaagtaccaaaaaaatgaaaaatttaaaatctatacacgagattctggg

SEQ ID NO: 57974 - DNA, 354 bp, Zea mays
  unsure at all n locations
  Clone ID: LIB3069-041-Q1-K1-H10
cccacgcgtccggtaaaaaggagtacccggtgaaggtgagcggagtgcagatcgtgcccgatccggtcgagcccggcaagcccgccactttcaagatctccgcttctactgataaaaccatcgagaaggggaagctggtgatcgacgtcaagtacttcttcttctacgtgcactcggagacgcgcgacatctgcggagagatctcctgtccggcgaccggcgacttcgtgctgtcccacgagcagacgttgccagggttcactccaccggggtcgtacacgatctacatgaagatggtcggggacgacgacgaagagctgagctgcatctcgntcggcttcagcattgggttcg

SEQ ID NO: 57975 - DNA, 222 bp, Zea mays
  Clone ID: LIB3069-041-Q1-K1-H12
ggaaaagaaaagagggctaaaaacctagcattcccctgctcgccgatgctgtgggacgatgcaaccatgggcgcagggggcaccagccacttatgataccccgagtcacagcactagggctactgaagccgatgtgagtgcaaggcgatgcagacgcatacttagaaccagggtattggaccggccgcctctgagatcaaagttgaatgaggactagatgcg

SEQ ID NO: 57976 - DNA, 250 bp, Zea mays
  Clone ID: LIB3069-041-Q1-K1-H2
agccaagtttcgcgtgcttgtgccctcactcgatgcagagtatgctgctcggattcagtgggcgctgagagggtcccaggcatacaacagttagagcgttttaacatgttgcgtgtgttgccagactgatgcattgcggtttgttttcgatagtgagttatatgtgcggaggcgcagtcctgtataactgagacatgatgacctaacaagcagctcgtatctgttttttatacataatgcctactatgga

SEQ ID NO: 57977 - DNA, 298 bp, Zea mays
  Clone ID: LIB3069-041-Q1-K1-H5
gttcttcttcttcctcaagctgtagcctgtgggaggagaggccggagaggcctcccatggagttcccccactcatcacttcttgttggtcccctgctagctgttcgttccctcagcaggtagctagagatgatcttgctttaattttgtgctgatctcttcctcgtcgtgtacgctcatatgcatggggcgacggatttgtctctgatcgttcccatgccgcctcttgtatcttgacttggatctatatatcaatgcaaataaatcatcgatgggtgacaatcgatccaagcttcctc

SEQ ID NO: 57978 - DNA, 359 bp, Zea mays
  unsure at all n locations
  Clone ID: LIB3069-041-Q1-K1-H6
gagcgaggcaggcaactaaccaccgagaggcagggacaggaacaggaagccggaggcgaagatgtcgtcggtgttcaacggcgatgagacggcccccttcttcggcttcctcggcgccggcggcggcctcgtcttctcatgcatgggcgccgcgtacgggaccgcgaagagcggcgtcggcgtggcgtcgatgggtgtgatgcggccggagctcgtcatgaagtccatcgtgcccgtggtcatggctggtgtgctcggtatctacgggctcatcatcgccgtcatcatcagcacggggatcaaccccaaggccaagcccttactacctcttgatggctacgcccacctttcgtncgggc

SEQ ID NO: 57979 - DNA, 428 bp, Zea mays
  unsure at all n locations
  Clone ID: LIB3069-041-Q1-K1-H8
cccacgcgtccgctcagatattatgtgggcagaagcaatggggaaacttgaatgcatggatagtgcagacagggagaggctgtggcctcagcttgtgcagggttttaaagacctttcccatcggcttaagcttcaagatgaagtccttgtttcggacactgatagattgagcatgactcactctaatgttaaaaagctgcaaaggcatttccaagctgacacgtatccttggatccagcgattgaagcaacaagagctggctattcagagacgtcttttaaggtttgttagaatagtggaggcattggagaatcggggctaccgctgtcctttaacaaaggaggaagctgacttgtatgaaagattggttgctatattaaagcggctaanaggacataacgctgatctttctaagagggtcaatacac

SEQ ID NO: 57980 - DNA, 429 bp, Zea mays
  Clone ID: LIB3069-041-Q1-K1-H9
ctagggttttgctgctctccgaccccgagctccgaaggccgcagcatcaggcgcggcccggctcgcgtgtgaccgagatggcgctgccgaatcaggggaccgttgattaccccagcttcaagctcgtcatcgtcggcgatggtggaactggtaaaactacatttgtgaagaggcatctcactggagagtttgagaagaaatatgaaccaaccattggtgtggaagttcatccgttggatttcaccactaacttgggtaagatcaagttctactgctgggataccggaaggcaagagaagtttggtggcctcaaggatggatactatatccatggccagtgtgcgatcatcaatgttgatgtaacctcaaggcttacttacaagaatgttcctacgtggcatatggacctgtgcagggtctgtgaaaaca

SEQ ID NO: 57981 - DNA, 274 bp, Zea mays
  Clone ID: LIB3069-042-Q1-K1-A1
acggggtctggctcccgctttataactaacgtctttagtttcagggcaccgcggcacggacgccggctgggtcgccgtaggcaccgacttgggcggaggctccggggctgggaacgagggcagcggcccggccatcatcctcggcagcttccagcagcagaactacctggtggagtacgacctggagaaggagaggctggggttccgacggcagtcatgcacgtcgtcgccgtcgtgagggctcacgacgtcagcatggcggggatcggagtgg

SEQ ID NO: 57982 - DNA, 374 bp, Zea mays
  Clone ID: LIB3069-042-Q1-K1-A10
gagagggcagagttgctgcacgaactgctttagagcggagctggcttcgaccccctcccggttcttacccaagaaacactgatcatctggggcgacaaagaccaggtgttccccgtcgacctcggccacaggctgcacaggcttctgggcgagaggtccaggctagagatcgtcagggacgcagggcacgcgctgcagctggagggcgccgaccacgtcaaccgctccatcaagtcgttcctcctggacgagcgggtcgggccgggagccggcgcgggccgcaagtaggacgaggccttctcccgtccaggcccacaagcaaacggaggcctgctcgcaggtgcctgcgttgcagagcttcaacagtgcgaacg

SEQ ID NO: 57983 - DNA, 392 bp, Zea mays
  Clone ID: LIB3069-042-Q1-K1-A11
cccacgcgtccggactagttctagatcgctagccgcacgcttcttgttgccaaagaattccctcccctagccgccgccgccgctcgtctccctgagaggtgccgggaccgaggatttggccgagttctaggtagagaatcggttttacttgtctcagcccggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttctatgatgtatgaagctccccttggctacagcattgaggacgttcgacctgccggaggcgtgaagaag

SEQ ID NO: 57984 - DNA, 118 bp, Zea mays
  Clone ID: LIB3069-042-Q1-K1-A12
agcggtttgattctgttgggtgcttttctttctgtttttttaggatgcaaagaactcggattcacaaactttgttggcttcactgctgatttttttaataattaggcatttcagtggt

SEQ ID NO: 57985 - DNA, 377 bp, Zea mays
  Clone ID: LIB3069-042-Q1-K1-A2
tcccaagccagccattggttggtagcaagctcaagctaatcaagttagctttagatacccgctcccgctcttcttccctccgacgaaggcagctgacgacacagcaggctagcttcggagttcggagcactcagccatggccattgccggcgctctcctcctcctgctcggactcctcgcgcgggaggccgctgccggcgggtggcagagcgcgcacgccacgttctacggcggcggggacgcgtccggcacaatgggcggcgcttgcgggtacggcaacctgtacagcacggggtacggcacgagcacggcggcgctgagcacggcgctgttcaacgacggcgcggcgtgcgggtcctgctacgagctgcggtgcg

SEQ ID NO: 57986 - DNA, 110 bp, Zea mays
  Clone ID: LIB3069-042-Q1-K1-A3
gtttctgcccctgcttccatttgatgtcactagtggtagggagtgtggcataatcatgtagatgtacctgctatgcatacatcgttttaataaatggcaccattgctctc

SEQ ID NO: 57987 - DNA, 384 bp, Zea mays
  unsure at all n locations
  Clone ID: LIB3069-041-Q1-K1-G6
gtctgcacagaaaggatctgtggtccacggaaaggaaatgacgggcctcgagatccttctggtacttaaaaacacctgggatggctacaatgccggctgtctgatgttcctaacctcggtcgctgggtgcaccatcttctgtctaccaccgacggtcccggggttcctgaaatctgaagatatgggagtggtagatatcgccggagctgttgccttgccacgtncatttggttgatcctgctgggcgttgcccactccgtccaccatgtacagtagatgcaagtcctctcagtttttttgggggaaggggggtggatatctgatttctggaccaagaacaatgtanatttgccgcggttctcgccctccttcagtaaatccacc

SEQ ID NO: 57988 - DNA, 142 bp, Zea mays
  Clone ID: LIB3069-042-Q1-K1-A4
cccacgcgtccgcccacgcgtccggttagttacctggtgctaacgaagtatactcacggggaggggctaattttacctccgtcacaagcatttattaaaacatcattctaaaattcaaacccatgaacactcagacctaacc

SEQ ID NO: 57989 - DNA, 377 bp, Zea mays
  Clone ID: LIB3069-042-Q1-K1-A5
agctcccggtcgagaactacttcgtggtctcggggcgcggcgccgtggaggccatctgcctcgccgtcgtcaccgacttcggcggaggctccggggctgggaacgagggcagcggcccggccatcatcctcggcagcttccagcagcagaactacctggtggagtacgacctggagaaggagaggctggggttccgccggcagtcatgcacgtcgtcgccgtcgtgaggtctcacgacgtcggcatggcggggatcggagtggaggccagtaattactccagagtccagtccacgtaacactccaaattccaattccaaaagctggctgcttgatcttttgttagtgctcgtgtactgctaataaaaaactaaattt

SEQ ID NO: 57990 - DNA, 423 bp, Zea mays
  Clone ID: LIB3069-041-Q1-K1-F1
cggacgcgtgggctctggtgcaacttctgcaaactgctgaatttgacatcaagaaagaagcagcctgggcaatttcaaatgccacttctggtggcacacatgatcagatcaagtaccttgttgcccagggttgcattaagccactctgtgatctgcttgtttgcccggatcccagaattgtaacagtttgcttggagggtcttgagaacatcctgaaagttggcgaggcagagaaaaatcttggtgcaggcgatgtcaatgtttacgcacagatgattgatgatgctgagggcctggacaagattgagaacctacagagccatgacaacactgagatatatgagaaggctgtcaagatgctcgaatcttactggctagaggaggaagatgatgccatgccctctggcgacaatccccagaatg

SEQ ID NO: 57991 - DNA, 109 bp, Zea mays
  Clone ID: LIB3069-041-Q1-K1-F10
gccgccgccgctgcagtgtccatagccaccgcaggagactgagatggggggttttgtcaagacccacaagagcaatgcgtacttcaagcgtttccaggtgaagttcaag

SEQ ID NO: 57992 - DNA, 439 bp, Zea mays
  Clone ID: LIB3069-041-Q1-K1-F11
cggacgcgtggggtgctcgccttcttcgccgcctccgacggcatcgtgctcgagaacctcgcgtcccgcttcatgtccgacgtgcaggtcgccgaggcgcgggccttctacggcttccagatcgccatcgagaacatccactcggagatgtactcgctgctgctcgagacctacatccgcgacgacgtcgagaaggaccgcctcttccgcgccatcgatacggtgcccgcggtccggcgcaaggcggactgggccatgcgctggatcgacggcggggagcgcttcgccgagcgcctcgttgccttcgcctgcgtcgagggcatcttcttctcgggctccttctgcgccatcttttggctgaagaagcgcgggctcatgccgggcctcaccttctccaacgagctcatctcccgcgacgagggcctgcactgcgatttcg

SEQ ID NO: 57993 - DNA, 240 bp, Zea mays
  Clone ID: LIB3069-041-Q1-K1-F12
cccacgcgtccgcccacgcgttcgaaaggtagcaccggatcggagcaggcgatacggctgcgacgacaatggctgcaacaagggtttccccggttcttctcttgctgctcaccgtccagctcagcttgctcttccgtctacctgactcccgcttcaccctctccttcacccttgcctcggaaccagagcatcaaaacgccaagcatcatcgccagcccgagctgctggtgcagtcaactt

SEQ ID NO: 57994 - DNA, 411 bp, Zea mays
  unsure at all n locations
  Clone ID: LIB3069-041-Q1-K1-F2
cccacgcgtccgggagacggagcggagctccaccgagtcctccggggcttccgggctcgacttcgaggacaccgcgctcacgctcaccctccgcctcccgggctccgcgccttccgccgccgccgccgccgcggcctccctgtccctctcctcctcgtcgtcctccgccttccccgaccccgaccgcaagcgcgcctnctccgacgctgaccccggccgctcctccccgctcgccgcgtcctccgacgctgcaccggcacccaaggctcgtgtggtgggctggccgccggtgaagtcgtaccgcaagaacgcgctcgccgacgccgcgggctccggcaaggccgccaagttcgtcaaggtggccgtcgacggcgcgccctacctgcggaaggtggacctncaggcgtacgc

SEQ ID NO: 57995 - DNA, 214 bp, Zea mays
  Clone ID: LIB3069-041-Q1-K1-F3
ctagttctagatcgcgagcggccttatatctcaccatggttttactttctgcgcatagacctgcaacttctggaaataattgttgaaatttactctgcaaaaaaaaaaaaaaaaaaaaaaaaaaaaaaaaaaaaaaaaaaaaaaaaaaaaaaaaaaagaaaaacaaaacaaaaaaaaaaatagaacagaaactgaacgatgctagaaaaaataa

SEQ ID NO: 57996 - DNA, 181 bp, Zea mays
  Clone ID: LIB3069-041-Q1-K1-F4
gctaacaatttcgcccgtggccactacacatttggcaaggagatcgttgatctgagccttggccgtatgcgcaagcttgctgacaactgcacctgtctccagggcttcctggtcttcaatgccgttggtggtggcaccgcttctggccttggctctcagctcttcgagttcctgaatgttt

SEQ ID NO: 57997 - DNA, 449 bp, Zea mays
  Clone ID: LIB3069-041-Q1-K1-F5
gcttctcaagtaccatgccagggttctttatattgacattgatgtccatcatggagatggagttgaagaagccttttatttcactgacagggtaatgactgtgagtttccacaagtatggtgacctgttctttcctggaacaggtgatattaaggatataggagaaagggaaggaaaatattatgctatcaacattccacttaaagatgggatagatgacactagctttactcggctttttaaaacaattattgccaaagttgttgagacatatctgcctggtgctattgttcttcaatgtggggctgattcattggcgagggatcgtttaggctgcttcaatctctccattgaaggccatgctgaatgtgtaaagtttgtcaagaaattcaatattccccttctggtaactggaggtggtggatacacaaaggagaatgtagcacggt

SEQ ID NO: 57998 - DNA, 380 bp, Zea mays
  Clone ID: LIB3069-041-Q1-K1-F6
ggtcctcctagttcaggcctcatgccatgttcacctcaacaggggcattggtgcatattggggttgaacacgttaccaccggaacaattgtgtaactgctgctgttgagcctgcccgtctgcatttgctcgctgttcaagctacacatgaaacctgtgttgtattctgtagttcagtatgcagagtttataaccttgagatacaagcattttatggtaaggacagcattagttccggtagaactatattctgtgctagaacttgctgacgcaagtgtaactgctgatcttgttcattcggttgcacagaaatcgaaagggattaaaggagatcagcttaaatctctacattgaacgccatgctgaatgtgtaaagtttgt

SEQ ID NO: 57999 - DNA, 206 bp, Zea mays
  Clone ID: LIB3069-041-Q1-K1-F7
gctttgttttattataggacaagcctgctctgttcagaagcttcttcaaatggctaaagcccggtggcaaagtcctaatcagcgactactgtgagaatcctggaaaaccatcagaagaatttgctgcgtacattaagcagagaggctatgaccttcacgacgtgaaggcttatggacagatgctcgaagatgctgggtttcataat

SEQ ID NO: 58000 - DNA, 356 bp, Zea mays
  Clone ID: LIB3069-041-Q1-K1-F8
cggacgcgtgggtctgccttggctacttcatattccgtaatcagctttttaatgtatatgcgccaaagtatgatactggagggaaattttggcccgttgtgcacaacacaacgatattctctctgggtgttctgcatataattgctattggagtatttgggataaagaagcttccccttgcgttcagtttgctacttcccctaccaacgctgacccttctgttcaacgaattctgccggaacagatttctgcctatctttgaagcatactctaccgagtctttgctaaagaaagatagagaagaacagagcaaaccagatatggccgagttcttcagtaatcttgtaacagcttac

SEQ ID NO: 58001 - DNA, 393 bp, Zea mays
  Clone ID: LIB3069-041-Q1-K1-G1
cccacgcgtacggatctcgatcgcgagcaccaactgttcgtcgttatgttcgacaccgacgggtgctcgactcgccctgcatatgcgtctctctgcctgccaggctcaagggctccacgctcgccaccaacggcgtgataacggccgggtctgacgagtgggccatctacggcggtaccggggtgtttgccatggctaggggcgtcataaggagaaggtatctcgacgacagggcccgcgggaacactgatgagctcaacatggatgtcttctgccggacgtttggctcacagtcacagctgcaagataagatgcaggtgcatgagcaggggcagggctctagcgtcaccaagattggactatggtgtggaccgggagggtcggcacaggaca

SEQ ID NO: 58002 - DNA, 366 bp, Zea mays
  Clone ID: LIB3069-041-Q1-K1-G10
tcgcaccaatttgtttgactaaattttaagaataatatacattcaatacatccttcaaaatttgccaagtctgttaaaaaaactatgtaaaagtctgaaatgaatttgtggtatgtttgattatatttgtcagtgtagttaaagttactagaagatttgctcttcacatccttgattggctagtggtttatttaccagtttgtgacattcaaagattcgtttctgatcatgaaggttatttgtgcattaagaatcttctaaaacttaatacattgattggttgatgagtaactgattcgcaatgcaacgggcacaagaccttttttttaaaaaaggtaacttatgctatcttatttggttaaaaat

SEQ ID NO: 58003 - DNA, 287 bp, Zea mays
  Clone ID: LIB3069-041-Q1-K1-G11
aattacctactcgacccactctttctcaccagatctgcttgactaacttttaagaattttatacattcaatacatccttcgaaattttgcgagtttgttaccaaaactacttcaaactctaatatgaatctacgctatattcaataatatttcactctctcaattaatgtactaccaaatatcattataagatcctcctaatgttagaagataccagtctaacctcttgcgttgctcatctcacaattacccactaaagggagctgtacattcaaagtgaagctcta

SEQ ID NO: 58004 - DNA, 453 bp, Zea mays
  unsure at all n locations
  Clone ID: LIB3069-041-Q1-K1-G2
cccacgcgtccgcccacgcgtccgcaacagtcatgcacctctggccttatcactcccaacgatgaccggtgctactttaaatactcatacaccaaaggctggtgagccgtatgctgatctaagcgaccaatatgctgtactggtatcttatcgctgtaattacacagaatcgaaactttttttcaagcaagcaacaagttggcgaccctctgcagccagcgatcttatgatctcagtatcatccgaactgtctttacggaatcctagtcttggtgctcgtgttcctcaactccccgtgcagatactaacactcgaagctactaatatgacatccgaaaaccttacattaactgtccttgctcctgaagcatctggttcttcttcagttttatccttgaactcatctncaaccaccccaaatggttcttttgatggtgttaatgagtcatcaaa

SEQ ID NO: 58005 - DNA, 454 bp, Zea mays
  Clone ID: LIB3069-041-Q1-K1-G3
agtttctacatcagttctgttgctggctccaacaatggaagttctattgtagtgatgtcaaaaggcacaccatatacacagcaatcttataaagtcagtgattcctttccatttaagtggataaacaagaaatggaaagaaggttttcatgtgactgcaatggcaacatcaggcaatcgatgggctatagtcatgtcccgcagtgctggattttctgagcaggttgtggagttggacttcttgtacccgagcgagggcatccatagacgctgggacaatggcttccgtattactgcaatggctgccacgatggatcagtctgcgctgatcctaagcaagccaaggcgtcgcccaagagacgagacacaagagactctgcggactacacagtttcccagtcaacatgtcaaggacaagtgggccaagaatctctaccttgcttggatatgctatg

SEQ ID NO: 58006 - DNA, 445 bp, Zea mays
  Clone ID: LIB3069-041-Q1-K1-E9
cccacgcgtccggagtcgtcactgacagccccgtgtacgacggccgtggcgccgacgcccgcctcgtggctcgcatacagggagtcacggtcctggtcggtaacgcagacgccttgttcaccatggtgttcgaaaccgacaggctaaagggctccacgctcgtcatcaacggaatggtcacggatgggtcagacgaatgggcgatctacggcggaaccggggtgttcgccatggccaccggtgtcatgaagagaagaaaccttgccgccggtagcaacgacgggaactctgacgagcttgccctggaagttttctgcccggtgtttggcgcatcacagcaaccaattagcaagcagcaggactccatctcctccgtcaccaagatcggactatggggcggacagggagggtcggcacaggacatcacggcagagcagccaccacg

SEQ ID NO: 58007 - DNA, 260 bp, Zea mays
  Clone ID: LIB3069-041-Q1-K1-G5
cacgcttgtaccaaactatcgagagcatccaatctagatctacactatatgcaggtaacgtgtgatgtcttgatgattatcttaccttcattgaatctgtattgatagatgctgatctgcgatcgaagccaaaggatgtaaatgtgtacctaggattccatgtgaaggttaacgtgcctgatatgtaacctgtaaaaacgtactatcaaatatatacctaatcaggacaaatacctgaaaacaaacaaaaacatggcata

SEQ ID NO: 58008 - DNA, 421 bp, Zea mays
  Clone ID: LIB3069-041-Q1-K1-D3
cccacgcgtccgagcaggagctggcaagggagtgtgattatgtgctagaagcaagtaaccggaagcgttacaaagaattgctatgtgatagtgatggttataatgtcccaaaggtcattgatcaattgtctagcaggaaagtgctgacctcggagtttgtttccaggcattcctatcgataaggtggctcagttaagtcaggaaacccgcaattatgttggttgtaaactgcttgagcttacaataaaggagttgcttgtcttcagattcatgcagacggatccaaattggagtaattgtctgtatgatgatgctacaaggaaattcaatctgatagattttggagcagaccgtgattttgcataacacttctgagatgattatctacgaatggtaggtgcctgtgcaaatagagatcgga

SEQ ID NO: 58009 - DNA, 256 bp, Zea mays
  Clone ID: LIB3069-041-Q1-K1-D4
ggagaactgccagaagagcaagatcttcttcatcgcctggtctcctgacacggcgcgcgtggagagcgggatgatctacgccagctccaaggagaggttcaagcgggagctggacgatattcaagtggagctacagtccacctactatcgtgtggttggacatgacacaattccaggttaaccctgcatatgatgctcagagaatatttgcctatgttcaaacactgatgtgcgtcacagacccaaattgtgctgc

SEQ ID NO: 58010 - DNA, 374 bp, Zea mays
  Clone ID: LIB3069-041-Q1-K1-D6
caatcatacagctgcggaaatggaacagcaatggctacttcccttctagtttggaaatatggaaagctagtgagaagcaggacgattccattctattgactgatgctttggcagggaagtttgagaaagacctttcttcatgggaaccggcacatgttagtttggttcaaattaacaaaacccctcttgagcaaagcacaatagctggtgaacaaactccaaaatcagtagttgcaaagtctttctcaagtagtaatcaaagacatgggtatagttcaacaaaccttggaacaaccatgatccattctggcacacaagggtattatggaatgcaaaattcccatgcagcatacacaagccaacattctcttact

SEQ ID NO: 58011 - DNA, 315 bp, Zea mays
  Clone ID: LIB3069-041-Q1-K1-D7
ctgtacgcgtgggttcggaccaacaacaacaacaccggcattcgacgcgacgacggcgaaaagcgaaccgcaaaggcccggctcccccgtctaacgggggtaccggcaagcaacggcaacccacccgtaacggcccccccccctcggaccccaatccgtccggcggacttccgcccagtcccggtacggggggggccggggacccctacggcacaggggccaaggctacacgcccccgaccgcctactgtgcccggggcgggtacggcaacgtcgtgcacgtcgcgcacgaggtcggcgacgagagggcttacta

SEQ ID NO: 58012 - DNA, 162 bp, Zea mays
  Clone ID: LIB3069-041-Q1-K1-D8
gcaacgcaactgcaggtgactgatacaacttcatcgacattagataaactatggtgtacaggaacggtaaagcgagccttgagcctactaaacaccataccgcaagacaccaccatcagaccagtacgcgccgaccaacgtgtgctcctataccgtacatca

SEQ ID NO: 58013 - DNA, 234 bp, Zea mays
  Clone ID: LIB3069-041-Q1-K1-D9
gaactacccactcgacccactcatccactcctcatttcatatacaacatttcaaaataggagatcatctccaaaactacgatacttgtgtgcttcatatgctcaccatcctgtccaactattacatctaaatccaaccacctgatctcactcatattcatttaacatcatgaccatcatccactacctcaacaactactacaatcctcttttctacttcaatcacaattatact

SEQ ID NO: 58014 - DNA, 441 bp, Zea mays
  Clone ID: LIB3069-041-Q1-K1-E1
cggacgcgtggggaaaacccctgctgcaaagaaggataatgctgagggacaagaggttgaggcagcagctgaggaaacgaaaaagagcaaccatgtcacgaggaagcttgagaagcgcaaggagggacgtacccttgacccacacattgaggagcaatttggcagtggacggttgctggcatgcatttcttcccgccctggacagtgtggccgtgctgatgggtacattcttgagggtaaagagcttgagttctacatgaagaagctacagaggaagaagggcaagagcgctgtagcttatagcattctcatggattggcttgcaccgaaatgtgtgtcctgatgagtacactttttttggttagtcgtctcaagttcagagcgttatgccatgttttcagacctgattagtacactcttttctaaaagcgattgagctct

SEQ ID NO: 58015 - DNA, 414 bp, Zea mays
  unsure at all n locations
  Clone ID: LIB3069-041-Q1-K1-E10
ctccccaacgaagtgcgagcgacccacgtccacacgacacgaaccaccaccaccaaccagcggccgcaccacgcacccagcgcaaagcgatggcgtcgctcaccatgatggcgtccttcgccgccgtggcggtggccgcgccctcgcgccgcggcaccttcgccgtggtcaggtccgccaaggtcgaccgctgccaggagcccgccacgctagcagcaaccgaggccaggcccgccgacgacggacgccgcgccgtcatgctcgcggctgctgcggcggccgtggcagccatcggcggcgccggcgccgccatggcgggccccaagaacgggacccccgaggcgaagaagaagtacgcggccatctgcgtcaccatgcccaccgncaaggtctgccacaactgagcacgcccgc

SEQ ID NO: 58016 - DNA, 443 bp, Zea mays
  Clone ID: LIB3069-041-Q1-K1-E11
ctcccgctcggctcggcgaacgcgatctgttccccaacctccgcagccgctccaccgtccggcactccggctgccgaatcgacccgccccgatccagatcaggagctgagggatggacgcgaacaggcgccagagtgggatccagcagttgctggctgcggagcaggaggctcagcaaattgtgaatgccgctagagctgccaagtcagcgaggctcaggcaagcaaaagaggaggctgagcgggaaatagccgaataccgtgcccagatggaggctgagtttcagaggaaggttgcagagagcagcggcgactccggtgcaaacgtcaagcgtctcgaggaagaaacggcggcgaagatcgagcaactcacccagcaggccgcaagcatctccccggatgtcattcagatgcttctgcggcatgtcaccaccgtcaagaact

SEQ ID NO: 58017 - DNA, 439 bp, Zea mays
  Clone ID: LIB3069-041-Q1-K1-E12
gtagctgttggtacggttttcctcctcgctcttcttctccttcttcttgctgctggttgccgggagctgagatcgatcgagagcactgctgttgttcgtgcggcgaggcggcggcggcggcgcgcggcagtgggcggagacgacgaccgatcgatcagctgaaggaatgtcgtcggcccaaatcgtgccggcggaccatgtgtgctatgtgcactgcaacttctgcaacacagttctcgcggtgagtgtcccggggaacagcatgctcagcatggtgacagttcggtgtgggcactgcacaaatctactgtcagtgaatctgagagcactcatgcactcagtcccagaacaggatcagcttcagcaggaagacatcagggtccatggcacgttgcgtgagcatcatcagtgtggcggcgggcaccatctggagctgggc

SEQ ID NO: 58018 - DNA, 450 bp, Zea mays
  unsure at all n locations
  Clone ID: LIB3069-041-Q1-K1-E2
gcacgccgtggcccagatgtccggcggcaccttctccttcatcgacgtggtggggtcgatgcangacgccttcgcgcagtgcatcggcggcctcctcagcgtcgtggcgcaggagacgacgctcagcgtcgagtgcgccgaccagggcgtgctcctcacgtncatcaagtctggcagctacgccagcggagcggacggcgacagccgcggcgggttcgtcgacgtcggccgcctctacgccgacgaggagagggacttnctcgtcaccgtgcgcgtnccgccgtcacgcgcgaccatcgcgctcgtncggncgagctgcacctaccgcgacgcgggcaccacggagatggtgcgggtggggggcgacccggtgacgctgctccgcgcggngagcccggtgagcgcggcgatgtccctgcangtggagcgcgagtggcaccgcgtncacgc

SEQ ID NO: 58019 - DNA, 397 bp, Zea mays
  Clone ID: LIB3069-041-Q1-K1-E3
gacaaaggagaactttgatgctctcgaaaatctttcgggtgttgattccagcagcgctcaagttgttgaagatgacaatgacgatgaccttgttatgtttgatgaggacccaaggcaaagtaagaagaagagattgcagtagcatcctgctgcggcgataacagctcttgactcccggcatcgtggctaacacattgttcgatcgtaacatctttgataacttatttatgcggttatgtaccaggttgatgttgaaacattagtaacaatgcccagggcaccttttggcctcagatagtcagataccctgtagggttgtaatttgtaggatttaggaacaagagcaactaatgctcagctgacagactgctgcgagatagaaattgtatctcaagag

SEQ ID NO: 58020 - DNA, 264 bp, Zea mays
  Clone ID: LIB3069-041-Q1-K1-E4
gccagcatggaacccctgaagtccccagaactaagctattggaacgacttgttattccatggcatccaaagtccaaatgttagtttgctaagctccataatgctgtggcatcgtattgcgaaaacattgattgggagaacattagtacatgaatacttgatcttcataggtcagctttcatgcatgtgcacacatggaaaatacatagtcttagggctagcttatttatgcggttatgtaccacgatgatgttgaatcattagt

SEQ ID NO: 58021 - DNA, 385 bp, Zea mays
  Clone ID: LIB3069-041-Q1-K1-E5
agacgaccgcagaggcccgcctcccccggtctacggcggctacggccagccaccgccacccgacccgtacggccgcgcgcccgtcgaccccgatccgtacggtcgacctccgccccagtccgcgtacggtggggccggggacgcctacggccacagcggccaaggctacgcgcccccgccggcctacggcgccgggggcgggtacggcaacgtcgtccacgtcgcgcacgaggtcggcgacgagaggccttactacggcggcggcggcggcggtcttggtggcgcctacggaggcggtggcttcgagtacgggcacgagggccgaccgcaccacggcggcggcggatcccagtacgggcacgagacacgcccgcaccacggcggc

SEQ ID NO: 58022 - DNA, 444 bp, Zea mays
  Clone ID: LIB3069-041-Q1-K1-E6
tgaatgcacagagtggggccaagttttcattttggattctttggcaagatattgagcaacggattccaaggaagcttaaaacataatggaaccagttacaccccgtcttcaacatgcaaattgggccggtggtctttctggtggcaagataatccttctacaaatggagcttattacgagcaccgatgtagtcaagaatctctgcaagaaaatggcttccccttttggtactcttttgtcagcaaagccttgaattcaatatgtagccttgaagaacattaatctgatagttcaaaagaagcctacaatactcgctcatgagattaaaggtttcttttgcaagtacaatgaccctatatatgttaagatggaaaagctggaagatatgataaagcttgcctcagatcgaaatatagatcaagtgctcttgaaattcaaggagta

SEQ ID NO: 58023 - DNA, 352 bp, Zea mays
  Clone ID: LIB3069-041-Q1-K1-E8
cggacgcgtgggcggacgcgtgggttctgataccatttatggtctggaagatgatgtgcggaatttgtttaggggatgctgtgtacagtgtactgtcttttaccagtcacggagtgtttttgttgtgttgtcacagaactacatacgatctggccagttgatctcttagttccattgggcatggttggtgttcggtaaatagaaaaggacatcactgtccatatacagcaaatgtgcactaattacgctttaccgaagtattgatggaaatctaatcactttctaaaggtcctcgtatgtgcaagattgcttattattattacttaccacgactttattatatgatcacagt

SEQ ID NO: 58024 - DNA, 390 bp, Zea mays
  Clone ID: LIB3069-041-Q1-K1-D12
cggacgcgtgggtctagatactgccgcgatccgaacaatccaaggaggatgggtagagcagctgctaagcgaaagtaggcagggagcgcggacttggttggagttgagcacaccaacttttgctgtgggggggtctggtttcgtgtttgatgtggagtaatgcagtaccatcacctcagctagtattaagtgtagataggtgtggatgattttggtgaatggtgttatggacggaaatgctgcaggctgagcgacctagtaacctatgccatgtagtggcatctaaattagcctgggattgtgtatgcgtaaaaagaacgcctaagacttaaccatgttattatgtcagcttggtacatggtgataaaaagaatctgaccatttcatgtc

SEQ ID NO: 58025 - DNA, 330 bp, Zea mays
  Clone ID: LIB3069-018-Q1-K1-B2
gtaaagcgcaatcaaattagactgggccttcaattggagtctgcaccaaagctggtcaatgattggatgttgcaccgcagctgtatatgcccataataagctgaaggtttatcctattgatctgatccctatgtcatatcatgattaaacataaataatggtaacctaattacgatcacttgatgtatgttagatacctatagatgcctttgtggcttagtagctgggcattgatgtgggtcaaaatgcgatggtgcattaatgcttatgtacctactatgagcttgtgggaccataaagacaaagtcttcatagaagatcttaacttta

SEQ ID NO: 58026 - DNA, 373 bp, Zea mays
  unsure at all n locations
  Clone ID: LIB3069-018-Q1-K1-B3
cccacgcgtccgagttctaatctcaggtttggggggaaaaggcctcgcgggtcgcaaaccgctctctgttgatttgggatttgggaggcgctcgagttttcaggtaaaccatagtttagtgaccaatggctcgtactaagcaaactgctcgcaagtccactggagggaaggctcctaggaagcaacttgccaccaaggctgctcgtaagtctgcacccacaactgggggagtaaagaagcctcatcgttaccgccctggaactgttgctcttcgtgaaatccgcaagtatcagaagagcactgacctgctcataaggaagcttccgttccaaaggcttgtcanggagattgcccaggatttcaagactgatct

SEQ ID NO: 58027 - DNA, 376 bp, Zea mays
  Clone ID: LIB3069-018-Q1-K1-B4
aagatgtcaagccagctgagcctgaagctgcagcaagcaaccaaactgaggattcggcccctgctcctgctgaacctgctgatgttgctgctccagctgctgagaccaaatcagacgccaaacctgctgctgttgctgctccagtgcctgagaccaaatcagacgccgagcctgctgctgttgctgctccagcgcctgagaccaaatcagacgctgagcctgctgctgctgctgctccagctcctgagaccaaatcagtagccgagcctgctgctgttgctgctccagcgcctgagaccaaatcagatgccgagcctgctgctgttgctgctccagtgcctgagacgaaattagatgctgagcctgctgctgatgc

SEQ ID NO: 58028 - DNA, 435 bp, Zea mays
  unsure at all n locations
  Clone ID: LIB3069-018-Q1-K1-B5
aatttccgggccgaggctcgacccacgcgtgcgcaccaattctagcaaggcagctctgcagcttttgtagcgagcttcttggagccttgaaatgagtagtagtggtagcctagccaccacgagtagcaagtaggcactataggcactaggaagtagctaaagcagtcataaccatgggttcgctgccgccggtggacgggcagagacgccccccacacgttgtgatgatcccgtacccggcgcagggccacatcacgccgatgctgcagtttgccaagctcctccatactcgcggcttccacgtcaccttcgtcaacaacgagttcaatcatcgacgccacctgcgtgcgcgagggcccaacgcgctcgacggcacggatgggtttcgcttcgccgncatcgacgacggtctcccgctctttgaaagcggacgcc

SEQ ID NO: 58029 - DNA, 335 bp, Zea mays
  Clone ID: LIB3069-018-Q1-K1-B6
acgcacaagcgttcgctagggatagatttagatcgagcggccagcttgatggatcctggagatgatgatgaagcggagggggttgaccacgaatatcatgtaagcactataggcactaggaatgatctaaagcatgcataaccgtgtgatagctgatgacagtcgacgggtggtgacgttgctgatacatcgtgatgaaccagttcccggcgcatggccacatcacgcggatgctgcagttaggcaagcacgtcagtctctgagcctgctggtgatcttggtccacagcgagataaattatcgactgcacctgctggtgctagggctgaacgagc

SEQ ID NO: 58030 - DNA, 244 bp, Zea mays
  Clone ID: LIB3069-018-Q1-K1-B7
atctccgatttttagttttaaggcccagctttttggaaccgggtaggggctaatttcggaagcctaaggcccacgagtagcaagttagccctttaagtactaacaaatggcttaagctgacataaccattggcaagctgactgcaggtgacgctcatagacaccaactagacatcaagactattccataccctgcacccggacccatcactccaatgctgcctcatgccaagcttcttcatact

SEQ ID NO: 58031 - DNA, 435 bp, Zea mays
  Clone ID: LIB3069-018-Q1-K1-B8
gaaaagtttgaactttgatgcctaccggttctcaatctcatggtccaagatctttcccggtgggcaaagggaaatcaattccaaaagggtaacggattaccataatttggtaaaacttttggtttaacaaagggttgcttcctaccttaaaccttaaccctatgatctttctttttgccctggaaaaaaaatatggagggggttaaagcccaaaaatggcggacttgttacagactatgctgacttctgttttaagacctacggcgatcgcgtaaagcactggtttacattcaatgagccaaggatagtagcgctacttggctatgacacagggtcaaatcctcctcaaaggtgcaccagatgcgctgctggtgggaattcagcaaccgaaccttacatagttgctcataattttctcttttggggtcacatgct

SEQ ID NO: 58032 - DNA, 216 bp, Zea mays
  Clone ID: LIB3069-018-Q1-K1-C1
cccacgcgtccgcggacgcgtgggcgagtacacggtggcggtgcggcggatggcgtgcgcgctgctggacctgatggcagaggcgctgaacatccccggcggcgcctgccactcagcacgagggactcgacccagccgaggcggccgctaccggcaatgcgctagcttccgtacccaaacgtggggccatactactgcttctcgccctgccgtcga

SEQ ID NO: 58033 - DNA, 417 bp, Zea mays
  Clone ID: LIB3069-018-Q1-K1-C2
cccacgcgtccgcccacgcgtccgcccactcgtccgcaacttctttttttccacattcttctgatcaagaagggaatcagtacctatgactacatcattgccctgcgagagcaagagcaagatgatctgagtgggcagcagagtccacagatgtctcgtgtaagctcctacaccggactcagcagtactagctcctttggtccacttcgtcgtggttcatggtgcactccgccaaggctgtttcttgaggatcagtttgatgttattccatcggaagctgcttcttcgcataattctgctacgaagaggaaagaagaccaggggaagaggaagaagggctcaagggccgtgaaaataagcccatgggcattagctcgtcttaacgctgaagaagtttcgagggttgctgcaaaagca

SEQ ID NO: 58034 - DNA, 170 bp, Zea mays
  Clone ID: LIB3069-018-Q1-K1-C3
atcattgtgtcgtccttggtccttgctactgtacggtcgtcctcaagcagtagtagagacactggcataaccgtcagcagttagctacatgcatagtccaggatgatctgatgttacgcagagcagatgttgtagaacaggcttttgtattttgctgccggttacatgtt

SEQ ID NO: 58035 - DNA, 417 bp, Zea mays
  Clone ID: LIB3069-018-Q1-K1-C4
cccacgcgtccgcccacgcgtccggccatgtggaggagggctttagcgatggtcctgttcatggctggcgccgcgctgctcgccggggctgccggcgccggcgcgcagcagggcgtgtggagcatcatcacccggcccatgttccagagcatgctgagccaccgcggcgacagcgggtgccagggcgccttctacacctacgacgccttcatcgaggccgccagcaagttccccggcttcggcaccaccggcgacgagcagacgcgcaggcgggagctcgccgccttcttcggccagacgtcccacgaaaccaccggtggatgggcgactgctccggatggaccgtttgcctggggatactgccgggtgaaggaacagaaacagacggacccaccctactatggacgaggacccata

SEQ ID NO: 58036 - DNA, 392 bp, Zea mays
  Clone ID: LIB3069-018-Q1-K1-C6
cccacgcgtccgcccacgcgtccgtccactcgtccgattgattgcatgtgttctcctcctaggaagaagttcaaattgagccctcttcagaattgggatcctcgcttggaaccagaccttattgtatacaatgcagttttgaatgcttgtgtgcaacaaaagcaatgggaaggggcattttgggtactgcaacagttgaaagagaagaacatttgtccaacaaattcaacatatggtcttgttatggaggtaatgcttgtctgtggaaagtacaatttggtttatgagttcttcaataaggtggataaatcatcaatacctggtgctctgaactataaagttcttggtaatgcactttggagagaaggaaagattgatgaagcaatgatggc

SEQ ID NO: 58037 - DNA, 392 bp, Zea mays
  unsure at all n locations
  Clone ID: LIB3069-018-Q1-K1-C7
tgtttacatctaacgttctttttgttgcaatcgaaaatcaatattgcattgtggaccatgggctactgaagacatatgttttgtttacacaaatgaaatagaaatctgaaaaaaaaatgttctgtgaacaggttaccattagcctggaactgcgacaaaataagaataatcgaaaccaataaagcctagcgttttgttgttctactcggtcattttcgtgtcctaaacttgtaattttgctggaatattgtacagggcatctgatgcaaggtgcaaaaactggtgtttggtctgcggttgctttcaaagagttgtgtgccggttgcttgcacatctttaactctgggtcttgaaagcanatcagaagtatttatggtttaaggaaatatgca

SEQ ID NO: 58038 - DNA, 382 bp, Zea mays
  Clone ID: LIB3069-018-Q1-K1-C8
ggcgtctgcacatgcagcgctcgaatatttggcttatgatcttgagattgcttaaaatgccgtggtacaatgatgactggtgagcgacattcatagctggtgcaacactatgttcctttaccggaggatcttcggcagataaatttgggcggacaagaacattcatcctggatgcagccccactggctgtaggtgcattcttgagcgcaacagctcaagatatccgcaccatgattattggtcggttgcttgctggaatcgggattgggatctgatctgcacttgtacccctttacatatctgagatatcaccaactgaaattctgggaacacttggttctgttaatcaactctttatctgcattggaattcttgcaacttt

SEQ ID NO: 58039 - DNA, 275 bp, Zea mays
  Clone ID: LIB3069-018-Q1-K1-D1
ccaacacgttcgatcgaacaaggacggatgcctggccttctctggtaaattaaacgtcggataccatggcatatagacatgctgcatccggacacagagttgacagaaccaagggtctgtcaactggattgtaggaatacacatagctttctccgatgcggacattcatgagttgggtttcaacgttgtatgcgaggtgtacaacctgatgtagcacatggtctactgcctctagtaaaacatctagggcacattgagcggacacctgaactaga

SEQ ID NO: 58040 - DNA, 398 bp, Zea mays
  Clone ID: LIB3069-018-Q1-K1-D2
cttggtgtggtcaatggtgcgcttgaatatcttgcgaaggatcttgggattgctgaaaatgccgtcttacagggatgggtggttagcacatccctagctggtgcaacactaggttcctttaccgggggatctttggcagataaatttgggcggacaagaacattcatcctggatgcagccccactggctgtaggtgcattcttgagcgcaacagctcaagatatccgcaccatgattattggtcggttgcttgctggaattggtattgggatctcatctgcacttgtacccctttacatatctgagatatcaccaactgaaattcgtggaacacttggttctggtaatcaactttttatctgcattggaattcttgcagctttggtagctggattggc

SEQ ID NO: 58041 - DNA, 61 bp, Zea mays
  Clone ID: LIB3069-018-Q1-K1-D4
attcccgtcgcacgcgtctctcttagcgtatcaagatgctgtcatatccggatctgtgtca

SEQ ID NO: 58042 - DNA, 413 bp, Zea mays
  unsure at all n locations
  Clone ID: LIB3069-018-Q1-K1-D5
cgcggaggaggcacaggcgccgatctaaagacgatggccgccgcgggctcctcgccgtccttctcctcctcgagtaagcggctggaagggaaggtggccctcgtcactggtggcgccaccggcatcggcgaggccatcgttcgcctcttcatggagcacggcgccaaggtctgcatcgcggacatccaggatgaggccgggcagcagctgcgcgacgccctgggaggtgacgcgcagggcgccatgttcgtccactgcgacgtgacgtcggaggaggacgtgagccgcgccgtggacgctgcggcggagcggttcggcgcgctggacgtgatggtgaataacgccggcgtgacgggcaccaaggtgacggacatncgnaccgtggtacttcgcgggaggcgcgcagggtgctc

SEQ ID NO: 58043 - DNA, 312 bp, Zea mays
  Clone ID: LIB3069-017-Q1-K1-H10
gcccggcgaatccaccttgcccgcagcgttttcggcgagcagcacccccgtagacgcctggggggagccgatcccgacttggtcggtgctgatggcggcgtgtaagcacatcgcggtccggtgcctcccggagaacgttgccttcctcaactgcaagaagaaggaccctaacccctagaagtgcctcgagaagggccgacaggtcacacgctgcgtccttagcctgttgaaagaacttcaccaatagtgtccctatgaaatgtgtggatatgctggttgcatgtatgactacactaacgaattcgacttctg

SEQ ID NO: 58044 - DNA, 444 bp, Zea mays
  unsure at all n locations
  Clone ID: LIB3069-017-Q1-K1-H11
tcggtcccttcggcaggtctttgttggggccttcactggcgactagcacccaccaattactgggtgtacatctgtatgctcatggcctttgcttggtcccacccttatcccaacctattgatggaatctgagaatttggcaaggtctaccaaaggggtcgtagaaatttaaattccaagggatagtgatcttctggtgcatctagcagcacaagttgggaacgctctaactgagcgccatgcatttatcaacgagttcattaaatttgntgatgatgtagaaatttatttgcactacatcctcaacatataccacgtgttaggcaagatggtcgtgcatcatacttcttccatagaagttttgagccctacatcaatgagaatgatgtaaataactgctggaagaaaattggaagtactagatccatcatcctgnatggaacac

SEQ ID NO: 58045 - DNA, 401 bp, Zea mays
  Clone ID: LIB3069-017-Q1-K1-H12
cgcgtccccatcccaattcacaacgcattgtcgtctcccacaacacggtccactaaccgtggcgacagcctcggctcgtttgatccccgcggggagctctagttccgtcaagcgtgcgtaccggcgtccggatccgggaccgaagatgacggagtccctggtgcggaacaagccggggatggccagcatcaaggagatgccggtggtgcaggacgggccgccggcgggcggtttcgcgcccgtgcgcttcgcccgccggatccccacctcagggcccagcgccaccgtcatcttactcaccaccttcggtgctttcgcatatggcatgtaccaggtcggtcaggggaacaaggtccgtcgggcgcttaaagaagagaaaattgctgctcgcagtgctatac

SEQ ID NO: 58046 - DNA, 238 bp, Zea mays
  Clone ID: LIB3069-017-Q1-K1-H2
actgcagggtctctagaagaaagttaagaagatttcaaataaatcagttgaaacaggcaaaattgtcatctttaaagtgctcaaacatgtacacacatacatttgcatctcatccaaatacatgtccataatatactaccacatctactacatcattattacacacactatcactatcatacaatcttatactttacctcattatgcccaccattccatcctactaaatccacaccta

SEQ ID NO: 58047 - DNA, 436 bp, Zea mays
  Clone ID: LIB3069-017-Q1-K1-H3
cccacgcgtccgcccacgcgtccgcccacgcgtccgaccgtggtggcgacgagctccgtctggtgcaccgcctccgccttctggccccttccgctgaggcccgcgtcggcgcgttcctgccatagtcggcaaccaataggagcgtaaaactggagctagggattgaagctgttgcaggtacatgtcatatataaatggacatgggcaggcactcccgctgagggtgcttcttggcttcgtctgtagaggcttgctgatatttggcataggatattgctaatttgtgggtatgatgcatggattatttgagatctttgagccgatgaagcaatcattatcatctcaaagggagggtattgatttcatggccgtgattcccccttttccagtcaaagccatccaagccgcaattacttcagggacagggtgttcactg

SEQ ID NO: 58048 - DNA, 306 bp, Zea mays
  Clone ID: LIB3069-017-Q1-K1-H4
cacacgcgtccgatcacgcgtacggctagctaagaatgcgacgacgggacttgcacgaacgatgctgctggaatgcctaagctcgaccagtcgctcgtactctgcctgaaggccgattccgccgcggcgtccgtggcgcggaccttcttcgactgcgagcagctcctgctgcacaatggcgacaaccactacctgctgaccacggagcacgccgacacgctcccctacagcatcaatctatccacgcactaagtcacaggccgtttcttcaacgggctcaacatgcacgacatcgtcagcgagcac

SEQ ID NO: 58049 - DNA, 194 bp, Zea mays
  Clone ID: LIB3069-017-Q1-K1-H5
tccgccgactccttcagtcacactttgcacgtttactgacaccaacttccttacggtaacttggtgcacattaaaataaggcctatccttgcgaagaaaattatccatgatacttattaagatattccccatcagaattgcgccacatacggtcgccattattacacacgctattactatcataatatctattc

SEQ ID NO: 58050 - DNA, 375 bp, Zea mays
  unsure at all n locations
  Clone ID: LIB3069-017-Q1-K1-H6
ggagggtggcgagaagaagggtaagaagaatgcaaagaagtcggtggagacgtgcaagatgcgacatctttaaggtgctgaagcaggtgcacccggacattggcatctcgtccaaggccatgtccatcatgaactccttcatcaacgacatcttcgagaagctggcggcggaggcggccaagctggcgcggtacaacaagaagcctaccattacgtcccgcgagatccagaccttcgtccggctcgtcctccccggcgagctcgccaagcacgccgtctccgagggcaccaaagccgtcaccaagttcactagcttctacgcgagcgatgcgacgtgcactcgtctnctcttcttgcagtagtgcaatagtagta

SEQ ID NO: 58051 - DNA, 430 bp, Zea mays
  Clone ID: LIB3069-017-Q1-K1-H7
cccacgcgtccggacagctagcacgccggagctgggcctggtgcaaaggagaaggtgcgctggcagggaggatgggactggtcggtgtgcaaccgggagcaggtgccattgttcaaagaaaaggaagctaaggataaggaggtccatcaaagtccctgcaataagcaacaaggttgcagacattccagctgatgaattctcatggaggaagtatgggcagaagccaattaaaggatccccacatcctaggggttattacaagtgtagcagtgtgagaggctgccccgcgaggaagcatgtcgagaggtgcgtggacgacccctcgatgctgattgttacctatgaaggtgaccacaaccacaaccgagttctagcccagccagcctgatctttcaggctatcaattcaagatcggttctacagtcaccct

SEQ ID NO: 58052 - DNA, 305 bp, Zea mays
  Clone ID: LIB3069-017-Q1-K1-H8
agatggccgaagatgggaactgtctattcagagctgttgctgatcaagtttatggagacggagaagcttatgacatggctaggcagatgtgtgttgattatatggaaagggaacgggatcatttctctcagttcataactgaaattgaaagttttacattatactgtaagaggaaaaggagagataaggtttatggcaacaatgttgagatccaggcatttgcagagatgtacaatcgtaccattcacatatattcctacagtacagagcccattaatatttttcaaggaagctataacacagac

SEQ ID NO: 58053 - DNA, 427 bp, Zea mays
  unsure at all n locations
  Clone ID: LIB3069-017-Q1-K1-H9
cccacgcgtccgaataaagggagggtgactgtgaaccttggaggtcgccccaatagcggggtccatgcccagcccacccgatttttctcaaatgccaccgcttgttccaatccaacggaccagatcgctccaactaacccccacacacaaaccctactcagctccacctatatagcctattgccctttcggcgcgcctccattcgcaccaccgacgcgccgtccaaaccctagccgacgtcgacggcgtcgccgacatggtcgccgtcaaccggccgctcgtctacgtgaaggccctagagggcgacatggtaaccgacgcccccggcatcgccttaccgnccgtcttcggggcgccgatccgccccgacgtggtcaggttcacccacaagctgctgtcctgcaacaagcgccagccctacgcagtc

SEQ ID NO: 58054 - DNA, 414 bp, Zea mays
  Clone ID: LIB3069-018-Q1-K1-A1
caaaaagcgcccgattcgcctcgcaaaatctccgccgccatcacctacctactcacagaagttccgccttcctttcctccggcgcgcgccgcgcctgtcgccatggtgaagcgatggcttcccctcgaggccaaccccgacgtcatgaaccagttcatgtggggactgggggtccccgaggacgtggggttctgcgacgtgtacggcctcgatgacgagttgctcgccatggtgccccagccggtgctcgcggtcctacttctctacccccaggaccggagcaaggagtcccaagcttcagctacctcgtcggtggagaccaaggagcccagcaagaacgtatatttcacaaagcaaactgttgggaatgcctgtggcacagttggtattattcatgcactggggaaatgctac

SEQ ID NO: 58055 - DNA, 386 bp, Zea mays
  Clone ID: LIB3069-018-Q1-K1-A2
cccacgcgtccgcccacgcgtccgcccacgcgtgcgtccacgcgttcggacaaatcgaaagccaagaggagatggccatttggaaagtccaagcactcggagccttccatatcgacggtgccaggcactgctccagcagtagctccgttgccatcaccaccagcaactcagccccactctctggagatcaaagatgtcaatccagttgaaacagacagtgagcagaacaagcatgcctactccgttgcgcttgcgtctgctgtcgctgctgaagctgcagcagttgctgcccaggctgctgcggaagttgtccgcctcacagcagttaccacggctgcaccaaagatgcctgttagttcgagggaagaacttgccgccaccaagat

SEQ ID NO: 58056 - DNA, 285 bp, Zea mays
  Clone ID: LIB3069-018-Q1-K1-A3
cccacgcgtccggagatctggcgcacgaactaccttgtgcagctgagaggtccacttaccggctacaaccattggcaatgcgtagagattcagagatactcatgttaggaaagatgctgatggtgctggaacatgtgaccgagatatacatcctagagctgaacctgagcaatacttgacatccgatgatgcagctgaactcgcctattctggagcgcatgaattgcatgcactatcgatgcggacagctagagaaagcgatgatcctgtgagggctaagaattc

SEQ ID NO: 58057 - DNA, 420 bp, Zea mays
  unsure at all n locations
  Clone ID: LIB3069-018-Q1-K1-A4
gagctggagcaggaagccaaaactgctgcgaatccaaaactctgtgcgtgccttcccagaccatcgtcttccaggagctggagcaggaagccaagtgggtcgcggccgtgctgtcggggcgggcgacgctgccaagcgaggaggacatgatggcgtccgtgaggagccactaccagctaatggaggaggccgggaggccgaagcgccacacgcacgcactggcagctcagtgggtaagccaacgctgacaacgtgtgactgtgtgtgtgtgtgtgtgtgttaccggcccgacgctgcagcctgaaactgtgtgcgttcggaccaggcggagcacatgaactggctcgcggaccaggtcggcgagcctncagtggagccgtggaagtgcgagatgttcgataaggtacttgcgagcatctt

SEQ ID NO: 58058 - DNA, 292 bp, Zea mays
  Clone ID: LIB3069-018-Q1-K1-A5
atcgagaccggctgcccgaccccggtccggcgatccctctgcacccctttctttgcgctgccagccccaatctctcgcatccctgtcaaccatggcggcgtcagcaggcggaggcgcggtgcgcgcgctgtcccagaaggagcaggacatacagatgatgctcgcggccgacgtccacctcggcaccaagaactgcgatttccagatggagcggtatgtctttaagcgtcgcaccgacggcatctacatcatcaacctgggcaagacatgggataagctccagctcgcggcg

SEQ ID NO: 58059 - DNA, 405 bp, Zea mays
  Clone ID: LIB3069-017-Q1-K1-H1
cccacgcgttcgcccacgcgtccggagaaagatggcatctgggctgtgctagcatggctttgtattattgctttcaagaataaggacaaccttggaggagataagcttgtcactgatgaagatattgtccgtcagcattgggccacatatggtcgccattattacacacgctatgactatgagaatgtcgatgctggggctgctaaggagctgatggcaaacctagtaagcatgcagtcatcactttctgatgttaacaagttgatcaaggagatccggtctgatgtttctgaagtagttgcagctgacgagtttgagtacaaggatccagttgatggctctgtgtccaagcaccagggcatccgatacctcttcggagatggttcacgactggtgttccgtcta

SEQ ID NO: 58060 - DNA, 264 bp, Zea mays
  Clone ID: LIB3069-018-Q1-K1-A6
cccacgcgtccgaaaatatccccaaaccctagctcccgatctcgatggcgaaccctcgcgtcttcttcgacatgaccgtcggcggcgccccggcgggccggatcgtgatggagctgtacgccaacgaggtgcccaagaccgcggagaacttccgcgcgctgtgcacgggcgagaagggcgtgggcaagtcccggaagccgctccaatacaagggcttcaccttccaccgcgtcatacccgagttcatgttccatggctgcgact

SEQ ID NO: 58061 - DNA, 339 bp, Zea mays
  Clone ID: LIB3069-018-Q1-K1-A7
ctctcctctactagacttgttttttccgttcatcgtttcgtttgttccacctgcgcaactgcgacggggataagtacgtcttccagatgacgacggcggcatggccgcggccacgcttcctcgtcctcccccagcctggattcctccgctcggtctgccacggcctctgctcccgctgtctcttctgcttcctgctgctcctcgccttcgcctgcagctccagctccgggcgggtggtggtcactagcttgcctggcttcgacggcgacctcccctttcacctcgaaacagggtacgtggaagtggaggaagacgccggcgtggagctcttctactact

SEQ ID NO: 58062 - DNA, 429 bp, Zea mays
  unsure at all n locations
  Clone ID: LIB3069-017-Q1-K1-F5
ggcattcagcagctgccagcggacgtcctcgtgtcggtgatctcccgcgccgccgcgagggggagggatgcctgcatcgccgccacggtgtcgccggcgttccgcgccgcggccgactccgacaccgtgtggtcacgcttcctcccggctgacctcgccccgctcgtctacccgacgcctgcgccaagatccaagaaggagctcttccttcgcctctctgaaacccatgccctcgttgaagatggcctcatgagcgcgtggctggacacggagaccggcgccaagtcctatatgattgcggccagggctatggctattatctgggtcgacacgccggactactggcgcttgatagtgcgcgaagactcaaggatgctgtcaggtgacacgcgctatgcagnctacctggtattcaagatggccgatgac

SEQ ID NO: 58063 - DNA, 440 bp, Zea mays
  Clone ID: LIB3069-017-Q1-K1-F6
cccacgcgtccgcccacgcgttcgcccacgcgtccgcggacgcgtggggttcgggatagaggtgcatggcaatgtgattggagcagtggaaacttgtttagagtcgtttcatcggtatcacaagtatctaaatttttcgcatcctactatcagctccaagattgatccacatacttgtggatgggcttttggaatgaacatttttgacttgatagcttggaggaaggcaaacgccacatcattgtatcattattggcaagagcaaaattctgacctattgctctggagaacaggaactcttcctgcaagccttttgacattttatggcctgatggagcccctagaccgcagatggcatgtcttgggtctcgggtatgatgtagacatagatgatcgtctgattgagagtgcttgctgtgtgcactataatggaaacatga

SEQ ID NO: 58064 - DNA, 435 bp, Zea mays
  Clone ID: LIB3069-017-Q1-K1-F7
cccacgcgtccgcccacgcgtccgatctgctgcccgctgctcccccctctctgtgcaagctggcttgtagctggctgcatgctcctcgcgcgagccgtggtgatggagcacaggaagaagtcgaattatcttgttgccctcgtcttggcttcgctcttgctctccgccatggcaggagggcatcggaagaagcttctgaacaaagacgacgcatcagaatcaatggagctatcggaatccacgcagcagctgcaggaagacgacgaaatggctgtggtggtccacgagagaattctcaggcaggcgaagatgaacgactacgggagctacgactcttcgccgaccatggctaagcctcacttcaaggacatacctaactagccagcccactatatacattgagaggtcgatatatgttgcttgctagtcgagtcg

SEQ ID NO: 58065 - DNA, 355 bp, Zea mays
  Clone ID: LIB3069-017-Q1-K1-F8
gtcctgcgctccagcagctgccacagagacatcagagagcggtcctccttgtgagtctgagctgaagaggaggaggaggaggaggagaagcagcagcgcagccggaggagggagagcgaagatgcgccgcgtcgcgctgttgctcgtcgccgacgtgtgcgcgctggcggcgccggctgccgcggtcgtcactgacggtcttctcccgaacggcaacttcgaggatggcccgcccaagtcggcgctggtgaacggcacggcggtgtcgggcgcccacgccatcccgcggtgggagacgttcggcttcgtggagtacatcgagtcagggcacaagcatggggacatgctgctggtg

SEQ ID NO: 58066 - DNA, 450 bp, Zea mays
  Clone ID: LIB3069-017-Q1-K1-F9
gtcccttgatgcatgaaatttatgaagatttgactgcttgttgtcaaaaaaggcaacactgctgagttcttggataacactgaactttttttttggataaatatccttccctcagtgttgctataggcagtttctcaaaagcatcgcttagttttgcttgtaccttacgatagacaacgactattgtgcaatcaggtctaaggttcaaacgagtctcctggtctgttagatcatgatccaaccgtatatcatatttaacacttagacccttacatcaccaactcatgaagctttataaaaaacctaacaaaccacagtcatatctacccctaaggtctaattgcacctaaggatcaagagactcgcttgcacacttgcacctaaggtctaattgcacaacaatcggtgccccttactgcattacacaaatgacattttatttttacccct

SEQ ID NO: 58067 - DNA, 217 bp, Zea mays
  Clone ID: LIB3069-017-Q1-K1-G10
tccttccgcgagaactccgcctacatcgagaacgttttcaacaacgtctggaagttccacttcgtggggttctacaactgctggaacaagttcgtgggcgaccacacgacgcacgcgttcgtgttcaccgacaaggcaaaggactcgagccgtgtgtgtgtgtccttccgtgtcacggagcccttcaacatgctgtactggtccacggacttaaacc

SEQ ID NO: 58068 - DNA, 161 bp, Zea mays
  Clone ID: LIB3069-017-Q1-K1-G11
gttgtcttaacatgtatgtttctcgtctttcaaaataataataagatgtgagtctgatagaaaactaggatgtgaaaattttatatctataataatgtatgctattcgttttttgtgcagttattgtacattaccattttatcgaatttgtgtgtcattgc

SEQ ID NO: 58069 - DNA, 250 bp, Zea mays
  Clone ID: LIB3069-017-Q1-K1-G12
cgccggcatataccacgattttagtacggtttataaatgcttcattccagctacttcaagcggggacatttgctcatcatactgcagctgatgttatcattataatcgcggaatcagggcagatatccaatgacctgaaaccaaggttaaaacatgtcacatgcataaacagcatctgacgataccatttgcctagcttcttgagacggctatgccagacatgatgccctgctgaactatgacttgaccc

SEQ ID NO: 58070 - DNA, 432 bp, Zea mays
  Clone ID: LIB3069-017-Q1-K1-G2
cccacgcgtccgggacatcaagggcacagataatggcttaccgaggttaactgcctggggcggttgaggcatccaaatttggtgaagttgatcggatattgctgcgaagatgaccatcggctgcttgtctacgagttcatgtttcgaggaagtctagaaaaccacttattccgaaagacagctacgccattgccctggggtactaggatgtcaatcgcgctgggagccgctaaagggctcgcttgcctccacaacgctcaaaggcccgtcatctacagagatttcaagacatcaaacattctgctggactccgattatactgccaaactgtctgactttggcctcgcaaaagatggccctgaaggtgatcagacgcatgtgtcgacacgggtgatgggaacctacggttatgcttgccctgaatatgtgatg

SEQ ID NO: 58071 - DNA, 430 bp, Zea mays
  Clone ID: LIB3069-017-Q1-K1-G3
atttatctacagatacggaatcataagatctaccgttttattgatgatccagtgcttcagcggtctacagtaagtgatgatgagcatctggcaggttataagctcccaaagttggaaaagagggtgaattacattcagattgtgcatcgtcatgaagatctggaccatggaaacaataacagcttgacatcttggaaaccgtacggtgttcctcttcttgcacaaatttctcgcaatgaaattgtgacgggttttgatatccatgagttggtccataaaatgcttgtgaccgtgctaaggaatacggactctctgcatttggctgttcaaagatcttgttccacaagaactcatagttatcataccgacagcagcaaatttcagcttctggtggttgatgatagcaacacagtcatttgaaaatccaatg

SEQ ID NO: 58072 - DNA, 294 bp, Zea mays
  Clone ID: LIB3069-017-Q1-K1-G4
acaagatctagggggggttccctacggttggtgtcaggaagattgtaaaccgcggtaactggtcatgcggaactgctgccttgccccccgcgcctttctcttccatgtttgctgctacaatcttgttgttgggcattgcagtgcacggtgcacacttgtgtagcccgcctccgagaattctcctgcctctgcatctggtcagttcaaaaatgatttgcatgttggctatgttgtgtaagctctatttatggtggtctcgctgagacgggtatttggcttcgcagttatctagct

SEQ ID NO: 58073 - DNA, 418 bp, Zea mays
  Clone ID: LIB3069-017-Q1-K1-G5
cgctggaccgcacgttcggctgcgggttccattcccggcaccagtacctgttcgggaagatggacatgcagatggggctggtgcgccgcaacttcgccggcaacgtcaccggctactacctgtgcttgcaaggcggggcgcacgacgagatccacttcgaggtcctgggcaacgtgttcggcaagccctacacgctggacaacaacctggtcacccaggggcataggccaccggaggagcaagttcagcttttggttcaacccaacgtcgacttgcacaactacttcatcatctgaaccccagcacgtcatcttcatcgtggacgacatgctcatcaggtacttccgcaacctgtatagcaaggtggtgacgttccccaagagccagccgatgcggctctactccagcctgtggaacg

SEQ ID NO: 58074 - DNA, 442 bp, Zea mays
  Clone ID: LIB3069-017-Q1-K1-G6
gcagaaacgtgagaaggaggtgcatgctcttctggataaactccctccggagagcattatggtgaacccgaacacgatagccactgtacgagctccgaagaagaaagagaagaagaccaaggaggagattgaggaagagatggcagatgccgtggaggcggccaagaacactgagcgcaagaagaagaccaagggcaggagcaaaccgagcaagcgagccaagaagaaagaggaagacgttttcaaggccaagaggcccttcctggagcaatctgataaggtggatgggcgacctgacaagaagcagcggataggtgaactcccaaaggccttgcaaaggtttgccaagaaaccacaatcataatcgtcgtcgttaacacagggttgggatttcacattggtatttccaatatgtagaatttccgcgtgagcacagaagaat

SEQ ID NO: 58075 - DNA, 494 bp, Zea mays
  unsure at all n locations
  Clone ID: LIB3069-017-Q1-K1-G7
ntcgagcccaacgtcgtctcgcccacgacgtctcggtagcttggaagtagaaagctaacatgnncttgcaacaaatgctgtngnnctgcgtatgctcgagtgagactctataggagggggtttctctgcccatgtgatatgtagtcacggtgtgcacccgaactattggtgtccacttgctcgaagattttacctctccatgtaggaagtcacggagagctcgactgtttcggccatgtccggaaccttctacagctcagcaaanattggctcgttggaaaagggcacggctcaaaggccgtgatgaagtcttatgtcaaaacagttgtctgactacataattgcagcacttgttgaagcactgcacaaggagccagaaacagaaatgtgctcatccatgctggattctttaaacgagtgtatgcagctttcgggtcttttgctcgatgaagcccaagtacgagctatcatagatgagattaaaaacgtcatta

SEQ ID NO: 58076 - DNA, 237 bp, Zea mays
  Clone ID: LIB3069-017-Q1-K1-G8
gccaaaattaaaaacctgtgtctaacagttatgtagtctaggctccattaatcgaacggaggccgtaatttcttggaaaaaaaacaaaaaaaaaaaaaaaaaaaaaaaaacaaaaaaaaaaaaaaaaaaaaaaaaaaaaaaaaacaaaaataaaaaaaaccaaataaaaaaaaaaaaactgaaatatcaaaactaacagaacaaaaaataattagaaagaaaactaataaagaccaa

SEQ ID NO: 58077 - DNA, 401 bp, Zea mays
  unsure at all n locations
  Clone ID: LIB3069-017-Q1-K1-F4
cccacgcgtccgattttgataacacactactagagttcttggtgagtgatttcaagaaaacgcgagggcgttgatctgtcaaaggatagattggccctgcaaaggcttcgtgaagctgctgaaaaggcaaaggttgaactttcatcgacttctcagacagaaatcaatctgccattcataacagctgatgcttcaggggcaaaacatttgaacattacactgacaaggtcgaaatttgaatctcttgtacacaatctgattgaacggactagagatccatgcaagaactgcttgaaagatgccggaatatctactaaagaggtggatgaagtacttcttggtggtggaatgactaaggttccaaaggtgcangaggtagtctctgaaatcttcggaaagag

SEQ ID NO: 58078 - DNA, 442 bp, Zea mays
  Clone ID: LIB3069-017-Q1-K1-G9
gaattcgctctccgcgaggtcggcacggtacgccaccttaccgttgaggagttggcccgctcacccatcgttcaggagctgatgcgccgccaagctttcagtactcccaactccaactgcacctcaaattcccaaagcggcacctccacgccgatcgagagatcgagctcaggttccagcaacggtgtggggcgcgccaagcggcgtagcagctggctccgcagcatccgctgcgtagctggctccttcgcgtcccactcacgtgaccgccgcagcagcgacgagaaggacgcgtctccagagaaaggcgggcaccactccagctccacgacggatgacagccaggacagtgttccacgccatggcccggcccgtgtcaaggtgcggcagtatgggaagtcatataaggagctcagtggcctgtttatgacacaggagatac

SEQ ID NO: 58079 - DNA, 160 bp, Zea mays
  Clone ID: LIB3069-041-Q1-K1-B3
cccacgcgtccgcccacgcgtccgtgcagatccgtctttgggttgtgatccatttaacatggctgcctgcgttctggtgccagcatctgggggtgttggattactgtatcgttatttggttccggtttgttggccggatttttacaattgcttatctggt

SEQ ID NO: 58080 - DNA, 333 bp, Zea mays
  Clone ID: LIB3069-041-Q1-K1-B4
atttaattgcaatttcgtggtcgaacaagaatattttatgataaccaattaatgtattatgcgacaagtatccgatatccgatcaaataatatccgtatccgtcacttatccgcccggataaatatccggtccctgtatccgtatccgtcccgtttctaactatccgtatccgatcccgaatccgttttaaatacattagggtaggatacgagatgagctactatccgtcccgtatccgccgttttcacccctacgattaatgatgttggcgtaggagtagtttatttattaaacgtgcagtgcagctatgggcgctcgggcgcctttcgccg

SEQ ID NO: 58081 - DNA, 289 bp, Zea mays
  Clone ID: LIB3069-041-Q1-K1-B5
ggatgctgaaactgagcgaaacggtccattaaagcaagtgcccatgtggaccaagaagttgacatgccgtcgttaaaagaccgtctggcatcttttaatatcagcgactcctctccggatcattctgccatggaaactgaagtaacagaattaacagaacagcataatgaaaacaaagcgacagagggagcaagcaaaagaagcggacgaaagaaggcgtcatcatccttggcgacgatactatctgatgttgatgatgaagtcctagaggtccaagctcagaagaaag

SEQ ID NO: 58082 - DNA, 259 bp, Zea mays
  Clone ID: LIB3069-041-Q1-K1-B6
gaattaggaggcgatggggcactccaacgtttggaactcgcaccccaagaactacgggcccggatcccgcgtctgccgtgtctgtgcgaaccctcatggactgatcaggaagtacgggctgatgtgctgcaagcagtgctttcgcagcaatgccaaagacattggcttcatcaagtaccgctgaaatcaggtgggaatggaccatgttgtagaagcgaagttgtagttttatttccagtaatttaagatgtttggtcaa

SEQ ID NO: 58083 - DNA, 289 bp, Zea mays
  Clone ID: LIB3069-041-Q1-K1-B7
tgaattatcacgcgatcgtccaatccaacattttgaactgctacccctataaaggctcccttctatccttcgcctgccttctatgttctaactcttatatactgatccctaaattcaatctactgtccttcaatctacaatttcgtaactatgccaaccacattgtcttcaaacaaaaccgctttaatcaacattcaattgaccacatcttacatactaacctatagtcccatttccaacgatctatataacattttcacaaacttaattgctaatactactcccccta

SEQ ID NO: 58084 - DNA, 436 bp, Zea mays
  unsure at all n locations
  Clone ID: LIB3069-041-Q1-K1-C10
cccacgcgtccgcgatgctatcaaacattctttccttgcaaaatttaatgagataaagccggttgcatattcagagtttttggaagatctttgcaagcagattttgaatgacaaacctgatgaccgtcagaaggacctaacattcatcccacttgccccagcttgtgttgtaattcgtgtattgaccccagtatatgctaccctccttcctgctggcccttttatctggagaatattctggattttactttggtcagttctgacctattttatgctcgccatattcaagataatcgtgggattgatactgcgctgccttgcaaattggtatgtaaatctacggctcacaagaaaacaacacgtggattgagtacatggcaccacaattctgctgctatcgntacatctgtgagtagaaaatttgctgtggtgcatg

SEQ ID NO: 58085 - DNA, 385 bp, Zea mays
  Clone ID: LIB3069-041-Q1-K1-C11
ctaacacttacattgtcatcagtcatcgcggcctcagctatctgaatcacttgtcccgctcggtacgtagtagtagtagcatgggctgctgtggcgccgccatgtccgccaggccgcggggcatccacgaggagacgctgctgcgcgtcccgggcgcgtccgtgcacctcctggccggctcatccgacggcccggtcgagctcgcgcgcggggacctcgccgtcgtcaggctgaccaaggacgacgtggccgtggccaccgcggtgcgcgtcggcagggacctgggctggccgctggcgcgggacgagcccgtcgtcaggctcgacccactgcactacctcttcacgctgccggcggcggacaaggacgggacgttcctcaacta

SEQ ID NO: 58086 - DNA, 325 bp, Zea mays
  Clone ID: LIB3069-041-Q1-K1-C12
acacagggcacacgcactacacgcacggcacgcagatacatatagagagaggttagctatggcttgcacatctatttaactaactaactaactggctagctagctcgatccgcagagcaaagcgaaagcagcaagaagcaaagcaatggagaaccctgcgagtgtgctagttctaccagctcatttcaccaaactcaccttctgaaacctgtacatccgccgggccgggccgtgcagcagggagataaccgaggagggcaggtgcgacctggacaggagatacttgagtaacttctcccgctacgacagccgctgccccgactcc

SEQ ID NO: 58087 - DNA, 206 bp, Zea mays
  Clone ID: LIB3069-041-Q1-K1-C2
cccacgcgtacggtgggccactggccatggcatgtactggtccttaacattggaaatcacctctgatcgcggctcatgtcagctctgaccaatctctgaagggcttgatctctgcggcattgtttcaccacattaactgcattgcttgaaagatgcctgtcatccaaaagaaactgcatatctgacactcattgatcgacttgcct

SEQ ID NO: 58088 - DNA, 348 bp, Zea mays
  Clone ID: LIB3069-041-Q1-K1-C3
cccacgcgtccggtcaccgccttccagctcgagcccgagggggaccacaaggccgaggacgccgccggcgccgtcgtcaactgatctgctctagcttccggcggcggcggccgtgcgtgggctgctcgatccggtagtggcagtggctttgtgagacagtcgagtcgattgtggtttcccctcctccgccatgtgcgtgtagtggatgatgatgcaggaataaacggtgtccctggatccagaactcacggttcgatccatccagtttatctcatgcttgtgtatctctatgtatgcattgcctgtttgatcgctggaatctactacttgcagcggcctcgtctgttc

SEQ ID NO: 58089 - DNA, 454 bp, Zea mays
  unsure at all n locations
  Clone ID: LIB3069-041-Q1-K1-C4
cggacgcgtgggcgggctcgcctcggccgctctggcgcttgtgcggtgggtgaagcgcgggtgctggtgcgggaagcctcgccagacctagcgctgccgactgccgagctgggtgtgggcgcgaggagtcgacgggaagacaagggtgaggatcagaaggatacggtgccactgcttatgtgacattcaaggaacgctttgccttggaaactgcagtattgctcagtggggctactattgtggatcagccagtatgcataacctattgnggacaacctgagggaacttttaatttctgggacaggccaacttgngaggttgaagaggaaatcgaatacaggaactaccaaacatgccagtacaacactactncgcagggaagctttacagtggctcaagatatcatgaggacgatgctagaaaaggggtacgtgctcagcaaggatgctttggc

SEQ ID NO: 58090 - DNA, 407 bp, Zea mays
  Clone ID: LIB3069-041-Q1-K1-C6
gtaggacctttccatgttaacgcatatgggaagggggtccatgtcaatccttattcttggagcaaagttgcaaatttactgttccttgattcacctgttggtgttgggtactcatattcaaacacctctgatgatgctttaaaaaatggggatgcaagaactgccacagattcattggcattcttactgaagtggcttgaacgctttcctcaatacaaggaacgcgaattttatttgacaggggagagttatgctggtcactatgctcctcaactggctcaagccattaaaaggcaccatgaggctactggtgacaaatcaattaatctaaagggctatatggtaagaaatgctctcactgatgatttccatgaccactatggaatatttcaattcatgtggactac

SEQ ID NO: 58091 - DNA, 288 bp, Zea mays
  Clone ID: LIB3069-041-Q1-K1-C7
caagagctggtactcatggatactttcttctatgacaagctgtgtgtacatgtgtgaattgattatgatgtgccggcaattgtgcttatcatacttaagtgaatagatagagaaaccgaccacacggaggaaaagtacatacctaaggcacttaattgcaatggcatcgtactatttactattattctgtgacaagctgcacgaacatgtttgttctcattacgatgagccccctatagtttatgaactacaacttgtacacagatgatgatatgccctacatacata

SEQ ID NO: 58092 - DNA, 348 bp, Zea mays
  Clone ID: LIB3069-041-Q1-K1-C8
gtccctccttcccgtctatgtgtttactgcaccaccgtggagcgaacattcatggcatctggctccattccttcctttgcttataagtgaccattatttatcctctactagtctctttcatgctacatcgaatctaaattccacttcacatttgcacattcatgctctacttctattacaacccgtatgatccatccattacactactatgttctttactgcatctactaatcttcatccgacttgacgcctaaacaaaatcggaccacctgagtgaacttttaaaattatttaccagacaacttgcaaagctaaacaagcactattctacacgaactaccaaacatt

SEQ ID NO: 58093 - DNA, 322 bp, Zea mays
  Clone ID: LIB3069-041-Q1-K1-C9
tcggcggccgtacctgagctggacctgaccattcatcgccagcaactactaccagggctgctgggtgaagcgcttcaacacgctgtcagcacaacacaactcgctgctgcaggccaaggtgtcgagcctgcagaacaagtaccccggtgcgcgagtcatgtacgccgacttctacagccacgtgtacgacatggtgaacagccccagcagctaccggttcagcaccaacctcatggcctgctacggcgcctgcggaggcaagtacaactaccagaactgcgcgcggtgcagcatgcccagcgcgtactcgtgctccgaccct

SEQ ID NO: 58094 - DNA, 478 bp, Zea mays
  Clone ID: LIB3069-041-Q1-K1-B2
ccggactggaacgaccggatcgacccccgcgtccgcgcagagaccgggagccagatctttttgcttaagccgaggctgaagaaattgagttcgacggccaggagaatactggcatcaattttgatgcctatgaagacatccctgttgagaccagtggccatgatgtgcctgcaccagtcaacacatttgcagagattgatttgggtgatgcattgaatgacaatatccggaggtgcaagtatgtgaaaccaacaccagtgcagcgttacgccatcccaatctccattgctgggcgggatctcatggcctgcgcacagactggatccggaaaaaccgccgcattctgttttccaatcatcagtgggatcttgaagtcaccaaagccacaccagaggtcacggagtacaaggaccgcttgccctctagctctgatcttatcacccactcgtgagctttcagtccaaatccatgaagaagc

SEQ ID NO: 58095 - DNA, 71 bp, Zea mays
  Clone ID: LIB3069-041-Q1-K1-D10
attcccggtcgacccaccgtcgcccacgcgtcggagatcccctctccaatttctataaatcatatacctgg

SEQ ID NO: 58096 - DNA, 313 bp, Zea mays
  Clone ID: LIB3069-040-Q1-K1-H7
cccacgcgtccgcccacgcgtccgcacttcttcaatccactagctaagcgcgccatggcaaagttcgctcttggtcaccaccgcgaggcctccgacgccggctgcgtccgtgccgtcctcgccgagctcatcctcaccttcctcttcgtcttcgccggcgttggctccgccatggcaacagggaagctggccggcggcggcggggacacggtagtgggcctgacggcggtggcgctggcgcacacgctggtggtggccgtcatggtgtcagcggggctgcacgtcttcggcggccacatcaacccggccgtga

SEQ ID NO: 58097 - DNA, 419 bp, Zea mays
  unsure at all n locations
  Clone ID: LIB3069-040-Q1-K1-H9
gagagaataagcttgattgaaagcagccctacaaaagtatttgagcttgattctgccaatgaggtggtggtgaaaaacgcggaggcatacacctacgacgacgaggtgatcaagcacgccgaggccatcgggaagccaggcttggtggagatcaccgccaaggaggacagcttcgtcttcaccgtagaaacaaccggcgccatcacagcctacgagctgatcatgaacgcgatcacggtcctgaggcagaaactggatgccgtcccgcttcaagaagacgacggcgaccttggcgagctcggcgcccaccttggtgggccttaggagctttgagcaagaaggaatcgccctgtggccttnctccctcccactgcctacgtaggcctatctaactgccgtgcgtgctagtcgatcgatcg

SEQ ID NO: 58098 - DNA, 387 bp, Zea mays
  Clone ID: LIB3069-041-Q1-K1-A1
gcccaagccgaccccgccgacgtacaccctttcccccaagcctccgacacctaagccgacggcgcctacgtacactccaagccctaagccaccggctaccaagcctcccacgcccaagccgaccccgccaacgtacaccccttcgccaaagcctccgacacccaagccgaccccgccgacgtacaccccttctcccaagccttcgacgcccaagccgaccccgtcgacgtacactccaagccccaagcctaccacacacccgacgcccaagccgaccccatcgacgtacaccccttccccaaagcctacgacgcccaagccgaccccaccgacgtacacacctttcccaaagcctgcgacacccaagccgaccccaacgacgtacac

SEQ ID NO: 58099 - DNA, 433 bp, Zea mays
  unsure at all n locations
  Clone ID: LIB3069-041-Q1-K1-A11
gttcagtagtgtgctctgacagtgagatggcgagcgtgaaggttttcgggtcacccacctcggcggaggtcgcccgcgtgctcatgtgcctcttcgagaaggaggtggagttccagctgatccgcgtcgacgcctaccgcggcaccaagcgcatgccccagtacctcaagctgcagccgcaaggcgaggcgctcaccttcgaggacgagagcctcaccctctccgactccagggggatcctccgccacatctnccacaagtacgcgaagcanggcaacccgtacctgattggcacgggcgcgctggagcgggcgtncatcgagcagtggctgcagaccgaggcgcanagcttcgacgcgcccagcgccgagatggtctacagcctcgccttcctgccgnccaccctgcccaggcagaacgacaacggcaacgg

SEQ ID NO: 58100 - DNA, 426 bp, Zea mays
  Clone ID: LIB3069-041-Q1-K1-A12
gttcagtagtgtgctatgacaatgagatgtttagcgtgaaagtgctcgcgtcaggcacttgggcggatgtcacccgcgtgctcatgtgcctctacgagaaggaggcgcactaacatcatgatccgcggcgacgcctacctcggcaccaaacgcatgccccagtacctcaagctgcagatcgaaggcgaggcgctcacctactatgacgagatcctcaccatatccgactccacggggattctgcgccacatgtcccacacgtacgcgaatcagggcaacctgtacctgattggcacgggcgcgctggaccgggcgtacatcgagcagtagctgcagactgaggcgcacagcttctacgcacccaacgccgacatggtctacagactcgacttcctgcctgctaccctgcccatgcagaacgacaac

SEQ ID NO: 58101 - DNA, 171 bp, Zea mays
  Clone ID: LIB3069-041-Q1-K1-A2
ccaacactgacatcaccggtgggggctggggaggagagggagagccttctttaagatcagtagatcaccacaccctcacccctgctcattgcccccctctcacacacgcacacacactctctctctcccattgtgtcactgtaactagcaatggagctctaaaaatttggg

SEQ ID NO: 58102 - DNA, 323 bp, Zea mays
  Clone ID: LIB3069-041-Q1-K1-A3
atttctcgccccctactgattaaattttcttcgcacgaggaaaaaaaaatcaagtggcaagggcttgatctggtgggcgacccatggtgaaagggatggtagtggccgtgccgaatggggtgaaggcggatggcgccgccgtcaccgacgccgccgccgtcgtcgctaaggcagagtctcctaaatccgttctggatgacgagaaaatctctgaatccaagaatgggaacgcctgcttagccacggagccaattaagcaagaggacgagacctcagacgtatttgtggatgcaatgatgtccctttctgatgaccatgaaatc

SEQ ID NO: 58103 - DNA, 381 bp, Zea mays
  Clone ID: LIB3069-041-Q1-K1-A4
cccacgcgtccgctcatcgcatcgcacgcatcgcacagacactccactgcacgcgcagcagtggcgacgaccacctcgccgccgctgcagctcgccaccgcctcccgcccgcacgcctccgcctccggcggtggcggggttctcctcgcgggcggttccggaggtggggtcgcgccgggtcggggtcggggtcgagggcgattgcagcggcgggtgtcggcgcgcagcgtggcgagcgatcgggacgtgcaaggccccgtctcgcccgcggaagggcttccaaatgtgctaaactccatcggctcatctgccattgcatcaaacatcaagcaccatgcagagttcgctcccttggtctctccagatcacttttctcccctg

SEQ ID NO: 58104 - DNA, 254 bp, Zea mays
  unsure at all n locations
  Clone ID: LIB3069-041-Q1-K1-A5
accacgcgtccgagcggccacccgttcctcttcctcgtacgactacaacgaccgccatccgtcgccatggctggcctcaccaccacgctgctgctcctgctgctgcgctccgccgcgctcgcgtccggcgccacggcgggcgacgacagcggattcacgaccttcaaggtgttcttccacgacatcgtggcggggacgagcccgacggccatccgcatcgcgcagggggcggcgtncagcaccttgtacaccag

SEQ ID NO: 58105 - DNA, 289 bp, Zea mays
  Clone ID: LIB3069-041-Q1-K1-A6
ctcctgtccctctccgcatccaagggttgtagccatccgcattcaccggaccccaccggggatggccgtttgagtgagttcccgtaccaaggttcttcggtcttggaagcctaagggacaccgggtcggaatgaggggccgccattgcgagcgacgtgcccattgacccggagctcgagcagatcgactgcgagatccacgatatctttcgggcccttcaaaatggatttcaaaagattgattagatttaagattcaaataggcaagcttagcaattggaagatcttac

SEQ ID NO: 58106 - DNA, 415 bp, Zea mays
  unsure at all n locations
  Clone ID: LIB3069-041-Q1-K1-A7
tcgcccacgcgtccgcccacgcgttcgcccacgcgttcgcccacgcgtccgagatgaggtaggtgcagaacacggtccattcatggatttgaaagcgagattcatggactttaaacagagaaactatgtggggaatttttcaaattacccaaatcttgcttagcaacaaacgccaaaagttatggtgattgcttgggctgactccagaatctgccctaccgctgtttgggggttcagcctgccgaagcatttacgggtcgtaatgtggcgaatttggtaccaccatatgagcatgagggatcagagactagtgcagcactagagtttgctatcaatacactcgaggtagagaatgtgcttgtggtaggccacagtangtgtgggggcatcaggcactaatgagcatgaaagatga

SEQ ID NO: 58107 - DNA, 114 bp, Zea mays
  Clone ID: LIB3069-041-Q1-K1-A8
cgcagagaccgggagccagatccgtttgcgaaagccgaggctgaagaaattggtttcgacgggcaggagaatactggcattaattttgatggctattaagacattcctgtttag

SEQ ID NO: 58108 - DNA, 437 bp, Zea mays
  unsure at all n locations
  Clone ID: LIB3069-041-Q1-K1-A9
cggacgcgtgggcccaattggaagggcagctaataaggtaaggggcgacgaaaatggctgcaacgaccgccaccaaggacgacagtggctacggcgacgagcgccggcgcgagctgcaggcgttcgacgacacgaagctgggggtgaaaggcctggtggactccggcgtcaagtccatcccgtccatcttccaccacccgccggaagccctgagcgacataatttctccggcgccgcctctgccgccgtcgtcgccctccggcgccgccatcccggtggtggacctctcggtgacgcggcgcgaggacctagtcgagcaggtgaggcacgcggccgggacggtgggcttcttctggctggtgaaccacggcgtggcggaggagctgatgggcggcatgctccgcggngtgcgccagttcaacgagggccccgtggag

SEQ ID NO: 58109 - DNA, 439 bp, Zea mays
  Clone ID: LIB3069-041-Q1-K1-B1
actttctaaggcaaatgattctgcgtctgaagatggagattatgtggctgctgaaaatcaaaagaaacaatccaagaaagcaagtgcccatgtggacgaagaagttgacatgccgtcgttaaaagaccgtctggcagcttttaatatcagcgactcctctccggatcattctgccatggaaactgaagtaacagaattaacagaacagcagaatgaaaacaaagcgacagagggagcaagcaaaagaggcggacgaaagaaggcgtcatcatccttggcgacgatactatctgatgttgatgaggaagtcctagaggtccaagctcagaagaaaggtagaggaaggaagcctgctgccgctgtgaagccgaaggctgctgccgccaggaaaagggcgccggctcaagcaaggcaacgcagaagaaaatagatgagatgc

SEQ ID NO: 58110 - DNA, 230 bp, Zea mays
  Clone ID: LIB3069-041-Q1-K1-B10
ccacccgtccacacaacggaaaagatcctcaaaccctagctttcgactttaggcgaaccctcgcgtattgttctacagtgaccgttgctgcgccccggcagacccaatcgcgatggagctgtacgccaacgtggttcccaagaccgttgagaacttccacgcgctgtgcacgctctagaatggcgttggcaagttctggaagccgctccactacaagggctccacctttc

SEQ ID NO: 58111 - DNA, 447 bp, Zea mays
  Clone ID: LIB3069-041-Q1-K1-B11
gcaccctcggccgaacagttccccgagtccccgactgctctctgtctctctattggcgacgactgggctaccgccgccacaggcgccctacgccaggtgtccaggtctcgggcccttctccggcaccgagcacccaccagcggaatataccatggaggtcaggcccatggtagctctgcgtgccgccctagttggtggggtagcggcatttgcgaagatcggtggggcgatgaaagccgcaagcggtgtcaagattggtgcagccgctgcagccgtcacggctgcaacatcagctgccatatcgggaaaagacgcaaaagaagacacttcaaagccggaaacgaaatgatatgacccatggattggtcgacaagtatgaaatcgcctctccagaggtttagaagagagagggtgccatagtcaataagttacaggagtaaattttga

SEQ ID NO: 58112 - DNA, 378 bp, Zea mays
  Clone ID: LIB3069-040-Q1-K1-H6
cccacgcgtccggccagtccttgtcgccggccccaaactgcgtgtggcaaaggcaggaaaggcatttgtcgatatggtagatgccagtggctatgcctatgccgtgatgccatcggccaagggtcttgtgccagagacgcacccccacttcatcggcacctactggggcgcagtcagcaccgccttctgtgctgagattgttgagtccgcagatgcctacctctttgcaggccccattttcaatgactacagctctgttggctactcattcctcctcaagaaggaaaaggccatcatcgtccagcctgagcgtgtgatagtggggaatgggccggcattcggatgtgtgatgatgaaagagttcttgtctgaattggc

SEQ ID NO: 58113 - DNA, 398 bp, Zea mays
  Clone ID: LIB3069-041-Q1-K1-B12
cccacgcgtccgagatgccagatgtgcctccggtctgatcctttgctgaaggtgatggagcgactggctaatccgggggtgcggcgggtgttcatagtagaagctgggagcaaacgtgtggagggtattatatcactgagtgatattttcaagttcttgctgagcttgtgataagagaagaggagcatgacggacatttgtttgtgatcaatagtaagaaaacagcagggtatgtgaagcaagctgccatggatctcgcatttcccctgcccctccggcctttggtcaagtaaggcaagattgaaggtggcgggctttgtctttgctgataatggctgttggaattcatgggctgtaaaagtctttttttaccctttggttttcggtttaaccatttt

SEQ ID NO: 58114 - DNA, 359 bp, Zea mays
  Clone ID: LIB3069-040-Q1-K1-G12
tctagatcggagcgccgccctttttttttttttttgtgcagtggtaacaaacacaaacgcagtgcagggtggtaaacaagtgcagtggtaacaaacacaaacgcgccatactctacttgcgttttggacaccgtaggggtagggctacattatttccaagagatcgatcatagacagagcacgacatgttggggcggcggccgacagcccggcactaaggacgacgacatcgacgacgacggaagccttgggcatgttcatgtccagcatgatgcagcatgccccagatccagaagaaggggttgatcagatgttgtccttggcgacttcggggagatgcaccgggtagcggtcgatgc

SEQ ID NO: 58115 - DNA, 287 bp, Zea mays
  Clone ID: LIB3069-040-Q1-K1-G2
cgcaagggaccattcttttatgggggagattttaacaccggtcaccatgtggagaaaagggacgggggacaaaaagggtgggaggctaattggaacaagtatcacattgagctggaccctcaacttgaagctcttgttggaaggcatagtagaaaaccctggtcaaagttcatgaatgctgataaccaacatctagtatcacctgaggccatagattttctcgataagctcctgcgctatgatcaccaagataggctcactgcacgtgaagctatggcacattccta

SEQ ID NO: 58116 - DNA, 425 bp, Zea mays
  Clone ID: LIB3069-040-Q1-K1-G3
cggacgcgtgggctccggcttccgcgcgaggtcgagctagcgttgggagttctcgagacctgctgtgatggcgacagagcaagcggcggagaactacacggtggaggacctcgtggccctgaacccctacaaccccgacatcctcaacgacctcgagaagttcgtcaatgagcaggtctcatctcagacatataacttggatgcaaatctcagccttcttcgcttgtaccaagttgagccagaaaggatgagcatacagattgtggcccacatactgattaaggctctcatggcaatgccagcccctgacttcagtttgtgcttattcttaatccctgaacatgtgcaaatggaggagcaattcaaggtattgatagttctttctcactacctagagactgctaagttcagtcaattttgggatg

SEQ ID NO: 58117 - DNA, 387 bp, Zea mays
  unsure at all n locations
  Clone ID: LIB3069-040-Q1-K1-G4
cgcaaggaaccattcttttatggccatgacaaccatgaccaacttgtgaagattgcaaaggtccttggaacagatgggttgaatgcttatttgaacaagtatcacattgagctggaccctcaacttgaagctcttgttggaaggcatagtagaaaaccctggtcaaagttcatgaatgctgataaccaacatctagtatcacctgaggccatagattttctcgataagctcctgcgctatgatcaccaagataggctcactgcacgtgaagctatggcacatncctacttnctncaagtcagagctgtggagaacagtagaacgagacccacataatcgntgtctacaccctcgaaatgaaaagtgtgctaatttctggaacatcat

SEQ ID NO: 58118 - DNA, 190 bp, Zea mays
  Clone ID: LIB3069-040-Q1-K1-G5
cgattgggtcggaaatcgagggtttggtaagcgagatcgccgccggtgacagctgacagggacgagatggacgccgccgaaggcggctttttggtcgccgttttttgaatgctgttggccttggccattttccccttcttcttttggggccgccgttccaatgccgcacaccgccgttaacacaccgttc

SEQ ID NO: 58119 - DNA, 288 bp, Zea mays
  Clone ID: LIB3069-040-Q1-K1-G6
ggagacgaaagagaaatatgcaggcggtggcacgggcggcgcgtgggctcgcggctgcggctgcagctgcgcggccgtcggcgacggaggcagggcaccggcggccaggtgcacaaggctcgggcaatgtggggcaagtgaaggacgggaatctggagcgggcgctgtcgatcatggagcgcaagatgcggtccagcggcatggagcgcctcatacgggcgcgcacccattaccacgtcaaggactctgagaagcgcgtgctcgcgcgtaaagggcttatgcaacgcg

SEQ ID NO: 58120 - DNA, 418 bp, Zea mays
  Clone ID: LIB3069-040-Q1-K1-G7
gaagactgaagagaagggaagacatggccgtgacggcggaagcggcggcagagatggtgttggagcggcgggcgtacgcgcgggtggggctcctcggcaaccccagcgacgtgtacggcggcagggccctgtccttcgccatcgccgacttttccgtcaccgttcaccttcgcccttcgcccgagctgctcatccagccgcatccgcaccacgacctcgtcgcctttccctctctccctcaactcgtgagccgtttgcaaagtgaaggatattatggaggcgtccggctgctgatggctatctgtaaagttttctacaactattgtgttcaaaataacatcagtttaaaagctgaaaatttcaccttatcatacgatactaatattcctcggcagtctgggctgtctggttcgagcgc

SEQ ID NO: 58121 - DNA, 357 bp, Zea mays
  Clone ID: LIB3069-040-Q1-K1-G8
gtcgcccagctgaggagagtgggcaaggggcacggggtgtggcacttcgatcagatgctgcttgaggaagaggcctaaaaagaagaacggacagatgaatgaaggaaacaagtgtgtaatgttgatcaggcggaggaataatgggtcaactgacaactctgggtcggtggatttgtagttggtttgggttttttagttgtagaacggtgttgcccccctcctagagagggatgaacacattatgcatgcgatgtgtcagttcggtcggtgctatgctcgttgggatttgattgtcggaaattaaacatgggtgatgaatgtgtaccctccctaaaaaataaagtcctaaaatgaaaa

SEQ ID NO: 58122 - DNA, 383 bp, Zea mays
  unsure at all n locations
  Clone ID: LIB3069-040-Q1-K1-G9
ggacaggtcgcctgggatgagccggacctgttacagaacgtgaagagggaagaagctgtgcgtcccactgtacccggagcttccgctggagggccagttcccggcgccgatgttccacggaagccccctcctcggccgtggcggcgccggtggcccgatgtgctacttcccggacggcactcctgcaggcatacagggagccaggcatgctcaattcggcatatccttatcagatctccacctgaacaagctgcagccgggcctgtcaccgcacgggctccaccgncagctcgaccacggcgtgcaggtgcaggtgcagcagccgaggatcgccgncgggctcatcgtcggcggccacccggcggcccgagacgacgtctcgt

SEQ ID NO: 58123 - DNA, 383 bp, Zea mays
  Clone ID: LIB3069-040-Q1-K1-H1
gttgacgaagcctcagcaggagatggttcgatgctgaagaatctcatttctcaagatgactctggtgcgtcttcttcaaaagcttctcggtccttctccctactgtcaccgttccgcagcaagcacaaggtgattgttctgtgagcacaaggtaatcaatttgggaggagaggaatataatggcgcagcacagtacatacttttggtttttcccttctagtatatatttacacacacgtatacataaatacatacatactatatgatggacttgtcattagacagcctatgtgaaagctgtgtgtggcgatggattggttgttgcccttgtggttttgtaccctaactatttgtgttgatatatatggtgatactttttgttc

SEQ ID NO: 58124 - DNA, 427 bp, Zea mays
  unsure at all n locations
  Clone ID: LIB3069-040-Q1-K1-H10
gttgtgatgtgaacgtttctgttcgaccagttggacaatcagaatttggtacaaaggtggaaataaagaatatgaactcattttctgcgataaatagggcaatcgattatgagatctcccggcagattctgctccataaagaaggccaggctgatcaaattgtacaagaaacccgcctgtgggatgaatcttctcagaaaacttttacaatgcgaaaaaaggagggacttgccgactatagatattttccagaacctgatcttcctgaagtagttatcactagtgactatattaatgaaatcagcaagtcaatgccggagcttccagaagcaaagcgtaggcgttatgagaatatgggactcagcatgcaagatgttctgntccttgctaatgatgataatattggtcatttctttgattctactct

SEQ ID NO: 58125 - DNA, 399 bp, Zea mays
  Clone ID: LIB3069-040-Q1-K1-H11
gacaaaggtgggggttatggggatgaactcattttctgagataaatacggcaactcgattatgaaatctccccgcagattctgctacataaagaaagccaggctgatcaaattgtacaagaaacccgactgtgggatgaatcttctcagaaaacttttacaatgcgaaaaaatgatggacttgccgactatagatattttccagaacctgatcttcctgaagtagttatcactagtgactatattaatgaaatcagcaagtcaatgccggagcttccagaagcaaagcgtatgcgttatgagaatatgggacttagcatgcaagatgttctgttccttgctaatgatgataatattggtcatttctttgattctactcttgagcatggtgctgatgcaa

SEQ ID NO: 58126 - DNA, 293 bp, Zea mays
  Clone ID: LIB3069-040-Q1-K1-H2
gcgagaggaggatggcagccgaacaggatcatggtagtggtggttaagcatcagcatcggcgacgaggacgacgctgagaggcttctccgttcttgacggtactgtcaccgatgcggagccatcacaatgggacctctgtctccgctcaggggtatcccttcgccagcattctacaattctgctgcgtcactgctgatgctgtccaagtcgctcttcctgtactgctgaacacagacctatacttgatcggatacatgctctctgagggatttttcattagacaggccctgtg

SEQ ID NO: 58127 - DNA, 426 bp, Zea mays
  Clone ID: LIB3069-040-Q1-K1-H3
cggacgcgtgggataaaaatcgccgtggaggcgagtcgccgccggcaccgtccggcacgggcttcttctccggcgaaggcggagctcgttacggggattccgcatccgttaatcggtcccaccggatccctcgccgcctcccacgggccgggccgcgccgtggcgcgcgcgcaggccgagatgcggaagaggatggagagcgtcgacgatctgatcgaggaggcaaagctgcgcaccgtctggtgggcgctctgcatcttcgccgtcttctacttcctcacgcatacaagtaaatcaatgtggacaaatgtgcccatgtcaatccttatacttgcatttctgcgatatctctccttcaaaggggagttcccgtggagggaacaccctgtacgtaagcagacacatttgtcttaagccttaaagaga

SEQ ID NO: 58128 - DNA, 401 bp, Zea mays
  Clone ID: LIB3069-040-Q1-K1-H4
atttgatccgccgcgcgcggcccgatcgacgagcgagcctcattcacactccgatctagctagctagctagtttaggaaagagaaatctgaccacagggatgcggtggcggctgcagccggcgccggcgccggcgctgctcctcgtcctggccaccatcgccgccgtcgtggtggtgcgagcggagccccaggtgccgtgctacttcgtgttcggggactccctcgtggacaacggcaacaacaacgacatcgcgtcgctggcgcgggccaactacccgccctacggcatcgacttcgccgccggccccaccggccgtttcagcaatggcctcaccaccgtcgacgctatatctcggcttctgggcttcgacgattacatccccgcgtatgctggcgcgag

SEQ ID NO: 58129 - DNA, 402 bp, Zea mays
  Clone ID: LIB3069-040-Q1-K1-H5
ccggcccaaccctctcgttcgccaaggcttaacatgacatggccccttgctttaaaatctcatttctcaaaatgactctggggcctctttttcaaaaacttttccctccttcttcctactgtcaccgttccgcaacaagcacaaagtgattgttctgtgagcacaaggtaattaatttgggaagagaagaatattatggcgcaacacaattcatacttttgggttttcccttttagaatatatttacacacacttttccttaattccttccttcctattttagatgaccttgcctttaaccacccattttaaagcttttttttgcccaatgattggtggttggccctttgggtttggaccctaactatttggggtgatatatattgggaaactttttggtcc

SEQ ID NO: 58130 - DNA, 431 bp, Zea mays
  Clone ID: LIB3069-040-Q1-K1-G11
tgtcaggccacgcgactgcttttattgcaattgaggactgtggcataaaatctagagctcagagattgttgagtagcattaccaattcacttgagacggtactgaaatgcaacgtggaagtcaagattggtccactagcagaattgatggacggagaagtaacattagaggctggtgctaatgttaggaagatacgagtctgacgtcttgagttgctcatcaaacagtgaccgactaaagggagctttagattcaaggagaagctctggtcatactgatgaagtaaagaaagaactggagacgtacaaagaagttcccatccagactacaaaagaaccaacaattgacgaccagcgactggaaagtgcatggcttcaggttactgagaagcacacaccttgtctggtggatcaggcactacacgatcaaca

SEQ ID NO: 58131 - DNA, 353 bp, Zea mays
  Clone ID: LIB3069-017-Q1-K1-D9
cgaccgactcccgcgcgctgcacgcgacttccggacgcggcgtctgctcctcggcggcgaccgccggtgctgcactcacggtgctgctcgccggctacctcctcctgctcgtgccatagctgtcgcctagctcgttctagaccctctgtcaagttgtgccaccagtaagattcgatgtgttgttgctctttctagtacgtgacgcgacagacaatttgctgctggtgtcctccttgaagtccatgcactgggtgatcactgtatgctatgggtactagatgctagggcatgtgttaagctaagctaaggctatggggtatcagtaccctacctgtcaaaagacggcactcaag

SEQ ID NO: 58132 - DNA, 385 bp, Zea mays
  Clone ID: LIB3069-017-Q1-K1-E1
cccacgcgttcggactggcgagccaaaggtattgatattatatacgacaagacctataatggcgattatgagctagataacggggaggaaaacatgagatttactgaagaaacacgtcaataatatgtagacctagcttctgcagatatactgaccacagcaattaggtcgtaaatgaacgtatcgattgaaggctcgacagagttagtcgcaccggatctaacatcactgtaatatgataaagaccttgaactgctgatcagtgatctgactgtaattgacttggatgatctgaaggtcaacacagtgtatatagcatattcagatgaatcttcggtgatacagacgttattgaaaattgttagatcgtccagtacgtaggaca

SEQ ID NO: 58133 - DNA, 388 bp, Zea mays
  Clone ID: LIB3069-017-Q1-K1-E11
ccataactgagccacgcctcggctggtttaatgaaactgcagctactattggagccatgggaaggattgacatggatgggactttaaatatcaaggtttctggccgaaaaagcttatggaaggttgctcctggtgacgctgagaggctttcagcttttgaggttggagattgggtccgaccaaaaccaagtattgggagcagacctacttatgactggaatagagttgggagaatcaacattgcagtagtccatatcattcaggactctggatacttggagttagctggctgattcaggaatgggaagtggctaacccataacacagacattgagaaagtgcagacattaaaaattggtcagcatggtcggttccatgctggaatttc

SEQ ID NO: 58134 - DNA, 431 bp, Zea mays
  Clone ID: LIB3069-017-Q1-K1-E12
acgcgtacgggtttatcctcaacagacacatcatatgcacttccagaatactacatatgcacagcggcaaacccaaggtgctttgatgcaacctgtacatgtgtcccaccaacaaacacatgtttctcatcatcctgcaccgatgcgtccttcattggcaggccatcagccagctttgcagcatccttaggcccagggaattcaacatacattacaacatgaaaaacatattgggtttcatgctcagtggccaacaatgtattccaacattccttcccaagcaccaccacagggattgtctgtgcactcatctgtttcctcacaatcagtttaatcataccagcaaggaatgtcttcatcacaacagatgcatttccaaccttgtcaggcatatacacaacagcatggtactggcaatactggacaacatg

SEQ ID NO: 58135 - DNA, 127 bp, Zea mays
  Clone ID: LIB3069-017-Q1-K1-E2
cccacgcgttcgcgcacgcgtaggcaaacttttgagactttatacaacatgacctttaatagcgaatttgagcaatattatggggaataaaacattagatttactcatcaaacacaacattaaaatg

SEQ ID NO: 58136 - DNA, 439 bp, Zea mays
  Clone ID: LIB3069-017-Q1-K1-E3
cccacgcgtccgtgtttccagaggaagttattgccggtcttgatcgtgctgtgttgaacatgaagaagggcgaggttgctcttgtcacaattcctcctgaatatgcatttggttcaactgagtcaaagcaggatcttgctgttgttccacctaacagcacagtaatatatgaagttgagcttatttcatttgtgaaggtgcggacatgactgatattcgtgtctgttctaaatcattgacctgtgtgcaactgcacatgactgatattcgcgtctgttctaaatcattgacctgtgtgcaattgcaaaattgatcaatataatcttgtcacacaggacaaggagtcgtgggacttgaacaatgaagagaagattgaggctgctggtaagaagaaagaggaagggaatgcattgctcaaatcgggcaaatatgctagagc

SEQ ID NO: 58137 - DNA, 438 bp, Zea mays
  Clone ID: LIB3069-017-Q1-K1-E4
cagaggaagaacgccctggttagcctgcgcttgtggagtgaagtcttcttgcaagtcggcgggtagatgctgtacgcatcgatattgccttcctcggcctcggcgatgtcgaagaccttgttgcactccttcgacgcatgctaatcagaggaagaacgccctggttgcccagagggtacgatccctgcacggagaagtactccacgaagtactacaacttacctgaggtgcagagagctctacacgccaatgtcaccggaataccgtatccctgggtaacctgcagtgacccagtgtatgatttttggaaagattcgccgaggtccatgcttcctatctaccgtgaactcatcgccgcgggcataaggatatgggttttcagtggcgacgcttgattccgtgtcccgctcaccgcgacaaggtactccattgacgccc

SEQ ID NO: 58138 - DNA, 389 bp, Zea mays
  Clone ID: LIB3069-017-Q1-K1-E5
ccaaaaaatcccccattttcttcgaggcgattagagcgtgaaagacagggcaccggcagcggcgatgtcggggcgcggcaagggccgcaaaggtctgggcaagggcggagcaaagcgccaccgtaaggtgctccgtgacaacattcagggcatcaccaagcccgcgatccgtaggctggctcggaggggcggcgtgaagcgcatttcggggcttatctacgaggagacccgcggcgtcctcaagatcttcctcgagaacgtcatccgcgacgccgtcacctacaccgagcacgcacgccgcaagactgttaccgccatggacgtcgtctacgcgctcaagcgccagggccgaaccctctacggcttaggaggctatgctggatgcctct

SEQ ID NO: 58139 - DNA, 434 bp, Zea mays
  Clone ID: LIB3069-017-Q1-K1-E7
gttgatgccattgacgagtatgctgttggtcagctcaaggagtttgagggcaagaagcttggctctgccaccaaggagggtctgaagcttgatgagactgaggacgagaagaagaggaaggaggagctgaaggagaagtttgaggggctgtgcaaggtcatcaaggaggttctgggtgacaaagttgagaaggtggtggtgtctgatcgcgttgtggactcaccgtgctgccttgtgactggcgagtatggctggaccgccaacatggagaggatcatgaaggcacaggccctgagggactcgagcatggcgggctacatgtcgagcaaaaagacaatggagatcaacccagagaaccctatcatggatgagctccgcaagcgtgccgaggctgacaagaatgacaagtcagtcaaggatctcgtgatgctgct

SEQ ID NO: 58140 - DNA, 304 bp, Zea mays
  Clone ID: LIB3069-017-Q1-K1-E8
cccacgcgtccgcggacgcgtggggggagagattctgatcaggtgcaacaacgtgatgtaggtgcgaggcgttccagaggatgcagagatagaggatgcagagtgagaagatgcgatcaatgttagattgataaatgtaatatggttctgacatctatgttcgaatatgccggtgacaagtagatctatcggatcgctttgttctcttgagtgatgaaacatgatggcggtcgggctaagggtgaagctgctttcagttagactatgctgtcattctgctgaatatatatcagatttcttgaac

SEQ ID NO: 58141 - DNA, 355 bp, Zea mays
  Clone ID: LIB3069-017-Q1-K1-E9
cggacgcgtgggcggacgcgtgggcggattcgtgggtggtcttgaagttggtctgacgggctatgcagatgcctactgcactggccttctgttggctcgccgtgtgctcaagatccgtggcttggatcatgagtacgacggcaatgttgaggccactggtgaggacttctctgatgagccagctgatgagaggaggccttgtcgtgctctcttggatgttggccttatcaggactacaacagggaaccgtgtctttggtgccctcaagggagcattggatggaggcctgtatattccttacagcgagaagaggcttgctggattcaagaaggacgacaagcagttggatgctgat

SEQ ID NO: 58142 - DNA, 401 bp, Zea mays
  Clone ID: LIB3069-017-Q1-K1-F10
gacgtaatgggtcgtgtgccatacggattatcgtttctggataaacaggccgaagaaaggtcctgggacatcaacctaggatggttcttagagccagtggttcgtggtgactaccccttctccatgagatcattggctagggaacgactacccttcttcaaggacgagcagaaggagaagctcgccggttcctataacatgttggggttaaactactacacctcacggttctccaaaaacatcgatatctcaccaaactactcacctgtgctcaacactgacgacgcctacgccagtcaagaagttaacgggcctgacgggaagcccattggtcctcctatgggaaatccatggatctacatgtaccctgaaggcttgaaggatctccttatgatcatgaa

SEQ ID NO: 58143 - DNA, 417 bp, Zea mays
  Clone ID: LIB3069-017-Q1-K1-F11
ctgtcacacacacacacacagacaagtggtttccaaagccaagtgtgtgtactagcaacgagctagctcgggcggcagcaggcagccatcatgtcggaggagaagcaccaccacttcttcaaccaccacaagaaggacgaggagcagtccgccagtaacgacgggtactccgagaccgaggtggtcaccgccaccggcgagggcgagtacgagaggtacaagaaggaggagaaggagcacaagcacaagcagcacctctgcgaggccggcgccatcgccgccggcgccttcgcactctacgagaagcacgaggcgaagaaggaccccgagcacgcgcacaggcacaagatcacggaagaggtcgctgccgcggcagccgtcggcgccggcggctacgtattccacgagcaccactag

SEQ ID NO: 58144 - DNA, 450 bp, Zea mays
  unsure at all n locations
  Clone ID: LIB3069-017-Q1-K1-F12
atcacaccctccgagctcagctgaccttttctgcagctacaatcacagtcgatgaccagagcgagagctagctagagggccgtgaaaatgccgatcaataggatcgccctggggagccaccaataggtgtaccacccgggcgccctcaaggcggcgttcgctgagttcatctacaccctcatattcgtcttcgccggccagggctccggcatggccttcagcaagctgaccggcggcggcccgacgaccccggcgggcctgatcgcgacggcggtggcgcacgcgttcgcgctgttcgtggcggtgtcggtgggcgcgaacatctncggcgggcacgtgaacccggccgtgaccttcggcgccttcgtgggcggcaacatcaccctgttccggaggctcctgtactgggtggcgcaactgctggggtccaccggggcgtgcttcctgctc

SEQ ID NO: 58145 - DNA, 448 bp, Zea mays
  unsure at all n locations
  Clone ID: LIB3069-017-Q1-K1-F2
gcaagattgacaactctgggttttggcgcctactcacagttcgtgagggaagatgtccaggggaagctgttgtttcacagaatgcagaatcacaaatatcagaagtcatgcttattgtgcaggtgtgttcgacaagtgttgatgaagctcttatgaaagaagagtttgacaagctgtctgctgccctggtacaaggagcagcaacatgctcacctcccttgccactgacaactattgtagtgcaagatcataaagggatatcaaatgctgcacctactgattgcccactgagcccgctattggtaccaaagggagataagttggatggcacatcagaagataaaacaagaatccatgatcacataagcaacttaaagttctctatatcaccaacagcttttttccaggttaatactcttgctgcngaaagattgtatacccttgctgg

SEQ ID NO: 58146 - DNA, 402 bp, Zea mays
  Clone ID: LIB3069-017-Q1-K1-F3
caacctcaacaggcttgtgtcccaggtcatctcatcccttactgcctccctgaggttcgatggtgctctgaacgtggatgttaacgagttccagaccaacctggtaccctacccgaggatccacttcatgctttcttcgtacgctccagtcatctctgctgagaaggcctaccacgagcagctctctgtggctgagatcaccaacagtgccttcgagccatcttccatgatggccaagtgcgacccacgccatggcaagtacatggcctgctgcctcatgtaccgtggtgatgtggtccccaaggatgtgaatgctgctgtggccaccatcaagaccaaacgcaccatccagttcgtggattggtgcccgactggcttcaagtgcggcatcaactaccagcc

SEQ ID NO: 58147 - DNA, 434 bp, Zea mays
  Clone ID: LIB3069-017-Q1-K1-D8
cgagttgatgacagacatataactggctatataatgaagggcaatctgcatctgtcattggatcgaccagatttggcagtgacagacttcaggggggctcaagaattgagggctgatcttcgttcttatcaaggattggtgcgtgcttatctagcactttctaaatgcaaagatgcattattcactgcacgcgaggcgatgaacgttatgcatcagtctgcaaaagctcttaagctagttggtgatgttcatgcaattagttccagtgggagggagaaggcaagaaagttctatgaatcagccattcgtcttgaacctggatttcttggagctgcactggctctggctgatctgcatgttgcggaaagacggaataaagaggctgctatgctactggaaagatatatacaacaatggtcagatgattctctaca

SEQ ID NO: 58148 - DNA, 431 bp, Zea mays
  Clone ID: LIB3069-017-Q1-K1-C3
cagcgacagtgcaggcgagcgatgaagctgtcgagactttgagaaggtaaattcgacaagggaagagacggacagctcagacgtttatcccgtgattctatctttctatctcctcaaccctcaagacgcaataactataacatgcactagagtatgaagaaacgcaagacgtccccgacatctactccgtctttgcaaaaactgtctcaatgatatctccatgaagacatcctaaggctaatcactgatcatgtctaatgactcatatcgcacagtcattaacgcaacagcatatgtctccaaagagctcaacgccaaggacactaccatgtaggcaggtcatcagcggcttccatagaatagacaaagtgcccactgcagggcaaacggtcctccatgggcaaggcctaatcaaagcatctgtatatgca

SEQ ID NO: 58149 - DNA, 359 bp, Zea mays
  Clone ID: LIB3069-017-Q1-K1-C4
cggacgcgtgggcccggagaagcgtgggctttcgatcctgggcgacgacgacggcgccgcgggggctggggcggatgaggaggagcagctgcccgagccgaagcggccgcgcgcgtgtgtcgccacgctcgaccacgtccccggcgcggcggtgtccttggttctggtgaccgatgagacggaggactcgcctggctcgggcagaggcgactgcggcgacggcgcgtcgttctcgatccagcacgcgcggagcggcttcgtggcgttggagaccacgcccaagttcgggtccttcaacccgccgggggaagcctagctggcggccctagatctgaagcatgcgcggcacgaagccgacg

SEQ ID NO: 58150 - DNA, 427 bp, Zea mays
  unsure at all n locations
  Clone ID: LIB3069-017-Q1-K1-C5
gaaggcatcgccagcaacaagacgtttggcactaacaaaaacactccagccactctgcaagagatgccttcgtggttgacctctgaatatgtggcgaaagcgccattccacaccatgcaggtccttggctacaagctcttgtgttggaggttgacgggtcatatcctgaccagaaagccaaagcaaagattaccactaccagtaaagcaacaaatagcaaacctacaactgatgcactggcaatatcaagtcaagaatccagcaagctaccagtggcggaagacactcatctgcatggcgccgcagcaccgagaatccaccatgagtgctggtatcagaggctgtcaatgtcttgcagaaggagtgcacgcgtggccttgcaagtgcagcaggaggtgaagcangcatctnctcactagagccattc

SEQ ID NO: 58151 - DNA, 413 bp, Zea mays
  Clone ID: LIB3069-017-Q1-K1-C6
cccacgcgtccgcggacgcgtgggcaaacttgtagaaggaacttaaccgatacattcccactgccgctgcatttggtggtgtatgcattggcgcattgaccgtcctggctgatttcatgggtgcgattggttcaggaactggtatattgctcgctgtgacaatcatataccaatacttcgaaacctttgagaaggaaagggcgactgagcttggtttctttggcttttgattagtagctgtggaaccttaacttggctatagctgaattttcttgtaagtacctgtagtgcttagccagttgtaacttaaagagttctcgttaggttgccttcttgcggccacaatcatgtagcagaatgtgcctgtgtttcacgttagcgtgggggtatgtgcatctgtccaaagagagtct

SEQ ID NO: 58152 - DNA, 412 bp, Zea mays
  Clone ID: LIB3069-017-Q1-K1-C8
tctcaccgcactgcctgccccctcctctcgtctgcctcgcttagcttagccgccgctgctaggcactctcgccctccttgttcccgcgtcgctctgctcgcgatggcgtcccgcgttgcagtgctgctcgtggccgtggtggccgtgctgttcgccgcggcgtcggcccaggagatggacctgggcgtgccgcccgcgccggcgcccgtcacgggcgcggcagcggggaccgcggcgtcggtcctggccgtggcttgctctgccgtattctccatcctcgtcgccggtggcctcgtgcagtaagcgctgccgtcgacctggtggctcgctgctggttcggggtcaagcggagccctgttcgatcgttttcgcctctagtagtagtagaagtagcagtcatgggctgtgttga

SEQ ID NO: 58153 - DNA, 143 bp, Zea mays
  Clone ID: LIB3069-017-Q1-K1-C9
gtcgcacatgaataatgattctacagaatttaaaaaaaaaaaaaaaaaaaaaaaaaaaaagaaaaataaaaaaaaaaaaaaagaaaaaaaaaaaaaaaaaaaaaaaaaaaaatgaaccaaaattaagagcacataaatgcaac

SEQ ID NO: 58154 - DNA, 260 bp, Zea mays
  Clone ID: LIB3069-017-Q1-K1-D1
acgcgttcgcccaggcattcgctgcagatgtttatgacattttgactgaaaagttgattgtgcaaataagtgttaactaaagcgttgaatgagatattccatctagccaatataccaggttttaatagaaaataactatgactccagcttccatcttaagggaagctggtcttgcaagatatggtcctggtacctgaaaaaactatcttgaggtcaggtcaaggaatactacctgtgaacctaatgtgatactggcttct

SEQ ID NO: 58155 - DNA, 371 bp, Zea mays
  Clone ID: LIB3069-017-Q1-K1-D10
cccacgcgtacggcagcagcctaccactgtaccatccgaccgatcaaccaaagtaagccgggcgtaaacagccagacaaccggcactgactcactagctaggtgcaactggtacacaagccatcgtgaacgctatgtactgtgaatccatccatcctctcagtcgaccttcgaccgctagctgatctatacgacgtaacagactagcacgcagcagctaataatggcgctgggcctagcactgcgtacggttatgaggcgctcgggcagtaactactcgcgcgttgcggatgcagcactgcgcctctacgtctccgggtcgtcggctgcttacactgcgcagaaacggcagctcgacaactggcttatcct

SEQ ID NO: 58156 - DNA, 398 bp, Zea mays
  Clone ID: LIB3069-017-Q1-K1-D11
tcgcccacgcgttcggggctgagcccactattcttgccattgccagcatgcctatttggacgggagcttcgactacgcattcgcaagacgtgtggaaaggggactgaagctcgcacacctggtctgatccaccggcccgcggaacggatccagggcatccgcattctaggatcgcgtcgcgtcgcgtgccgccgcttgaaatccccggatcggtgcaattggcccctggctgcactcgataacccagccgtagggtagttgcctgtcgatctcgctgctggagctggttaactacctggccatttgtggatttgtgtgcctgcttgattttggtgcatgcatggtcgtggtgaatcccctgcttggggtgtctgaactaggggttgggccttcaagat

SEQ ID NO: 58157 - DNA, 380 bp, Zea mays
  Clone ID: LIB3069-017-Q1-K1-D12
gacaatactacgaccaatcgtaagcacatttatacataaaacacgtgaaccaatacctagggggtgattcagatgatcattatgtgatcatggaaaactacctagtgggatcattttgcgttgctggatatggatggggagaagtgtccagcacatggtgcttgcagattcggtttgtatgagttgatgatttctctgtggggcgttgcaaggaagatgggggtcgaggagaggcatgcgcagaatagctcctaggatgagcattccaagaacctcattgtcgatgccatgatgctggactcccgggctgtcaatctcgacaaggggccaccctgtcgctctggacaagggggctgccctaaggtcctgtttttgctttc

SEQ ID NO: 58158 - DNA, 437 bp, Zea mays
  unsure at all n locations
  Clone ID: LIB3069-017-Q1-K1-D2
cccacgcgtccggttttcatcatacaaggagcgcctacttggcctttcatttggtttgctggcaacaaggaaccatgacttgtcatacaaccttgcgtggcgtaccttaactgatccatcacgtgtctcatcaaaggccataaggaggcagttagggcataaccttctttctgcattgaagtacacatacaagattgataagagggattcacatcttaggccaacgaaaggatatgcgtttcagtcaacttctcaagttggtggtctatggaatagcaaaagattgagatatttccggcaggagttcgatgtacgtggtgctgtgcctttgggattttatagtgctgctctcaacgttggtgtangagcgggtgtcattttaccgcttgcagggggattcatgaattcgacttcatcagtgccagagaggttttatc

SEQ ID NO: 58159 - DNA, 362 bp, Zea mays
  Clone ID: LIB3069-017-Q1-K1-D3
cggacgcgtgggcggacgcgtgggctgactcgtgctggtggcttggcttctcgtccccctgcagttcgggaccggattcctgaggctctcacgtgttaagcttcgatggtgagcagatcgatgatgccctactcggatgttgagtaccgctgcttcgtctgcggcctcgtctgggacacggaccaccagtcgctgcataacgacttgaacatctatggcgaggtcctcctagccaacatcatcctccatccggacacgcacagtgcccgcggcttcggcttcgtcaccttctccacggaggatgcgatgcctaacgacatcgagggcatcaacagcaaggagctggactgtcgcaacatcac

SEQ ID NO: 58160 - DNA, 439 bp, Zea mays
  unsure at all n locations
  Clone ID: LIB3069-017-Q1-K1-D4
gtgcagcagaacgatcggatctagcagaattctctcaacctcatcggcggcggcgaagagcgtgcggatcggagatggcgacaagcgggtggaggaggagagcggcggcgcgggccttctggagccacaccacggtgtacctgtggctcgcgctcgccgcagcagcactgacgctcgcccaggctaagaaggacctaacggaggttacccacaaggtctacttcgatgtcgagattgacggcaagcccgcaggtcggattgtcatggggctttttgggaagactgttcctaagacagcagagaacttccgagctctttgcacaggagagaaaggaattggcaagagtggcaaagctctccactacaagggaagtacattccacagaatcattcccagcttcatgctccaaggaggtgacttcactcttggngatgggag

SEQ ID NO: 58161 - DNA, 395 bp, Zea mays
  unsure at all n locations
  Clone ID: LIB3069-017-Q1-K1-D5
caggagaacggtctggtgccaattgttgagtctgagatccttgttgatggccctcatgacgttgatcgctgcgcttacgtcactgagacagtccttgctgcctgctacaaggctctcaacgagcaccatgtcctcctggagggtaccctcctgaagcccaacatggtgactcctggctccgactctaagaaggtgacacctgaggtgatcgcccagtacaccgtccgtacccttcagaggaccgtccctgctgctgtgcctgctgttgtcttcctctacggtggacagagcgaggaggaggccaccctgaatctcaatgccatgaacaagctcagcaccaagaagccatgggccctgtccttctncttcggccgtgcccttcaggcgagcaccct

SEQ ID NO: 58162 - DNA, 433 bp, Zea mays
  Clone ID: LIB3069-017-Q1-K1-D6
gctcgatccatctcactctccgctggtcgctcactcttgcagctccacccttcactcagtgggagtctcttattagctctaggctctagctagccgcgccactccttcgtgtagccatcagccttctcatcgccaccaatggccactgccgaggtccagaccccgaccgtcgtggcggccgaagaagcgcccgtggtggagaccccgtcgtcggccgtcgtgcccgaggagtctgcccccgccgaggccgaggccgaggccgaggctgctgctcctgctgatcccgaggagcttcccgcggccgagcagcaagcagccgccgaggcggaggccgcggctcctgctggtgccgaggagcccgtcgcggccgaaccggccgtcgaggcggaggctgctgctcctgctggtcccgaggagactcctgcggtcgagc

SEQ ID NO: 58163 - DNA, 389 bp, Zea mays
  Clone ID: LIB3069-017-Q1-K1-D7
cggacgcgtgggctctcacgggcgcattcgtaccgcgatgaactacgccgcaggcgccacggacgcccccgcggcggcgcccgcggcagcgccggcgtcgggcacagaacacgcccactacccgtattacgctggctattcttatccctacggcgcctatcaccaacctgccccgcccacgtactcctccgccgtggccgacgcctcgtcatcctactactaccccgtccctgccgccgcgtcgtccaccgacgcgcagtacgacccctattcgggttaccagcactacagtcacccggagggaggacgctcggcgggggctggcctggtgggctgctacagcaccgtcggcgaggcgttgcagcaggccgaggtagcatcgacgacgc

SEQ ID NO: 58164 - DNA, 419 bp, Zea mays
  Clone ID: LIB3069-017-Q1-K1-C12
cccacgcgtacgatcaatgtgcaatcggttaataagtgccatttgtgttagttgctgaggtatgtaatatatacctagtggagttcacactttacatgtgcaatttatggttattagattgcgcaacatcaaatcaatgtagcatgcttctgtaccttcaaggttcgtccttgtgaactctgatgtacttctgattaaagttttcattccaaatgtttatttggtcatgttgccgctaatttatcagctccagtgtcgtcaatctcattggacatacctgcccggtctcaacatgaggttagtctggcaattggaagagtatgctggttactagaaatatggatatggaatgcatctaccaacaaaatttagaattccagtgcatgggatgcacattaacaagtgtaatgctatacatt

SEQ ID NO: 58165 - DNA, 424 bp, Zea mays
  Clone ID: LIB3069-017-Q1-K1-A5
cccggccgaccacgcgtccgcctttaactctggtgacataagctgttgctagggtagcaaatcaagagctaaggatggcagagtcaatggtagcaagcttctgggggcctgtgacatcaacaactgagttgtgcgaggagaattatgcacactcgtcatatatcgcagaattctacaataccatctctaatgtcccatgcgttcttttggcacttattggattagtgaatgctttctgccaaggctttgagaaacgatttagtgtcctgcacatatccaatatgatacttgctattgggagtatgattttccatgccaccttgcaacttctcctacaacagagtgatgagactcctatggtttgggagatccttctctacatgtatgtcctctattcaccggactggcactacaagagcacaat

SEQ ID NO: 58166 - DNA, 412 bp, Zea mays
  Clone ID: LIB3069-017-Q1-K1-A6
cacaatacgaactgcagtttccaatactcattgagttacggaaagcagcggaggggaagcggtgtatcatatgtgaaactgtcaacttggaattcaaagaaattggttctatgtgtggtgggccttaggagaacaccagatctagacatttgttgaaacaacttaccattggcccagacaattctttagcacgaatgatggatcttgcaaccacaaggaagctcgcgatgaaaaataaaattgtttttggcacaagtgaccattggccggcccctactttgactgctaacatgggttctgtaagagctgtttcccactctggtatgtccttgcttaccatcgatcaccgaccttgggcgctgattgtgctgtgacagttagtatgccataactattctatacgtggtttgag

SEQ ID NO: 58167 - DNA, 111 bp, Zea mays
  Clone ID: LIB3069-017-Q1-K1-A7
cccacgcgtacgctgtgtcggatggtgtcactcctgtagcccccggtgctccgggcgtgcgtgatgtcgaggtcttgggacctaaagacactctcagggccagggatgtgt

SEQ ID NO: 58168 - DNA, 254 bp, Zea mays
  Clone ID: LIB3069-017-Q1-K1-A8
cccacgcgtccgctcacgcgtacgtcgacgcttggggtttaaaactgtcaattggcgtgtggggcatcatactcttatgtgtcggcgtcagtttgtttgcgtcatcagtttcgttgtctgttgcatgtcacggcttacttatgtgcttatggattgctactatacaagtattcgttttggatgtgttaaaaagacatgaaaatggagctacatgccagaagacagacggaggcttctttggaagctgctctgac

SEQ ID NO: 58169 - DNA, 434 bp, Zea mays
  unsure at all n locations
  Clone ID: LIB3069-017-Q1-K1-B1
cccacgcgtccgggatggttcactggccactatcttccagctcgcaaattcgacgcttgctgaagtgctgctgttgcggctccatcgccggaccgtgccctcctcctgcacccgagctcctcttaaggtcctggtacatctcctcgatcaacggcttccacagacgaaccctcgcatttatgaaccaatttgaaacctggtacaaatgcaaaaccactcgaatccatcattaccccatctcgccaaaaaagaatcgaatttgaaacgagtctggtgggatttcgatctgtgcttggttcctggtgaggctgctccttgccgncagcacgtncttctcatggtccttgggatacctgagcagagcanagcagagcgcgattctgatcatggccaacaatgtcgatagacgatttgcacagcaacgtcgcgggaca

SEQ ID NO: 58170 - DNA, 264 bp, Zea mays
  Clone ID: LIB3069-017-Q1-K1-B10
accacgcgtgcggcaccgcgagaactcgtttaatgctaactgtgtaccagtgtgaccctggacgctcattgggtacgtgaacaaggatgctcatgctgcattacagtgctaatgttggtctcatgggcaatactactgatacatatctctacggtgtcattgagattgttatacacagcaaacgttggactgaaccttcatatgataatggatggtgccactctagtgtttaaggctgtatagaaaatgaatgcggtcgatatt

SEQ ID NO: 58171 - DNA, 295 bp, Zea mays
  Clone ID: LIB3069-017-Q1-K1-B11
atcggaatgctcaggcgcgtctaccgcttttactacgtctcgctcttcctcgcgctcatgggcctcaggagatgaagcagccggcggagagtgcgtgaacaatcgagccaacagaatttgcacccacacccaacacacagttgctagtggtcaattgtcgttcatactgatcgatgaatatgtaattgtcccttctgtacaccaaaacgtctgtagtgtcgtttactcgttttatacgtgtctgtctatttatcgcaccaaaagatatttaataataatggattattatctttct

SEQ ID NO: 58172 - DNA, 287 bp, Zea mays
  Clone ID: LIB3069-017-Q1-K1-B2
aaaaagaataaaaaaaaaaaaaaaaaaaaaatttaaaaaaattaaaaaaaaaaaaaaataaatagaaaatatgaaaaaaataaataaataaaaaaaaaaaaaaattaataatatatataaaatttcttttaaattccttttccatcttatacttcaacctatttcacaactaactatttgatttatcaaccaatttttaaaatatacaaatttaaaccactataatcattattaaccatctcttaaaaaaaaatagatttaaaaaaaaatttgaaatttcatttttc

SEQ ID NO: 58173 - DNA, 443 bp, Zea mays
  unsure at all n locations
  Clone ID: LIB3069-017-Q1-K1-B3
gtcgcagcccgtgttccagcgcatcgcgctctacagggctggcattgtccccgtctcctacggcagggtggcgtgcaacaagaagggcggcatccggttcaccatcaacggccactcctacttcaacctggtgctggtgaccaacgtgggcggcgccggcgacgtgcacgcggtggccgtgaagggcgaccgttccgcggggtggcaggccctgtcgcgcaactggggccagaactggcagagcaacacgctcctggacgggcaggccctctccttccgcgtcaccaccagcgacggccgctccgaggtctccagcaacgcttgcccgcgcggctggggcttcggccagaccttcagcggngcccagttcaactgaacaccctccatggttcccgcagcgtcgtctcgtccgtcgtcggcgcggtgccacangtagtagtttt

SEQ ID NO: 58174 - DNA, 310 bp, Zea mays
  Clone ID: LIB3069-017-Q1-K1-B4
aaaaaaaaaaaaaaaaaaaaaaaaaaaaaatattaaaaaataaaaaaaaaaaaaaaataatagggaaaaattaaaaaataaaaaaaataaaaaaatataaataaaaaataaaaaaaaaaataataattaaaaattataaaaaaataacaaaaataaaaataaacaaataaaataacaaaattaatcattaaagtcaacttttttaaatagatacaaatatatgttgtacaacttaggttaaaactttattaataacacactaatggactttaataacctcttcttaaaaattattaataattaaaaacac

SEQ ID NO: 58175 - DNA, 442 bp, Zea mays
  Clone ID: LIB3069-017-Q1-K1-B5
gttgctatgaagtaccaagcgctgcttggaatgatggtggctggttgctatgggctgccagagttcacgatgcgtgtgttcctctggggtgctctttcttccatggtgctccctaagtatcctctgcccacctatgatgttgtagtacgtggaggagcccctaatgccttttcgcaatgtatggttgcatatgacgagacacaaaaaccatccctgaagaaagccttgcttcttggtgatgcaatttcagatttaccaaaggttcaaaatcaccagcctaacgatgtgatggagtatggtggttcccccaagaccgaattccagcgctacattcgactcagtcgtaaagacatgttggattggtccttcagtgagggggctggtccaaatgaaggcaagctctttgatcaccaacctttacggcttacaacgatgattatga

SEQ ID NO: 58176 - DNA, 441 bp, Zea mays
  unsure at all n locations
  Clone ID: LIB3069-017-Q1-K1-B7
cccacgcgtccgagcggatctgttgagacattatgttgaccagcctggttatggtgatctggattggggcatgttcgttccagctataaaaggccaaggaactgaggagcagcagcacaagtggttaccactggcttacaagttccaaataattgggtgctatgctcagacggaacttggtcatggctcaaacgttcagggccttgaaacaactgctacattcgatccgaagactgatgagtttgtcatccacagtccaactctcacgtccagcaaatggtggcctggtggcttggggaaagcttacacccatgcagtggtgtacgctcggttgataactgaaggaaaggactatggcatacatggtttcattgtgcaactgcgaagcttagaggatcacttcncacttnctgggtgtacccctcgtgatattggtggaag

SEQ ID NO: 58177 - DNA, 419 bp, Zea mays
  Clone ID: LIB3069-017-Q1-K1-B8
gcaacatctctgaatatatcggcttatcaactgcatgcactgcatttgaattggatataatgtgtcagtaagatgcagctctgctcttgatcttttctggttgacgagcatgtatggtccttgcaaagcgatcattggtccaaagcgactttaatctgacgagacctcctcatttttaggttttttggtatttagaaccagaataatttgtgcatactcattactcccttggatctgaaacaaatgtcgttatattgaatgagtggttctctgatgcactaataacctgatagccggagaatcactaacattatatgcaagaactttatctaaaagccagtcaccatggccccctgagaaccccgacatgctgcaactgaggcaagcttttatgctcaagatcttgatgaggtattcat

SEQ ID NO: 58178 - DNA, 353 bp, Zea mays
  Clone ID: LIB3069-017-Q1-K1-B9
aagacgcgtgagcggacgcgtggggaatatatgctactcgacaaaacgagaaccgtgatgagcgctgattatggtgttgctggcctcgaagcttcaaatcccatagacatgacaggcgaaactggaacgctcggttacatggcacctgcgggtctgaatggaaatccctacaacaggaaatgcgatggttacagcttcgggatctgtttgtgggagatatactgctgagatatgccatatcctgacttgagcttttctgaggtcacgtctgcagttgtccgtcagaacctgaagcctgagataccacgctgctgcccgagctctctatcgaacgtgatgaagcgctgctggga

SEQ ID NO: 58179 - DNA, 407 bp, Zea mays
  unsure at all n locations
  Clone ID: LIB3069-017-Q1-K1-C1
ctgcttcttcacagtctgatgggagtggaatatgcgaggtgtctctccatacggagttaaggctatctggggcccagaatgctgatgccacacgtaccacaggagctggcacaaatgatgcattcaggaataagaaaaagcacgatcgctcttcatgcggttctaacacaccttcaagtagtgatgtagatgcgggcaatgttcctgaggaggacaatgctaatgagaaggcgaagcaagcctcctgcagcaactcttcagctggtgacactaaccaccgcagatttagaagcaatggaagcacaagtgattcatggaaggaagtttccgaagagggtcgtctggctttcgatgcgctgttcagtagggaaaagcttccgcanagcttttctcccccacaagcagta

SEQ ID NO: 58180 - DNA, 350 bp, Zea mays
  Clone ID: LIB3069-017-Q1-K1-C10
cggacgcgtgggcggacgcgtgggcggtctcgtgggtgagagtgctgctgctgaaaagggacatgaagatcacgcacagggtgagcatgaacaccatgagcatgagaatgaacacgaccatgaccatcatcaccatcatgatcatgatcatgatcatcatgcacatgaccacactcatgatcccggtgtttgtatctgtgagcattgactgcgaaggggacatggatcttgaaaaggctgacatgaggctgggggacctactgctggaacacagcgaggatatctacaggatgaaaggtctgctttctgtcagtggaatgccggatcgacttgtctttcagggagtccat

SEQ ID NO: 58181 - DNA, 438 bp, Zea mays
  unsure at all n locations
  Clone ID: LIB3069-017-Q1-K1-A4
caaaagaattggcttcttcggctgccgtcgaactcaagaatttggctgaagaagttacaaagggatctgggctaaatgcaaagcaggcgaaggagttattagttgctcaggagatggcacattcaagggttcatggtagaaagggtcgtacagctagtaggggtagggatgaggttgggacatggagcctcgatttggaggacatgaaaatggagctacaggccagaagacagagggaggctgctttggaagctgctttggcagagaaggagcttctcgaagaagagtacaagaaaaagtttgacgaggcaaagaaaaaggaactatctctggagaatgatctagcangcatgtgggttcttgctgctaagttgaaaagaggagctttaggcatatctgatttgaatgttgacgaccgaactgttaacctagctgata

SEQ ID NO: 58182 - DNA, 458 bp, Zea mays
  Clone ID: LIB3069-017-Q1-K1-C11
cccacgcgtccgcccacgcgtccgcacgtttcctgcctatttcaacgactcgcagaggggggccacaaaggatgctggggtgattgctggcctcaatgtgctgcgtatcatcaatgagccaaccgctgctgctattgcctatggtcttgacaagaaggcaaccagtgtcggtgagaagaatgtcctcatttttgaccttggaggtggtaccttcgatgtctccctccttacaattgaggaaggtatctttgaagtcaaggccacagctggcgacacccatcttggtggtgaggactttgacaacaggatggttaaccactttgtccaggagttcaagagaaagaacaagaaggatatcactggcaacccgagggctctccggcggctgaagaccttttgtgagagggccaagagaactctggcttccactgcccagaccaccattgagattgactcgc

SEQ ID NO: 58183 - DNA, 274 bp, Zea mays
  Clone ID: LIB3069-040-Q1-K1-E4
ctaggaggagctttgggtgccaaagctgcagaagatttgaagctgagaataattgaacataatatcttggttgtgtctaagtactattcgagggttaccataaagaggcttgctgatctgctctgcctgagtttgcaggaggcagagaagcatctttcagacatggtgaactcaaaatctctgactgcgaagatcgacaggccgatgggagttgtgagcttccgagtagttcaggactgcaacggcacacttaactcgtgggctacaaacctcg

SEQ ID NO: 58184 - DNA, 221 bp, Zea mays
  Clone ID: LIB3069-040-Q1-K1-E6
cgccgatcgacgccggcagggacgtcggcatcggcctgcgctacgactggggcaagttctgcgcgtccaagacgttctacgacccggcaaagcgccgccgcgtgctgtggggatgggtcggcgagacagactcggagcgcgcggacgtgtccaagggatgggcgtcgctgcagggtataccccggacggtgctactggacaccaagaccgggtagcaacct

SEQ ID NO: 58185 - DNA, 269 bp, Zea mays
  Clone ID: LIB3069-040-Q1-K1-E7
cgccgatcgacgccggcaggtacgtctgtttcggcctacgctacgactggtccgagttgggcgcgttcaagacgttctacgacccggcaaatcgcctccgcgtgctgtggggatgggtcttcgagacagactcgtagcgctcggacgtgtccaatgtatgggcgtcgctgcagggtatccctcggacggtgctactggacaccatgacgggtatcaacctgcttcagtggcccgtatacgatgttgagactctgagcaccagctgcacc

SEQ ID NO: 58186 - DNA, 428 bp, Zea mays
  Clone ID: LIB3069-040-Q1-K1-E9
cggacgcgtgggctgaaacagcccgtcacctaccattcgacccgccgcgacgctccctgcgcggaacagcctgcgttgctcgcccacacgacgccacgcatgcaggaggagccagggcgtcgtcccgtgccgccgttcgcgggcgtggacctccgccgccccaagggctacccccgtggcggttgccaaggaggagaggccggcgccgggcggcgacccgtgcccgcggtgcgggtcgcgggacaccaagttctgctactacaacaactacaacacgtcgcagccgcgccacttgtgcaagtcgtgccgccgctactggaccaagggcgggtccctccgcaacgtccccgtcgggggcggcacccgcaagagcagcagcagctcctcatcatcctcggcggcggcggcggcgacgacgacgacgacgt

SEQ ID NO: 58187 - DNA, 438 bp, Zea mays
  Clone ID: LIB3069-040-Q1-K1-F1
aaagcaggctgcgaagaaggctgctgttatgccaatgcacaagggggctatccgttggaacaagccaaggtaaacaatgatgttcttttattgcttatgagaaagtttactgcattcaaggggttgttcaatttattgagtcatgcaccttggattatattggctgagaatgattgtgatgctggtgtttacatggaactgccttaacttctctggttatacacacacaagcttataaagaacaatcgatttcatattcttgtggcacaaggcctgttttcttggttgaactgctacaaatatatggtgaatatagcatatgagccttgaagcttcattgaaaggtattgcccttctctttatctgcttgtgcctgacatttttctatgcagtttcatggtgtaatttatagctgctggatgagtgttattttggaca

SEQ ID NO: 58188 - DNA, 295 bp, Zea mays
  Clone ID: LIB3069-040-Q1-K1-F10
cggacgcgtgggaagcaaactataagtttgttgtattggatactgggaattaccagattgattcaatggatcctgataagatgcttcagtgggaagatattatctgtgtaagatactatagcccttctgaggtacaatgccctatttgcttggaaagaccattgtgcccacagatcacatcatgcggacccatatattgctttccatgcattttacgttatctaatgatgggcaaagatgattatagaggtgagtgttggaagaagtgtcctctgtgtttcatgatgatatcatc

SEQ ID NO: 58189 - DNA, 431 bp, Zea mays
  Clone ID: LIB3069-040-Q1-K1-F11
attccgtctcattctcatccctgacccccgtaccgcaccgtaaaccctaatccccggcggcgacccttggggcctccgttgtgctctacctgtgccccgcttagacgaggagctgcggcggccaagaccaatcgaccatggctacccggatccagtttgagaacaactgtgaaattggtgttatctccaagctgacaaatgcttactgtctggtagcgattggagggtcagagaacttctacagtgcctttgaggctgagcttgcagatgccatccctgtggtcaagacctctattggtggcactagaatcataggccgactttgtgttggaaacaagaatggacttctattgccacatactacaaccgaccaagagcttcagcatctgaggaattgcttgcctgatcaagtggtggttcagcgcattgat

SEQ ID NO: 58190 - DNA, 234 bp, Zea mays
  Clone ID: LIB3069-040-Q1-K1-F12
cccacgcgtccgtccacgcgtacgcccacgcgtccggtttccctccgcttgccgagtgccgcgcgggagcacgcgcccatggcgacgcctgcgacggcgtcgacggcgtacgcgcttcccaagtctggggcggtatacaagggctacaactttgcatccacttgggaacagagcgcgccgctcacggagcagcagaaggccgcgatcgccgcgctctcccacgccgtggcagag

SEQ ID NO: 58191 - DNA, 317 bp, Zea mays
  Clone ID: LIB3069-040-Q1-K1-F2
cccacgcgtccgcccacgcgtccgcccacgcgtccgcggacgcgtgggcttcactctcctggtttattcctccgtgccgatctcgtcttctccggcgggaccatggcgccgtcctcctcccgattcgacgatccggcggcggtgaggcgccccccgcagcatgaacggaagccgccgtatatgttgcttctcccgctcgtctacgcccccgtcctccccctcatcaggatcgggctgcggcacaatcccgtggtgagggaccgcctcttctacggcgtcctcgccggcgcattcgcccacggcgcctacctcatatc

SEQ ID NO: 58192 - DNA, 416 bp, Zea mays
  Clone ID: LIB3069-040-Q1-K1-F3
tggcgcttttacactacctatgctagtttgcctgatgctacatttccacgatggttaagctgactatgatagcgcgtgtcactgatggccttccattgtcggagggattagatgatagtcgggatctgaaagatgctgacttctacaagcagcaagcaaaactgttgttcaagaacttgtccagagggcagcatgaggcgtcaaggatgtcaattgagacaggaccataccttttccagtatcctaagacctttttctcatttgcaaaattctttgttccacaattaatcatttagaaatatatgtgattcttcatcatgatcctaaattagagtttttgtgaactggcaagtttaggcagcctaaccatataccgtaaacttgaccagtattgtgtatatattggattcaatatt

SEQ ID NO: 58193 - DNA, 426 bp, Zea mays
  unsure at all n locations
  Clone ID: LIB3069-040-Q1-K1-F4
cccacgcgtccgcccacgcgtccgggcagggcaaaaggcccgatcccccctccccgccggttgccgcgctcgtgccacggtgcgctagccccgtcgacgccggcggacagcgtgcactatgggttgctcctcctccgtgccagctagaaatactggagggctgaacactatcagcaacgatagctctccagacgccagttcaaaggacttgcgtgctaagttggtattgctgggagactcaggtgttgggaaaagttgcattggtcttcgttttgttcgtggtcagtttgatcctacttncaaagtaactggtggcgcatcctttttatcacaaacattggcattggaggattcaacaatagtgaaagttgaaatttgggatactgctgggcaagaaaagtatgctgccttggcgccactttacta

SEQ ID NO: 58194 - DNA, 390 bp, Zea mays
  Clone ID: LIB3069-040-Q1-K1-F5
caaaggcgacgtcgccaaccaagtgcttgtagcgcagatgttcttctcgggttatggaacccccaagaacgagtataagggaaaacaatggatggatagggtgtcaaggttcaggtcttcagctttgaaggttggcatgaaacgtccaggatacaatgcaagtgactcggactccgatgatgccaaccaatgacagtcagttacaaattgagttattattagttaggagattcacatggtaagaaagtttggtataagctgttgctcaccttttcatgatttctaatattcccctaaccttggtttcgggacttcaagattgaattacttggtggtttatgcatttatctctacgttgaatcactgtcacactgagcttgtggtgattag

SEQ ID NO: 58195 - DNA, 416 bp, Zea mays
  Clone ID: LIB3069-040-Q1-K1-F6
cccacgcgtccgcaaccttgctttctaccaagaactttgcagggttcacaatgctgctcttactgcacaaccagctttggtgcaggatgagaggaagctgcttgagaaaatcaatattctttgtctgatggagataatctttagtcggccatctgaagatagaactattccattaagtgttattgctgagcagactaagctttcaatcagtgatgtggagtatctccttatgaagagcctctcggttcatcttattgagggaataattgatgaagtggacagtacagttcatgtttcgtgggtccagcccagagtgcttggaatcccacaagttaaagctttgcgcgaccgcctggatgcctgggttggaaaggtgcatactacattggtttcaattgaggcagaaacacctgatc

SEQ ID NO: 58196 - DNA, 423 bp, Zea mays
  Clone ID: LIB3069-040-Q1-K1-F7
caagttgtagttggtcctcgctagttgcggccatttgcgagagttgccagactccctgacgacacgctcaatcacgacatcccatggacaacgtgtgtcatgggttcgcgagtggcaggcgttgtgggtccatgcgacacgacaacgaacggcttggcgatggtgtgcgtggtagggtcttgtcatcggagccatcacctttgctagatgtacccgtcttgtctgtgccggtggcgtccggctatggctctgacttggtgacaccatggtggcgcaaggtcctcacatacagctccaatgcgagttgttaggcctcgacccgacgttatatgcaggcggcgaggacgagagctcaatgaatagcgagttcaacgccacaccaacacaagctagaacacttggaacacgaacgggtttggtgct

SEQ ID NO: 58197 - DNA, 311 bp, Zea mays
  Clone ID: LIB3069-040-Q1-K1-F8
cccacgcgtccgcgtgaagagactgcaggagaagaagcatatcgttggtatgactggagatggtgtcaacgatgccccggctcttaagaaggctgacatcggtattgctgttgcggatgctactgacgctgcgaggagtgcttccgatattgtccttactgagccaggtcttagcgtcattatcagcgccgtcctcaccagcagatgcatcttccagaggatgaagaactacaccatctatgcagtttccatcacaatccgtatagtgcttggatttatgctcattgcgttgatctgggaatacgatttct

SEQ ID NO: 58198 - DNA, 413 bp, Zea mays
  Clone ID: LIB3069-040-Q1-K1-E3
aaaaaatcttgacactttatagtacagtcaacagtcattataaagggaataagcatacaagccttagtcatcaaacctatttctttatttcgtagctgcatccaccaacttatagtgaaatatcttaatccaccaaagatatttttccttattggtccacatatgaacatagcagtggcatccatatacatttccaacatttgtgtcactgaaattcataaataagaatataaagaggaaatacaatatttaccaaagaagagtttgttgtcacttttagactggagtatccgagcttgcagggtcttgttctgaaaaaattataactagcttatcatgatccaaaactgtagttttaaagtagactaaataaaaccaagattaatttgagaaacgacacaaaacaaattttg

SEQ ID NO: 58199 - DNA, 159 bp, Zea mays
  Clone ID: LIB3069-040-Q1-K1-G10
attcgaagtccttggttctcattttaaaacaggcattatggcaacttctgtgggttattgcatcctagtgtactcagaaagtgtcacccaacccttcaggccttaaaaagttgtcagtggaaaatgtcaggactagagctagggttgggtaatctgaac

SEQ ID NO: 58200 - DNA, 321 bp, Zea mays
  unsure at all n locations
  Clone ID: LIB3069-040-Q1-K1-C3
tctccattcgcgaaaggctcgcagcanaaccacgccatcgatcgccgtcaccagtccagcgtcctccgatcgactacgtactcccacccactccggcagcagcgaggcctctctgtctgtgcgcggcgtggctgtcgtcgatctctgcctggcgggcggccggcatggggaggtccccgtgctgcgagcaggcgcacaccaacaagggcgcgtggaccaaggaggaggaccagcgcctcgtcgcctacatcaaggcccacggcgagggctgctggagatcgctaccaaaagccgcaggtctgctgcgctgcgggaagagct

SEQ ID NO: 58201 - DNA, 319 bp, Zea mays
  Clone ID: LIB3069-040-Q1-K1-C4
ccctgctccattctcagccgccgccaatcccttcccgtgctccgcaaccgctgagtgagaagaagagatggccggcaagggcgatggcccggctatcggcatcgatctcggcacgacgtactcttgcgtcggcgtgtggcagcacgaccgcgtcgagatcattgccaacgaccagggtaaccgcaccacgccctcgtacgtcgccttcaccgactccgagcgcctcatcggagatgcggccaagaaccaggtcggcatgaaccccatcaacaccgtctttgatgccaagcgtctcatcggcaggaagttcaatgatgcg

SEQ ID NO: 58202 - DNA, 325 bp, Zea mays
  Clone ID: LIB3069-040-Q1-K1-C5
gtttgtgaggcgttggctcccttccccactgcttcctccccccactgccggtcgctgtgcaagagctgccacgagacagcagattccccatcatccaaagcgaggtgagattcttgctgaaagatcggacggagggagtagaatcgcggggggcgtggctgtggttgccagtcgccatgccatgatgtgtgtagggtccagccaccggagaccggagttgctgatgacgacttggcgatgctgtggtttccaggctgtaggggaggagaggaagcaggaatagcctaacaggggtatagatctcaggaagctccatgcgggtgag

SEQ ID NO: 58203 - DNA, 255 bp, Zea mays
  Clone ID: LIB3069-040-Q1-K1-C6
ccagggtccacttcgctcgcaaccttccccagccatggcgaccgcgacgcggaggctgctccccgcgctcctcaagaccctagctccagccggcgcgcgcggcctctccaccgagaaggctgttggtgcagccgccgtcgtcggcagccacaccgctaagtggatgcaggacacgagcaagaagtcgccaatggaactgatcaacgaggtaccttcgatcaaggttgatggtcgcattgccgtctgtgaaggggc

SEQ ID NO: 58204 - DNA, 317 bp, Zea mays
  Clone ID: LIB3069-040-Q1-K1-C7
ggcaactggatcttcgtcggaatcatagccgcgacggtagcgttccaggtggtgatcgtcgagttcctcggcacctttgcgagcaccgtcccactcggctggcagctgtggctggtgagcgtcggcctcggatccgtcagcttgctcgtcggcgccgtcctcaagtgcgttccagttgaaccggacgatggagttcgcgccagtccaaatggctacgcgccgctgcccggcggccctgacaacatataacagctgaacctgagcggccgagaaggtactgacgacgtgctgatttttttcgcgttaggggtcataac

SEQ ID NO: 58205 - DNA, 435 bp, Zea mays
  Clone ID: LIB3069-040-Q1-K1-C8
gccagctggatcttggtcggaatcatagcttcgactgtagcgctccacgtggtgagcgtgaagatcctcgacacctttgcgagcaccgtaccactcggctggcagctagagctggaagagcgtcagcctcggatccgtcagcttgctcgtcggcgccgtcctcaagtgcgttccaaatgaaccggacgatggagttcgcgccagtccaaatggctacgcgccgctgaccggcggccctgacaacatataacagctgaacctgagcggacgacaaggtactgacgacgtgctgatttttttcgcgttaggggtcataacagattatattatgtaaaaagagatggtggtgacgacaaggcacctctattttgatgggtcatacttagaagtggtaatagcctctagattttacgctacaaactttaaagatcgaaa

SEQ ID NO: 58206 - DNA, 406 bp, Zea mays
  Clone ID: LIB3069-040-Q1-K1-C9
atcgagtggagtttttgaggtggaaccaaagagctgcccagggttcatatacagatgtacggttttcataggccacacaactctgaatcccttggaatttcgagaattcattcagaggatggcctcagaataccatggagatacctaccacctcatttccaagaactgtaaccactttacagatgatcttagcaccagattaacaggaaaatcaattcctggttgggtcaatcgacttgcaaggctaggcgccttttgcaactgccttctaccagaaggcttgcggcttgagtcaactgaaacaaagcatcttggagactgtcgtttctcagatggttccaataccaccagcaacgataactctgacgaagatgaattggaagaaaaacacctgcttccgactact

SEQ ID NO: 58207 - DNA, 336 bp, Zea mays
  unsure at all n locations
  Clone ID: LIB3069-040-Q1-K1-D12
tttccaatctttggatgtcatggactactccctttgggtcggggtcgccaaaaagaaaaaggacctgggggttggcataatcgatttcctgcggcagtccacctgggacaagcagctggagacatgggtgaaggcctcggggatcttagggggccccaagaatgagtctcccaccgtgatttcttcaatccagtacaaaaagaggttcangaaggccatgtcgaggtactttctcgncgtncctgaccaatggacctcgaaaggcggttaaatcttctcgctgntttttagctgcatcttttttgtcagcgaaagcttcactcgttcatccttggc

SEQ ID NO: 58208 - DNA, 166 bp, Zea mays
  Clone ID: LIB3069-040-Q1-K1-D2
ccagggtcaagctggccagcctcgtcccccgtccaaaatctgacgaataatggtgatgcaggaccttaattggcctttaatttggcctatcaaggatgatgaagatgaaacttcttacaaaactgacaccaccgaagtttaattattttgaggttcttacactaca

SEQ ID NO: 58209 - DNA, 349 bp, Zea mays
  Clone ID: LIB3069-040-Q1-K1-D3
gagcaagagaaccctggcttcaccaggatcaggaccatgccagcactatgtaaatgaatgcactaccagtacacagtcgactgataatcacccagacgacctacccgctccgagatctcctgaacaatccgcgtgatttcagaatgacaacgattcgggttcagtaggcatttgtcaaagcaacacgcgaagaagtatatatgaactctgcggtaagctgcagagtttcaaagtttccagcgccgtataaggaagctacgtagctatgggtgcaccttgtccgaagcctgtggacagcacgagccgatctgcagtcgcgctgctcacgaacatagagaacacaactgct

SEQ ID NO: 58210 - DNA, 444 bp, Zea mays
  unsure at all n locations
  Clone ID: LIB3069-040-Q1-K1-D5
ggagaggtgggggatggcgaagccgacgccggtggcctcggcagaggaggcggcggcgatgcggcgccggctgaggcgcctggtggccgcggtggcggccgggagcgccgacgccgaggccttcgacgaggctgcagaggcgctcgccaagctcagggacgccgagcttggcccccgcaaggacaggaccggcgacggccgggagaacaagcgcagcacggaggccgccgtgccggagcacttcctttgccccatctcctcagagatcatgagggatcccgtcgtcctcgccttcggccagacgtatgatcgtcgtttcattcaagaatggttaagcgctggaaaccggacatgcncacagactcaacaagtcctttcgaaacacattatcaccccgaaccaccttgtgagaagcatgatctcacagtggtgcacagacaacgg

SEQ ID NO: 58211 - DNA, 260 bp, Zea mays
  Clone ID: LIB3069-040-Q1-K1-D7
ggggatgggcggcagcaccagcctgggaccggcggacaacaccctggacgccgccgcggggggcctgctccccagcgccgtatccctcgccgccgccgccgccagcctctacttgctcgccctgctgcagcattgattacgtgctctagctgctagctatgcggtccgtgaaaaagaaagggggcacagcggatagtactggagaatgtgaatcggttcggttggctgcaggacggatccgatttcacttcacccatctt

SEQ ID NO: 58212 - DNA, 264 bp, Zea mays
  Clone ID: LIB3069-040-Q1-K1-D8
gttctgtggatataaaaatataacatcgtccgcgctctggagagtctggatcctgctggagctccaagcagcaagcgatgaatggagggacgcaagcaattagcctgatggtgcaccttgctgtgccatggctctgccttgcttcttgggcagctctgctaccagcgctactagcatctggaaatgtgggtgcagcagcttcgacactgagagcagagtacatgaatttgaacttcagcaccgcttcggcaaaccccgacaagt

SEQ ID NO: 58213 - DNA, 247 bp, Zea mays
  Clone ID: LIB3069-040-Q1-K1-D9
actaaccaagtgctgcatcactataaacattaaaaaattaggacactatctttctcactagtacatttggatactattaccccacaccatcctctactattacacctccatattacgatacatcatacaaccatctatacaagacactccttttcgttccacatcctacaataacatcctatccctatctttctacatccccctctaactctctctcttcaacctcttctccatcatgcttacccaa

SEQ ID NO: 58214 - DNA, 250 bp, Zea mays
  Clone ID: LIB3069-040-Q1-K1-E10
acttggcgtatccttgcctgacatgtctagtctgactatcaatgggaaaaccttacttagagcttgcagagcacttgattttacagcaccaagtgcatcatgcacgaccactagatttctagctgctctatcaatgggcaaacacttgatctctgaagagcactcgatctgtacggcatggcacattggagtacaacattgaaatgctctgaaacaatgatggtccttcagaaataactagcaccgatgg

SEQ ID NO: 58215 - DNA, 430 bp, Zea mays
  Clone ID: LIB3069-040-Q1-K1-E11
atgctgctgtcgcatccacagaggacctgctgaagcccagctcaacatccaagtcgccagaccccaggcacgacgcccaagctagcactcaacctgcaggtacgggggtctccatgaagccggaaccggttattggagtctcaacaatcaagaaagaggactcctccttgacagaaggtgaggttgatggcggcaccggaagagtgcctggagaaacttgggtgcgatcaaagccaggctcaaatacctcatgcagggcacgcggctggaacatgagcgcagcgccaccttccgtgggtagtcaggcagatgaagctgcatcaaaggtgcaacttcacgcaggggtttagggtttagggccatctaacgcctgttgtggttgctgaattttgtgtcctgtggttacaggtattattgtcctgaataatga

SEQ ID NO: 58216 - DNA, 333 bp, Zea mays
  unsure at all n locations
  Clone ID: LIB3069-040-Q1-K1-C12
cccacgcgtccgcccacgcgtccggccatgacggagctcatacggaagccacacctgatgaagaagctgcaggaagaagtgcggcggaacgtgccggcggngcaggagatggtcaccgaggacaatctgcccggcatgacctacctcaaggccgtcatcaaggagacgctccgactgcacccgccggtgccgctcctgcttccgcactactccctggacgcctgcgaggtcgccggctacaccattccggccaacacccgcgtcgtcgtcaacgcctgggcgctcggccgacacagcggctactgggagcgcgagaacgagttcgtcccggag

SEQ ID NO: 58217 - DNA, 379 bp, Zea mays
  unsure at all n locations
  Clone ID: LIB3069-040-Q1-K1-E12
ggagcaaccgcttgcgtcacacgcacactgtcgggaaaatgatcaactgatatctggtcatgggaaaccgtgactggaggaagttgcttccggtcgtcaccgtctgcgangagcacggcgccggatgcggcgaaggaagtggcggagaagccggaggaggggaagaagcccgacgaggagggtggcgaggggaagaaggccggccccgccgccgagaaggagaagaaggcgaggaagccgcggagcaagaagcccaagtccgacgggccgcaccacccgacctacttcgagatgatcaaggaggcgatcctgtcgcacgactgcgggaaggtcggngcgagcccgtacgcgatcgccaagcacatggcggagaagcacc

SEQ ID NO: 58218 - DNA, 446 bp, Zea mays
  Clone ID: LIB3069-040-Q1-K1-E2
gattttctttatctgaaattgaaaatgctactgacaaatttgagagaagaattgggtctggaggctttggcatagtatactatggaaagttggctgatgggagagagattgcagtcaaacttctcacgaatgactcgtatcagggaatcagagaattcttgaatgaggtgacattgctttccagaatacatcatagacacctggttacattccttggttacagtcagcaagatggcaaaaaacatactagtgtatgagttcatgcataatgggacactaaaagagcaccttcgtggagctgataatgaaaaagataactagctggcttgaaccgtttgagaatggcgaagattctgcgaaaggtatagagtatcttcacaccggatgcttcccaacaatcattcatagagacctgaagagcagtaacattcttctagacaagaaca

SEQ ID NO: 58219 - DNA, 353 bp, Zea mays
  unsure at all n locations
  Clone ID: LIB3069-040-Q1-K1-A8
gttgacttgcaagattatgattactctctggacatgtggagtctgggctgcatgtttgctggaatgatttttcgtaaggagccatttttttacggtcatgacaaccatgatcaacttgttaagatagccaaggtacttggaacagatgggctgaatgtctatttgaacaagtacagaattgagcttgaccctcagctcgaagccctttgtngaaggcatagcanngaaacctggacannagttataaatgcagacaaccaacacctagtgtctcatgaggccatagattttctcgacaagcttttgcgttatgatcatcangacaggcttactgcacgtgaagctatgacaca

SEQ ID NO: 58220 - DNA, 451 bp, Zea mays
  Clone ID: LIB3069-040-Q1-K1-B1
agccaccgatcggcgtgccgcgtgcgtgaggcgatcggagcatcccgtcccgaggagggagacaaccggcgacgcggggggaacatggggaagacgccggtgcggatgaaggcggtcgtgtacgcgctgtcgcccttccagcagaaggtaatgccggggctgtggaaggacatcaccaccaagatccaccacaaggtcaccgagaactggatctgcgccacgctcctgctcacccccgtcgtcggcacctaccaatacgccatgtggtacaaggagcaggagaagctttcccacagatattaaatgcgctgcccttgacagacagcactcggagttttcatgatgggtttcataatcctcccatgatgatttaacatttgtttgatcaatttcagttcaacgccttttcatcgttccatatgcatatatggtatacgtgtctggcaaactt

SEQ ID NO: 58221 - DNA, 338 bp, Zea mays
  Clone ID: LIB3069-040-Q1-K1-B10
gtcgtccccaatcgtcgccgggagtctcccgatccttcttccaccacctctaccggtggtgccagtgccggctcgcggacggtgcttggactgcccccgtcccgtcatggatcgcgccgagctcaccaccgaacaggttctgaagcgagatattccatgggagcattacatgtcaactaagcttatctccggaacgtgccttcagctcttacggcgatatgaccacaaaccggagagccagcgagctcctttgcttgaggaggatgggccagcatatatccgagttttcctgaatatcctgcggagcatctccaaggaagagactgtggaatacgtgc

SEQ ID NO: 58222 - DNA, 331 bp, Zea mays
  Clone ID: LIB3069-040-Q1-K1-B11
gccacgcgtacgagccaagctccacttcaccgacacgctgcgctcgagcccgcccgagccgcccgctagatccatggcgcggctgctcccgtcggccgcggcagcggtcatcgtggccgacgtcatgatggcggacctgccgaacgcccaggcggcgtctgactcgccggctgcagacgacgcgccgtcgggcacgaaccacaccgttggccgcggatacgagcggttattggacggccacagcaacgccttgttcgaggactactgcgactggtacatccgcgagaccttgtacctcggggacaacctcattatcgagacgaacgacaac

SEQ ID NO: 58223 - DNA, 276 bp, Zea mays
  Clone ID: LIB3069-040-Q1-K1-B12
agagaaggaaaaatatccccaaaccctagctcccgatctcgatggcgaaccctcgcgtctgtcttcgacatgaccgtcggcggcgccccggcgggccggatcgtgatggagctgtacgccaacgaggtgcccaagaccgcggagaacttgcgcgcgctgtgcacgggcgagaagggcgtgggcaagtccgggagccgctccactacaagggctgcaccttgcaccgcgtcatccccgagttcatgtgccagggcggcgactttacccgcggcaacg

SEQ ID NO: 58224 - DNA, 439 bp, Zea mays
  unsure at all n locations
  Clone ID: LIB3069-040-Q1-K1-B2
gaggaagctgttgccatggtcaagcctatccaggacccccaggaagcagcaaacaagcttctcgaagaagcttcccgaaggggaagctccgataacatcacagttatcatcgtccgcttcatagacggaactaccggtgagaaatcaggcgacgacaaagagaccaccaacgaccaacactcctagctgtctcgtgtagggatccatcgtgctgtgtgttcttctggctgttgtacctgatgctcagagtagacactggctgctgctccgcaaggaaactgactcccccgaccgncgttcatgctcctggctggctcgctggccgnctcgacgggaacgctgccgcagaatgacgactggggctggtgttgntgttacagtatggtccttttctttctttctttctttcccctttcatccattaagctctgtgatgtaa

SEQ ID NO: 58225 - DNA, 388 bp, Zea mays
  unsure at all n locations
  Clone ID: LIB3069-040-Q1-K1-B3
cccacgcgtccgcggacgcgtgggtggcgtcggaggtggaggacgaggcggcgacgccgctgctcgccaacggtgcagccgacgtccgccggaggagggaccaggcgaaggcaattctgtccacgcaggccgtcaggatcgccaccaaggccgagcagcatgagcgcttcatctttaaggtcacacacttgctgggtgttcttggatttgggggattttgctatctcttgggtgccagaccacaggatgtgccatatgtgtactgcctgttctatgtcatatttgttccgctccgctggatttactaccgctacaagaaatggcattactaccttctggacttctgctactatgccaacacctttctncttgtaatgattctcttcta

SEQ ID NO: 58226 - DNA, 427 bp, Zea mays
  unsure at all n locations
  Clone ID: LIB3069-040-Q1-K1-B4
atccgtgtcgcagtgccacccatcgatccacaggtcgacgccggtgtgtcttgccacctttgccacaaatcaatctgcaggtctgtgttcttatcttcccttcttgcttctcaatctgttgactgccacaactncggtcttgttagatcccatggcagcgaccagtgagttcaaatgtttctgcttctacatctactgangccagtggcagcgaagactggctggagggaatggtcacagaatatcttgttgagacatttgctgattacttcggtgacgttaaaatgtatattgaagaaagaccatttcgaagatttgtggaagcttgcatagaagaaacaatcgtggtctatgttgatcatctnctttcccagaaagttgaaagtagaatgcggattctggcagatatgagagatctagcttcaac

SEQ ID NO: 58227 - DNA, 449 bp, Zea mays
  unsure at all n locations
  Clone ID: LIB3069-040-Q1-K1-B5
cccacgcgtccggccagctgcagggcacctagcgcgtggtcggcgagcgcgcgggcgggcggcagggggcgccgcggcggcgagcgcgcaggcccccactcacagacgactgggccggccttcactgctacttcggccccttcgtcgccgacgagaaccaccgcgtgctggttggaatggcaagtacagcatgctttgtgattgtcagtaagaatgacatcccaatctatgaggcagaagttggatctgcacccaaaaaagaagatttgtcttatcaccatcagtttattctgcatgctgcattagatgttggtcaggatctagcatggacaacaaatgcaatgttcctgaagtcagttgatagattcaatgaccttgtggtgtctgtttatgtaactgctggtcatacccagatcatgctgcttcatgactcgcgtancgaggatgga

SEQ ID NO: 58228 - DNA, 416 bp, Zea mays
  Clone ID: LIB3069-040-Q1-K1-B6
tctagatctgtcagctccttccacaaatagcctaatgacatcatttcaacacaatcgggataggcatcggcctgtgtgcatggaggaactccataaatcgctttccatcgtcttattcatcacttgtatagctggagctgtagcataccctgatggttctgaattattgtcccataaggcaatcccacagccgcaggattttccaagtgagcagctatatcgctcctacctggtaatccagcgcttcaagagcacaattaccagcgaccccaagaacgttaccgcattctggatcggcaatgatatctgcggagaagcgacctacgtgggtttctactgcggagtactgcctgggcgaagtaacaagctgacagtcacagcggtcattttgaatggatatagactacatgcaccga

SEQ ID NO: 58229 - DNA, 303 bp, Zea mays
  Clone ID: LIB3069-040-Q1-K1-B7
cccacgcgtccggtgggcctcagcgacgacagctatgcgagggggccgtatgcagcggcgcatccactgcagttgagagggtgcgcgaagaaggcgatctctccccaagacgcggctgacgacatagtgcatctcggcggccagccgtggaggcggggtgctcgtcagactgtgttccatcttatgataaaccctgacgatgtcgaggaatgtggaggcctcgttgctgatcgaggagccgccgtcgcccgaggtcggagagggagtggatggtgatgaaggggacgtcgtgctggtgagcga

SEQ ID NO: 58230 - DNA, 429 bp, Zea mays
  unsure at all n locations
  Clone ID: LIB3069-040-Q1-K1-B8
gctagctagttcgggcagcgagcggggtgagacggctatggcgtgctgctccgccgtcctgcaccatccgctgggcttctcactcaccccgtgctccgcctcccgagccccaccgcgcatccagcgcgtgggcgtggcaactacctcggccgnctncgcccgccctctttctcgcgccaggatctcaccgcgctgcacctactccggtggcgccagcgctgcccctggtcctggggagctacccgcggcggcgctccgacgggtccttgagatgccgggtgcgcaccangcgcncgnctgctacgacgcgctgagcgcacgcctcgtcgagcgcgccgagttcagggcctgctttacgagcgggttctcaatctctgccgcacggctttggattaccagatgttggtctcatctcgtacggggaaatga

SEQ ID NO: 58231 - DNA, 410 bp, Zea mays
  Clone ID: LIB3069-040-Q1-K1-B9
gaggttgtcctaaaaagatgctggcttgcacgctattggggcttagcagttcaaaatggtgtgtatcccgaaattgcggtatcaaagcatgaacattggtcatcattggctcctcttcctcttgaggttgttctttccgccggtcaaaaagctaaggaggaacctcgaaaacaaggtgacaatgttcaagggagaaataaacttgcacgagaaatgagtgatgtaatgggagaaggcaatatagagagcatgctttcagttgaaatgggccttagagagctttcttcattgaaggtggaagatgctgttgtagttgcagttggccaacatcgcagacctagcatagttcgtcagttcacatcagatttcaaatcacctggtgaacctaaatacttggagggcattgatct

SEQ ID NO: 58232 - DNA, 371 bp, Zea mays
  Clone ID: LIB3069-040-Q1-K1-C1
cccacgcgtccgcgacgaccgcgtcctctgctgcggcctcgacctgctccacttcttcacgcgcgactcctccttccagccggcggaccgcgccgccgtctcctcctcgtccccgctctccgccggcgcgagcaggccgtcgtgcacgcgccggagcctcgacgccgtccaggccccgcgctggatcgagttctggagcgacgccgcgtccgaccgccgccgccgcgactcctcgtcctcggaagcctccaccgcctcctcatcctcctcgtcgtcgtcgtcaggatgcccatcgccaccccggcggccaaccccgcggtgggtcgacagctacctcgacgagctggggtcaatgctgaaggaagggggct

SEQ ID NO: 58233 - DNA, 273 bp, Zea mays
  Clone ID: LIB3069-040-Q1-K1-C10
gatcaccggtcgcctcccttccgctcccctgactgcctaatccctacggtcaccccgaaagcgctcggtcgctcgctcgctccccgcgcccagagacaagcccggagaccatggcggaccagctcactgacgaccaaatcgacgagatcaaggaggccttcagactcttcgataaggaccgcgacagctgcatcacaaccaaagagcttggaactgtcatgcgttcactgggtcagaacccaaccgaagctgaacttcaggacatgatcaatg

SEQ ID NO: 58234 - DNA, 383 bp, Zea mays
  Clone ID: LIB3069-040-Q1-K1-C11
gggtgcttcccgatctacctgacgctgtaccagacctccagcgccggcgactacgaccagggcggctgtctgaagcgcttcaacgcgctgtcggcgcagcacaactcgctgctgcaggccaaggtgtcgagcctgcagagcaagtaccccggcgcgcgggtcatgtacgccgacttctacagccacgtgtaccgacatggtgaagagccccggcagctacgggttcagcaccaacctcagggcctgctgcggcgccggcggcggcaagtacaactaccagaacggcgcgcggtgcggcatgcccggcgcgtacgcgtgctccgacccggcgtcgtcgctcagctgggacggcattcacctgaccgaggcggcgtacaggaaga

SEQ ID NO: 58235 - DNA, 279 bp, Zea mays
  Clone ID: LIB3069-020-Q1-K1-G4
acccacgcgatgcgtccacgcgtccggacgagatgctcccctatcgttcggaggatgacatggagttggttgaaggaggtgcttgtccacaagagcacaactgctggcttcaggaacaggatggggcacaacagggcacgaggggaacaagaggacgggtacaggcaccgccgtggaggtcatcaagggtggcgagacagtgacacaaatgacagaccaaagaggaggaggtactgacctactgcactcacagcttgaccggctaatgaagacgacgtc

SEQ ID NO: 58236 - DNA, 382 bp, Zea mays
  Clone ID: LIB3069-020-Q1-K1-G5
cccacgcgtccgcccacgcgtccgctcactcgtccgcccacgcgtccgaacaaactggtgcggagggaaagattgtgagcaaggtctacttgtgtgagaaactgtctctcactaatgagatgtattttgccattacccttgataggaaaactgctggtccgctcattattgcttgcagcaagggaggaaccagtattgaagatcttgcggagaagtatcctgatatgattatcaaggttcctgttgatgtatttaaaggaataacagacgaggatgcagctaaagttggtgatggtctagctctaaagtcagcggataggcagtcttctatagaacagattaagaaactgtatgaacttttctgcaagtctgattgcacatt

SEQ ID NO: 58237 - DNA, 286 bp, Zea mays
  Clone ID: LIB3069-020-Q1-K1-G6
cacacaccccacctacctacctagctagctggagtaggaagccggccagcaaggaaggaatacctcgtggcaatttcgtcccctcctctcttggattcttccatggaggagcaaggtgagcgacacatccagcttcagctactgctcctccctgcgcctgcaggtcatcatcaagtcctgcgtgacgtaccggcggcggtgccagccagcgccgtggagcccccccagctggaccttgatctgaccatgaacattgggcccaggccggattcaacgggccaaacac

SEQ ID NO: 58238 - DNA, 298 bp, Zea mays
  Clone ID: LIB3069-020-Q1-K1-G7
agaccggaggagcccactcctgcatgtaactcagatactccacccgagagtccgcaccaagttacattacaccttaactttcacttcagaagaagaaagccgaaccggattcccagaagccttgttccttgggttcttcttccgtgggccgttgggccgccggccggggttgttgggccaaaacccgaatgatttctgggaacatgtgttcaccggggctgaccgcaatggggcctttgtccgtggccatgttcctggggtacgggtcggtccggtgggggggcattttaacggggga

SEQ ID NO: 58239 - DNA, 429 bp, Zea mays
  Clone ID: LIB3069-020-Q1-K1-G9
ttcttttctcctttcccttttatcagttgtaggcgcacttgcacacccttacttggcatgacttcatgacataagtgatgagccaggctgctcaatgcccttcagctttgacttcgagcagcatgcattgtctgaagaacaaatgaaggatcttatctaccaagaggctcttgcattcaaccctgattatcagtagccaaagttcaatttcagccggtgattggcttcattgacatggagattttttccccacctgatgtcagtgcaaaaagtcaccaactccgattgctagctgtaaataactgccttacctgaagatactccattcctctgattaaaagctggtgacggtgtcattaagggtagaaaagaacgagcttgtgaaagtcaaatttctgcgaagccatggatttctgtgcttacaaatat

SEQ ID NO: 58240 - DNA, 417 bp, Zea mays
  Clone ID: LIB3069-020-Q1-K1-H1
gagaagattgacgtctattcgtttggaattgtcatgtgggagctgcttactggggaagagccatactctgatatgtgtgctgctgaaattattggggccattgtaaacgattccctatgccctcaaatcccttcatggcgtgatcctgagtggaagggattgatggaaagctgttggtccagtgatccagccgagagaccgtccttcactgatatatctcaaaggttgaggaaaatggccgctgcaatgaatgtgaagtgaaggttcggaagccatatttgtcttgattttcttagtcccagctgtcatttgccttgtgtcgaaaataactatgctactggtgctggggttgcatttcaccataccattgtacaagaaggtggtgttagcgacttagtactacgatatgctcaattt

SEQ ID NO: 58241 - DNA, 400 bp, Zea mays
  Clone ID: LIB3069-020-Q1-K1-H11
gtagagagaaggaaaaatatccccaaaccttagctcccgatctcgatggcgaaccctcgcgtcttcttcgacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttgcaccgcgtcatccccgagttcatgtgccagggcggcgacttcacccgcggcaacggcaccggcggcgagtccatctactgcgagaagttccacgacgagaagttcgtgcgcaagcacactcgccccagtgtgctctccatggccaacgccgggcccaacaccaacggcttccagt

SEQ ID NO: 58242 - DNA, 391 bp, Zea mays
  unsure at all n locations
  Clone ID: LIB3069-020-Q1-K1-H2
ctgccaggtctccctgtccccggctctcttgcttgctgttccagtcctcgcgcgcgagagcgccgccccgtgtgggccctagatcccgatggcctcgcgccgtcgcaccctgctcaaggtcatcatcctcggcgatagtggggttgggaagacttccttgatgaaccaatatgtgaacaagaagttcagcgatcagtacaaggctacgatcggcgcggatttcctcaccaaggaagtgcagttcgaggacaggctcttcactctgcanatatgggacactgctggccaggaaaggtttcagagtctcggcgttgcattctaccggggagcagatnngtggggcccagtctatgaaggtcattctatgaaatcatttgacaaccttgacaac

SEQ ID NO: 58243 - DNA, 329 bp, Zea mays
  Clone ID: LIB3069-020-Q1-K1-H4
cccacgcgtccgggaagaaagacgtagaatattggatgggttcagattaaaaaggcagtgaagctcgatggatgcgtgtgatgattatataaaggacattataaatcaatgggagcaaaggaaaggaaaggaaaggaaagggagaaaatttcatatagcaattgtttcgcgtataggagggagaacaaaggtcgcgtctcgaaagttcttgccttgttgggaagggatggcgtcggaggtggaggacgacgcggcggtgccgggcgcgccgctggtcgccaatggtgcagccgacgtccgccggaggaaggatcaggcgaaagcgattt

SEQ ID NO: 58244 - DNA, 403 bp, Zea mays
  Clone ID: LIB3069-020-Q1-K1-H5
ggaaggggtggcaccattggtctttgccacgccttaccacgtgcagctgtgggccgtctctcgccagttgcagtgagcgtcaatgacgacagagctgcagttcaatgcattgcggaacaaagatttgtccgtgaagtgactatacagtacaatctgtgcaatgagccatggttgaaatatagtataaacattgtggcagataagggattgaaaaagtctctttatacttctgctagactgaagaaaggagaagtcatatatttagaaacacacattaatagtttaaacaggtatgagctttgctttagtggagacaagccttgcattattggatcaagctgcaatgcatctgaatcagaacagagaaacaccatagcgggagtcaccattctcagaatggtga

SEQ ID NO: 58245 - DNA, 389 bp, Zea mays
  unsure at all n locations
  Clone ID: LIB3069-020-Q1-K1-H7
gttctcgtgagaacattctttctggtgtttctgatggacagatcaacttgcttcatgagaggcagcgtcgtcgtcgtgtgaggtcaagcaaagaacccattgagatgaatctcaaccacatagaccactcaaatcttcagcttgataatactagtgaccttggaggtttaaaaccaaacaagttacctcattggcttcaggaggctgtacgtgctccttcatctaagccacctgaacgtgagctaccagcaacagtttcggcaattgctcaatcggtgtgccttcttcttggagaacaagaaccatcaatacctncattcttgatcccgggaacccctctttcttgcccaaaagatccaatgattaattcaaaagagaaacttcgcaag

SEQ ID NO: 58246 - DNA, 74 bp, Zea mays
  Clone ID: LIB3069-020-Q1-K1-H8
cgccgccttcgcggaccgccgccgttccgttgctgcgaaagtctcgtcgccctcgggcattggcaccggcatgc

SEQ ID NO: 58247 - DNA, 408 bp, Zea mays
  Clone ID: LIB3069-020-Q1-K1-H9
cccacgcgtccggttctacgtccgagtcgtcgcatcaggtcccctcgattcgccggcggcggcgccaccaaccaagctcatacatctgaattgactagtccaactcagggatttctttggggaccaatcaaactcaagaactaagtttcatgtctgatctcgacgtccagcttccatctgcttttgatccgtttgcagaggcaaatgctgaggactccagtgctggtgctggatcaaaggactatgtgcacgtgcgtattcagcagcgcaacggaaggaagagtctgacaactgttcaaggcttgaagaaagagtacagctacaacaagatcctcaaggatctcaaaaaagagttctgctgcaatggtactgtagtccaggatccagagctaggccaggtcattcaac

SEQ ID NO: 58248 - DNA, 455 bp, Zea mays
  unsure at all n locations
  Clone ID: LIB3069-021-Q1-K1-A1
ggagacgacgcgagcggcgagaacggcgacgctctgccagcggtggcgaagacgccaaagaggaggacgacgctgcagagccagctgagcaagtttgaggacgaggacagcgagaaggcaagagcagccgcggatgcgatgagtcctgtgcaagatggattgttgataagaaaaccgccagacatgaggtttccatcaagaagaaatgtgcctatgtctgctgatccagtgggccatctccacaatggcagcagtttcgatgccgtctcagtgtcgggttcagatggaagttctgggcgatatacccccaaaattagcgcaagcacacacaactcatttcttcaggatagtagcaatgctctctcgccatttgccaacaatcgcaccgtgaggaacccattgaccagttctggtgactggtcangaagctcagctcctgatgctagtacggatgg

SEQ ID NO: 58249 - DNA, 297 bp, Zea mays
  unsure at all n locations
  Clone ID: LIB3069-021-Q1-K1-A10
cttgagaggatctatgaatcggaccgcttgtaggaagaggtagagctgcttgctacatccgccatgcatgaattccagtccaacaataccggaagctatctggatgtcttcaagtcgaaagaattgaggctagctttctttgctggggctggtcttcaggccttccagcaatttaccgggatcaacaccgtgatgtattacagccccacgatagtccagatggctggtttctcctccaacaggctggccttgctcctctccctgatcgtggcggccatgaacgccgncggaaccatc

SEQ ID NO: 58250 - DNA, 322 bp, Zea mays
  unsure at all n locations
  Clone ID: LIB3069-020-Q1-K1-G3
cgacaccaacccagcggcgatccgggcctttctctcccgcctcctcgacaccacccggcgcgcgctgtcgggcgcccgcccctggtccgagctcgcggaccgctcggctctctcccgcccggagtccctcgccgaggccacgtnccgcttgcgcaagaacctggcctacttccgcgtcaactacgccgncgtggccgcgctgtgcctcgccgcggcgctcctggcgcaccccttctccctggccgcgctgctggcgctgctcgccgactggtgcctcctctacgtgctccagcccgncgacgcgccccccgtctccgcgttc

SEQ ID NO: 58251 - DNA, 485 bp, Zea mays
  unsure at all n locations
  Clone ID: LIB3069-021-Q1-K1-A11
gacccacgcgtccgtttgtgttttcatgtgcttcaaggtgctaggtaagaatgcagacgaggaaaccataaagagaacctacagccaagttctatcaccctgatggcccagaactcatgttttgctaagtcttctccacctaagtcctcaaaaatttgaacaaggccatattatcagataaaagcagatgtagctttcataggacttagttccagcaaagcaaaggttgacattgcaccaaacaatagcgtctatacttcattcttatggcttggagaagcctatgcaacatgacaagccagatgacatgtagatgagaaggttctgcatcaagagaaaccaaagcaaaatctttgcatcaagagagcaccgatgaaaagctgatgtagaggccagttgacaaacttatggaagaccagctgaccaaataatngaaaatctattgaactatgtatcaagttcattaatttgtgtaattctgaatg

SEQ ID NO: 58252 - DNA, 433 bp, Zea mays
  Clone ID: LIB3069-020-Q1-K1-F1
gaacttaccaaatatgatgttgtgcttactacatattctatagtaagcatggaagtaccaaaacaatcaaatcctgatagtgatggagaagagaaagggaagcctgacccgtatggtgcacctgtgtcctcttcagggagcaaaaagagaaaggcatcctcttctaagaaaacaaaaaataaaagtgttgcagagagttgcttgcctgaaaaacctcttgcgaaagttgcttggtttagggttattcttgatgaagcacaaagcattaagaactaccgaactcaggttgccagggcttgctggggtttgcgagccaaaagaagatggtgtttgtctgggacacctatacagaatgctgttgaggatctctatagctacttcagatttctcagatacaatccttacgctgtatataagcagttttgcactctga

SEQ ID NO: 58253 - DNA, 424 bp, Zea mays
  unsure at all n locations
  Clone ID: LIB3069-020-Q1-K1-F10
cccacgcgtccggcacaagcatagtgcatgggcttggcacctaagtaaggcctgagagccatggcatccaaggccgtcctcttcttggctctcaacctcctgttcttcacggtggccaacgcctgcggcagctgcccgaccccaacgcccccggtcgagccaccgccgccgcctcctgctgctaccccacccccttcgtccagcggcaagtgcccgctgaacgcgctcaagttcggcgtgtgcgccgatgtgctcggcctcgtcaaaggcgaggttggcaaggtgcctgccgagccgtgctgtaccctcatcaaaggccttgcggacttcgaggccgncgtctgcctctgcacggccatcaaggccaacgtgctcggcgtcgtcatcgatgtccccatcaagctcagcgccctcgtcaactact

SEQ ID NO: 58254 - DNA, 79 bp, Zea mays
  Clone ID: LIB3069-020-Q1-K1-F11
cccacgcgtccgtcacatgcatagagcaatttcttttcacgtacatacggacttacagcgacaggatcaaataacgcac

SEQ ID NO: 58255 - DNA, 407 bp, Zea mays
  Clone ID: LIB3069-020-Q1-K1-F12
cgggatctcgcatggtgggttcctgacaacacatctcatcggtcaggctccggacaggttcgccgtggcagctgctcggaaccctgtctgcaacctgtcgctgatggccggcaccaccgacatcccggactggtgttacgtagtggcctgcggaacccaagcgaagcgatacgcctctgaagcgccttcgcccgaccatcttcgtctcttctaccagagatcgccgatcgcccatgtctctaaagtcaaagcgccccttcttatgcttcttggcggagctgaccttcgagtgcctgcttctaatggcctacagtacgcaaggagcctaatagaaagaggaggcgatgtcaaaatcatgatgttcccagaggacatacacgaaatcaatttaccgcggtccgatttcg

SEQ ID NO: 58256 - DNA, 336 bp, Zea mays
  Clone ID: LIB3069-020-Q1-K1-F2
cccacgcgtccggagagggtcaagttggtggacttgcaccccacggaggcatggatgttgagcctgtactcgaggagtgcctgcatccgggattatcacacacagtcaatttgtaggagaggggacgccatacatcaaagatgactaaagaagaggaagatgaagaatacctcgaagaggaagaagatgcccttgctggtgcaggggggaacacatttagtttcacaaccttcatgctcttaacccctctgatcctggggcgtggcagattagactccgatggggaagtcactagcgaggtggatcaagttcgtgctcttcaggaagaagtcgtca

SEQ ID NO: 58257 - DNA, 468 bp, Zea mays
  Clone ID: LIB3069-020-Q1-K1-F3
gccgccctttcttggatattggagttagctccattaaactggtatatcttattttcagcgtctaagacaaacacatcatcatggtttaatgatgaccgggcaaagggaacctctttaacccgaatagctctcttccctctgcaaatatacaaccgtgtttcaaacttctcctcttcaggctttttgaacccagaggcgaaaccaccctccaaaggtataatgcaaggcttgaagtatgacaagaatttgtcagattcataaccttggagttccctatgttggattgcacgacccccaaggatggcatcaagttcaactgtcttgattgctgcagtcccagcttcatcctgcaatacaaacagtcacaaggaaggctagaactagtacacataataaaacagaatttaagttcacaagtgtgtacttgactcggatctttcccaatccagaagtggatatcatatagat

SEQ ID NO: 58258 - DNA, 449 bp, Zea mays
  Clone ID: LIB3069-020-Q1-K1-F5
cccacgcgtccggcatcatgtcagaaatgctgtcgagagtttggtttacttgatgttgcctctgagatgcctgtgcggaattttgaggtaattggttcatgggagacaagctcctcgtctcaagtttcttccatggtaaccttccaagtacaggatggtagggtgacatgtgataggtgcaagattgcgtctttgtcaataccattttgctccatgcttaatggaccgttcaatgagtcacagcttgagcttgttgatttgtcagagaatggtatttcgttggagggcatgagagctgtttctgagtttagttctacatgtagtttaggggatcttcctgtggaaatcttattggagatcctggtgtttgcaaacacattttgttgtgacaggctaaaagatgcttgtgataggaaactggcttcatttgtttcaacaaggcaagatgc

SEQ ID NO: 58259 - DNA, 371 bp, Zea mays
  Clone ID: LIB3069-020-Q1-K1-F6
cacaaacaacacccggcggccaaactagtttagagcgctgactgctccaccctccttgctgcttcgctcgccttggtggacaccgcaggccgcagcgcgtagcttgtaacgtttccggaggccgacatggagcgtggccgcagcagcacctcttcctcttgccggtccttgctgctcctcctactcctcctagtctgcttctcccacggcgcggcggtggcggcagcggctgctcggcttctgactacacctgaagcagctgctggcgatcctcctctggctcttcgccaagcggagagtaatggcgccacggcggcagctgccgacgacggcctcgtgatgactgaagaaagtgacgctgacgccacgag

SEQ ID NO: 58260 - DNA, 423 bp, Zea mays
  Clone ID: LIB3069-020-Q1-K1-F7
cccacgcgtccgatgaagtgaagcatttctttgagggaacatgtggtgaagtttctcgtgtgaggctacttggtgattatgtgcactccacatgcatcgcttttgttgagtttgtccaagcagatagtgctattctcgctctgaactgcagtggcattgttcttggaacgcttcctgttagggtgagcccatcaaagacaccagtccgctcgcgatcgccccgtgtgacgtcatactgaattcggctcatctgaagccgtcgtccagggcagcaaatttctgggcaacaaagccctagtcgtgtggccttagagactgccgcatcgcggataagtaattgtcgttgagcagagttctcgttggttaaagtccagtctagtaggaggcgcagagacccgtctgtattgtcgctgggaagatcta

SEQ ID NO: 58261 - DNA, 270 bp, Zea mays
  Clone ID: LIB3069-020-Q1-K1-F8
gtaggtttgaccagctcccagattttcatatggagacgcagtgaaccaagaagcagtatggaatctggtggagcctcattcaatcatgggttatgcatgaggtgtggattctgtttttattattagttaaggtagaagagctgaaccatacaaacaacacacttgcaagcctataggagatcaataggaaggcagccggaggttagaccattctagcatacgaaaagaagttccagtattacaagaatggtatgcaactaagatatgcac

SEQ ID NO: 58262 - DNA, 401 bp, Zea mays
  Clone ID: LIB3069-020-Q1-K1-F9
cccacgcgtccgcccacgcgtccgctctctctctattcgttccccgcctcaccccgagccagccgtctcgctagggtttcgccgccgccgccgccgccgccgccgctatgcctcgccgcagctcaggaaggtctgccccacgcccagctccccgtgctgctccagtgaggaacccgccacagccagcacgccaggctcctactacagctcctgttcgagatggtggtggctccatgtttggaggaattgggtccaccattgctcaaggtatggcgtttggcacgggtagtgccatggcacacagggctgttgatgctgtattagggccccggaccattcagcatgagactgttgcctcagaagctgctgctgctgcccctgccctgcagtgatgaatgctg

SEQ ID NO: 58263 - DNA, 403 bp, Zea mays
  unsure at all n locations
  Clone ID: LIB3069-020-Q1-K1-G1
gagatccgaaattcagaagcgaggatggctacgaccgcgactaggcggtggtggaggcggcacgaaggcggcgacgatgacccagacgacctcgtccccatggacacccaagagcaagaagagctggtccggtctctggaggctaagcaggcgcagcaaggccgccgttggaggcgcgtcttcgcggggttcctcctaggttacgcggccttccttgtctactccagtttccatcatgcttggtctccctgggagctgcggtaccatgcttacttcatggaagatttgcctgcaccaatggtcataattgcaggtttggtatttccttcaactatttagtttgagtttgcaaagttgtaaacaaatcatgtgttgatgcttctaactgaattattntggatct

SEQ ID NO: 58264 - DNA, 420 bp, Zea mays
  unsure at all n locations
  Clone ID: LIB3069-020-Q1-K1-G10
ctccactcatcttttcgcgtttagaacctttaaaatttcccccactcgccagtcgcagcagcacctgtagccatggacgccagcggagccggtagcaaggggaagaagggtgcggccgggcgcaaggcaggcggccccaggaagaagtcggtgacgcggtccgtcaaggccgggctgcagttccccgtcggccggatcgggcgctacctgaagaagggccggtacgcgcagcgcgtgggcactggcgcccccgtctacctcgccgncgtcctggagtacctcgccgccgaggttctggagttggcagggaacgcggcgaaagacaacatgaagacgcgcatcatcccgcgccacgtgctcctggcgatccgcaacgacgaggagctcgggaagctgctggcaggcgtcaccatcgcgcac

SEQ ID NO: 58265 - DNA, 424 bp, Zea mays
  unsure at all n locations
  Clone ID: LIB3069-020-Q1-K1-G11
gagcaaaaacatttcagtctcgttatggcataattatacacatgtttcattgagattaatgtattttcactgtagtttaacaatcgcaatctgctgccactatccatcatgcagcaacaacaaagcctttgtcagtggcgaaagcaggacagaaatttaagtgggaccaaacaaaatcgcaaagcaactagacaagaccgtgaaactgatctctggtggatgtggacgcactaaacatggaaatggctcactatgagtggcattntaccatgaaatagtgaaaaggataatgagaaagaaagcactcatgtcgaagtgtttgagcagactagttgtggtaactatatctcgtctagcaaccataccagtaaaatcatgaaatgttgatggctgataagaattgtggtgcacctttacaatcaat

SEQ ID NO: 58266 - DNA, 378 bp, Zea mays
  unsure at all n locations
  Clone ID: LIB3069-020-Q1-K1-G2
aagatatgaacgtggcattagtccttgattaagggcttgcctctccaggggaggagtaccgtgtgttctatgcagagcgtagcccttggtggcttactataaaagcaacgggcgcaccagggcacggtgcgaagttgtatgatggtagtgcaatggagaatttgatgaagagcgtggaggctattaggagattcaggacatcacagtttgatctagtgaaatctggagagaaggctgaaggagatgttgtatcggtgaattttgcgtacctgaaggctggcacacctacaccaacgggttttgtcatgaatcttcaaccatctgaagcaaaggtaggtcttgacatccggatccctnctaatgcccatgtggaagcac

SEQ ID NO: 58267 - DNA, 290 bp, Zea mays
  Clone ID: LIB3069-020-Q1-K1-E9
cgttctcttccccatcctcctcctcgtcatctccagtcgtcttcagcccttcaccacaggcaggcccacctcccaccaccacatttcttctcatccaaccgccccgtaggatcacagagaagggggatggcgagcggcggggcggtgagggatgtgggctcgcctgcggagctggaggcggcggtggccggggcgcgggcggcggccgtgcacttctgggcgtcctggtgcgaggcgtccaagcagatggacgaggtcttcgcgcacctcgccgtcgacttcccccacgc

SEQ ID NO: 58268 - DNA, 285 bp, Zea mays
  Clone ID: LIB3069-020-Q1-K1-D12
cccacacgtgcggaagaagcagaactcaatatgctgagaaagagtttgaacttcaaggcaacaccaatgccaagcttctatactgaaccaactgctgtcaaggttgaattgacaaagatacccccaacaagagccaaatcgccaaagattggccggtctaaaaacaagtccacaccatatactgacgaaaatgctaccgcagaccagactgcccacctgaacctcgatgagaatgttgctcaaaccggagtgaaaaaaccaaccccgttgaatccaccaaagaag

SEQ ID NO: 58269 - DNA, 422 bp, Zea mays
  Clone ID: LIB3069-020-Q1-K1-D3
cgaagaagccccaagcaagcgacactcttgtcctctccgcgccagatcgttgtttatgagctcgaaggagaagcccactcttggaggcacgcggattaagacccgcaagcggaacattgcagctcctttggaccctgcatcattctctgatgcaattgtccagatttatctggataatggtggagatctggaactcgtcgccaaaagtattgagtcttccgacctcaacttctcacgttacggtgacaccttttttgaggtggtttttgttggaggacgcactcagcctggcactgtaaaacctgaagaaggagaccgtcacccttattctatgttagattgtgtggcacagcgtgaaacaattttgcctttcgtactctatatccagaaaacattgcgcaggaagcctttcttaataaaaa

SEQ ID NO: 58270 - DNA, 425 bp, Zea mays
  Clone ID: LIB3069-020-Q1-K1-D4
gcttttgctttgctcaccagacaaacagctgcttatggcgtcgacgatcatggccgtcagctggcgcatcgtcgcggccaagacgccgtttcttggccagggtcgcgccgccgccgacgtcgccaatgccagccccctccgcgacgtcgccgccgccgctgctggcggccggatcaccatgggcaacgacctgtggtacggcccggaccgcgtcaagtaccttggccccttctgccgccagacgccctcgtacctgaccggcgagttccccggcgactacggctgggacaccgtcgggctgtccgcggacccggaggcgttcgcgcggaacagggcgctggaggtgatccacgggcggtgggcgatgctgggtgcgctgggctgcatcaccccggaggtgctggagaaagtggtgcgcgtggact

SEQ ID NO: 58271 - DNA, 451 bp, Zea mays
  Clone ID: LIB3069-020-Q1-K1-D6
ctccgcttttactagatcatcagtagccatctcaggagccgagcctggtcagggtagccaagcccatcccggtcctctcccggcgtcttctccctccgcaccgcggctccggcgatggcgggcgtcggctccgcgctgcgtcggctctacctctccgtctacaactgggtcgtcttcttcggatgggcgcaggtgctgtactacgcggtcctgacgctgcgtttgagcgggcacaaggccggctatgccgccgtcgagaggccggtgcagttcgcgcagacagccggcatcatggagatcgttcatgggctcgtagggctggtgaggtctccggtctctggaactcttgcacagattggatccaagttgatgcttacgtggggtggcttgtggagttttcctgagacccagtcacaccttcttggtactaccctggtcataagctggtcta

SEQ ID NO: 58272 - DNA, 409 bp, Zea mays
  Clone ID: LIB3069-020-Q1-K1-D7
gtttcaagaaggatgacaagcagctggatgctgatatccatcgcaagtacatctatggtggccatgttgctgactacatgaggaacctcgctgaagaggagccagagaagtaccagtctcacttcagtgagtacattaagaagggaattgaggctgatgacatggaagctctgtacaagaaggtccatgctgccatccgtgctgatccttctgtggtcaagtcaaccaagcagccaccaaaggagcacaagaggtacaaccccaagaaactgacatacgaacagaggaaggccagtctcattgaaaggctcaaccaactcaactcctcgggcggcgcagatgacgacgatgaggatgacgagtaaagtttggtcccatcgaagtagtgctatcttatgcggcgatcagt

SEQ ID NO: 58273 - DNA, 357 bp, Zea mays
  Clone ID: LIB3069-020-Q1-K1-D8
cggacgcgtggggcttaaataaggcatcatctaaggcagatgagggctcctccattttatgctcactttccctatccatggtggcaacgaagcttaatctttctggttcagatattgtagatgatgaaccactgtctctctctcttgggctccctagtgttgtcggtgggagagcagatcaggagatgaagcaattcctgccggagaagccaggcataaacacttaatgcccctttagatttgcgagtgtacagttttgtgcagctgtattgagtttagacagggttgaagtatggtatagctgataaattatggatatttttcattttttttcaaaaaaaaaaacttttaaaaagg

SEQ ID NO: 58274 - DNA, 328 bp, Zea mays
  Clone ID: LIB3069-020-Q1-K1-D9
cccacgcgtccgggtgaagcagctccaggtggaggctgccgcctcttaaaagtctcttaatagtgttgccaaacagctatttgtcagatgagctttgtgccatttcctcattagaagtatatcattcgatccattggggatctgtgaaccatgtacctgtttatgtaacttttttttttttcgaaagagcgcaggaggactgcgcacccatatattaaagtagagggaaaataaagggccataatgatgatatccatctatctatctatgtaactggtttatgtaccatgtacctgtttatgtaactggttaccagtgttatccatct

SEQ ID NO: 58275 - DNA, 386 bp, Zea mays
  Clone ID: LIB3069-020-Q1-K1-E1
cccacgcgtccgcaccaggattcccttcatggttcaagggagttctgcacggagatagagctactatcaagattgcatcatcgcaatttggtttcattggttggctattgcgatgaagaggatgagcagatgctggtttatgaattcatgtcaaatggcactttacgtgatcatctttctgccaagtccaagagacctctaagttttggtttgaggttgaaaatcgcattgggtgctgcaaagggaattttgtatctacatactgaagcagatccacctatattccaccgtgatgttaaggccagcaacattctgttggactccaaattcgttgcaaaggtagccgattttggtctctcgaggcttgctccagtgccagatgtcga

SEQ ID NO: 58276 - DNA, 322 bp, Zea mays
  Clone ID: LIB3069-020-Q1-K1-E10
tgatgctgttgcagcatgccgcgctctagtcaatcttcttgaagatcaaccaactgaagagatgaaagtggtagcaatatgtgccttacagaatctagtcatgtacagccgagcaaataagagagcaattgcagaatccggtggtgttcaggtcctgctggatcttatcagttcaagcaatcctgacacttctgttcgggctgcaatgtttgtcaaacttctattcaataaccatactatccaagagtatgcaaccagtgaaacagtcagagttataactgcttctattgaaaaagatatatgggcttctggaagtgcttac

SEQ ID NO: 58277 - DNA, 398 bp, Zea mays
  Clone ID: LIB3069-020-Q1-K1-E11
gaccgacgcgtccggaggctgttgcaatatgcctcgctctagtcaattttcttgaagatcaaccaactgcagggaggcgtgtgttagaactatgtgccgtacataatctagtcatgtacagccagcgcagattagagagcaattgcagaatccggtcgtgtacaggtgctgctggatctgatcagctcaagcaatcctgacacttgtcttcggcctgcaacgttcgccaaacttctattcagtagccatactatacacgagtatgcaaccagtgcaacagcctgagctataactgctcctattgaaaatgatttatggtcgtaccgaaagtactaacgaggagtatctcagagcactcaatgctctgctgaataacttccgtcgtctgagggtcactg

SEQ ID NO: 58278 - DNA, 396 bp, Zea mays
  Clone ID: LIB3069-020-Q1-K1-E2
aaaagagcgaacacgagcacgaacacaagtgcagagcagccaagcgccacacacacgccgacgcgaaccaaccaaccagctggtagtaggttcgccgcgctgacgatgatgcctcgccgcgcccttctcttcgccgcggtgctcctcgcggcctccgccgccgcggtctccgggttccacctgggaggggacgagagcggtctcgtgaggggtgtgctcgccgcgctccgggagggaaccgaagcccaggacgccgctcgcttcgccgtcggccactacaacaagaaccagggcgccgctttggagtttactagggtgctcaaatccaagcggcaggtggtgaccgggaccctgcatgacctgatactggaggcagctgatgctggaaaaaagagt

SEQ ID NO: 58279 - DNA, 429 bp, Zea mays
  Clone ID: LIB3069-020-Q1-K1-E3
aaacaagggcatgttcaggctgtcattgttggtgctgatcgaatagcagcaaatggtaaatgtccacatcatttctgtgatcaatgtataactaaatattcctactgttaaatttgtttcctttatgaaattgcaaggtgacacagccaacaagattggcacatataacctcgccatctccgcgaagcatcatagcgtccaggtctatgtggcagcgccggtaacttccattgatctctccctcccatctggggatgagatagtcatagaagaaagatcaccaaaggagttgctgaactctgaaggtggtctgggaaagcaagttgctgcatccggtatatcagtctggaacccagctttcgatgttactccagcaaatctgatcactgcaatcataacagaaaaaggtgtgatcacaaaaactgatgc

SEQ ID NO: 58280 - DNA, 394 bp, Zea mays
  unsure at all n locations
  Clone ID: LIB3069-020-Q1-K1-E4
tcggcctgtttatgtcaaggacgacttctttgttttcctctctagtggaacgtttggacgtggagggccaaatggaaggggaagaccttctgaacggcgcagagtagacacagagacgtttggtgaatttccgaggcacaggcagccctaccgtggtggcggccgaggctaccgtggcggtgggcgttcccgtgggtcatattacggtggcagaggctatggaaacacggggaggggtggccctgggaattcttatcctcactggggcaatgggagagattgattatagcagcagcagccatacttgcgggtgttgtagtcttttgccacatgcatgaagcgcatccattactatntaaacaaataatggaaccttaccaccatgtcactcgtc

SEQ ID NO: 58281 - DNA, 356 bp, Zea mays
  Clone ID: LIB3069-020-Q1-K1-E5
cggacgcgtgggtcagatacgaaggttgtttacacagagcaattcatttccacccgcgcgataagatggaagtcagaaccatgtagttgttttcgtttgtaattttgtttctagagtgtaagatttgacaaggctgttagtttgcacctcggatctgcttatatccacagggcaacctatagttcagcaagtattgagctatacatatgtcccgagaagattagatagatgagttggcgtcttggcgatcgatgtgggcttttgccgttgttgttccttgcaatttatgttcgaaaaaaagaaacatgttcgcttttaaggtttacgatacggtatatattattcttggaagtgtt

SEQ ID NO: 58282 - DNA, 362 bp, Zea mays
  Clone ID: LIB3069-020-Q1-K1-E6
gcttcgcagccagcactcgccacctgctgggcaatgtgctgccctccgtcgaaggctactacgggaactgtgtgtacccaggtggtctcaccaagaccagccaggaggtgaaggaagcttcgcttgtggagattgtgaccgcgatcagggaagccaaggaagctctgtcatcgaggttccttgactggttgagcggcggcgccaaggagaaccactacaatgtgtcgctagactacggcaccctcgtcgtgactgactggagccatgtgggcttcaacgaggttgactacgggttcggtgagccgagctacgtgttcaccctgaacgacgacgtgaacatcgtccccttcgttgtgtacctg

SEQ ID NO: 58283 - DNA, 340 bp, Zea mays
  Clone ID: LIB3069-020-Q1-K1-E7
cccacgcgtccgtttttttttatttttttttttttttttttttttcactgttatttgggacttgataaataatactcatacattcgggaggcaagttacactgaagtacaacagcaaacgtagagacgacatccggatcttgttgctaccaaggcctaataataatacaagtgcatcaaactgaaaattccaagtttcttcccaaaacaaggcaactcaaaagtctagcatatattatatgtctgctaaaagcttctccatctattcatttccatagcaaccctactgcctgacttccaacaaaaaagaaaattaacgaaagataaagcaactaatgggc

SEQ ID NO: 58284 - DNA, 157 bp, Zea mays
  Clone ID: LIB3069-020-Q1-K1-E8
gctgagtttgggtaaggaggatgattcgtttcctatgaagaattcaacggttcagagcacggcagcccttattgagtgcaaatgtgggatgcctttgtgtatatgtgaagcaccaaaaccagaaccttcttctacacctgttaagaatatcaacacc

SEQ ID NO: 58285 - DNA, 446 bp, Zea mays
  unsure at all n locations
  Clone ID: LIB3069-020-Q1-K1-D11
agaacacagggcacacgcactacacgcacttcacgcagatacatatagagagaggttagctatagcttgcacatctatttaactaactaactaactggctagctagctcgatccgcagagcaaagcgaaagcagcaagaagcaaagcaatggagaaccctgcgagtgtgctagttctaccagcgcagttcaccaaactcaccttcggaaacctgtacatccgccgggccgggccgggcagcagggagataaccgaggagggcaggtgcgacctggacaggagatacgtgagtaacttccacgtctacgacggccgcggccccgacgccagccttgtggcccgcgtgcaggggatcaccagcgaaantcgggacgcgcaccaacttgtcgtcgatgtgttcgacaccgacaggctcaaggggctcacgctcgtcaccaatggcgtga

SEQ ID NO: 58286 - DNA, 459 bp, Zea mays
  unsure at all n locations
  Clone ID: LIB3069-043-Q1-K1-A9
cggacgcgtgggctccgccagtacgacggttcagaccctaagaagccgctcctcatggccatcaagggccagatctacgacgtcacccagagcagaatgttctatggacccggcggaccttatgccctgttcgccggcaaagatgccagcagagctctagcaaagatgtcgttcgagccacaggacctcaccggcgacgtctcgggcctaggcccgtttgagctcgacgccctgcaggactgggagtacaagttcatgagcaagtacgtgaaggtcggcacggtcaagaagagcgtccctgtggaaggcggcagcaccgcgagcaccactgaggctgagaaggcgccgacaaccgaagagaagccaagcggngcggtggttgaggagaaggaagccgtggctaatgaaggtgcccaggaaaactagagcttttctgtgcatgccggcataattcgacat

SEQ ID NO: 58287 - DNA, 362 bp, Zea mays
  Clone ID: LIB3069-043-Q1-K1-B1
aaaagaacatttgttgtgaggaaaggaggccttcctgatgctgttgtttggaacccctgggacaaaaaagcaaaggctatgtcagattttggggatgatgaatataaacgaatggtatgcgtggaggcggctgctattgaaaagactgtcactctgaagcctggtgaagagtggactggaaagttggaactttctgctgtgccatctagctattacagtggtcagctagaccctgaccgtgtgattcaggattccactgtcccggatgactccatcagctagtccttattctatttttgcaggtagagcattgtatcattatgcataagagatgctggcaacaagggctgtacacatgtttc

SEQ ID NO: 58288 - DNA, 451 bp, Zea mays
  unsure at all n locations
  Clone ID: LIB3069-043-Q1-K1-B10
cccacgcgtccggtgctggccgtgtgcgccttcacggcggcggaggggttcgacatcctgcagatcctggggaagcacgacgagttctcgcagttctgcaagctgctcaacgagacgcacctggccggcgacatcaaccgcgaccgcacaatcaccgtgctggccgtggccaacggcgacatgggccacctcgccgccggccactactcgctcggcaccatccgccacatcctcgagctgcacgtcgtcgccgactactacgacgacaagaagctcaagcagctgtcgcacgccgncaccgncgcgtccaccttgttccagcgatccggatttgcccccggcatggcaggatacgtgaacataacgcagcaccgcggcggcaaggtgtcggtcatcgtggacgacgcggcggacagcgtcaagcccgtcacctacgtgaagcagatcgaga

SEQ ID NO: 58289 - DNA, 409 bp, Zea mays
  unsure at all n locations
  Clone ID: LIB3069-043-Q1-K1-B11
caaatcgcaaagaggcgtcttccaagcttgtagggttaccggatcggaggagcatccccgcctaggtcaccacagccatggttcgcggatcgctaggcaagcttgcgtcgcgcgccctctccgtcgccgggagatggcagcaccagcagcttcgccgcctcaacatccacgagtaccagggtgcggagttgatggggaagtacggtatcaacgtacccaggggtgcggcggcggggtccgtacaggaggtcaatgacgccttgaagaacatgttccccagtgagaaagagatagttgttaaaagtcaaatccttgctggtggccgagggctgggaactttcaaaagtgggctgcaaggaggtgtccatattgttaaggctgangaagctgaaagcattgcacgtaaaat

SEQ ID NO: 58290 - DNA, 404 bp, Zea mays
  Clone ID: LIB3069-043-Q1-K1-B12
caacaatgtatggacagccatgcaaatttgtctggggatggagagatagagattgacatgcatgctgtcagtgatgacttgttatttgagctgaagaaacatgttgacaagtatttgcaagagaaagagcagagccagcaggtgaaatctgagccctccgagaatgaagctgtgaatgtatctggccttagccactcttctacaaatccttgcaaaggcggcgaacctatcgaagaggatgtggacatctgtggcaatgcctcacctatcatgctagacaaagatgcacaaatcaggaatagcaagtgtggtagtccaagtagttccagcagcgactctgaatcatcttctagcgattctgattcaggcagtgactcttaaagcgaatcaaaaaaagttggcag

SEQ ID NO: 58291 - DNA, 449 bp, Zea mays
  Clone ID: LIB3069-043-Q1-K1-B2
cacttgtctgttggtttggttgttcatccttttgggtcttgaatgtctgttcatcaactgttttatttataatattgttttgacttgtcaacacaccacattctttgcacttagtgacatcacttgtagttgacattccaaggtctgacatctgtatgggtatggaagaatggaagggactaaagggttgagcaaagatagattatagagagcagagaaaacccatctatctaaggtttttcctagctaattgatgccattgtggacaaaagtcacacaatacaccaacaatcattacaaagaagcaaatctaacatagtcacaaagataactaacatgaactcaaacatatcagcacaacataactcgatgttattcattcaatcaaaaggcaatcttgcctatggaaaaacaatttcttataagttttttcgaaaggcgggacaagg

SEQ ID NO: 58292 - DNA, 439 bp, Zea mays
  unsure at all n locations
  Clone ID: LIB3069-043-Q1-K1-B3
cccacgcgtccgcccacgcgtccggttggtgatcctcagccttcggaggagtcgtgagtgcatacttcagtggttctttagtggatacttatggtgtaagatttgtttttggtgttacagcacttctgccactgatgacatctgctgttgcagttcttgtaaatgaagaacgcttacctttggggaaaagttcagtctcactttcagttccaagttcagaattaattgagagctctaagaaacgtatcatgcagatttgggattcagtaaagcaacccagcatactcctacccaccttgttcatattcctttggctagcaacaccgcaatcagactctgccatgnttttcttcataacaaataagctcgggtttactccagaatttttaggacgtgttacgcttgtcacaatctgtgcattcttactgggaatcggagt

SEQ ID NO: 58293 - DNA, 425 bp, Zea mays
  unsure at all n locations
  Clone ID: LIB3069-043-Q1-K1-B4
gaacgagaagttcttgaaggaattttttcttaagaggccgtaccttgagacagagaagagtaagtcctatctagataatatccaggaattgtcagatgaagaggagctcgagattcaggaagagtatgagcatgcttataattaccggcatgaggaggccatggcatcaggggcagtggtggcggatcgggtgttgggacattccagggttgttgaaggttcggtgaggaagaaggagagcagcagaaagcagcagcgcaagagcaaagaggagcggatggcccgtgttaagcaagagcaggcagaggagctgaagcatctcaagaatttgaagaagaaagagattgcagagaagcttgagaggatccgaatgattgctgggattgaaggagatgctgcttgtaagnctggtgctgatgacttgg

SEQ ID NO: 58294 - DNA, 369 bp, Zea mays
  Clone ID: LIB3069-043-Q1-K1-B7
cccacgcgtccgcggacgcgtgggcggactcgtgggcgccgccgccgtcgccggagccatggcgtcgcggcgctgtctcctccgcttcctctcgatccgcctcgttcctcagagatctcaacctcttgcgccgatctcgactgcgacccggaccctaacctctttgtccgaggccctcggctccccagctccccgggccctcgcctccccccggctgtactacccctcgcgctgccacttcgcgacccgctcctccggcgacgaggacgacggagaagacgaagaagagcactacgacgatgaggggagcgatggggaatggggggacgatgaggaggtggtggctgcgaagaaaccgagcgggaagac

SEQ ID NO: 58295 - DNA, 319 bp, Zea mays
  Clone ID: LIB3069-043-Q1-K1-B8
gtcaaactagctgtggaatgggggcaacgtttacagtacatatgtctgcacttatgacactgggactgaacgacattctgaggacagaaattgacatcacatgcttgacagatgctcagactgtgatctgactggcatttctggatcgcaaacctattcttactacaagattgacgcttatacatatcaagtgcacacacacaggagttgcacatacttgactgccgattgttactccaaaacgggtcggcttacgagtcgtaacgatcatgatgctactcggtacgcctaatctgtatggcactatggtggctaacac

SEQ ID NO: 58296 - DNA, 436 bp, Zea mays
  Clone ID: LIB3069-043-Q1-K1-B9
cccacgcgtccggcccgtcgcggtcgaactggccgccgacgcggaggctgctgctcctgctggtcccgacgagactcctgcggtcgagcaggacgcagccgccgaggaggaggctgctgctgctcctcctgctggtgccgaggagcccgccgcggacgagcctgtcgccgaggcagaggctgctgctcccgaggagctcgccgcggacgagccggaggctcctgctcctgctcctgctggtccccaggagccggccgccgaggccgacgctgctgatcctgacgagcccgagatggccaccgagtgaggccgtgcgcacgcagcggcggcagccagggcccaggccccaagggatcggcatgcgcgcgtggcggtgtagtcttttgcgcgcgtacatcgcagtatgacacgggattttgcttgccagtacgctacg

SEQ ID NO: 58297 - DNA, 223 bp, Zea mays
  Clone ID: LIB3069-043-Q1-K1-C1
gatgaatcggttatttgtgtaatgcacactagtcttttcagcgggacagtttgcatacggcaacaggtctacagtcatcagatgtacagtcgtcaagccggttgcattcggaacgtcgccatgcctatgcttgttatcccaccaacctacttacacgtatccaccgatcctttaaaaccgctcaatttgtacacgatgtgctggctttcacaagatgcaaagc

SEQ ID NO: 58298 - DNA, 404 bp, Zea mays
  Clone ID: LIB3069-043-Q1-K1-C11
ggcaaaagccaaaaggcatcaccttcgcgacgacgatggcagcctcgctccaagccgcgggcaccctgatgcagccggccaagatcggcggccgggcgccctttgcctcgctgccgtcccgcccgtcgtcgcaactcgcctgcagggcgttcggcgtcgacgccggcgccgacaggatcacgtgctccctgcaggacgtcgccagcaggtgcgtcgacgccgcgaagctcgccggcttcgcgctcgccacctcggcgctcctcgtctcgggcgcgagcgcggagggcacgcccaagaggctgacctacgacgagatccagagcaaaacgtacatggaggtgaagggcacgggcacggcgaaccagtgcccgaccatcgactgcggcgagggagtcgtcccgttc

SEQ ID NO: 58299 - DNA, 372 bp, Zea mays
  Clone ID: LIB3069-043-Q1-K1-C12
cccacgcgtccgcggacgcgtggtgcagttgacagtgaaagaaagatagtatcaagtgcagactttgacttctacatcgtcgaggatgtgattcatgttgtggagtccaaacctaccaagcgtcatggtgattactttttgagacaaattttgaagtttgaggaaatgattggtgaactggagaaggtacagcttgactgaaatctgatagcgatcatggagagaaatgtcactgtttcctttttgctctcttttgtactccgttgaaaccccatctttttttgtttccttattgactctgaagcccgttgaaaccggccattattaaccgtgtaccgtgtaatgttacttaggccctgtttggttcggatt

SEQ ID NO: 58300 - DNA, 342 bp, Zea mays
  Clone ID: LIB3069-043-Q1-K1-C2
gactagttctagatcgcgagcagcccccctttttttttttttttaaaaaatatatggggcagacaattgctgattactattactaattggaatgtaacacgcttgagacagcaatacattacagagctacctaaatgggaataccacaataccgaccgaaaccaccatgaataactgaattaagcttacacgacatagccaacacgggaaaccattttgatgaaattcttgcggctgcctggatgctgtgtgcatcacagtattgaaccttacgtgtcgcagcagcagacaagaatggcaagtttcaatgatatcgcagctaaaacagcatgttgaattctt

SEQ ID NO: 58301 - DNA, 311 bp, Zea mays
  Clone ID: LIB3069-043-Q1-K1-A7
cttcttcgacgggtgtgagaagacgggcctgcaagtgcagcacctgggtgatcttgtgtaccttattagcaataaacaagaggcggattttgtggaaacgaagtcagacggtggcagtagtgaggggatgattttttgagtaggttttgttaagtcatattttgttcaatttcccccaaacacttgattttttgtttctctgattctatttgggatattctgtttgattctgttgcaagattgtttatgcactgaggtggtttataatggcttaagcatgcagcccagcgaggtgatctatgcaggcttat

SEQ ID NO: 58302 - DNA, 398 bp, Zea mays
  Clone ID: LIB3069-042-Q1-K1-H12
cccacgcgtccgcaatgtgctacaaataattaaattaaaaccaaaagaccccggcgcggaggtgatcgcgctgtcgccgcgcacgctggtggcgacgaaccggttcgtgtgcgagatctgcaacaaggggttccagcgggaccagaacctgcagctgcaccgccggggccacaacctcccctggaagctccgccagcgcagcagcctcgtcgccccgtcgtcggcggcggcaggctccggcggcaggcagcagcagcagggcgaggccgcgccgccgcgtaagcgcgtctacgtctgccccgagcccacgtgcgtgcaccacgacccggcgagagctctgggggacttgactgggatcaagaagcacttctcgcggaagcacggggagaagcggtggt

SEQ ID NO: 58303 - DNA, 384 bp, Zea mays
  Clone ID: LIB3069-042-Q1-K1-H2
gggagggcatggacgagatggagttcaccgaggccgagagcaacatgaacgacctcgtgtccgagtaccagcagtaccaggacgccaccgccgacgaggagggcgagtacgaggacgaggaggagggagatctccaggactagaataggctgcttcacattcagtcaccgtcagtcatgaaaaactaatcatttgctgcttttcgtcgtcgtagtagtagtaggtcggtaatcatctgtcgtgggtttgtttcgtttctatcattaatcagcattagtagtagcagctgctgctgcgggggcacaacacaagggggggataggaactgcaataccctgttgcgctttggttgtttctggaaccgatgttatgttaaattctcaa

SEQ ID NO: 58304 - DNA, 372 bp, Zea mays
  Clone ID: LIB3069-042-Q1-K1-H3
cccacgcgtccgggacttcccggaccccaagccgtcgcgcgaagagatgatcgagacatacctccagactctcgccaaggtcgtcgggagttatgaggaggccaagaagaggatgtatgcttttagtacgacgacttatgttggttttcaggctgtaatgaccgaggaaatgtcagaaaaatttcgcggtttgcctggagtagttttcattttgcctgattcatatctatatccagaaacaaaggagtacggaggagacaaatatgacaatggtgtcatcactccaagaccaccacctgttcattatagcagaccatcaagaactgacaggaaccgtaactaccgaggaaactaccaggatggcccttcaca

SEQ ID NO: 58305 - DNA, 346 bp, Zea mays
  Clone ID: LIB3069-042-Q1-K1-H4
cccacgcgttcgggacttacctgacccctagccttttcgcgaagagatgatcgagacatacctcggtactatcgccaaggacgggggtagttctgatgaggccaagaagaggatgtatgatcatacgcccaccacccatgtttgactataggctgctaaaaccgatgacatgccataccgattactcggcatgacggccgttatccacattcagcctgacacatatctatagccattcacgaaggaatacggacgatacaaaaattacattcgcctcattactacgagtccagcacctgtggataataacatagcattgattactgacacgatccccaattaccca

SEQ ID NO: 58306 - DNA, 368 bp, Zea mays
  Clone ID: LIB3069-042-Q1-K1-H5
cggacgcgtggggaactacaagtttggtttcggaatgaccgtaggagagtaattctgctaaaacaattgctgagaagagcacatgaggactttcgcagtctgctttgcattgtatgttaagatacttcaggtctcagttttgattgatcaggttctgccccgtcgaaaaaaatactagctgttgctgctttacagggttttgtctcagtgtattggtggttgtttattttcagctacttgagcatgggggccatgattctttgttcatcttggatgtaactagctgattggtgttccaatgatgttgtatttgcagaacgattttttccttttaaatcaccaacaaccaccacactaggctttttctg

SEQ ID NO: 58307 - DNA, 380 bp, Zea mays
  Clone ID: LIB3069-042-Q1-K1-H6
ctctccttcccgagcaggaggcggacaatgtaagcagcaatcgcaggaaccctagcgccgccgcacccgcaggaatgggtatcgacctcgtcgccggtgggaggaataagaagaccaagcgcactgcgcccaagtctgacgatgtctacctcaagctcctcgtcaagctctaccgtttcttggtcaggaggaccaagagcaatttcaacgctgtcattctcaagaggcttttcatgagtaaaaccaaccgaccaccaatctccatgcgccgccttgtcaagtttatggaaggaaaggagaagaacattgctgtcattgttggcacagtcacagatgacaaaaggatccaggaggttccagcaatgaaggttactgccctg

SEQ ID NO: 58308 - DNA, 372 bp, Zea mays
  Clone ID: LIB3069-042-Q1-K1-H7
aaaaatataaagcaataaataaagagcagtcgggttaataaaactgagaaaattgactcggaaaaaaaaattggaagctccattgcaggattcaaacctaaccattaaaggagaagctgtgggaacgacaaaacctatgactacataggattttattgaaaagaatcctaacacttcattgggtgggatggcggaacaaaccaaaaaaattgctttatttgataaggttctaaattaacaaataagacaggaaagagtaaatattcgcccgcgaaatccttattggattagaatactttaccacgattcaataagaataaaaaaaaaggagattccaaaaaaggaaggattacattttatataaatattgaa

SEQ ID NO: 58309 - DNA, 380 bp, Zea mays
  Clone ID: LIB3069-042-Q1-K1-H8
ggacaatgatctatctgaatttgatgaatctcgagagataatagagagcctagttgatgaatacaaggcctgcgagtcgcctgactacatcaaatggggaatggaggaccctggagaggcaaatgttgtggcggcacttgactctaagttggtagtgtaaatataaaggtaccatctcacagtattaggcactttttatgcagaaacaatttgacgcacaatcatattgaattgattatccacttgaaaccttgaacacttgctttcttttgataaccatgtggactacaccaattattataaacgatgcacaatctctgctagatgttgaaaatgatactaaatccctcatttttcgtatctattgctggcaaataaca

SEQ ID NO: 58310 - DNA, 415 bp, Zea mays
  unsure at all n locations
  Clone ID: LIB3069-043-Q1-K1-A10
cgcccgctgctccccgccgacgccttcgaccgcgcgctcgcgcggttctggtgccacttcgccgacgacaagctcgggccggcggtgggcgcggtgttcgcgtcgacgggggagggccaggaggcggcggtgcggcaggtgcacgagaacctggcgctgatcgagtccgagctccgcgacggcgcgttccggggccgccgcttcttcggcggcgacgaggtgggcctgctggacgtcgtcctgggctgcggctcctactggctcgccgtgttcgaggaggtgaccggggtgcgcctcgtggacgccgacgccttcccgcgcttccacgcctggctgcgcgacttcgaggccctggacgaggtccgggagaccattcccgcggtggaccgnctgctcgagtacgcgcgcgggcttc

SEQ ID NO: 58311 - DNA, 455 bp, Zea mays
  unsure at all n locations
  Clone ID: LIB3069-043-Q1-K1-A11
caacatctacctcaacttcgacgccttccacggcgacaaggaccacggcggcgtgcgcgacggcaccaacatcgtgctctggaagtggtgcgagggcgacaaccagcgctggaagatcgtcccctggtaaatgtgctgttctgtggctgcactggtcatcaccatgatctggagctttgaaggcatagccacctgtggtcagcagctgctgccgtgttgttagaataaagttggtggcgatcgatcgatctgtggtgatgagtgtccctatctgtgtgtttgtgtttagttccagtcgtctgtgaggaagtcagttatgtttgagtgagaggggtacttcgctcttcggtgaacactgtacttgtcatgaggagagttttcatacccggagtgtangaactctgtactgtactcggatccttcctttntcatcgaagtgggttttattttaaaaa

SEQ ID NO: 58312 - DNA, 469 bp, Zea mays
  Clone ID: LIB3069-043-Q1-K1-A12
gggatgtctacctcgacctcctccaggccgactactcacttgttcccaataaccttgccgcaggtgaagcagcgcactgggataatcatcttcacctgcggcaaggttattgggaacaagtgggatgtctacctcgacctcctccaggccgactactcagaaggggatgctctggatgctttggaattgttccgctactgctgcaggcgaatgctcatgacacatgttgacctcattgagaagttgctcaactacaacaccctagagaagaccgagacaagttaagcgagcacatcatgctccaaaaacactactgtttcgcagtatcatagagcttaggtagtatgttgtctcttctctatcagtagaaatgggttgtgagtgtgaacatgcttttgctcatgagcattcaaggacttttcatgcgacagtgcttggtggcacctatgcaacgatggtggatatttta

SEQ ID NO: 58313 - DNA, 466 bp, Zea mays
  unsure at all n locations
  Clone ID: LIB3069-043-Q1-K1-A2
aaaaagataggtgaacggggacgtccaatatccccagcgcaaccatggttggagatcatctgtttcagtttgcagaattggttaacaacttgttgcacaaacttttagtaaagatttatgtagattgcaataagagctgcagtccctagcatgttggccatcacttgcgtccttcctatggccgctaagaagcgatacaagcccattgacatttgatgcatggcaaaaagtaccagaaagtgctggaggatcctgccataagcaatggaatttcatttcttgcttttacctattgaagttgaagcatcagaagtcattcagcatgcaagtaccaggagatgagtacctgatagcagaaggttctagcacaagctanttgctttcatcacaaggttcctgggctttggatctatgcggcagcatgggaattcgattaaaacctgaacgtcgtcgtagcatgtgcact

SEQ ID NO: 58314 - DNA, 150 bp, Zea mays
  Clone ID: LIB3069-043-Q1-K1-A3
acgaaaagaacatctgctgtgaggcaaggaattttccttgaggctgcagcacagaacccatgggacggtacagcttaggctatgtcaaaattttgggattatgaatatcaacgaatggtatgccctaaggcggctgttattgaaaagact

SEQ ID NO: 58315 - DNA, 453 bp, Zea mays
  Clone ID: LIB3069-043-Q1-K1-A4
cccacgcgtccgcccacgcgtccgcccactcgtccgcggacgcgtgggcttcactctcctggtttattcctccgtgccgatctcgtcttctccggcgggaccatggcgccgtcctcctcccgattcgacgatccggcggcggtgaggcgccccccgcagcatgaacggaagccgccgtatatgttgcttctcccgctcgtctacgcccccgtcctccccctcatcaggatcgggctgcggcacaatcccgtggtgagggaccgcctcttctacggcgtcctcgccggcgcattcgcccacggcgcctacctcatatcggaactgtatgatgtggagagcaaatgatggacatccctcgaaggatgaggggataacgtttcaagtagcaaaatttgattccatcgggattccagattgttggatgagagctgacatggcaatttatactaacta

SEQ ID NO: 58316 - DNA, 435 bp, Zea mays
  Clone ID: LIB3069-043-Q1-K1-A6
cccacgcgtccgcccacgcgtccttggactcgtgggttccacgcgtcgatggcctcgggtatttatacaagctcaatgtaggagttgaccttccattacacactcaggcgcgattgggggggcgtgtcggagctagtccatcgctttcggcttggtgcgtaactactaccctaaacttcacatttgatataggagccgacactggtaagggacgaaaatttcctggtgttacggatgccaagggcctccttctcaatcacaatagcctgtctgggccacttccggcggaccttggctattccaaggtgagctacctagctctggctaacaacaggctgacagggccaatcccgcaatcgattggccacctccaggattccctcttcgagatgctgctccttgacaaccagctttccggatgccttccgcacgagc

SEQ ID NO: 58317 - DNA, 362 bp, Zea mays
  Clone ID: LIB3069-042-Q1-K1-H11
gccacgcgtgcggccacgcgtacgcccacgtgtccggttctgctcgacggagaccacaaccgttacgtctcagactacgggctgagctcgttgacgagccttccgatcaccacttcccgagctgtcgctggctaccgagctcaggagaccttcgaatcgaggaagttcacccacaagtccgacgtgtacggcttcggcgtcctgctcatggagacgctgacgggcaaggccccgcttcagtcacagggtcaggacgacgccgtcgacctaccgaggtgggtgcattccgtggtccgcgaggagtggaccgctgaagtgtttgacgtccagctgatgaagtatcccaacatagaagacgagct

SEQ ID NO: 58318 - DNA, 370 bp, Zea mays
  Clone ID: LIB3069-042-Q1-K1-F7
gacctcttcaaggccgctgcggccgactgtcgcgacacgctcttctgcgaggtggctccgaacccgccgccgcgggaggagctgccggagccactgaggaacgtgatgctggagtacggcgcggcggtgacgaagctggcgcggttcgtgttcgagctgctgtccgagtccctcggcatgcccagcgaccacctgtacgagatggagtgcatgcagaacctgaacgtggtgtgccagtactacccgccgtgcccggagccgcaccgcaccgtgggcgtcaagaggcacacggaccctggcttcttcaccatcctcctgcaggacggcatgggcggcctgcaggtgcgcctcggcaacaacgggcagagcg

SEQ ID NO: 58319 - DNA, 379 bp, Zea mays
  Clone ID: LIB3069-042-Q1-K1-F8
gttcgttttcaggaaacggcacggaacatggatcttggaggtgcatctagccgcaggtcacggtcaattcacttgacaagctcactttccaccaaatctctcagcctcaggtctggaagtctaaagaatctcagctatcagtacagtactggagcagatggtcgcattgagatgatttctaatgctgataatgaccgcaaatacccagcgccacgtggctacttcttcaagcttctgaaactgaacgcacctgaatggccatatgcagtgttgggggccattggttctgtcctctcaggatttattggcccaacttttgccattgttatgggcgaaatgcttgatgtgttttactacagggaccccaatgaaattgaga

SEQ ID NO: 58320 - DNA, 362 bp, Zea mays
  unsure at all n locations
  Clone ID: LIB3069-042-Q1-K1-F9
cacctctgctaccccaacaaaaccaggactacgcctcgcgcggcgctgtcatgctcccggcgttcggcaacccgctctgggtaccggaggacgtcgacgaccagcagcagcaccacgcgccgccgccgacgcccatggggttggggccggggcaggggcacgatgaacagaacctcctggccctggcctccgccgccgccatgggggccggcggtattttcagctcgccagcggtgctcgacgacgactggtacttcgaccccgtggctgtggccgncgncgccggcgctcaggggcagctgctcctggcaccgncgggcccagcgcccgacgccgggtcgcagatgttctcgctcttcaac

SEQ ID NO: 58321 - DNA, 371 bp, Zea mays
  Clone ID: LIB3069-042-Q1-K1-G1
ccgggtgtccccggccatcgaccacctcgacgcgtacgactccaacccgctgcagctcggcctggccgtagtggaccgcctcaacgctctccaggaggagaccgggcggctggcctacctgcacgtgacgcagccacggtacacggcgtacgggcagacggagtccggccagcacgggagcgccgaggaggagagccggctgatgcgcgccctgcggggcgcctaccgcggcacgttcatgtgcagcggtgggtacacgcgcgagctcggcgtggaggccgtcgagtcgtgggacgccgacctggtgtcctacgggcggctgttcatcgctaacccggacctggtggagcggttccggcgcgacgccccgc

SEQ ID NO: 58322 - DNA, 423 bp, Zea mays
  Clone ID: LIB3069-042-Q1-K1-G10
cttccccgcacccaacccccgtcggagagtgagatggcatcggtggcggagatgcagcccctcgcgccggcggggtaccgccgcgcgccggagatgaaggagaaggtggaggcgtcggtggtggacctggaggccggcaccggggagacgctgtacccggggatctcgcgcggggagagcgccctccgatggggcttcgtccgcaaggtctacggcatcctcgctgcgcagctgctcctcaccaccgccgtctccgccctcaccgttctccaccccaccctcaacgccacgctctccgactccccgggcctcgcgctcgtgctcgccgtcctgcccttcatcctgatgatcccattgtatcattatcagcacaagcacccacacaatttcgttttcctgggtctgttcacgttgtgcttgagc

SEQ ID NO: 58323 - DNA, 377 bp, Zea mays
  Clone ID: LIB3069-042-Q1-K1-G11
cttttccgtacccaacttacgtcttagagttagaggtcatcggcggcggagatgcagccggtcgcggtggcgttgtaccgtggcgcgcgcggagatgaaggagaaggtggaggcgtcggtggtggacctggaggtcgacaccggggagacgctgtacccggggatctcgcgcggggagagcgccctacgatggggcttcgtccgtatggtctacggcattctcgctgcgcagctgctactcaccaccgtcgtctacggcctcactcgtctccagctcaccctcaacgtcactctcttcgactcctcgggcctttcgctcgagctcgacgtgctgcccttcatcctgatgattccattgtattattatcagctcaagc

SEQ ID NO: 58324 - DNA, 400 bp, Zea mays
  Clone ID: LIB3069-042-Q1-K1-G12
cttatctacaagcatgctgtgcctgttcctaagtctgagtgcagcaagactacccagttgggtattagctttgctggtggttacgttgccggtgtcttctgtgctattgtttctcacccggctgacaaccttgtgtctttcctgaacaatgccaagggagctacagtgggagatgctgttaagaagcttggtctctggggtctcttcactagaggacttcctcttcgtatcgtcatgattggtacccttactggtgctcagtggggaatttacgatgcattcaaagtgatggttggactcccaacaacgggaggtgttacacctgccccagcagcagaggctggattgaaagccagtgcttgatttttttttctgtgttccctgagatcatatttggtag

SEQ ID NO: 58325 - DNA, 360 bp, Zea mays
  Clone ID: LIB3069-042-Q1-K1-G2
cccacgcgtccgttttttcgaccacctttttgctttcgacttcaacctgttgtatttcggtctggtcgtattggaccttgtaaacgctcttcaagaggagacccgtcggctgacctacctgtacgtgacgcagccacggtacacggtgtactgtcagacggagtccggccagcacgagaactccaacgatgagagccggctgatgcgcgccctgcggtgcgcctaccgcggcacgtgcatgtgcagcgaacggtacacgctcgagctaggcgtggaggccgtccattcgtgggacgcctacctggtgttctacggccagttgttcatcgttaacccggacctggcggagcggtttctact

SEQ ID NO: 58326 - DNA, 307 bp, Zea mays
  Clone ID: LIB3069-042-Q1-K1-G4
cggacgcgtgggtcttttaactcatgcttttattttctgatctgttttgaaatcaaacgggcttttttccttggttccggcactaacttactacaaggactactccttgaaccaacatttgatactcaactctgtacccttaatactgctcacatatcttccatttaccaaccaactaacataaaaacccacccgcataagaatctaccctaaacttaccattccatgaccaaaacatccaattcgaaaaacaggcttattactactaaatcctaatgaatgaccacgtctaaatttttaagagaat

SEQ ID NO: 58327 - DNA, 371 bp, Zea mays
  Clone ID: LIB3069-042-Q1-K1-G5
tgaaatgcaccatgaggctctccaggaggtccttcctggtgacaatgttggcttcaatgttaagaatgttgctgtgaaggatctgaagcgtgggtatgtggcctccaactccaaggatgaccctgccaaggaggctgctagcttcacgtcccaggtcatcatcatgaaccaccctgggcagattggcaacggctatgccccagtgctggactgccacacctcgcacattgctgtcaagtttgcggagctcattaccaagattgataggcggtctggcaaagagcttgagaaggagcccaaattcctcaagaatggtgatgctggtatggtgaagatggttcccactaagcccatggtagtggagacctttt

SEQ ID NO: 58328 - DNA, 379 bp, Zea mays
  Clone ID: LIB3069-042-Q1-K1-G6
ggtgttcctggtccaccttgccaccatctccattactggcactggcatcaacccagctaggagccttggcgctgccatcatctacaacagggatcacgcctggaacgaccattggatcttctgggtcggccccttcattggcgctgctctggctgccatctaccaccaggtgatcatcagagccatcccgttcaagagcaggtcttaagctgccgtggccgtgccgagacatgccagtccgaagaacgggcgtcttcctgtgatgtcttcttgtctgcccacgcctagtttctctgtcgattcctattcgtcgtctcttcagggctggtgctcactgctgcgccgttctgttaaccgaaacaagaactctgtgtattcc

SEQ ID NO: 58329 - DNA, 358 bp, Zea mays
  Clone ID: LIB3069-042-Q1-K1-G7
cagagagattactacgatccaacagttcttgagcaagagagaggaagacacaccgcatagttagcaggctaataacttgcaggagcagcaggaatggcggcgacacgtcgcctctcttgctttctcctcgccgtgcttctggcacgagtggccgctggcaccgccttcgacgaaacggctgctgccggcttcgggcttggccacggcgcgcgtttcgcgcgcaagcatggacgtgctgccgctgagatgccccagccggagccacaacctaaaactaagccggaaccccatatgcagccactgtcccaggcagaacctaaacctgaacctatgccacattcagagccaaagcctgaac

SEQ ID NO: 58330 - DNA, 380 bp, Zea mays
  Clone ID: LIB3069-042-Q1-K1-G8
gttcttcccctccgatccgatgtccccatctgcgctcccgtcggcgatcaaacaccggatcgcggcactcgccgccgttgaggaggaggtttccggcgctgcttccagcgccttgccgtcagcaccatgaggaagaagctggacacgcgtttccccgctcctcggattaaaaagatcatgcaaacagatgaagacgtcggcaagattgctcaagctgtacctgttctagtgtccaaagcattggagctatttctgcaagatttatgtgataggacatatgatattacaattcggaagggggtcaagactgtgggttcttcccatttgaaacaatgcatacaaacgtacaacgtctatgacttcttgagggaagtagtcag

SEQ ID NO: 58331 - DNA, 76 bp, Zea mays
  Clone ID: LIB3069-042-Q1-K1-G9
cttttgtactccgttgaaaccccatctttttttgtttccttattgactctgaagcccgttgaaaccggccattatt

SEQ ID NO: 58332 - DNA, 375 bp, Zea mays
  Clone ID: LIB3069-042-Q1-K1-H1
cccacgcgtccgcccacgcgtccggaacatattatcaagggatttccacaattatccagctttgggtggacttgtccagacccttatgggctatgtcgttggcggtgacagttcaaattgggtaggagtgctcggtttgccccactacaacatggatgacatgcctggtgtgtcatttcatgttgcgcttcaccttgcccagataaagagggcaaagaagttccaaatgtatgactacggtagctctgcagcaaatattgaagcgtacggaacaccggaaccattggacttgggagctcattatggtctcattgacattcctgtggacttagtcgctgggcagagggacagagttatctcaccatccatggtaaa

SEQ ID NO: 58333 - DNA, 446 bp, Zea mays
  Clone ID: LIB3069-042-Q1-K1-H10
gctgcgactgctgctacccgcaatgtgaatgcctatgggcagaaggaagagggacgaagccgctggcaggagaggaagaaagccaagagtcagatgtatctgatgagtacagagaaggttgcgaagctgggcactgtgaagcaaaaagcttcagaaacttcttctgttggcgcatatacccaatgccagaagtgtttccagcatggtcactggacatatgagtgcaaaaagagcgggtgtacatatcacggccctcaagaacgtagcagcttaagaaccccaagctgaagaaatgcgtacctgtttcttatcgatttgagaatcctgatggtgatcggcgatcgtgagcttccatgttatgtgttgtgatacttgagacttttattatgactatatatgagatattggctattattatgactggatgaaatgtgcttattatgact

SEQ ID NO: 58334 - DNA, 377 bp, Zea mays
  unsure at all n locations
  Clone ID: LIB3069-042-Q1-K1-F6
caacgtgttcgacgccaacttcgacacgctggtgtcggcgctcaagagggtcgggctcggccacctgccggtcatgatcggcgaggtcggctggccgacggacggcgacaggcacgccacggcggccctcgcggagcgcttctacgcggggctcctccagcggctcgcggccaggagaggcacgccgctccggcccggcgcgcgcatcgaggcctacctgttcgggctcgtggacgaggacgccaagagcgtggcgccgggcaacttcgagcgccactggggaatcttcaccttcgacgggcggcccaagttcccgctggacctgcgcggcgacgggcggccggcgatgcccgtcccggcccggngcgtggagtacc

SEQ ID NO: 58335 - DNA, 438 bp, Zea mays
  Clone ID: LIB3069-020-Q1-K1-B8
tgttcctgctacaaggaaggaagatgtaactgctgatagtaggaagaccaagaatatcagactatatgttaagcgtgtattcatatcagatgactttgatggagaattgttcccaagatatttgagctttgtgaagggtgttgttgactcaaatgaccttccattgaatgtttctcgtgagattcttcaagaaagtcgaattgttcgtataatgagaaaaaggctggtgcggaaaggccttgatatgatacttggcatttcttgcagtgaaaatagagatgattatgaaaggttctgggagaactttggaaaaattttaaagctgggtgccatggaagataaggaaaatcacaagagaattgctccttttgtgcgcttcttctcttctcaaagcaacaatgaattaattaagctggatggatatgtggaaaacatgaa

SEQ ID NO: 58336 - DNA, 345 bp, Zea mays
  unsure at all n locations
  Clone ID: LIB3069-020-Q1-K1-B9
cagctgcatcgacgaggaccgccgtagcgttttgtgaagcaagggacgggagaggaacccgaggaaggcgaaaatgatctaccgcaactggtcgctgctctcgtccacagtcgtcatttggggcggcgtcgccaccgccggcctcgccggtatcttcctcttgggcggcaaggagaaattcaatggttatctgtgccgcgaaggcgagaggcttaggcagcaggacagagccacgatgggccgaagctaagcgttagcttctttggtatctcaagggagcaatagcccttggaaatttcacangattcctgcgtccctaccagaacaagtccctatctaggatgg

SEQ ID NO: 58337 - DNA, 383 bp, Zea mays
  unsure at all n locations
  Clone ID: LIB3069-020-Q1-K1-C1
ccaagggcaaaccaaccgaccgattaacctaccaccgcctcgcctcgtctccgctctcttgctcggacaaagccggggccgttcggcgggaggcaggggacgcacgggcaggcagccatgaacggcatcaaccccaacggcgggttcctgtcgtacgggaacatggagagctacgcgatgtgggtggcgaccggcgtggcgtcggccttcttcgcgtccctcgagcgctgctcctgcatccaccttcacaccgcggaggacgacggcgtcgaggaggaggaggacctcgaggaggcccgccgctccttctcccgcccgatccctgagtactactacgaccggtccggcttctccgncttcgtcgccaagatgtgacctgaccg

SEQ ID NO: 58338 - DNA, 450 bp, Zea mays
  unsure at all n locations
  Clone ID: LIB3069-020-Q1-K1-C10
attcgatttttcaaaggaacaactaatatttggtggaagaagttattatggtgcactgtggtggtgcacttggagctcagatggaaaatatctattaacaggtggtgaagatgatcttgtgcaggtatggggcatggatgatagaaagatagttgcttggggtgaaggacataattcatgggttagtggagttgcttttgattcatattggtccccaccaagttctgatggaaatggagaaaatgtatatcgcttcggttctgttgggcaggacacccaactacttctgtgggacctggcactggatgagattgttgtcccactacggcatccttcaagtgcctcacctacgtttagcagcgggagccctttcacacactgggacaatgcatgcccttcaacaggtgttcttcaaccttctnctagaatgccagatgtcccaaaactatc

SEQ ID NO: 58339 - DNA, 381 bp, Zea mays
  Clone ID: LIB3069-020-Q1-K1-C11
ctgatgaggacaagacaactgttctggagttgacgtacaactatggagtcacagaatacagcaagggcaatgcatatgctcaggttgccattggcaccaatgatgtgtacaagagcgccgaggcggttgatctggccaccaaagaactaggtggcaagattttgcggcagccagggcctctacctgggatcaacactaagatcgcctcttttgttgatccagatggctggaaagtggttctggttgacaacaccgacttcctcaaggaactccactgaaggctcgggatacccatgtgctgtgctaggatgtagtaatgcttgtctgtggtgtaataagatgtgggtggtttggttacggcctgatgaacttataatactg

SEQ ID NO: 58340 - DNA, 445 bp, Zea mays
  unsure at all n locations
  Clone ID: LIB3069-020-Q1-K1-C12
cagagacgaaggtcttgttgaaagggctgtaaagttaggacaggagtttagggaccagttacagaaggtccagcagaaattccctcaaatcctaagagaagtgcgcgggaggggtttgctgaacgcagtggatctaaacaacgacgcgctatctcctgcttctgcatatgacatctgcatcaagttgaaggagagaggcattttagcgaaacccacacatgacactataatccgacttgctcctcccctcacaatcagtcctgaggagcttgcagaagcatccaaggcgcttagtgacgtgctggagcatgacttgccacagctgcagctgcagaagcagataaaaaagccagaatctgaggcagagaagccagtctgtgacagatgcggccgggacttgtacggatgaatgaagcctncgaacagagataacttcattttcgta

SEQ ID NO: 58341 - DNA, 396 bp, Zea mays
  Clone ID: LIB3069-020-Q1-K1-C2
atccattccacacaaccaccactgctcttgctcccagcccgccgcaggagttgccagatctgccccggtcacaggagctccgactccgagccctctccaatggcggttaaggtctacgtcgtgtactattccatgtatggacatgttggcaaactagctgaagagatccagaaaggtgcctcgtctgttgaaggtgttgaagctaaaacatggcaggtccctgaaaccctccctgaggaagtgcttggaaagatgggcgcaccccctaagcctgacgtgccagtcatcacgccgcaagaactcgcagaggccgacggaatcctcttcgggttcccaacgaggttcggaatgatggcagcgcagatgaaggcgttcttcgatgccactggtgggctc

SEQ ID NO: 58342 - DNA, 425 bp, Zea mays
  Clone ID: LIB3069-020-Q1-K1-C3
gttcaggagagccttattcatgcaatggatactggtaggtacaaggacttgcatgggggacgagtgactgatcttaatgactcgattgtggtgttgtctacaagaatgatccaaggatgccaggatgcttctcttggggtggaagagggcaatgctttttcagaagaaaaggctgtggcagctcgtgggcatcaactgaagatcatagttgagccgggcacaaccaacatcggtggaggcaacgttgtagtttcgtcaaggcattccttgggaagcagtgaagcctcaagtaagcggaagctccacatctctgatgggcaagaaaagacagaagaatcggcaagcacttcaaagcgactgcatagaacatcaagcatcccattcgacttgaaccttccaggcgacgatgaggaagcccatgatga

SEQ ID NO: 58343 - DNA, 432 bp, Zea mays
  Clone ID: LIB3069-020-Q1-K1-C5
cccacgcgtccgcccttatcttcgtgacacggtcgcgcagctggtcgtttgtggagcgtcctgggttcttgctggtcttcgctttcttggtggctaagctgattgccactctgatcgctgtatatgccaactgggcgttcactgcgatcaagggcattggatggggctgggccggtgtcatctggctctataacatcgtcttctacttcccgctggacatcatcaagttcctcatccgctatgcgctgagtgggagggcatggaacctcgtccttgagcagaggattgcgttcacgagcaagaagaatttcggcacggaagaaagggagcgcaagtgggcgcatgcgcagaggactctccatgggctccagccgccagaagcatccatcttcgagaacaagacgacattcaatgagctgaaccagctcgcgg

SEQ ID NO: 58344 - DNA, 452 bp, Zea mays
  unsure at all n locations
  Clone ID: LIB3069-020-Q1-K1-C6
atccatgatgggcatgcctccacagatgtttggcggcggatcgcaggcagccatgatgtacccgcaacaaatgccagtggcgccgcagcagccgatgtatggtggtggtggtcgtctggcagggtacatgcagcatcctgctgtggccgctgcacactactacagtaacctgggacggcggggatgtatgggtaccccggcgcgaacgggctgtcccagggcatgtatggcctctcggtgcaggataactcgtcgtaccagactacgagagcgccaccctctgcggcgacgaagcccgaagacaagcttttcggcgaccttctgagcattgccaagaccaagaaagcttcatgagacgagcaggagcatgagctttgtcgtttgatcttttacacttgtgtaacattcattgtctggctgtcgtataagctttttgggttctctnttttttt

SEQ ID NO: 58345 - DNA, 208 bp, Zea mays
  Clone ID: LIB3069-020-Q1-K1-C8
cggacgcgtgggctgagaaaaacaaggagtcccctggtggaccatggcagttcgttggtctgttgcccctgtttgatccgcctaggcatgacagcgctgagacaattcgcaaggctcttggtcttggtgttaacgtcaagatgatcacgggtgatcagcttgctattggtaaggagactggaaagaggcttggcatgggtaccaacat

SEQ ID NO: 58346 - DNA, 363 bp, Zea mays
  Clone ID: LIB3069-020-Q1-K1-C9
cccacgcgtccgctcgctccagccgcttacagctccgccgctcgcctctccgaccgccgcgagaatgccgttcaagaggttcgtggagatcgggcgcgtggccctggtgaactacggcaaagactatggccgcctcgtcgtcatcgtcgatgtggtcgaccagaacagggcacttgtggacgcccctgatatggtcaggtgccagattaacttcaaacggctctcacttactgacatcaagattgacatcaaacgcgttcccaagaagtcaaccctgatcaaggctatggaggaagctgatgtgaagacgaagtgggaaaacagctcatggggcaagaagctgattgtccagaagaggagggc

SEQ ID NO: 58347 - DNA, 409 bp, Zea mays
  Clone ID: LIB3069-020-Q1-K1-D1
cgccgccgtcgctctgcccgcattccctttcacaacaccgagacgccaggatgacggcgcagactgcggaggagctcgccacccagatcgagcagcagaagctcgaggagcagaagaccgaggcagaggaggttgtggtggaggatgaggaggacgacgacgatgaggacgatgaggatgatgatgaacttgacggacaagaaggggatgccagcggcaagtcaaagcaaagcaggagtgagaagaagagccgcaaagccatgctgaagcttggcatgaagcccatcactggtgtcagccgtgtcactgtgaagaaaagcaagaatatactgtttgtcatctcgaagccagatgtgttcaagagcccgaactcagacacatacgtcatattcggcgaggccaagatcga

SEQ ID NO: 58348 - DNA, 441 bp, Zea mays
  unsure at all n locations
  Clone ID: LIB3069-020-Q1-K1-D10
tttattcttttggttgttgtatttgctgattaacgactggctctattattatataaagaggatcatatcatcacacaatgacacaaacagaacgtaaccaaagaagacgacccataccatacccaaactgccatgcgtgagaatagatagacagaaagaacaggaactcaaccaacacaagacacagcaagctgcagccgcggcaggcatggggcaccgtgcgcactgacaccgggccccaccaccattaccacccgacgcacactntatttagcccacgtcactcgcagcccgcaccggacacgtccacgcgacagtcactgctagctacgtaccgggctacgtacgacacacacacacacacacacagagagacgccagtaaccgtagcgtactgaacagcaaaatcccgtgtcatactgccatgtacgcgcgcgagag

SEQ ID NO: 58349 - DNA, 389 bp, Zea mays
  unsure at all n locations
  Clone ID: LIB3069-020-Q1-K1-B4
cccacgcgtccggtacgcggtgcgccactgccgggtgcgctccgagctcctcgcgctgggcatccgccagcgctacacgctcgccgacgcgcaccacgcctacgccgagtcgctgcgcgccgtcggcgccctgctgcacgacttcctccgcggggtccagtcgctgccgccgncgnncgccgagcccgcgctccgnctnccgcagcagcggaagggcgacggcctccctgccgcgtcgccgccggccgcgatggcgtgctcctccggcgccggcgacgcgccggccgtcgccaagcaggtccgcatcgcccccgacgacgggcatatccagttctncgacggcgactccgattccgaggatgggcacatcaagttccactccgacgaag

SEQ ID NO: 58350 - DNA, 341 bp, Zea mays
  Clone ID: LIB3069-020-Q1-K1-A1
ctcgacgacgttgtcacgccctctcagcttcgctcgaccatcgctaaggagatccgtaaaaaccagaacgtcaccaaccccaaggtggttgatatgcttctgttcaacgcgacggaggagctgaacaacatagtcgaacatgcaaagcagcgccatcatgtgattgggcagtatgtgatcggccaagagggcctggtgcatgagctggggtcgaaggatctagggaactctgacttcctgaagaaattctacacaagcaattacttctgatctgtgttgcagatttacaacatctggtatactccgggtggtgctctgaataagacgacactgaggaccta

SEQ ID NO: 58351 - DNA, 378 bp, Zea mays
  Clone ID: LIB3069-020-Q1-K1-A10
gatggcttttcctcccccttcggttcgggttcgggttcgtgaggatctgcggggttcggaggcgtgggtgagcggatcgagatggccgcgtcagatgttgagtaccgatgcttcgtctgcgggctaggctgggccacggacgatcacttgcttcacaacgtcttgagcacctacggcgaggtcctcgagtacaagatcatcctcgatcggcagacgcataagtaccgcggattatgattcgacaccttctgcacggatgatgcgatgcagaacgccatcgagggcatgaacggtaaagagctgtactgctcgaacatcaccgtgaacgagggccagtcccgcggaggtcgtggaagcgagcgcggcggagggtactga

SEQ ID NO: 58352 - DNA, 165 bp, Zea mays
  Clone ID: LIB3069-020-Q1-K1-A11
acgcagacgcgtgggattcgataaaatatgctttgcataccatgatgctcggagctgcatcgacaatgacctgacttctgctggcaatgctgatgatataaaagatgacctgaatggtctcgacaaggctgctagtgctgatctaggattgagaactataaaacg

SEQ ID NO: 58353 - DNA, 371 bp, Zea mays
  Clone ID: LIB3069-020-Q1-K1-A12
gtacaagactttctctgaccactcgcccgtgctccagttcaccaacttcaccgcaacgcaggcacttcttgacgaaattggtggcagcacgtcgtcctgtatccatgtcatcgattttgatcttggcgttggaggccagtgggcttctttcttgcaggaacttgcacactgccgtggcgcaagtggcgcagctctgccgttcgttaagctcactgcctttgtatcagctgcttcccaccatccactggagctgtgtcttgcgcgtgacaacattgcacagtttgctgctgaccttggaattccctttgagttcagtgctatcagtgctgatatgatcaaccctgcagaattcatttctgccgctgatgatg

SEQ ID NO: 58354 - DNA, 464 bp, Zea mays
  unsure at all n locations
  Clone ID: LIB3069-020-Q1-K1-A2
ataactgggatcatctcgaaaaccatcttttagaaagggatgcttgaagtgtacaactctttgagcgaggaaggcaaaaaggagttcaacaaggcttatagcgcatcgttttacccatgcatggatatactctacgaatgctatgaagatgtggcctctggaagtgaaatccggagcgtggtgttggctgggcggaggttttatgagaaagagggcctcccagcttttccgatgggcaacatcgaccaaactcgcatgtggaaggttggtgaaaaggtgcgctcaacccgttcggaaggtgatcttggcccgctccatgccttcactgctggagtgtacattgccctgatgatggctcanattgagatcctgaggaagaaggggcactcctactctgagatcatcaacgagagcgtgattgagtcggtggactcgctgaaccccgttatgcacgcccggggggt

SEQ ID NO: 58355 - DNA, 448 bp, Zea mays
  Clone ID: LIB3069-020-Q1-K1-A3
gcgggcatccaggctcaaagcaagcagatctaatctccaggcagcgtcgcgacagagtgagtgagtagcacgacaacaacaatggcttccctgaaggccgcgaagcccagcggagttgcggcgcagggcaaggagccggcgcccaagctcagcgagacggcgacgaagccgtcagccgcgaagagcggcggcgttaagaaggctgagcagaagccccgggaaaccaaaaggaaggtgaagagcagcaaaccggcggcggcggccaaaaagtgacgtacagtacagtacgtgtggagtgtaatggagcttcccatgcatgagtgaatccatgccatgttatgaatctagtccttcctttcttgtatcttccatgtgacgcggcgtgtgcgtcccctcatgtgtgatgatgccagatgaatactaacaataagaacgttgtgtgactggc

SEQ ID NO: 58356 - DNA, 380 bp, Zea mays
  Clone ID: LIB3069-020-Q1-K1-A4
gtgtgtatgtatttttttagtacaatagtattcaaaatgtatgaggactctttctttttgattgttttgaacaatgggcgtatgaaccggtggaagaacaattcatttgatagttgtttgtgtccaaaatggaactaaatctaaaatttgtggagcaaaccactcaatccagatctctatttaatcaaacattttttttgttatgatgcagttccacacgtgaaatagccatatggatatgtaacaacataaatttgttcagtgggaaataagtttctataatacatttatgcacccaggtgacaagaaaaaaatattttgtcatttctataaaacatgatgcattttttctcaattcatagtgtgatgttattcctctt

SEQ ID NO: 58357 - DNA, 441 bp, Zea mays
  Clone ID: LIB3069-020-Q1-K1-A5
caaagaccacttcccgtcttcctcctgtggcctgtctgtcatctggctctgaaacgatggcagtcctgcaagttgctgctgctgcccctccccctgtctctgtgattgggttcgagggatttgagaagcgccttgagatcagcttctctgaggcacctgtcttggctgaccccagcggaaggggactgcgtgcgctctcgcgtgcccagatcgactctgttcttgaccttgctcggtgcaccattgtgtccgagctctcaaacgaggacttcgactcttatgtcttatctgagtcgagcctgtttgtctacccatacaagattgtgatcaagacctgtggaactacaaagcttctgctcgctattccgaggatccttgaacttgctgaagagctcctgttgccactcgctgcagttaaatactcccgtggaacggtcatat

SEQ ID NO: 58358 - DNA, 216 bp, Zea mays
  Clone ID: LIB3069-020-Q1-K1-A6
atttttctgcgcttggaaccaacgaattctcacaaaacatcagcgaactcgtcggcttgatgggcgtagaggctttgcgtcgcaatctggataatcacatttatttattgtggcgcgaatcctggatggccgcagcatctgtgtcagttgtcacctctgtttctttcaatcctacttgactcagaacataaaaaaaaagattcatgaaaaaacaac

SEQ ID NO: 58359 - DNA, 314 bp, Zea mays
  unsure at all n locations
  Clone ID: LIB3069-020-Q1-K1-A7
cccacgcgtccggagccacttggtgtttgcgctgggatatgcccatttaattttcctggtatgattcccctatggatgtttgccatagcagttacgtgtggcaatacttttggtcttaagccatcggaaaaggacccaagggctgctatgatgcttgcggagctagcaatggaagctggtttgcctaagggtgttttgaacatcgttcatggcaccaatgatgttgtcaataatatttgtgacgatgaggatattaagggctgtatcttttggntggttccaatacagctggtatgcatatttattctagagca

SEQ ID NO: 58360 - DNA, 260 bp, Zea mays
  Clone ID: LIB3069-020-Q1-K1-A8
gtgcaaagaaaaggattggctgtggttgattgttcctgggcacgtttaagtgatgtcccttttgtgaaactacgttgcggtgctcctcgtctcttaccatggttggtagcagcaaatcctgtgaactatggccggccatgtgaactggcatgtgtggaagctttatcagcagcccttataatatgtggggaggaagaatccgcacatttgctggttgggaaatttaaatggggtcacgcattcttggctctaacagagat

SEQ ID NO: 58361 - DNA, 369 bp, Zea mays
  Clone ID: LIB3069-020-Q1-K1-A9
gaattccctgcgattcctctcccctcgccttctcgtctccccctaggggatcgtcggagaggaatcgcaaagagggccgtctcatccgagttaaggaagccatggagcacaaggaggctgggtgccaggcccccgagggacccatcctctgcatcaataactgtggcttcttcggcagcgcggcgaccatgaacatgtgctctaagtgccacaaggagatgataacgaagcaggatcaggccaagctggctgcctcctctatcgacagcatcgtgaacggcagcgacgccgtcatggagccggttgttgctggcagcaacacggtagtagctggtgcccaagtcgagttgcaaacaatgaacgtgcagc

SEQ ID NO: 58362 - DNA, 238 bp, Zea mays
  Clone ID: LIB3069-020-Q1-K1-B10
cccacgcgtccgactggaccaaggctctaatgtacatgctgtgcaatctgaagtgggttctctactggcttattggcaatacaagttttggaccaacctctggatcactggacacacaatctgtggagaacaagagttgatgctggtctctctctgcaacaactggacataggttgtgtactcgaccctattcggtggatatagccgcagtgacaattatgacacgtttgatgtgcac

SEQ ID NO: 58363 - DNA, 318 bp, Zea mays
  Clone ID: LIB3069-020-Q1-K1-B11
caagattgataggcgatccggcaaggagctggagtatggagcccaaatttctcaagaacggtgatgctggtatggtgaagatggttcccactaagcccatggtggtggagaccttctctcagtatcctcctcttggtcgatttgctgtccgtgacatgaggcaaacggcgtctgtcggagtcatcaagagtgtggagaagtatgacccaactggagctcatgtgacgaatgctgctgccaagaagaaatgatctatctggctggtgacgaatgctgctgccaagactaaatgatctatctgtctggtgctgtgcttgc

SEQ ID NO: 58364 - DNA, 391 bp, Zea mays
  Clone ID: LIB3069-020-Q1-K1-B12
cccacgcgtccggacgaactagaagcttatcgccaaattcactttcctgtgttgtcagaactcaagaagatgacaaagttgccctctgctgctttcttacggtccgaaggcaaatgtccccttgcacctgaagaggctgtgcttatgctagcagctattggtttcaagcgcagcacaaatatatacgttgcaggtgctgaaatttatggagggaaggataggatggctgccataagtcgtctttatcctgctttagtaactaaagaaacccttctgtctccatcagagctcgaaccatttaggaacttctcatctcagttggcagccctggacttcattgcatgcgcagctgccgatgtatttgctatgactgacccaggaagtcaattct

SEQ ID NO: 58365 - DNA, 384 bp, Zea mays
  Clone ID: LIB3069-020-Q1-K1-B2
cggacgcgtgggcggacgcgtgggttttttttttttttttgaagtgcgaaaactagttgattggccacttcaatgaacctcaatacaagtaagttgaactagatacgtgtgcacccaaacaagacctaggttaagaatttggtgtccaaagaagcccaggaaaccagaacaatcggtaacctgtgttttggccagcaaggactgcatcagcatatataacaaacactacacatacacctgtgcttctccgggcaaatcttcataaacatagcgactttcatcgctcactctgacagtcgctttgattgatcagttgccaactagagatgtgtccaagtcctaagccccccatgtggcagcaaaaaggatacctggaggtagtca

SEQ ID NO: 58366 - DNA, 403 bp, Zea mays
  Clone ID: LIB3069-020-Q1-K1-B3
cggacgcgtgggccgaactgcagcacctcttcttccgccacccacacgtgctcccatgggcggcaccgcgatctcagtccggctgctcctaaccgtcgcgcgccatgtggcctccggccgccgcgcccgcctcggggccgtccgcgcgcagtccgcgccggcggcggcagcggcggcgctgacgcaggacgacctcaagcggctggcggcggtgcgcgccgtcgagcaggtgaagagcgggatggtgctcgggctcgggacgggctccacggccggcttcgccgtcgccgagatcggcgcgctcctggccgcgggcaagctcgagaagatcgtcggcgtgcccacatccaagcgcaccttcgagcaggcgcagtcgctcggcataccgctcttcacgctcgac

SEQ ID NO: 58367 - DNA, 378 bp, Zea mays
  Clone ID: LIB3069-019-Q1-K1-H8
actttgggctgattttgtgcttgttctaaggggtcgtaggaacctaagttcgcccaagagggcgtcagtgttcaaggacgctcttcctcttacgcgtgagttcgaagtctaaagtaaagccgtagaacaaggagttacgtctttccgcgcaaccctacaagatcataatttcaccagggtccgcccggccgcgctcgcactgaagggaaccgaacgcgaccaaccccttcctcacctcaacagaggggccccaactcttcttaacatctcctaacttatattcaattgaataagtttccaacacgacactccataccgttgcactcgcgcaacactacgaacaaaacccgtcaccacgcacctcaaggcccacgaatc

SEQ ID NO: 58368 - DNA, 360 bp, Zea mays
  unsure at all n locations
  Clone ID: LIB3069-019-Q1-K1-G2
tgggctgatttatgtgcttgtttatgtgcttgaaaaccttttttaaaaaataacaagctatccgcctactactactagagcaaatatagtagaatttcagtgtgttgccttcttgatgatctatactttatttatctatttattttacggtggttaagtctcttattagtgttgatgttttggttctggcgtggtctcttgtagtagtgtaagtggtcgtgacttagtttcctcntttgtgtcctcctcctcttctgtcggttgggattaatttggttcctttgtactgttgtactgttaccgttgctgactctcttgatgagcttgttcctgttgctaagcgggttgcgtagaatcatt

SEQ ID NO: 58369 - DNA, 349 bp, Zea mays
  unsure at all n locations
  Clone ID: LIB3069-019-Q1-K1-G3
aacctttgggctgatttatgtgcttgtttatgtgcttgtttatgcgtcgggcgaggcactatcataatatcgtctgcggcgcgtagaaggcctcctagaatcataaaaactcctaggacaccaccgtcactccgggcacggacgagtctagcgaggacgataagtcgatagctgtttgcgtaagaaagacctagtgcccttcgagttagttcccttacgctgtcgaagccnctatgggcgtcttaggaaagcacgcggagtcgaaggaaagtgcgaagagcccttagggcgccccggacgggaagcacgacgaattcttcgagtagctacctcatacggccggcggtac

SEQ ID NO: 58370 - DNA, 312 bp, Zea mays
  Clone ID: LIB3069-019-Q1-K1-G4
tgatttatgtgcttgtttatgtgcttgaaaaaaaaaaaaaaaaacccaaacctcaaaaaaaaaaaaaaaaaaaaagaagaaacgcaaaaaaaaaaaaaagggtggttgtctcagaggacttaagtccatgcatgtgcgtacgtgatgctacagtctcctcacagggctattcaaacctaacctatcggttgctgccccataatgctgcgatcgggaaaatttcggtgccatttaatccaactgttccgtagtatactttttccctgttagtcggtgcaacagttaagaggtttgtattgaatgtttccctta

SEQ ID NO: 58371 - DNA, 483 bp, Zea mays
  Clone ID: LIB3069-019-Q1-K1-G5
tggcttggaacctttgggctgatttatgtgcttgtgttgctccttttactctgtgtagtgtcatcgttggtcgcttggagctttgattattgcttctggtcttttgttgcgaacttactactttgcaacggagattcgtttgctggcgaagaatacttctccgtcggatctggagggaaagtgtgctgttgcaaagcatcatagtgacgatcggttcatctcacttgtgaagtcggttcctgagaagctggcacccattaaaatttagaaagtgaacgtcggaatggaagccgagaccgcaacgcccgatggctaaaccgcggcacataagcctacttaagattcgtatccccccgccatcggaggagaagaagagaatgagtccaccccagtactagcctcctagggacctctcgacgtcgctgaatgatcctctaaaaatacggcccgataaaggatagtatctgagaacccggacacgac

SEQ ID NO: 58372 - DNA, 353 bp, Zea mays
  Clone ID: LIB3069-019-Q1-K1-G6
gatttatgtgcttgtttatgtgcttggcagttcccatgctctccgtcagcgtcagcatggcagcattcacggcttcacgcttgcgtgttaccgtcggactcgacgaatatcatcagcctgagactcgtgtctttgcgcattacggactcgggtactcgtccggcatttgcatgtttcgttactgacctgcttaaggaagggcaaggcgaggcggcgatttgatgttagttagacgagacgagacttaccgaagttgatagttgagggccgggcgcaaaacacggagctgacgagcgcggcgcccccctcgctttgaggcgaaggatatagatcgccgcctgccgtctccgctt

SEQ ID NO: 58373 - DNA, 376 bp, Zea mays
  Clone ID: LIB3069-019-Q1-K1-G7
tggcttggaacctttgggctgatttatgtgcttgtttatgtgcttgtggtaacatgtggagaaccgcctcgtgaaggtcgtccgcacggcggtattcaagagtactactcttcatttataggctcggaaagggtaagggctgaggaagcggaagtccgattagagtgatgggcctcctgcgtaacctgaggtattggtgtcgaggaagacacggcccgcgttaagtataaaagagaagggatggataccgcgtaagagtttcgaggttccggatactggtacttacgaagcgtctttttgcacacctaaggaggtagtccaagtttaacaacggaagatcgcttacggaccttcgacttcgtatagtgtccgtcgg

SEQ ID NO: 58374 - DNA, 343 bp, Zea mays
  Clone ID: LIB3069-019-Q1-K1-G8
tttgggctgattttgtgcttgtggatgtgcgggtccggttttgttccttgctctccattgtatacgtgtgctggggtgtgcggatacagtcgtccggtggttatatttggaagtggaacgggtgctggttaagtgttggtgggtttgggtgcgtctttttcctcggctgctggtgggtctgcgggggtgccggtgggtaatcgggttgggggtaggaattagaagctggctttgggtactcctaagcctgggggatctggctcctgaaggtgggtaatccaatgctaaatggatggttaaaggggccaataatgggtggttcctttcatgggaggattccccc

SEQ ID NO: 58375 - DNA, 145 bp, Zea mays
  Clone ID: LIB3069-019-Q1-K1-G9
aactgaaaaactcattggaaaacttgagaagcagataactgattttaacgcggataatgtagcatgcctaaagactttgcaactgatgaagaaagcaatcgcccttgttctacatgtggctgaagaataacagatctcgattgaa

SEQ ID NO: 58376 - DNA, 452 bp, Zea mays
  Clone ID: LIB3069-019-Q1-K1-H1
tggcttggaacctttgggctgatttatgtgcttggctctgcttatttgctgcttcttcagtcttctcatctgttagctgttacgggtaagaccaagactggaactaatggtcctggaaggactggtaggtctgcggttagggctgtttcttagagtgaggacgctgagtctgctgttgctaatgattttcctactattatggatcatacgattcatacgcctaagcatgatattgcttatggttatcggaagtatagtgatactatatctaaggatcttaagatttcctctcctggcgataagttggctattgctcccggtactaggaatttcgaggaaactttgcggggcgaggtcggtgtcgagcacgctgcggagcttattggtgctcctatcgataaggataaggtcgtcgtatactctaagggcggcgttaaagagggccgcactct

SEQ ID NO: 58377 - DNA, 149 bp, Zea mays
  Clone ID: LIB3069-019-Q1-K1-H10
atagacagagtttcatagcgcaagatgcggatggtgcacaggccactagcttgacagcttcgacgggatcctgcgatagctataccatgcagctcaggatgcctactacagcgcatgggatgcgccactatagcgcactaatctcatga

SEQ ID NO: 58378 - DNA, 223 bp, Zea mays
  Clone ID: LIB3069-019-Q1-K1-H11
atgtaatcgccgtgtacgtgaatttctgattctggcacgtacatggttcgcattcggtttggcttccaaaactgggtgtgacataagtggtatcaaagctgtgctgactgtaggaccgctggcctagagtagaattggccgtgttaaggacttattgactattacttcacctcatccttgattttgattcaaaatattagtcacctcgactaattttatgttg

SEQ ID NO: 58379 - DNA, 238 bp, Zea mays
  unsure at all n locations
  Clone ID: LIB3069-019-Q1-K1-H12
tgggacagctgccttaataaagtcaagattttgcttcacaagatcgatggtgtgtaccagagcactgttaatgcggctgagggcaaggtgaccgtgtnntaccgctggcctatagtacaattgtccgtgtcaaggacttattgactattacttcacctcatccttgattgtgattcaaaatattactcaccttgactaattttatattgaaacaaacgtacgattagaaaagtatact

SEQ ID NO: 58380 - DNA, 407 bp, Zea mays
  Clone ID: LIB3069-019-Q1-K1-H2
aacctcttggctgatttatgtgcttgtcgatgtgcgggtggatctgcggctggatccccagcctcgagtgcggatggatgtgcgggtggatgtgcgagtcgttggacggtcgaaacggtcgtcacgatatatcgagtccccaatcgctcggaccctcgtcgcgataccgaaccttcacttgcactagaaatcacccggactacacctattcaccatgcctaaagcatagatatatgcataatggataatcgagaagtctcagcgatacgtatatctaaggatcttaagatttcctctcctagcgataagttggctattgctcccggtaccaacgatttcgaggaaacttcacggggcgaggtcggtgtcgaacacgctgcggagcatactgatgctcctatcgataa

SEQ ID NO: 58381 - DNA, 367 bp, Zea mays
  Clone ID: LIB3069-019-Q1-K1-H3
ctttgggctgatttatgtgcttggtagattatttcggatattagtaagacttaccctaataaggacgccgggtaagtgacttcggagagtcatctgagggcgccggagagtccggtccctaataccgccctgcgggctgatgacgcttcccctgctgataggctgaccaggaaatcgagcgacaattctaagcttcgagcctcccacttcgtatcgaagtcctttagtaaaaaggccccagacgctcggcggcgaagtcgtataagaaaggcgtgcgatcgcagcactggcatcagggcgaccccgtcgattcagagagacgtaagttctcaatcccgtaagaacgtataacgtaaagcagtgcgct

SEQ ID NO: 58382 - DNA, 358 bp, Zea mays
  unsure at all n locations
  Clone ID: LIB3069-019-Q1-K1-H4
ctttgggctgatttatgtgcttgtttatgtgcttggtttgtgttgttgagtctggtgattgntcttgtcttgctaatgaggcgtcttgttctgctgaggagcctagtggtgctgttacggatacntaggaggagacgttggtggatgatttgtcgtcgtgctttcggtagtcgtttcatttggtcgttgntacgtttactggtgttttgtatacgtcttatcatcgacgaccgttcctattaattatattattacatactcgaggtcgctagtcggggtcggccggtaataagataagaagaaccggtcgttctctaataatacctatactcatcattcattcggtcgtcccgagaac

SEQ ID NO: 58383 - DNA, 481 bp, Zea mays
  Clone ID: LIB3069-019-Q1-K1-H5
tggcttggaacctttgggctgatttatgtgcttgtggatgtgcgggtcatgttctgtcagtgttccttgtgaattgatctttgagaggttgagattattttgacgcttgttacggagattgatactaatgtgttgttgtttgttttagttggtgagggacttcttgcggctggcttgcttcctctacatccttgtaagtttaataagtgtcctgagacttagaagcggaatgtttctgtgtctcgggtacgggacactgctgctgataatcgggttactcggtggaattatactacggactcacgtactgagcgttaagtgaattaagtcagtgtgattagtgaggagcgtatcgctgtccggggcgctcgcaactacgttccctatccctatcgtcctaataggcggtccaagatctgttaagcgcgtttaccagacaatagcgagcgggagccttagaaacaccgttatcagccttcgg

SEQ ID NO: 58384 - DNA, 389 bp, Zea mays
  Clone ID: LIB3069-019-Q1-K1-H6
cctttgggctgatttatgtgcttgtttatgtgcttggtttggtggtgtgaagtgcagggcgagaacactggagcctggtgacgctgaagtggtagggattgttgaaatattagaattgtcatgtgcggaagttgaattccggctagaagactaatgaaattgagtttgggggtaggccttgattctcgctagaaactattggtgctcgctagtgtcgttgggactaaactgatcggaaatgtagacatggaaaacataagtttaccgccgagttagtaaaacgttagaagcgcaacaagtgaaatgcctggtaagtacattacaatgcacgtagagaccgtcttaaggattctggtacacgcgtcaagcgtcgtatacgcgccaacgag

SEQ ID NO: 58385 - DNA, 191 bp, Zea mays
  Clone ID: LIB3069-019-Q1-K1-H7
ttgggttgatttagtgcttgttttgtgcttgtcttgttagttcccagtccctcgcgaaaacatttgagactggtgacagggatgttccggcgattgattaagtattataattgacatttgctgaagtttaattaccggttagaaaactaatagaaatttactttaaatctaaagattattttacgcttcaa

SEQ ID NO: 58386 - DNA, 448 bp, Zea mays
  Clone ID: LIB3069-019-Q1-K1-G12
agacccgatgcagcaacagcaggacccagtttccgccgatcccgagccactgccgcccggggacctcggtgatgccgccggctcgttcgcaacgcagacgatcccttcccgcaacgcctgctccaagtacgatttcgtcaaggtcaaggtctggctcggggagaacgccgaccactactacgtcctctccaggttcctcctcagcaggatgctcacagtcaccaagattcctaatcatgtcgccatcaagattgcccttgagctcaagaagctgcttgtcgacaacagcctgcttgatgtatcccagagtgatctagaagctaatctgttcaagcttatggaaaaacggggatacggagaggagtatataaatcgctataaaatgatgacaaggttccatcatcaacgggttccactagtaattttggtgtgtggaactgcctgtact

SEQ ID NO: 58387 - DNA, 352 bp, Zea mays
  Clone ID: LIB3069-042-Q1-K1-E11
gaggtgggttggcttctcctccccctccgtttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggc

SEQ ID NO: 58388 - DNA, 274 bp, Zea mays
  Clone ID: LIB3069-042-Q1-K1-E12
gtagttgccatatgttcagtaattttttcctattaaattgtttatgtatagaaaattatgcgagaaaaatggaatggttaagatctttacaaaaaaaaaaaaaaaaaaaaaaaaaaaaaaaaaaaaaagaaaaacaaaaaaaaaaaaaacaagacttacagacacatgcaagcaaataactaaattataaaatgagctaccttaaattaattgactggccatcgatatacaactgactgacaagaaaaaacctgtacgtaaccaaattaatcgg

SEQ ID NO: 58389 - DNA, 241 bp, Zea mays
  Clone ID: LIB3069-042-Q1-K1-E2
gctcaagttctcgcgctcacattcaaatatatgttcactcaatcgcggcataagctgcggtgcggccatggacgccagcggagccggtagcaatggccaataacggggcagttgggcgcaaggctggtggccccagcatgaagtccgagtcgcagaccgtcaaggccaggctacacatcttcggcatggacatcgggctctacctaatgaacgggcggtacgtctcaagcgtgcacaccgg

SEQ ID NO: 58390 - DNA, 376 bp, Zea mays
  Clone ID: LIB3069-042-Q1-K1-E3
tggcattgcccggcatgcaaaaatggactttggtttattgactggtacaaagggctgcagcctgtagtgagtcatgctagaacaaagggttctacaagggttaaacttcacagggaattggctgcattgctggaagaggagctttctcgcaggggaacttcagtgttaccagcgggtgaacaatttgggaaatggaaaggactgcaagaaagcactgatcgtgagatagtgtggccaccaatggttattgttatgaataccttcttggaaaaagatgaagatgataagtggaagggcatgggaaaccaagagctccttgattattttggagaatatgaagcaagtaaagcacgtcatgcctatggtccctctgggc

SEQ ID NO: 58391 - DNA, 379 bp, Zea mays
  Clone ID: LIB3069-042-Q1-K1-E4
ggagaaggagaaagagaaggagcgggcgctgcggcgcgaggagagggaccgcgaggagcgggagagttccaggcggcgcggggatgcggatggagaggaggacgacgaccgggaccgcaagcggcgccgccggtcctcgcaccaccaccaccgggacccagagccggagccggagcctgcatcccgggaagaggaggaggtggacgccgaggaggctgagcgccggcgccagcggaagaaggaggaggacatggaggccgagcagcagcgcctcgacgacgagatggagcgccggcgccggcgcgtcaaggagtggcaggagaagcgccgcgagcagcagcagcaggacggcagtgttgccagtggcgcttctgctgct

SEQ ID NO: 58392 - DNA, 372 bp, Zea mays
  Clone ID: LIB3069-042-Q1-K1-E5
cttgatcctcctggaaatacaggacaccctgaagtcaccgccggccgagaacaagacgatgaagagggcgtcgatgatctcgatcctcgtcacgacattcttctacctctgctgcggctgcttgggctacgccgccttcggcagcgacgcgccgggcaacctccttaccggcttcggcttgtacggtccgtactggctcatcgacttcgccaacgcgtgcatcatcctccacctgctgggcgggtaccaggtgtacagccagccgatattccagttcgcggagcggctcttggcggagcggttcccggacagcgggttcgtgaacggcggctcctacaccgtccggttcgcgtgcctgcgggcgtgccgggt

SEQ ID NO: 58393 - DNA, 299 bp, Zea mays
  Clone ID: LIB3069-042-Q1-K1-E6
agcagaggcaccccgaagcgcggcagagtatcatgcggcgcggggatgcagactgagaggaggacgacgaccgtgaccgcaaggctgcgccggcctgacctcgcaccaccaccacacggacccagagcccgagccagagcctgaatcccgggaagagcaggatgtggacgccgctgaggctgagcgcccgtgccagcgcaagaaggaggaggacacgaaggccgcacacaagcgccattacaacaagatggagcgccagcgccggcgcgttaaggagtcgccggagaagcgccccgagc

SEQ ID NO: 58394 - DNA, 370 bp, Zea mays
  Clone ID: LIB3069-042-Q1-K1-E7
cccacgcgtccgtccctatattgcttcaatgggagtttacgtttttaagagagatgttttgttagaccttctaaagtcacggtatgctgaactgcatgactttggttctgaaattctgcccaaggctttgcatgagcacaatgtacaggcatatgttttcactgactactgggaggacattggaacaatcagatctttctttgatgcaaacatggccctctgcgagcagcctccaaagttcgagttttacgatccgaaaacaccattcttcacttcccctcggtacttgccaccaacgaagtcggataagtgcaggattaaagacgcgatcatttcacacggctgcttcttgcgtgagtgtgccatcgac

SEQ ID NO: 58395 - DNA, 175 bp, Zea mays
  Clone ID: LIB3069-042-Q1-K1-E8
aaaggagaatggtgcatgcaagggttgctctcatcaaccgtagcagtggaaggaaggaagccaccgtcgggcttggcttatgctaggcagtgtttctttggtattgctcctcatagtctttcccaatctgaaagtgattctcttttaaaaattccatctgatgatgattccaacc

SEQ ID NO: 58396 - DNA, 385 bp, Zea mays
  Clone ID: LIB3069-042-Q1-K1-E9
ccttctcgcgctctcgagattcttcccactttcacactgaagattcccgccgcctcccctgtgtcggcgctgctgccagcgctagcaccgatgccaccttgtcttgcctctttccatccaccgtcatcgccgctacctatggcttccacgtcgggccgtctcttgcctcatcctgttccccgccgctgctctcgccacccactatcggaggcattgtgtccagcaacatggttaagagggtatgctgtctgagcgccagggagatccgaacggtgatgccctctactcgcttcccattgtcagtggggctgccatagttggagagtggcggcgtagcatgccgacgactgcgagttcctcaacatgtactccggtaccaagcaat

SEQ ID NO: 58397 - DNA, 372 bp, Zea mays
  Clone ID: LIB3069-042-Q1-K1-F1
cggacgcgtgggcggacgcgtgggtgcagggcggtatcgcgagcagccccggcaccactttcaaggtatcggatgcggagatattcctgttctccggcatgggagcggcggagtctctgaggccaagctcctgctccagcaacgggaaggatgatgaccctactcacgcagacgcagactgcgccgagaaccgtggatcgtcggagaagaggctgagctccgcgagccgggccaaagaccgcctcaagatgatgctgagatggcctcgccacaaggacaagacgcccaagaagtcagaggacagcagcccgctggggtcgatcagcaggctgaacgagcacggggccgagacccctgctccgctgaggcaga

SEQ ID NO: 58398 - DNA, 368 bp, Zea mays
  Clone ID: LIB3069-042-Q1-K1-F10
ccggccttccccctctcgtcacttatggtgcccagccgctcgctgcgcaactactagcgcaccgtcccctcctcagccatggccgcggcgtcgttcgcccgcgccttatgtctccacatgctcctcctcttcctcgtggttggctcggcgcgctgcaagacggtgaagagagacgtgaaagcattgaatgagatcaaatcttcactaggctggagagttgtatactcatgggtcggtgatgatccttgtgggcatggtgatctacccccctggtctggtgtgacatgttctcagcaaggggattacagagttgtgacggaactggaagtctatgctgtatcaatagttggccctttcccaacagcagt

SEQ ID NO: 58399 - DNA, 404 bp, Zea mays
  Clone ID: LIB3069-042-Q1-K1-F11
cggacgcgtgggcacacatatatttgtatttatacataataagtatttcttttttttgtgtgaattctggaacggtattgacaagcatggtcgagacacccatgtctcacatcatatgaacatgtcggtgattgatttgagctactgatggtttattcacttaagcaatctttcttgtgagtgtagagcttgagaatacttagctcattattcttgtctttttttgggcaggattcaaacaaaccagtacattaccaccatggttcttgattcattatcatcacctcacaggaggtcccaaaacacattcttcgtgtcatctgcaaaaaagcctcagtcatctcgtgacgacagttggtctgcactgggtgagcgacaccggtttcttctgacgacacttcctg

SEQ ID NO: 58400 - DNA, 396 bp, Zea mays
  Clone ID: LIB3069-042-Q1-K1-F12
cggacgcgtgggcggacgcgtggggggcttaattaggcggaaagattataattgacaacattgacatctctgcaattggccttcatgatctgcggtcacggttgagcatcattccccaagaccctacattatttgagggtactatcagaatgaaccttgatcctcttgaagagtgcactgatcaagaaatttgggaggcactagaaaagtgtcagctaggagaggtcattcgttccaaggaagagaaacttgacagtccagtgctagaaaacggggataactggagcgtgggacagcgccaacttattgcactgggtagggcgctgctcaagcaggcaaaaattttggtactcgatgaggcgacagcatctgttgacacagcaacagacaatctta

SEQ ID NO: 58401 - DNA, 383 bp, Zea mays
  Clone ID: LIB3069-042-Q1-K1-F2
caaggataaggacacaaaggagaacaaggggttcgcctttgtcaccttcatggacaaggaggctgcgcagcgcgccatcgaggatgtgcaagacagggagttcaaggggaggactttgcggtgctctctgtcgcaggcaaagcacaggctgtttgttgggaatgtgcccaaggggctgagcgaggaggagcttaccaacactatcaaggggaagggtccaggtgttatcaacattgagatgtttaaggatcagcatgacccaaaccgtaaccgtggcttcctctttgttgagtattacaaccatgcctgcgcagactatgccaggcagaaactttcatctccaaacttcaaggttgatgggagccagttgactgttagttggg

SEQ ID NO: 58402 - DNA, 367 bp, Zea mays
  Clone ID: LIB3069-042-Q1-K1-F3
cccacgcgtccgccgcaccctttcatcattctgcctgtccactgttggcttggtgacttgctccgctccgctcccctccgctcccgaacggtcgatctttgcatggcagcagcagctggctccaaggggcgggcgatcgctggaagcttcgtcagccgcgtcctcgccggcaaggccgcctcgccgaggagggccgtgcacgcctcggcgtacgacaagaacctggaggaacaggtgcgcccggcgttcgtgccggacgatgtgatcggcagcgccgggagccccgacaagtactggagcccccaccccaagaccggcgtgttcggcccggcggcggtggaccccaagctggcagctggtggcgcgc

SEQ ID NO: 58403 - DNA, 373 bp, Zea mays
  Clone ID: LIB3069-042-Q1-K1-F4
cggaccaccggtgacctacccgccgatcaccggccctccaacaacgccgcctgttgtcggcccaccggtgacctacccaccgatcactggcccgcctgcgacgacgcccccggtcaccggtccgcccgtgacctaccctcccggcggaggcgggggaagctcgacgccgtgcccgccgccaccgagcccgacgccgacgccgtcgtcgcctacgtgcccggctgactcgctgaagctgggcgcgtgcgtggacctgctgggcgggctggtgcatatcggcctcggcgaccccgtggtgaacaagtgctgcccggtgctggaggggctggtggagctggaggcggccgtgtgcctctgcaccaccatcaagctc

SEQ ID NO: 58404 - DNA, 371 bp, Zea mays
  Clone ID: LIB3069-042-Q1-K1-F5
tgctcttcaggcagcatcggccttggcacttgaggttggtgacaaagcttctgaaaagcttttttgggacaaatatgagaaggccaagtttgtctatagcaagctgtggaacggttcttacttcagttatgatgatggcgacaacaaaatgagcacatctatccaagcagatcaattggctggacaatggtatgccaaagcctgtggtctcttcccaattgttgacaaagacaaggcacaaagtgcgctagagaagatatattctttcaatgtgatgaagttcaagggtggtacaaggggagccatgaatgggatgtggccagatggcactgtggacatgtctgcaatgcaatctagggagatatggccag

SEQ ID NO: 58405 - DNA, 377 bp, Zea mays
  Clone ID: LIB3069-042-Q1-K1-E1
gctcaagttctcgcgcccacagccaaatttttctccactcaatcgcggcataagctgcactgcagccatggacgccagcggagccggtagcaaggcgaagaagggggcggctgggcgcaaggctggcggccccaggaagaagtcggtgtcgcggtccgtcaaggccgggctgcagttccccgtcggccggatcgggcgctacctcaagaaggggcggtacgcgcagcgcgtgggcaccggcgcccccgtctatctcgccgccgtgcttgagtacctcgccgccgaggtgctggagctggccgggaacgcggcgaaggacaacaagaagacgcgcatcgtcccgcgacacttgctcctggcgattcgtaacgacgttg

SEQ ID NO: 58406 - DNA, 377 bp, Zea mays
  Clone ID: LIB3069-042-Q1-K1-C2
cgcatgacagtttcctgggaattgacctgtctagtgatggtcatacacttgtatcgtactcccagctctcaaactgggacaagtgctcctcatgggagggcttcaaggtgtcaccattcaccgcaggagcgaggacattcagcttcgatgcaaatccatgcgattacttccagggtggcaagattaaagcaacgaccctctccctgtcagtcttggtggccattgagatgttcaactcactgaatgccctgtcagaggacggcagccttgtgagcatgccaccatgggttaatccgtggcttcttctggccatgtcggtttctttcgggctgcatttcttgatcctctacgtgcctttcctcgctcaagtgtttggg

SEQ ID NO: 58407 - DNA, 378 bp, Zea mays
  Clone ID: LIB3069-042-Q1-K1-C4
ccaggaggccgtctgggacgctgacattgtcgtcaacggcctgccttccaccgacaccagggaggtgttcggggagatcaggaggtactggaaggagaggattactgcccccatcatcatctccctcgccaaaggaattgaggcctcgctggatccactcccacggatcataactcccacgcagatgattagcaatgcaactggagttccatcagagaatattctttatcttggcggacctaatattgcttctgaaatttacaacaaagaatatgcaaatgcacgtatttgtggagctgacaaatggagaaagccccttgcaaagtttttgaggcagcctcattttattgtgtgggataacagtgatctcatcactca

SEQ ID NO: 58408 - DNA, 370 bp, Zea mays
  Clone ID: LIB3069-042-Q1-K1-C5
gccaaagaattccctcccctagccgccgttgccgctcgtctccctgagaggtgccgggaccgaggatttggccgagttctaggtagagaatcggttttacttgtctcagcccggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttctatgatgtatgaagctccccttggctacagcattgaggacgttcgacctgccggaggcgtgaagaagttccagtctgctgcttactccaactg

SEQ ID NO: 58409 - DNA, 372 bp, Zea mays
  Clone ID: LIB3069-042-Q1-K1-C6
cccacgcgtccggcggggcgatcatctggtacaagccggagtggaaggtcatcgacctcatctgcacgctcgtcttctcggtggtggtgctgttcaccacgatccggatgctgcgcagcatcctcgaagtgttgatggagagcacgccccgcgagatcgacgccaccaggctggagagcgggctctgcgggatggagggcgtggtggccgtccacgagctgcacatctgggccatcacggtgggcaaggtgctgctggcgtgccatgtgaccatcgccagggatgcggacgctgatgagatccttgacaaggtgatcgggtacatcaagacggagtacaacatcagccatgtgaccatccaggtcgagcgcg

SEQ ID NO: 58410 - DNA, 372 bp, Zea mays
  Clone ID: LIB3069-042-Q1-K1-C7
cccacgcgtccgctaaatcatggtgaactttttgagaaaaataactggttacccgaggggcctattaccattggtgttacttcaggtgcctcaactccagataaggttgttgaggatgctcttcagaaggtatttgagatcaagcgtcaggaaattttgcaggttgcataaattttaagcagagatttggtgaagagctgaatagttttggcttggcaaaggttactagaaacgttgcacaggcaaatgtttgtacagtagctaaggatgtaacgagttgggcacgaatactaccacgagtcactatccttgtgctggaatttacagtacggtggaaactaaaatggtgtaagtttctagtacacgagtcac

SEQ ID NO: 58411 - DNA, 373 bp, Zea mays
  unsure at all n locations
  Clone ID: LIB3069-042-Q1-K1-C8
gcgagcaacagcagcgaggtttaccccaattccccatttcccgtagcacggcagacgcgctcccttctgatttctgaatccccgacgccatggcctccgcaccgacgccgccgcccctcctcccggtgaccaaccctgcgtccggatcgtccccggccgccgccggaggctccgatgcgccgatcgctacgccggctttccggctcttcctgagccggatctccgactcggcgcggcgctcgctgtcggatcgccggccgtggggagagctcctcgaccgttcggcgttctcgaagccagactctctctccgacgccacctcccgcctgcgtcgcaacctcgcttacttccgcgtcaactacgccgncgtggt

SEQ ID NO: 58412 - DNA, 319 bp, Zea mays
  Clone ID: LIB3069-042-Q1-K1-D1
attagctgagaagctggctgcagtcaggagttcatagggcggcacatcactggatgccgctgacaaagtttgagtcttctatgcaacgaacaacgagctgtgcggtgcagtttgtgatttcctggcaattcgtttctatgtgatttcaccagccccagcctcaccgccgagtgcttcattttttttatggtttctcatcctaatcatcatcgggaaccaactaatgaagcactgcgcgcccattttccccatggtttctctgtaatcaactagaagtgatcaagtaccaagcagtgtacaatgcgatgctccctaggac

SEQ ID NO: 58413 - DNA, 406 bp, Zea mays
  unsure at all n locations
  Clone ID: LIB3069-042-Q1-K1-D10
cccacgcgtccgcggacgcgtgggcgaggtgctaccgcatcgccggcggcccgctcggcgaggtcgtcgacccgctctaccccggcggcagcttcgacccgctcggcctcgccgacgaccccgaggccttcgccgagctcaaggtcaaggagctcaagaacggccgcctcgccatgttctccatgttcggattcttcgtccaggccatcgtcaccgggaagggcccgctcgagaacctcgctgaccacattgccgaccccgtcaacaacaacgcttgggcctacgccaccaacttcgtccccggcaagtgagggaggcgccgncggtgacctttaggtgtccggatgcatgtgagcgcacgctggttttcggtttggaccatgatgtaaactatgggtcaatcgac

SEQ ID NO: 58414 - DNA, 412 bp, Zea mays
  Clone ID: LIB3069-042-Q1-K1-D11
attcgcgggagcccagatgtgaaatgggatagcatcaaaggactggaaaatgcaaaacgccttctaaaagaggctgttgtcatgcccataaagtacccaaaatacttcactggtctcctttctccatggaaaggcatcttactttttggccccccagggacaggaaagacaatgctggcaaaagcggtcgctactgagtgcaaaaccaccttcttcaacatttcagcatcatcaattgtcagcaaatggcgtggagattcagagaagcttgtcaaagttctgtttgagcttgctaggcatcatgcaccatccacaatattccttgatgaaatagatgctatcatcagccagcgtggtgaagctcgcagtgagcatgaagctagtcgtcgcttgaagactgagctacttattc

SEQ ID NO: 58415 - DNA, 370 bp, Zea mays
  Clone ID: LIB3069-042-Q1-K1-D2
ccacgcgtccggctcgctcgtcccagctgtatcaggtcgagcacctagtagcgacctgctcgatcatcagtgtagagtgtcggtaggtgtctgtctctcttggtggctggttgcaacggtcatggcgacgtcgtctcgtcgggtgcccttgctgctgctgtccctgggcgtgctggtgtcctgctccttcgcggcgggcagcttggaccaggagctggacatcacgtggggcgacgggcggggcaaggtccttgacaacgggcggctgctgacgctgtcgctggaccgcacgtccggctccgggttccagtcccggcacgagtacctgttcggcaagatcgacatgcagctgcggctggtgccgggcaac

SEQ ID NO: 58416 - DNA, 376 bp, Zea mays
  Clone ID: LIB3069-042-Q1-K1-D3
cacgagcgattgcggcggcggaagtaagatgcgatggggcactccaacgtgtggaactcgcaccccaagaactacgggcccggatcccgcgtctgccgggtctgtgcgaaccctcatggactgatcaggaagtacgggctgatgtgctgcaggcagtgcttccgcagcaacgccaaggacattggcttcatcaagtaccgctgaagtcagctgggcgggctatctgaatgccatctcttggacagtgtagtagaggcgatgccacaattttaattactgtcatttagatgttcccttcagaactctgctatttaagtccgccatgtttgtgatggagaactgaagctttgtttgttatactgattatgagttacct

SEQ ID NO: 58417 - DNA, 376 bp, Zea mays
  Clone ID: LIB3069-042-Q1-K1-D4
cggacgcgtgggtcccactatgcgtcccatgccacctcgcgtccatgatcgaagccggcaagcggctgctcggcagaagccgctgccccatgtccctcaccgtgctcatcacgcagatgaccatgtccgccaacctgatgtccgacgtcgacgacatcatgcgacgggaagccgactccggcctggacatccgcttcgtccacctccccgccgtggagctccccaccgtccaccacggcctcgaggacttcatgatgcgcttcatacagctccacgcgacgcacgtcaaggaggccgtctccggcatgtcgtccccggtcgccgcggtcgtggtggactacttctgcaccaccctgttcgacgtcgcgcgcgagct

SEQ ID NO: 58418 - DNA, 370 bp, Zea mays
  Clone ID: LIB3069-042-Q1-K1-D5
ggcttctcctcccccaccggttcgtgtttttgttctggttcgtgggcgagagggaagagatggcggcgtcggacgttgagtaccgttgcttcgttggcggcctcgcctgggccaccgacgaccactccctcaacaacgccttcagcacctacggcgaggtcctcgagtcgaagatcatcctggatcgggagacgcagaggtcccgcggcttcggcttcgtcaccttctccacggaggacgcgatgcgcagcgccatcgagggcatgaacggcaaggagctcgacggccgcaacatcaccgttaacgaggcccagtcccgcggcggccgtggaggcggcggtggcggatacggtggcgggcgccgtgatgg

SEQ ID NO: 58419 - DNA, 66 bp, Zea mays
  Clone ID: LIB3069-042-Q1-K1-D7
tcgcattgtcacagacgagtcgacagttatgttggacggaacgtcgcctgaggtaggggcgggcca

SEQ ID NO: 58420 - DNA, 163 bp, Zea mays
  Clone ID: LIB3069-042-Q1-K1-D8
tcttttttcccactatttgtccctttccttttcttgtccatgatcgaaaaccgcgagcggcttctcttcagaaaacgctgtcccatattcctcaccgcgctcataacacacatgaccatgttcgccaaaccgatgttccacagtcgacgacatcatgcgacag

SEQ ID NO: 58421 - DNA, 343 bp, Zea mays
  Clone ID: LIB3069-042-Q1-K1-C12
gagcaatctaagggacatgataaaggtgattcatggtgtctaggcaccacataaacatatctgtgattatgatggaccctttaatatagaacaaaagttttggctcatttgagctaccagcgtaccagtaggcaattcgatttgttaccagcaacaagtgatctgattcccagtggtcctgctagagtaacattttttaccactgtctgttgtctatgtatcctttgatattgtgttgtaccaatgtgcaatttactctatggactgatggaacattgtgccatcccatccaccagatttattgtggcgttatggaaagcatagaaccgctgccatattcttt

SEQ ID NO: 58422 - DNA, 208 bp, Zea mays
  Clone ID: LIB3069-042-Q1-K1-D9
tgcgtgtcctcctactctacccctcactgtgtcgcatccacatacgccaatttcgtcaccgcctcgtcctccttctcctcgcccctgtgcctcgacatctcgcatccgctccatctatggaaggccaccacgcgccatggatcgccggtctctaccgccacctcaattgaagggtcaccggtctctacgtggatccggcaccttcttc

SEQ ID NO: 58423 - DNA, 370 bp, Zea mays
  Clone ID: LIB3069-042-Q1-K1-A8
cttgttcctgcattgcaggtggaaggagctacggtgctcacagcgctgcattaggagatgaggtgtcttcctccgtctccaggcctggactgggggcaactgtacatggtgcctggtggtgtaatgtaacataacggcaatggcatatgcagctgatcctggtctgcctgtatcatctcctcccacccgtaaagagaagttctttctgccgccatcgccatggtcagtcagagcttctctgctatagctgctggatgtgttgtgtgttgcgtctgtatcgtccctactccctagtttgttcgacttacatggaaacctgagaccagaccgggtatcgagcggctgcttgcagggatggagtgctgtaatg

SEQ ID NO: 58424 - DNA, 240 bp, Zea mays
  Clone ID: LIB3069-042-Q1-K1-A9
accacgcgtacgccctttcgtgcgaccatttgtccttttacacgatgcaaagaagatgggtgtaccttctatggccacatctctgatgtcactcataagagtatggcccttagatgctgacgaactttagctctataatccataaaacatggcctaacaccctaaacgaatcagcctgacgaaccacaagcatctgacctgctacgtatccgatccaggcccctaagtgcaactcactgt

SEQ ID NO: 58425 - DNA, 373 bp, Zea mays
  Clone ID: LIB3069-042-Q1-K1-B1
cggacgcgtgggctcgggtgcaagcgcgcgcgcggtcggcttcgccacggtggtggcgttggcgggcgcgggcctcgccgtcctgctttaaaaactagactccgactcttcctcctgtcctcacgccgatgttgtcaccccctccccgtgcctcgacgttgctgctcgctccatttcagtttcatcttttttttttttcctttggtgttgttatttaattttaccggccctacgatcgattcttgatgtacacgatgatgatgcattggttgctttggatccgcgggcgggtggtggttagtgttctgcccgcgggtgtcgccatgtacttttaccgcactacattttggttctatagagagaggatttgtgt

SEQ ID NO: 58426 - DNA, 359 bp, Zea mays
  Clone ID: LIB3069-042-Q1-K1-B10
tcctcttctccctctcctcctcctcctccttctcgtcccccttcctcgggttggaaattggaatggaggcggcgacgatggcgtggacggcggcggtggtcggggcggggctggtgtactggttcgtgtgggtgatgggcgcggcggaggtgaagggcaagcgggcggtggatctcaagatgggatccatcacgcgggacaaggtgcaggacaagtacacccagtactggtccttcttccgccggcccaaggagacggcaaccacggcggcgtcggcggagaaggtgccggccttcgtggacaccttctacaacctggtgacggacatctacgagtggggctggggccagtcgttccac

SEQ ID NO: 58427 - DNA, 367 bp, Zea mays
  Clone ID: LIB3069-042-Q1-K1-B11
ccttaccaacagatcccacaagcatacggttaccgtcaaatgcctgcaaggttggacagtaccaacccatcgcaggccatgggaggttacacgctgcagtcgcagaaggcctatgcttgtgcaaacggcaaaggctcgcctgatgtggccgtgaacatgagagctccccccttccatctcccagctggaccaaagaagaacccattagataggatagcacctgacaccaccgacatatacacaagatccctgaacggcatcgtcgccgccgccgctgcatcagtgggcgctggcgctggtactcaccgaaacatcggcgttgtgccatctggcatgtcaaggatgtattagctgctgctgaaatgct

SEQ ID NO: 58428 - DNA, 361 bp, Zea mays
  Clone ID: LIB3069-042-Q1-K1-B12
acgaataatctcttcttcacctcactaacatcagctatcaactctttctctcctgcaataatggccgctcgctcctcctcctcccagccgcagctggtcgcggcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaggccacctgcaactgcctcaagagcatgactggccggctcggcggcggcgtcagca

SEQ ID NO: 58429 - DNA, 377 bp, Zea mays
  Clone ID: LIB3069-042-Q1-K1-B2
gcagcttctgcttgctctggggggaaggttagagagagagagcgagagagagatctagtagagaggctagtaggtggtcctcgaacgaagatgttggcggtgttcagcgggcaggtggtggaggtgccggcggagctggtggcggcgggcagccggacgccgtcgcccaagacgaaggcgtcgcagctggtggggcgcttcctggccgcgtccgagccggccgtgtccgtgcagctcggcgaccacggccacctcgcctactcccacaccaaccaggcgctcctccgccccaggtcgttcgcggccaaggacgaggtgttctgcctgttcgagggggtgctggacaacctgggtcgtctgagccagcagcacgggct

SEQ ID NO: 58430 - DNA, 373 bp, Zea mays
  Clone ID: LIB3069-042-Q1-K1-B3
gaaccttcatagtcatagactcataggtactaatgttacctgtctggacagtggatggggaccatagatcctttgccactcattcttagttataactaaaaatgcttcaaattaaatcaaatcgtcttccatttttttctctctctggtattaattcaagcaactgtataatgcttttgcctggtagatctaattaaaccaaatctctgcttataattctctgattgggatcttaacttacaatcaactaacctagacttgtcagctccagttcatgctgctttccattccatcagtaatgtagcatgcatcagtactgtaatcaatcgatggacgaataattgtgcttcattgttgtagtgactaatcaaat

SEQ ID NO: 58431 - DNA, 366 bp, Zea mays
  Clone ID: LIB3069-042-Q1-K1-B4
ggccctgctcctctgcaggatatggcaaggcaaattgctacagccaatggccctactggctataatagggattacctgttctcaatggagaaggcattagccagcattagccacgaagatgattcgatcatagagcttgcaaacgaggtgaggaaggtgctcaacagaacaaaggagaccaagatcactggtgccaatgcttccctgaaatcacatgcccctcttgtgcacctgtccgcgcttccagaaggcaccgctgtggactcgagatagcgagagccttggacgttggacctctactcggaatttacttccagctcttgcatgtttgtggccaaaaaaaaaaaattaaatttaaaaaaataa

SEQ ID NO: 58432 - DNA, 353 bp, Zea mays
  Clone ID: LIB3069-042-Q1-K1-B5
gccacgcgtgctgcctgcttgatgtgcgatttggccagcaaccaatggcaggagctgcccaagtacgtcaatgccgacggcgaggccagcgagttactgggcggcttgtccttacagcccacagtggaggtcaccggataagcgcttatggctatagcgttactaccattaattgcttcatacattaaggcgcattaattacgggtgggatactactccgagtgaatgatttcttcgagtgtgtgagcatgtacttactgctgtcatgtcatatgacattgacattattggtcttgaataaaatcacagatactgtgcgcatgactactgcactgaactggcggtcgctctac

SEQ ID NO: 58433 - DNA, 373 bp, Zea mays
  Clone ID: LIB3069-042-Q1-K1-B6
cggacgcgtgggttcgccgtggtcttgcttaggctgggagagcttgaagagaaggtccagatgcttcaagaaaagccttctgaaatgccttgcgagaaagaagagttgcttaacgctgctgtgcgtcgtgtggatgcattggaagctgaactaattgtaacaaagaaggctttgcacgaggctcttatcaggcaagaggaactgctcgcgaacatcgacagcaaggagattgccagggctcagagaaagaagaaaacaatgttctgctactaggacaacacctgcttccgtgaggagatgacaaacgcggcggaccccttcatttttctgacacttgtgaatcaacaggtttccgttgtaaatcaacaaaatt

SEQ ID NO: 58434 - DNA, 371 bp, Zea mays
  unsure at all n locations
  Clone ID: LIB3069-042-Q1-K1-B7
ctgtcacacacacacacacagacaagtggtttccaaagccaagtgtgtgtactagcaaccagctagctcgggcggcagcaggcagccatcatgtcggaggagaagcaccaccacttcttcaaccaccacaagaaggacgaggagcagcccgccggcgagtacgggtactccgagaccgaggtggtcaccgccaccggcgagggcgagtacgagaggtacaagaaggaggagaaggagcacaagcacaagcagcacctcggcgaggccggcgccatcgccgncggcgccttcgcactctacgagaagcacgaggcgaagaaggaccccgagcacgcgcacaggcacaagatcacggaggaggtcgctgccgc

SEQ ID NO: 58435 - DNA, 374 bp, Zea mays
  Clone ID: LIB3069-042-Q1-K1-B8
cggacgcgtgggcggacgcgtgggattgctcatagaaggcccagatttcagaaccaagagtgaagaagagcttactcaactgataccaaagatacaggtgatggcaagatcttcgccactggataagcatacccttgtcaagcatcttcgaactaaactctacgaagttgtggctgtgactggtgacggaacaaacgatgcacctgctcttcatgaggctgatattgggcttgcaatgggcattgctggaaccgaggtggccaaagagagtgctgacgtcatcattcttgatgacaacttctccactattgtcactgttgcaaaatggggtcgatcagtttacatcaacattcagaagtttgtgcagtttcagc

SEQ ID NO: 58436 - DNA, 364 bp, Zea mays
  Clone ID: LIB3069-042-Q1-K1-B9
cccacgcgtccgcccacgcgtccgcccacgtttccggtgtctagatattttcttggtgtctggccctggtatggccattgttggcaaaccaaaatttagattagagctctcatttggtcacatagttcatcttgatgatcaataagccaaaaccttggccacaaaagtgatgcccctgattatggtaatgttttgggggggggggggggcatgccctactcagactaatcccacaaatgatgcctggaatcggtcagcttacagtcattctgggagtgatcgatgaaattaggaattgccactatgctttatacattgcttaccattgagccaaatgcatctagagtgatgcttgagcctttat

SEQ ID NO: 58437 - DNA, 371 bp, Zea mays
  Clone ID: LIB3069-042-Q1-K1-C1
cggacgcgtgggcacaaaccagcagcaggcagagcaacgactagctgccaggcaagccggccgggggtgctgcaagagtgcaacaaacaatggccaccgcgctctccttcaaggccttggcactggccgcgctcctctccatggtcgtcgcctctggcgctcgcgccgagcaacagttcaagcgcaacgccaccaccgcctcgcaggacagatccttgttgtcctacagcagtggctggctgccggccaaggccacctggtacggcgcccccaccggcgccggccccctcgacaacggtggtgcgtgcgggttcaagggcaccaaccagtacccgttctcgtccatgacgtcctgtggcaacgagcccatc

SEQ ID NO: 58438 - DNA, 387 bp, Zea mays
  Clone ID: LIB3069-042-Q1-K1-C10
aaggaattaccaagcgcaaaaagaacaagcgtgagtgggatgagcaaactcaatcctggaagcggactcatggctatgaccgtgttaatgatgacaaagacattccaatcattgaagccaaattgactgacgagcctggtgttgatccatttgcgcaaagaagggatgagaagaagaagagggttgaaaagcaagaaaaaaacagactggataacttaaagaaagctgcaaaggttggcgctttgccaagtcatatacagcttgctgcgaaggcgttgcccatcacaggaacaaaagctgaccttccaaaaaaatctagaaaagaggatcttgagagtgttgtcggcatggcttcatcagcaacagcaagtggtgggaagtttgatg

SEQ ID NO: 58439 - DNA, 375 bp, Zea mays
  Clone ID: LIB3069-042-Q1-K1-A7
cggacgcgtgggcggacgcgtggtctccttgcgccgctgccgcatctcctctacaggtgagaaggagagaaagagggcgaaatggtgaagcacaacaacgtcatccccaacgggcacttcaagaagcactggcagaactatgtcaagacatggttcaaccagcccgcccgcaagcagaggcgccgcatcgcacgtcaaaagaaggctgtgaagatattcccacgaccaactgctggccctcttcgtcccattgttcaatgccagactctcaagtacaacatgaagtcaagggctgggagaggctttacccttgaggagttgaaagctgcgggcattccaaaaaggcttgctccaaccattggcatttctgtggat

SEQ ID NO: 58440 - DNA, 383 bp, Zea mays
  unsure at all n locations
  Clone ID: LIB3069-042-Q1-K1-C11
cgagcctccgcaagtggtatgggttcgatttcccttgcatcgagaggagcaactgggccacgtcctcgtcggctgggctggtgtgcctgatggacagcgagaacaggcgcagcgtcctggtgtgcaaccccatcactaaggactggaagaggcttcctgatgctcctgctgttgggggcaggacagctgattacagtggcctcgccttctccgtggacagaagcactcatcgctacaccgtggccgttgcaaggagcagccaggttccatccgagtattaccagtgggagttcagcatccacttgtacgactcggtgtctggcacctgggcgactcccttcacggnggtgttgcttgggtggagaggcggcgacgagtgcgtc

SEQ ID NO: 58441 - DNA, 399 bp, Zea mays
  Clone ID: LIB3069-019-Q1-K1-E8
ggcttggaacctttgggctgatttatgtgcttgagattactccggccttaggaacgcatccttccgggtcgaagaagttgtaggaatgcgtcgactctaccgtgcattcgaaggaagtaatcgtgcagcacaacgatatgttcccgttacgaagagaaaacctgccccgtagcccaacaacaaatacccccagataacccgggctatctcggccggatagggcatataactcatgctctagcacccccgcctccacggctctggcaccgaacgttcaggcgagccccccccagtcgcgtataaaaaaatagccaaatctgacggcactctaatcgtcggagaaacgtcagcgtttcacccccggtcgcggaaccggaaactcggaacgtacttaccccg

SEQ ID NO: 58442 - DNA, 375 bp, Zea mays
  Clone ID: LIB3069-019-Q1-K1-E9
gtcgactacgcgtccgcccacgcgttcgtgcaggctgagtggctgatatggtacgacgactgttacgtcgctcagggggccatgaccatgcgttctgcttgtactgtggaataaataaatgatgggttatggtactctttatctggtagagtttggcagcttgtgctttgagggatgtaatagtggccccgatgtttgtattttcatggcgagccggaaattttgtggaataaaaaaaaaaaaaaaaaatataaaaaataaatagataaaaaaaaacaacttgtaacagactcattaaacgcagaaaaaaaaataataaacgcacaaagttaccattaaaaataaaaagggcgccctttttaaaggacccaagtt

SEQ ID NO: 58443 - DNA, 360 bp, Zea mays
  Clone ID: LIB3069-019-Q1-K1-F1
gaactttgggctgatttatgtgcttgtttatgtgcttgtggagtatagccctgttgcctacgacttcctcgtagggacatcacggggccttattgatcttataggagaattctattcatgaaggtatcgagacggtgatgcatgtctaaggctactacaggaaggtcagaagtccactgagtagtgaatacggagacggcgtcgatgacgtcgagaagtttacaaggtggtgttagaaagttgatctcgagtcgatgataggcaaggaggataacggtggccgttctccgttaagggtcgggtaagggtcggtttccgagttaaaactcgggagctgattagatgggaatggtagttagt

SEQ ID NO: 58444 - DNA, 330 bp, Zea mays
  unsure at all n locations
  Clone ID: LIB3069-019-Q1-K1-F10
cccacgcgttcgcccacgcgtccgcccacttgttcgnccacgcgttcgnccacgcgtccgggaagagctactgggaggaatcggctcctttcctaaaggaaatttagaggaaataatgttcgcgccctcaatgttcaaattgcaggaaactccacattcctggacatcttcaattgaattgggaagaacattgcacgtctacgttttcaggccgtttaagattatctgattgacagtttcacgcctaacatngtacangatagattaagaacattngttgctgctgctcctgaatttctgcaatcaggatctcgtcagcctatntttgat

SEQ ID NO: 58445 - DNA, 466 bp, Zea mays
  unsure at all n locations
  Clone ID: LIB3069-019-Q1-K1-F11
cccggaaggccggaacccacctgctgcgcatctgcaagcctcgagttgagctcttccacgggcgctgtggagatggcggcgaatctggaggacgtgccgtcactggatctgatgcacgagctgctccgncgcatgaagtgcagctccaagcccgacaagcgcctcatcctcatcggtccacctggctctggaaagggaactcagtctcctattatcaaggatgaatattgctcngtgccattagccactggtgacatgctgagggctgctgtggcggccaaaacacctctaggtatcaaagctaaagaagctatgaataaaggagagctngtttcagatgatttggttgtgggcattattgatgaagctatgaagaaaccctcatgccagaaaggtttcattcttgatggcttttctagaactgtgactcaagcacaaaagcttgatgagatgttggcaaaacaag

SEQ ID NO: 58446 - DNA, 476 bp, Zea mays
  unsure at all n locations
  Clone ID: LIB3069-019-Q1-K1-F12
gcgtccggtccggccgtccgggcggcgccgggaggttataatggcctccactttgtcgccgccggtgttcgagagggtggccgggatccgagccattgccgagtccggccgcttcaaggcatggttgctggaccagtttggcgttcttcatgacgggaagaagccgtaccccggcgccattctggcattggagaagctagcggagaatggggcaaagatggtgataatcagcaattcctctaggcggtcatctgtgacaatgaagaagctcaagagcctggggttcgacacgtcctgtttcctcgcgaccatcaccagtggggagctcacacatcagcaccttcagaagagagacgacccatggtttgctgctcttggaaggaagtgtatccatatcacttgggacgatcgaggggcaatttctctcgagggccttggtttgcangttgtgaacaatgttgatgatgcagagttca

SEQ ID NO: 58447 - DNA, 175 bp, Zea mays
  Clone ID: LIB3069-019-Q1-K1-F2
tggaacctttgggctgatttatgtgcttgagttcgttccgtccctggtgagagaggaagcacgtggccgagactagggtaacgggtggggtggaggtgtccggttagttggatggctacgtgaatggggtttgggcggaagagaaatccgatccctcctggtggtagtccgggaa

SEQ ID NO: 58448 - DNA, 400 bp, Zea mays
  Clone ID: LIB3069-019-Q1-K1-F3
ggaacctttgggctgatttatgtgcttgtttatgtgcttgtggatgtgcgggtccggacaggacgataacatacttggtaaagagggtagatcaatttgttcctgccacaccgactagtaaacaaggtaatagtgagtcccttaatagcacggcacgtcatagtaaaatgtccggaggttatatagaggatcattcgaaaacctagctctgacctcttgggtccggtcccccgaatacccttcctatttgcacttaaaagacctcgaaaagtcaacgccactgagataaatcgggccgataagaagctagaccctaaatcggcctactaacgtttgcgcttggtcgcggaagttaacgactgaagatacgcataaagaagagaccggcgaagtggagtca

SEQ ID NO: 58449 - DNA, 365 bp, Zea mays
  unsure at all n locations
  Clone ID: LIB3069-019-Q1-K1-F4
ggaacctttgggctgatttatgtgcttgtcctttctatatacttcgccctccgttgtatcagaaatgctgacttagtaacggtcgtcattttgattactgcctcggcgtttgctcggggtaccggttatcctgcattaacgtctgaggctggtaagtggtcgtctgtatgtagtgtatcgttttctattgctattgcgtctgcaacgttgccgttcgtagaggtgaagtgggtgcttgagactattgagtatacatgttagtaggaagttcctggttctgttacttgtccntattactcgttagtggcggaatttttaattgattatctgggtactgaggagcatacactttgtcatgcgtagtc

SEQ ID NO: 58450 - DNA, 467 bp, Zea mays
  Clone ID: LIB3069-019-Q1-K1-F5
tggcttcgaacctttgggctgatttatgtgcttgtctcccgcgacgtcggggaccttgccggtacccccggattggaccaccctaacgttgcttacgctaaccttagacgataaggcgcaatcgatacacccaccgggcggtcgtgaactttaaaatatcccacttcgacgccgaccgggccggagaaggcctccgaaagaaaacgagttcactttcaaatccgctatcgccgcgaacttggggaattttctcggagtccccaccttaaggttcacgtccgagagaaccctagactcgcgtaaaaacgtcggcgtacggtccgcggccgataacattcacgagcatcccacgcacgacggaacggagtatcatcgtccagaagacgtctacaccgctaattctcctctgcctctaaaggtccacggaacgacggggcggtgcgcaggacataccgtacccttaaacg

SEQ ID NO: 58451 - DNA, 203 bp, Zea mays
  Clone ID: LIB3069-019-Q1-K1-F6
ctttgggctgatttatgtgcttgtttatgtgcttgtttatgtgcttcccaaaaacacaaaaataaaaaaaaaaaaaaaattaataggtaaacattaaataaataaatacatatatcccctataccattaatcactacttttatctatcttacttctactccaccaaactggataattcatattcatatactgcttttactttc

SEQ ID NO: 58452 - DNA, 338 bp, Zea mays
  Clone ID: LIB3069-019-Q1-K1-F7
ggctccgaacctttgggctgatttatgtgcttgtgccctagtattgtgtgtaactggcctgtccccctttctccttcactgtttgttggtgttgcgtgtgttgtttgcttgtcctagcatgatgctgagtaaggggaggcaaaagcctgcccggtgcgtgttacgcccaagaagcctctcctagaagacacactcggatagaactaagccaaggtcctcgcataatgaaagaccttgtaaagcactgtcgacgagcattttagttccgaattcccgtcagacgatccgtccttaaaaaagctattcacgaccggcggcaaacgttaaaactactccaa

SEQ ID NO: 58453 - DNA, 435 bp, Zea mays
  Clone ID: LIB3069-019-Q1-K1-F8
aacctttgggctgatttatgtgcttgtgtatactctgcagaactagcttcccgatcccaatagtcacactaatcgcctaactgacgtttccactaggccccggcggaagcggactactccccgtacttgacgacttgcccctcctcaaggaagggttcctataaaacccttaaccgcatagtcgggagattcactagttcgcaagtggttcatccgtataattcgagcggattgtgcgggattaaatcgcggagcaccgcgtacccgtccactagtagcacacagcaaccctccttccgtggttctaacccaggcattccggagacgctctaacctttcccgtaatcggcgttgctcggtactgaaggtagccacccgcggtcatattaataataaccgagcgcgctcccgccgacgtcggaaccgtagacaccg

SEQ ID NO: 58454 - DNA, 388 bp, Zea mays
  Clone ID: LIB3069-019-Q1-K1-G1
ctttgggctgatttatgtgcttgtggatgtgcgggctgattatgtgcttgttccacgtgctaaaggtatatgccgggctcatgagcatccttgtacgtgtcgaattgtgtcggcggtaaggtcggaaataagggcgtcgaagtcgtctccatcctttctataagatacgccctcaaattcggtataacgaacaaccgctattacgaggctacgaacaagtataatcgctatggtgcgcgtcggggtagcggggtcgctgttaaggatacgtagtccgcgaagtagcgtcggagttgcttctactgttgagtagtctgcgagggcaacctaagtatgtcaacgtagctcggcttcataacagtgacttccggctcctattcatactcct

SEQ ID NO: 58455 - DNA, 285 bp, Zea mays
  Clone ID: LIB3069-019-Q1-K1-G10
ccgccgacgcgtgggctgacgcgtgggcatgatgattggtgcgctctttagagatgttaactagagggggtgtttaatgtggtatttctaatgatttaggggtaacaaataaggctatttcaggcgaaactttacttactacgcaggctatcctaccttgacacggatcgcaaacttgtactcctcaacctcaaaggctgtaacatcctgattctgcccaccacgatcacagagtcgctctccaacttctgtctcttacatctgtgcgcatgttataatgtacat

SEQ ID NO: 58456 - DNA, 462 bp, Zea mays
  Clone ID: LIB3069-019-Q1-K1-G11
cacagagcatgacccctcgtcccatgaattttatgttgactggtcctgtcacaatcctgaggtggtcattcgtcaggaacgaccagcctaggtttgagacatgctaccaaatagctcttgcaatcaaaaaggaggttgaggatcttgaggctgctggtattcaggtgatccagatcgatgaggcagctctaagggagggtctgccactacgcaagtcagagcatgcattctacctggactgggctgtccactctttcaggatcaccaactgcggagtccaggacaccacccagatccacacccacatgtgctactccaacttcaacgacatcatccactccatcatcgacatggatgccgatgtgatcacgatcgagaactcccggtctgacgagaagctactgtccgtcttccgtgagggtgtgaagtacggagctggcattggccctggtgtctacgaca

SEQ ID NO: 58457 - DNA, 469 bp, Zea mays
  unsure at all n locations
  Clone ID: LIB3069-019-Q1-K1-E7
ggcttggaacctttgggctgatttatgtgcttgcgaagagttcgcgcacgcaaacgtaaagtaccataacgttacaccaagatggtgctaactgtgggtcaaagtcgaactagaatgaaagtccactaaggggtgcaagtttcactcttacgagctatgctactagtacgttccgaaaagggttaggggagtcggaggctggccctctaatctaaagctagacgataaggaagagaatcttgatctgagctataaagagaactagaatggagccgtgttttataggagtggttaattgctaattttcttgctctttaatggcgtactgctagtcaactagggtaggtagctgcgaacgacgacctanaatctatagtcgaagagaccctagttttcgagtcagacacggtagtagccccgcatagaaaatgtcagcgggtagtaataatacggcgctgactggctgcgg

SEQ ID NO: 58458 - DNA, 382 bp, Zea mays
  unsure at all n locations
  Clone ID: LIB3069-019-Q1-K1-D12
cggacgcgtgggtttgctgccattagcgtgttgcctttcttgaggaagatgatgagatggaggatgcacattctattgctgcatctgctggtgacactaatattaatcttgatgttaatgtacactttgtatgtttctcctgtgttgatggtgaactttacgagcttgatggtctaaaatcacaacccacaccccatggcccttcatcacctgaaaccttgttgcangatgctgcagaagtcatcaaagctagaattgcggagaaccctaactcgatgaacttcaatgtcatggccctttcaaagaagtgaagtatactgtgatgggtggatttcattnggcagaatacgggtcccttttcttttcagttctgctgagtact

SEQ ID NO: 58459 - DNA, 482 bp, Zea mays
  Clone ID: LIB3069-019-Q1-K1-D2
ctttgggctgatttatgtgcttgtttatgtgcttgtttatgtgcttgtggatccgcgggctgtgagtagttaagaacctaatgggtatggcttgtttatttcttgcccttgtccttctttcttatgctgctctggctccttctcttcgcaactttgcgatatgggcggtcgtgatggtgaactagactttcatttgcggtgccggctgcgaaccggtgttgctctttttcgttagttggacctttcgtcccgcctctaggtaataccccgcctatcagcgcggcagtcccgccgaccggagcgtgtaacgcgaggtcgcgtgggaaaggcatgctgcgacgatgaagaaaagtccgaccccaaaggcggaaacgcctacaccacaataagtaacgagggtcgggattagaagaccgtagaagtacatagagacgggaaaatcgccgccgtaaaccctagtgtccttcggcgcgggttacgtt

SEQ ID NO: 58460 - DNA, 371 bp, Zea mays
  unsure at all n locations
  Clone ID: LIB3069-019-Q1-K1-D3
gaacctttgggctgatttatgtgcttgcttatgtgcctgtgatttatgtgcttgttcctgtgcctggcgagttgttttgttgtcttcgagttacgtctcttactctggcgctatatatcttgtacatgtgattcatgagagctgagcgatagtgagtgagtgagtgagtgaagttacggtctcntgtatttcggtactgaagaatgtttcacttcctgtgtctggtggtgtggtttggttgctggtggtgcgtgtgaggggggcgatgatggctgtgtcttttgattctcttcatgatcctggtgtgtcggagttggttactctgggggagactacgtgttcgtattattagaagtattatgttattcatg

SEQ ID NO: 58461 - DNA, 467 bp, Zea mays
  Clone ID: LIB3069-019-Q1-K1-D4
tggaacctttgggctgatttatgtgcttgtagttcccgaaaagaaaatttattttattgctgtggcggattaggtggatgagtaggaacggtgcatgtggtgaggtggaagaagtgggcgggttgtcatgaggcgggttggattactggttagggtattcctgttaaggctaagcctgttgctgatgttgatattggtgtgtttgctggtacgaaagggtctgatagggagattactcctgtttattgtacgtcttattagactaaaagggaaacactaactacgaagactgcaagatactttaatacagctaggtccaacgaggcgccggtagggaagatgaagacacatacaactccggaatccgctatcggaggtgaatcgcccgacaaaacagtttgacacgggaagtcatgcgagaacgaagttaggaagcacccttagtagtccaccgacgttaccgacca

SEQ ID NO: 58462 - DNA, 379 bp, Zea mays
  unsure at all n locations
  Clone ID: LIB3069-019-Q1-K1-D5
tggcttggaacctttgggctgatttatgtgctctgtttatgtgcttggatcgtgtacgtcgactcctctggtcgtgtgtgtgggtaactagagttgtggtatagagtaccgaacctatctggggctggcgggctagtctagtgtggtggtgattccgagacgagctgtgtggtgtagataggaggggttgggggtggaggtgtggtgaggtctaaggtgctngtgggcgttgtctcctctgcgtggtactccgagtattcgtatgtatttcgtgtcgagtttgatggtgatgtttaatgataacgcggcgttggggagtggccgtggtggtctgggtatgtttcgtgttgaggtgctcgctgtgccgttggcggtggcg

SEQ ID NO: 58463 - DNA, 438 bp, Zea mays
  Clone ID: LIB3069-019-Q1-K1-D6
tggcttggaacctttgggctgatttatgtgcttgcccttacccaagcggacaaataagccacgccaagaaggcccctacgcgatcgtaacggtagtactaggtaactgacgggtcacagctacgctttgtagcgtcggacccctcgagtaggccgcggagccggatcctccgcatttgagtgagggtacttacagatgtcgggataacggtccttgcaccatcgtaacggtcgttatgacggactagctcgtgtcgacttcaagtaagttaaggtgctgtttaagagatgagatataagagatctcgtggatcatatagccctttagctaatacgctaaggataagcgggttaagaactctcattccgtcgggacacgtcacgggtgaattgcggttcaatactgcatgccgtcgattcaagtcgcgcccgacgcaca

SEQ ID NO: 58464 - DNA, 324 bp, Zea mays
  Clone ID: LIB3069-019-Q1-K1-D7
tggttggaacctttgggctgatttatgtgcttgtttatgtgcttggggacgtcccgacgcgcatacggggccctcaaaaaattccgacataaggacgggggaatcctcccaagaagtatatacattaaactttacgactaggccctaacctctcccctagggagtgttaacgccggattctcccaaaaaatttgggcttacgaacacgaccatattcgccggctacgtagcgccgtaaggtccggccacctaggaatcgtcgccacactatgggcataattaactctagcctaacacgggtccggtacattagagtacgactag

SEQ ID NO: 58465 - DNA, 374 bp, Zea mays
  Clone ID: LIB3069-019-Q1-K1-D8
ggtctggacctttgggctgatttatgtgcttggagcagtcccgccctaacccatttcttcccccccttaggtcccgtggtcgaaagtgagtacgtagtcaattgcttgcttctcggacctattgcgtaggtcggagtataatcctggtaagcctttgcgtgcgattgttggtgagatgactgtggcgatcgagggtgagtgatggcatcattcggatgcgtcggaggtgcgcttggttggtgtggctcgtcttactgatatggatcgtgtcgtggatcccgtgttgttgtctgatcatgcggaggttttggttcctggcggtagttaaggtagtgatgaattgatgtagttggtttggactcgtggtatcggga

SEQ ID NO: 58466 - DNA, 348 bp, Zea mays
  Clone ID: LIB3069-019-Q1-K1-D9
ccggccagacgtacgctgcgcggcggtgacgattttggcgcggttcggtttctaactgctgtgggagtccctatgcaggcgcagctaccacctgtaccagatggagtgcatgcagaacctgaacgcggtgtgccagtactacccgccgtgcccggaacacgcaccgaaccttgggcgtcaagaggcacacggaccctggcttgttcaccatcctcctgcaagacggcatgggcagactgcaggtgcgccttggcatcaacttgcagagcggccgatgctgagtagacatcgtgtcctggcctggggcgctcattgtcaacatctgtgatcttctgcaactcgtgacca

SEQ ID NO: 58467 - DNA, 263 bp, Zea mays
  unsure at all n locations
  Clone ID: LIB3069-019-Q1-K1-E10
ccgacgcgtgggcgcggcgtgcctggccttgtagctcgcgaggcttttcaaggggcangagtgcaccaacacgaggggcgccaacaccgtcatcggcaccgagcagcagttcccggactaccccaggtacctggaccgctgccaccttaacgcgtcggtgaccgaagacggccaggtgatgccggcgtgcgtgccgggcctcgtccccgacgtcgtactcgacaactacaccaagtcgcagtacaaccggttccttaacgaca

SEQ ID NO: 58468 - DNA, 471 bp, Zea mays
  Clone ID: LIB3069-019-Q1-K1-E2
gaacctattgggctgatttatgtgcttgtgtgctgatattattgcttttactgaggacctgaccggcgagtctaagaagccggcggaggaggggaaggctaagcatactggtccgctagaggttagtttagatataacttgttgcgtgtatgttgcgtactttactattgttgcgtagacggagcggctgtctcggctttgagatactgagtttgagactgcgttatctcgtagagaaccggggaccggaaccgcggtccatagcttaaccggttgcggaccccccggcggaagaggagcgatatagtaagccctcctcgaactcagctcgtaaaggtacttaagacccataatagaaagtccggagaagaataagtagacccattcgaaaacagaagacccggttaagaagcattagcgtagtttagtctagtcagtctcagttcgggcctcgtactaaggggacgacgc

SEQ ID NO: 58469 - DNA, 424 bp, Zea mays
  unsure at all n locations
  Clone ID: LIB3069-019-Q1-K1-E3
tggaacctttgggctgatttatgtgcttgtggatgtgcgggtggatgtgcggggcctcagcactgtgagtggttgtctcagaggacttaagtccatgcatgtgcgtacgtgatgctacagtctcctcacagcgctattcaaacctaacctatcggttgctgccccataatgctgcgatcgggaaaatttcggtgccatttaatccaactgttccgtagtatactttttccctgttagtcggtgcaacagtgaagaggtttgtattgactgtttcctttaatagccgtgtagttcgaacggtgaacgggatgtgtttcgcagtggtgtaccaagtgtggtgggcgcggcggccatgtgtagtgcgattgtcatatccgttagtgtttcagtgtttgtcttccctgtcnctcctttccttccctct

SEQ ID NO: 58470 - DNA, 436 bp, Zea mays
  unsure at all n locations
  Clone ID: LIB3069-019-Q1-K1-E4
tggaacctttgggctgatttatgtgcttgacggtcctcgaggccgcttgtttcagtgatcttgagtcatcaaaggtataagttgatacacggtggtctagttctcttcattctatgttttcgctatcgaggcgtgttgcggagtccggtacttttatggtgactcattgttacggtggngtcgttctagttgtcgagtcggctatggtgtcgctctcttttcctatcaagtcgttgccttcttgntgntcgtcgtggtcttctgttgtgctgggtgcgcctattgctgataagtagagtatggaagaagagtggcattgtactagttttgcgcttcattcttcggcggatggtactttctatgaggattatacgaattatattgtctcggcgtctattcgtattctgatgtgtcatactgaggtggggacagggtc

SEQ ID NO: 58471 - DNA, 488 bp, Zea mays
  Clone ID: LIB3069-019-Q1-K1-E5
tggcttggaacctttgggctgatttatgtgcttgtggatgtgcgggtgggttcgatgggaagtctaccggcttcttcacgggaaacttacggacgcatacgcatttcgagggtccgaaggactcttccacgactacgaagaataaacatggaaatttattcactcatactatggagaatggaactggggacgccgacattaaggagatattctcatttacggaggacgttccaaacgatcataaaaggtcagaccatacttagtgttatactgtcatctccaaggaactaacagatccgggactaaacgcgtaaggtcatcctgtccggctctcgtcggataatcccgaacggcctgttggtcctattgaatgccacggtaccgctcatgctgattgtaataacaatcgtatgtgtcatacgaaggagctcgttaagcggccgaaatagcctaatgttgtgaagaagtttagtaagaagacctccatt

SEQ ID NO: 58472 - DNA, 195 bp, Zea mays
  Clone ID: LIB3069-019-Q1-K1-E6
tggcttggaacctttgggctgatttatgtgcttgaaagctttaaaggttgttggtgtttcttagcttattacgggtgtgtagcttccttcgtctggtggtatcgctgctgttagggtttttgtgggtcctggtggctttcaccttcgtgtatgtttcccttaactcggttatcccgctgtttggttttggggggt

SEQ ID NO: 58473 - DNA, 386 bp, Zea mays
  Clone ID: LIB3069-019-Q1-K1-D11
gaagacgttacttgcctcgaatagatggatctaattctttcaagtttatagcatcagtcgtggctcttattccagcgctgcatccactcgtaacactaatattaatttctataccgatatacactctgcatgtacctcctatgtttattgtaaactttacaaacttcatcatctaaaatcacaacctatactccatggtgcttcatcatctgaaatccttccaacatcatgctccaaatacaattatagctacaattgccgaaaaccctaactcgattaaccttaataacattacccttacccataattgacaaccactgtgatgctcagatttcatttagcagaatactgctcccttttatttataattctgctccattcttcac

SEQ ID NO: 58474 - DNA, 381 bp, Zea mays
  Clone ID: LIB3069-019-Q1-K1-B5
ggctccgaacctttgggctgatttatgtgcttgagaccccgatgatggcgctggtgacgaatccacctccttctcggaactcgacctaattggcgaccccgcggataccgatcttgtactattcattcccttcagcgatgacgtaacggaactactaaccattaacctacccgtctggaaccgcctaaccaacggtatcttaagcccagccctcgtaacgaaaggaatatgcgcgaagaagggaactatgataaagccgagtgccctccgggttttcgacgcacatgatttcctcaccatcctcgatctgtatatggcgaaagggtattacatgagcctaatcaaaggcaatcataaacataagattcctaagagtagtag

SEQ ID NO: 58475 - DNA, 443 bp, Zea mays
  Clone ID: LIB3069-019-Q1-K1-B6
tggcttggaacctttgggctgatttatgtgcttgtttacttctctgtctgttaggagaactagttgttgccgtcgtcgttgtgcttatagaacggggggccctgcgaagatctacaagattaacgtgcaccctaaatgcccttaagcgaaacctaagagaaggtgggtcggtaagatagatcatagggttaggacaaggtcgaccaattaagataaaaataagcataatatatttaaacatagacccgccgcgtgacccattaataaggatactatcgtttaaactacactcgtcagcacagtgggcgacacggcctccgtcctcgttcatctgtacgagccgttatgacacggctccgaagccggctcgattaatcacgtagtcgttcatcgtatcggttcctcgccggtctgttgcgcgtctaagacttgcggcccggact

SEQ ID NO: 58476 - DNA, 376 bp, Zea mays
  Clone ID: LIB3069-019-Q1-K1-B7
cctttgggctgatttatgtgcttgttaagcctcatgttaagctgcgtttctatgcggttgttactgcgtggctggcgacggagtaggtggctgttaaggagtttaggacgggtgttcttactacttgttctcctccttatgatcgccctgctaacggccgcgatgtgcttacttcttcggacgatatcctgatgcctattggtgagaagaatgttggagtgaatgttaatcttgcttgtgggcatgaggcgactgatgttactaagatgtaggctgaagtagttcgtaagggtattgcgctgcgtgttgatactgctgttccggtgctctgcgatgttgcggatccgtctggaggtttaatacggaatgcgtagtc

SEQ ID NO: 58477 - DNA, 299 bp, Zea mays
  Clone ID: LIB3069-019-Q1-K1-B8
acctttgggctgatttatgtgcttgaaaaaaaaaaaaaaaaaaaaaaaaccaaagcccaatgaaacaaaaaaatatggatccgtacgtgtgcgtacgtaaggctatacacgcctctccgtgatattccagcctccccactcggttattcccccctaacgtatcggttgggaaaacatactggtcctataggcaaactttcccggcctttacatccacccggttagtcggttccattgtccctaggtttcggttgactgttgccacggatagccgtgtcggtctccctgaaaacgggatt

SEQ ID NO: 58478 - DNA, 413 bp, Zea mays
  Clone ID: LIB3069-019-Q1-K1-C1
gaacctttggctgatttatgtgcttgtcctggtaatgtgtcgctgtcgcatgaggaccgttatgcgtatgtgactgtgtgggatcatggggtgtcgatggtgtagaattggtagagtacgtcggaggatatggggcctctgcctgctaatcgttgggcgatggggcttggtgtgtctcattcgggttgtgttcggggtattcctctttgtgctgctcctgttcatatttatacggatgatactactgcttttaatgggcggcctaatcggggtgattttaattgtgagtcgatggcgcctcatgggtagcataagcgtatgggtttgggtgtgattcacgttggtttggcggtgcggctgtatgagtctattgatgatcaggttaagtttcctactctgtctagtcctactga

SEQ ID NO: 58479 - DNA, 378 bp, Zea mays
  unsure at all n locations
  Clone ID: LIB3069-019-Q1-K1-C10
nccacgcgtncggtcactgtatcagttctttatgcacttctgggttttggtggcaagtttgggtgttgaaggcaaggaaaggggttacattcacgtgtaaaacgcctcgtaaatgaatttgatcagatcaagtcaatctctgctttcaaggatgttcacagtaatactggcatctttggaatccatacatctactgatgcatcatttgttcctaaagctattgacctagcagccagagagctcatttcccttgcaactcctggacaagttgaccaaagccaactggaccgtgctaaagcctcagctaaatcagcgatactggcgaatttggaatcacaggcatcactaacagaggacattgggcgccaagatttggca

SEQ ID NO: 58480 - DNA, 478 bp, Zea mays
  Clone ID: LIB3069-019-Q1-K1-C11
accgacttacgcgtccgcccacgcgtacgctgggatgagataatcgttttgtgggcttagtttttctactcttaccggatacatatgcaactgaggtaacttttaaaaactcatttaaatcttgtaggatatgcccaaggcacggaagtaccaaagtaagagctttccattgctcgactcactagaactgttatttgatggtgagcacacctccatccacctcaccgggcacacatgcatagccacactacctacagctggaaaaggctgagaagagctgtgctatacgctgataccttttgttttactaaaacaaatatgttactgtgataggtcctattcctgaaaggggacagaaatcgccttccagcgtacctcagaatggtggtgaaaatgttgacgatggaggcaacaataccagcacaatcccagcaaacagcattaggacctcaaggcatagatgatctcgacacgctgc

SEQ ID NO: 58481 - DNA, 470 bp, Zea mays
  unsure at all n locations
  Clone ID: LIB3069-019-Q1-K1-C12
atcgacgcggttcggttccagtttcactcttactgccgtctcggctacctcccctgttccgggcttcgtcctcgcgtgccaggctgccatggccgcgacgtcccccttcgactgcgtcctcctagacctcgacgacaccctgtacccgggcgacaccggcatcggcgcggccctgaggcgcaacatcgacgagttcctccaggccaagctcggcgtgtcggccgacgaggccgncgccacgcgcgccgagctcttccgcgcgcacggcagctccctcgccgggctcatcgcgctcggctacgacgtgcacccggacgagtaccacagctacgtgcacggcaggctaccgtacgacaggatcgcgcgcgacccgcagctggcgcggctgctgcagagcatcccgcagcgcaaagtgctgttcaccaactcggaccgcgcgcacatggagcgggcgctggagcggctgggcg

SEQ ID NO: 58482 - DNA, 473 bp, Zea mays
  Clone ID: LIB3069-019-Q1-K1-C3
gaactttgggctgatttatgtgcttgtccgaaaggggagagagagagagagaagacacagagcagagagagagagagagaggagcgggagatgtgtgagaggtcgttgcgcagggattgcagatctagtgatcgtgaaggagggacaaggggacggttgggactggattgactaggtaggatcgggagttggctgccgcgtggaagaaggtatttattgttgttgttaagaaggacgagaaggttgctaatgttgtgtgttgtgttggcgtggagactgacattacgaagaagcataatgtcggcatgaataaggtggtacttagtggcatactttctaatattaagtgttctgatgatgatattgaaaattctgtttacgagtgagccttaagcgactcgaagaagaactctacgtaagtaaagtctgacaagaagtcgatataggtataatccgtctaagacgacaacgag

SEQ ID NO: 58483 - DNA, 486 bp, Zea mays
  Clone ID: LIB3069-019-Q1-K1-C4
ttggaacctttgggctgatttatgtgcttgtttatgtgcttggttatttttgtgtttccttctttccgctgagcttaaacttaggccacagagttcgctgtgttgttgtctgtagttgtctgttgtttggcatactctttttgtgttctctttcgtcttcggaccctattgactcggtacgtcccatcgctttgctacatggcggtagtgggagttgtttttccttcgttcttatagtctacgttacgtacggttgacttacctttctagactgggaccgttgtagatacgttgccgtccttttgccagtcctctttccgctatatttttctgtcctgcctcgtgcagccctggggcccgatattgtccgctcactttgccttcacagtccccagggccctgagtctaaatcttgtgttggtactctagccgtcgtaagcggtggtggtaagtcagaggtagtaatcgtacattccgtaagaaaaa

SEQ ID NO: 58484 - DNA, 433 bp, Zea mays
  Clone ID: LIB3069-019-Q1-K1-C5
ggtctggacctttgggctgatttatgtgcttgtggatgtgcgggtggatgtgcgggtggatctgcgggggcgggccggtcctcttctttttcgtggcctgggcctgggcctgcgaggcctcttggggcctggccctgcgggcgagtggactgagacggtggtgctggacgccgagcattgtcgtcctgctggtggttctgttcgggttatggatgattatctttcttataatgttcctagtattcatggtgaggcttctgagcttaagactacttctgactgggagatgtagaggctttgtggtcctggtcctgctattcctcttatggaggaggtgacgtggaatgttactgagggtacgaatggtaaggagtcggatggttgtaatactattgctaatgaggtttagctttgtggtggttgcggaggtggt

SEQ ID NO: 58485 - DNA, 453 bp, Zea mays
  Clone ID: LIB3069-019-Q1-K1-C6
tggcttggaacctttgggctgatttatgtgcttgggggtggttaataaggatgagtgacggtgattaaggctactcgtccttccgcgtctgtacgttcgtcttctgttgctgttccctttgcgctcgtctcgtggtagtaggcgaagaagggtggtggtggaggtggaggtggaggtagcgccagtggaagtggaggtggtaattcgaactttcgggagcgtctgtttaagcgtgggctgtggcgtcttaagatgtagcataggaaggttcgttctattccacgcaataagcgtcgtgttaagcgttctcgtgcgttattggggcctcatggtaataagggtgttcgttttcgtcataataatcggaaaattaaggaaggagggtttaagcgttttcagaagacttattgtagtctttgcttgttaccgcttttctcctcttgaactcggaat

SEQ ID NO: 58486 - DNA, 486 bp, Zea mays
  Clone ID: LIB3069-019-Q1-K1-C7
tggctcggaacctttgggctgatttatgtgcttgtttatgtgcttgtttatgtgcttgcttatccgcttgtttatgtgcttgcttatgtgcttcgttatgtccctggcatccgatcgtttcgatccgcatccacaagaagaatggaaaattcgtcgttacctaacacggaattggcgtaaccgtcggcccccctagcgaggacagtgccaaaccaggcgactcggacgcgaacgactaggaacccaccgaagtcataaaggagttaggttccattcctacggccgtaaaacccgacggtacctccgggtcaggtccctaggaaacactcgccgggaacgtaatattcgcgcggcacaatacggcaaaataaggctctactagcgatttcgcccctctcactcggcccaattgatacgtcggcgaaggagaaggcggcgaaaccgcgcccggcggaacggacctcagctatcataagggcgactata

SEQ ID NO: 58487 - DNA, 445 bp, Zea mays
  Clone ID: LIB3069-019-Q1-K1-C8
tggcttggaacctttgggctgatttatgtgcttgtttgagtgttaacggtcgtatgcatttcgccattttaagcgtcgtcgtaatgatgagtaggagtagtggcctggttggtgcgcatagtttcttagtgacgggcttgctggtttctaatgataatagtgtcgttgttggtgctgcttctttgacggtcggtgtcgggtggtcgtcgacttcggttcgtcgtctgtctgctgtctctcatcattctggtgtgcgacgactgcgcgaggatgagatgttgtcttttgtcgttgtccgtcgccgccggggcgctcctccttccagtttcccctcccctcttctcagcggtagcggtaggtaagagagaattccgcgacgacgggtgtatcgtatcgttccttattggcggaggagagtcgggtaacgcgaggttttcgcaaactc

SEQ ID NO: 58488 - DNA, 268 bp, Zea mays
  unsure at all n locations
  Clone ID: LIB3069-019-Q1-K1-C9
cgccacgcgtactccacgcgtgcggtnctttcttgatactccattattgacagctatgctattacacttcagggacaatattctggaagctggtatgcaaaggctgacaagttcgtgttcagttataaatcacatggaacctattggtgaccttaatcatgtatctgttctacgcgaggacatgacatacatgcatcatagaaaatttcacgccatgatttcaaagttagcttaaaacacacaactgtattcagcgcacatcaatcat

SEQ ID NO: 58489 - DNA, 459 bp, Zea mays
  unsure at all n locations
  Clone ID: LIB3069-019-Q1-K1-B4
ctttgggctgatttatgtgcttggccgcccggacgctacgcacgtagtacgcgcaggaaccttccaaccacgtcaaacccgcgctgcggcgggccctaccaggcgcggtcctactaaccggatcaggcctcggcccgtacatacccgcggtcgcactcgggcttctacaccgtctcgcctatcaccaaggtcgcctaacgcggctgaaccgactcaaaaaccgtcttacacgacattacatagtcaaaggccgggttactacggtccgataagaaacgcctagaacccggattattcgcgcacttagtactagtctacctagccaggactttagctcctgattcatcattctagacatagtcggaggtagcctcccggggaaccgggatcgtgtccggcgagtctttcttccaccccacactatgagtagtctgtccactangaagtgagctaaaagtc

SEQ ID NO: 58490 - DNA, 341 bp, Zea mays
  unsure at all n locations
  Clone ID: LIB3069-044-Q1-K1-H11
cccacgcgtccgcggacgcgtgggtcctctcctcgcggcgactcttgccaagcattcctgcgcgaaaaacgcatccgctccaaggggagttgatcgagaagcgttggtggacatgggtcagatccagtactccgagaagtacttcgacgacacctacgagtacaggcacgtcgtcctcccgccagaggtcgccaagctcctccccaagaaccggctcctcttcgagaacgagtggcgcgcgatcggagtgcagcagagccgcgggtgggtgcactacgcgatccaccgnccggagccgcacatcatgctgttccgncgnccgatcaactaccagcagcagc

SEQ ID NO: 58491 - DNA, 384 bp, Zea mays
  unsure at all n locations
  Clone ID: LIB3069-044-Q1-K1-H12
cccacgcgtccgcccacgcgtccgactacttctccctctccgtcgcgacacaggccacggcgggcggcggcggaggcttccgtgcggctcttggcggattgaacgcccactcgagctgcgccggctgctgtttcagccgtccttagatagaccctgctttcctcccgggcaaatccaagttgcccaaatgccgacaccagtgaagtcggtgctgcccgtagtgctcctcggctgcggcggcgtcggccgctacctactccggcacatcgtctcctgccgtaccctccacgccaaccagggcgtggccatgcgggtggtgggcgtcgccgatagctcctncctgctcgtcgtcgaagatgtccactccaccggcctagatgacgc

SEQ ID NO: 58492 - DNA, 378 bp, Zea mays
  Clone ID: LIB3069-044-Q1-K1-H2
cggacgcgtgggtgtgaccctccctcagtcgcgttgcgtcccatcctacgatccaaaggtctctctgctcgcagccatggcgaagaactacccgaccgtgagcgccgagtacagcgaggctgtcgagaaggccaggcgcaagctccgagccctcatcgccgagaagagctgcgccccgctcatgctccgtctcgcgtggcactccgcggggacgttcgacgtgtcgtcgaggaccggcggtccattcggcacgatgaagcatcagtcggaattggctcacggcgctaacgcggggctggacatcgcggtgcggctgctcgagcccatcaaggaggagttcccaatcctgtcttacgccgatttctaccagctcgcggg

SEQ ID NO: 58493 - DNA, 442 bp, Zea mays
  Clone ID: LIB3069-044-Q1-K1-H3
cccacgcgtccgcccacgcgtccgggagtttattggcaccaaaggcagtgaggatgaagctgtggaggagatggagactgcaggtaatgcttttatggctgctgcccagtcaatgaagggggtgactgacggcatgaggaagaggaagagctgcggatatgaaggtgcagcagctgtgaagtttgtgaagtacaaggttgaagatagctcgctgaaggactacctgtcagcagctaatggcataagcagtggaagtgaggtagagaacccgcagtctgatgatgagatggaagaatcaaactgatgcatagaaacgagatcacccgctaatgcttactttggacagttgcttttgagagttccttggacagccgcctttttttggagccaggaccagtcttgtttcagctgccgcttgtttatgatgccgtgcagaatctgc

SEQ ID NO: 58494 - DNA, 381 bp, Zea mays
  Clone ID: LIB3069-044-Q1-K1-H4
gtacaccaagcccaagaagatcaaacacatgcactttaaggttaagctctccgtgctgcagttctataaggtggacgacaccactagcaaggtgacccgcctccgcaaggagtgccccaacacagagtgcggcgcgggcgtcttcatggccaaccacttcgaccgccactactgcggcaagtgcggtctcacctatgtctacaaccagaaggcgtaattgcttgccccgatttgctttatccgcctaccctatcgaacatccagctgtcggttactcgaattgtatctcatgtagatctgtctgaggttgaaacttaaatggagcagtagtatctgtcatattggtacccctgttactgaattgatgtgatgctgagttta

SEQ ID NO: 58495 - DNA, 437 bp, Zea mays
  Clone ID: LIB3069-044-Q1-K1-H5
cggacgcgtgggcggtcgggtagcttcaatgccgccgcccgccgctcggggatcgcctgctttcctctgccgaccacatctacaccgcaccaccggtccttccaagtgagcttcaaccccctgcgtgtagatggagagggttctcaaggatgacgccgtcgaggagaagggcgagcgcgccagaatggcatcgtttgttggggccatgtcaatctcggatttggcgaagaccacattgggtccaaaaggaatggacaagatcctgcaatcaactggtagagggcgtaatgttactgttacaaatgatggggctaccattttgaagtcacttcacattgacaatcctgctgcaaaggtccttgttgacatctcaaaagttcaagatgatgaagttggtgatgggacaacttctgttggtgttctagctggagaacttt

SEQ ID NO: 58496 - DNA, 340 bp, Zea mays
  Clone ID: LIB3069-044-Q1-K1-H6
cggacgcgtgggcagaagcttctttaaattgctaaagcccggtggcaaagtcctaatcagcgactactgtaagaatcctggaaaaccatcagaagaatttgctgcgtacattaagcagagaggctatgaccttcacgacgtgaaggcttatggacagatgctgaaggatgctggttttcataatgtcatcgcggaagatcgcactgagcagttcttgaatgttctacagagggagctaggtgaagttgaaaagaacaaagacgctttcctggcagacttcacccaggaggactatgacgacattgtgaatggctggaacgcgaagctgaaacggagctct

SEQ ID NO: 58497 - DNA, 325 bp, Zea mays
  Clone ID: LIB3069-044-Q1-K1-H7
cccacgcgtccgcaaaattcgacatgtactgagtccaacaacttccacggtaccgaacagtaaagcattcgataaaaagcctcttccagcgtcaccggcggcttggattaggatccaggatcagaagatttctgtaccggcttaattgttaatgtatttttggtgtgtgcaacatctcccaccagatggtgttaacacttgtagtgtgtgatgctaaaaaaaaaaaaaaaaaaaaaaaaaaaaaaaaaaaaaagaacaaaaacacaaaaaaaacaaaaataaacccaaaaagactatgacaacattgaaaaatggatagaacaag

SEQ ID NO: 58498 - DNA, 424 bp, Zea mays
  Clone ID: LIB3069-044-Q1-K1-H9
ctgaagacaattcagttcctgattttcatttgagctgtgcagcagttaaaagaaaaaggccatactttgtaagaataataagcaagcagatggttggagtgtacctatcaatatgggtacgaagaagcctccgaaagcacattcagagtctgaaagtatcaactgtaggggttggtgctatgggctacattggtaataagggatcaatatcagtaagcatgtccatataccaaacacacttttgctttatatgttgtcacctaacctctggagaaaaggaaggagatgaactaaaaaggaatgctgatgttcaagaaatccaccgaaggacaatatttaatccagtttcgagagtcaacatgcctaaaacgatatatgaccatgaaaggattgtatggctaggtgatctcaactataggatcaa

SEQ ID NO: 58499 - DNA, 412 bp, Zea mays
  Clone ID: LIB3069-045-Q1-K1-A1
cccacgcgtccggctcttggtccacaccatttgcattaacttcagggagctcggtctctgctccgctaccttcttgatcctcctcagaagagccagatgaaaggatgttgcgcagcgaccttccggagatggaaagcgagttcagctgcgactccacccttcgcatgaactccatcgcctcctgcagcttgccaacggtggcggcctcctcgacgcatgcgtcaaggcgaaggagccctcgtcgtcgtctccctacgcaggcgacgtcgaggccatcaaggccaagatcatctcgcacccacactactactcgctgctcactgcctacctcgagtgcaacaaggtggcggcaccaccggaagtgtctgcgaggctgacggacatagcgcaagaagtggaagcgcggcagcgc

SEQ ID NO: 58500 - DNA, 300 bp, Zea mays
  Clone ID: LIB3069-045-Q1-K1-A10
ccgacccacgacccacgcccacgcccacgcaaacgcacactcagcgtccccttaaaacgatcaccacccacaacacgggcaggacacaatacccggggcgacgcccacacgaccaacaaaccggcacacacaccgcagatccaaacacataccctaccacacagacaaaaccgcgggatagaagatgacccccgccgggcacaaccacaaccccccaacaagacacaccgcgggaccacagcagcaacgtgctacaacaacaacaccaacaaccgcgctgaacggcaacaacacaaagac

SEQ ID NO: 58501 - DNA, 262 bp, Zea mays
  Clone ID: LIB3069-045-Q1-K1-A11
aaaaaaaaaaaaaaaaaaaaaaataaaaataaaaaaaaaaaaaaaaaaaaaaagagaaaagagaaaaaaaaaaaaaagaaagacacaaaaaaaaaaaaaaaaaaaaaaaaaagaaaaaaaaaaaaaaagaaaacacaaaaaaaaaaaaaggagaccaaaaaaaaggcgaacgaatggactgaacaaaaaagccaaccagcaacgccatcctctgccacgccgaaaacggtatgatcggcgactatacccggggccgactata

SEQ ID NO: 58502 - DNA, 434 bp, Zea mays
  Clone ID: LIB3069-045-Q1-K1-A12
cccacgcgtccggaaacaaaggttcaggtttctgaaggtctaggagagttaattgatgtaacaagcgagaagactcttaaggaagttgtagtgccaattacaggacctcttatccgcatccttggtgatcggtttccatggcaagttaagtcagcaatcctatcaaccctgacaatcatcatcatgaaaggtggaattgcacttaagcccttccttccacaacttcaaactacattcgtgaaatgtctacaggataacaataagtctgtccggacgagggctgcagctgctctcggaaagcttagtgctcttagcacacgggtggatcctttagttagcgatcttctgtccatgttgcagtcaagagatgaatctgtaaaagaaagtgtgctttctgcactcaaaggtgttatcaaacatgctggcaaaagtgt

SEQ ID NO: 58503 - DNA, 371 bp, Zea mays
  unsure at all n locations
  Clone ID: LIB3069-045-Q1-K1-A2
gtcgacctcagtgaagctacaggtcaagagtgagagctgtcgaacagagatagcacactccaccagtcgcttgtagtggaagtacctgagtcggtgagcatttctgatacaaacgacattagtggggaacctgaacacagtagaactgacattgatgaggacccaagtgaacttactccaagaacctacaatattaaaagaatcgaggattggatcaatcagattgatatcaatgatatcgctttggatgggcaaggagagaattcagtttctgctttagccaaatctcgtgaaccgatggctggcgttcctgctgtgcggnctgatgctaaaagcccgcttggtatggagatagcttacacttatatttc

SEQ ID NO: 58504 - DNA, 282 bp, Zea mays
  Clone ID: LIB3069-045-Q1-K1-A3
cccacgcgtgggaaaaaaaaaaaaaaaaaataaattataaaaaaaaaaaaaaaaaaaaaaggaaaggataaaaaaaaaaaaaagaaaaaaaaaaaaaaaaaaaaaaaaaagacaaacaaaaaaaaaggaacaaaagtaaacaaagaagaacagacaaaaataaaagacccaagagagactaactaaaataaaatacaatagtaaaaagaataaaaaataggatcactggaaaaagatatcaatgaacataacataagatgggtaaagaaagaatacactttg

SEQ ID NO: 58505 - DNA, 413 bp, Zea mays
  unsure at all n locations
  Clone ID: LIB3069-045-Q1-K1-A4
gcatgtccataatgctcttggaaaaatcattancgtcagcaacaacaatcctgagcatttccttactaccaacccattttacgactctcgtgttgtgggtaaatattgtgaaaagcgggatcctacacttgctgttgttgcttacagacgtgggcagtgtgatgatgaacttattaatgtcactaacaaaaactcattattcaagctacaagctagatatgtggttgagagaatggatggtgatctgtgggataaagttcttcagcctgagaatgaatatagaaggcaactcattgaccaagtggtttcgactgcgttgcctgagagcaagagccctgagcaagtgtctgctgctgntaaggctttcatgactgctgacctgcctcatgaactgattgagcttcttgaaaaga

SEQ ID NO: 58506 - DNA, 256 bp, Zea mays
  Clone ID: LIB3069-045-Q1-K1-A6
cccacgcgtccgtgatgcgcaagtattggtttaaggcaaagccggcggcgagctcctgcagcccgtggtacggtcccgaccgcgtgctctacctgggcccgctgtccggcgcgcccccgagctacctgacgggcgagttcccgggcgactaccgatgggacaacgcggagctgtcggccgacccagagacgttcggcaagaaccaggagctggaggtcatccactaccgctggggcatgctgggcgcgttgggctg

SEQ ID NO: 58507 - DNA, 430 bp, Zea mays
  Clone ID: LIB3069-044-Q1-K1-F6
acgtctttgacgttgatgaaatattaataaatatattaacatctacaagtccaaataaatacacaataacattttcattgataattttataaaatggaatcaatttgatgttggagcatttttctacaaaccttgtcaaagctagagaagtttgacctatgacattgctaaagtgatctataatttggaatggaggatgtctttagtttgatctttattttatgcttgaataaaatcatggctagactcttgtagttagtaattcattatattgttctcttatttcaggtttgttctttctgcagatcgaacctatccgcaacttattcgctgctcttttccttgccagcattgggatgctaattaatgtccatttcttgtggaaccatgtggatatactccttgcagcggtaatttttgtgatcaccgt

SEQ ID NO: 58508 - DNA, 437 bp, Zea mays
  unsure at all n locations
  Clone ID: LIB3069-044-Q1-K1-F7
cccacgcgtccgcccacgcgtccggctaataaatccaaattaaagcgtgctcacttgactgagcataatgatatttcaccttgtaagaatgaacttgatgatttccatgatcttccagatatatctcttccatctgataaacaaataaaaagaaatcggcatcgttcgctgctattatctgagtccgatgatgatccagctgatgtaggtactgaaaaacataacatatttactgttactgaagttggtttcttcccacaaccttcagaggtgcctcctatgcatgggcaagggatttctgatcagttccattttcccgttgaatcacgagagacatgtgaaattgctgattctttccaaaatccacctganagcaacatgtatgggtccatttcacaagtttgtgatacatttatgtcacaggacgtgtcatgtgt

SEQ ID NO: 58509 - DNA, 317 bp, Zea mays
  unsure at all n locations
  Clone ID: LIB3069-044-Q1-K1-F8
cggacgcgtggggcaaggcggttttatctcattgatgcgctcgtgaggctgagcggaatgactgcagagggccaaggtgtgaaggttgaatcctcagcagttccttcagccccaactccagatgttgctgaagcacaggccccagctgctgaggaggaggacgatgatgatgttgacctttttggtgaggagaccgaagatgagaagaaggctgctgaagagcgtgctgcagctgccaaggcttctggcaagaagaaagaatctgggaagtcatcagttntacttgatgtgaagccatgggacgatgagactgacat

SEQ ID NO: 58510 - DNA, 436 bp, Zea mays
  Clone ID: LIB3069-044-Q1-K1-F9
cgagtggcgatggcagtactgcacttgcatgtggtggcggtggcggtgctgctgatggcgacggggctgcgcgcgcagctgcgggtgggcttctacgacagctcgtgcccagcggcggagatcatcgtgcagcaggaggtgagcagggcggtggcggccaacccgggcctcgccgccggcctgctccgcctccacttccacgactgtttcgttgggggctgcgacgcgtccgtgctcatcgactccaccaagggcaacaccgcggagaaggacgccgggcccaacctcagcctgcggggcttcgaggtcgtcgatcgcatcaaggcgcgcgtcgagcaggcctgcttcggcgtcgtctcctgcgcggacatactcgcgttcgcggccagggacagcgtcgcactcgtaagtcactgctttttagtgtcagtggacg

SEQ ID NO: 58511 - DNA, 401 bp, Zea mays
  unsure at all n locations
  Clone ID: LIB3069-044-Q1-K1-G1
cagcctctccgcctccgctcctcgcgccgttcgcttcgtctcctcctgtacaggtaaggagaggaagagggcgaaatggtgaagcacaacaacgtcatccccaacgggcacttcaagaagcactggcagaactatgtcaagacatggttcaaccagcccgcccgcaagcagaggcgccgcatcgctcgtcaaaagaaggctgtgaagatattcccccgcccgactgctggtcctctacgccccattgttcaatgccagactttaaagtacaacatgaagtcaagggctgggagaggctttacccttgaggagctgaaggctgctggcatcccaaagaagcttgctccaaccattggtatttctgttgatcaccgncgcaagaacaaatcccttgagggact

SEQ ID NO: 58512 - DNA, 257 bp, Zea mays
  Clone ID: LIB3069-044-Q1-K1-G10
ctggttaaaaaaaccaccactattgcacatacatgtgtcatcttagtgtacaacgccaagtcatgatctcgacttgcctatgcaatgcaacgtgaaacaaaagacacacatgcatctcgcagcatcaatcaatccacgtacgtacaccctctccgatccgaaagacaatgaagttgcatagcatagccgctgagcttagttgctggggacgaagttggaggcgtatgcccatgcgatgtcgttgactgggtcagcga

SEQ ID NO: 58513 - DNA, 324 bp, Zea mays
  Clone ID: LIB3069-044-Q1-K1-G11
cccacgcgtccgggctctctacacgtctatgacgctgcatcacgtagcgttcggcatcgcggcgttgatgaggtcctgtgacaagcgattggagttcatataggtgtggaggctcctgctcagcgacctgcactgctacctgtcgctggaccacaaggtgcgcgagtacaacatgttcaccgcgcacacacagctcatggtcatcacgatctcgaccgacacggccgacgttacactacactcacctgcagactcaccgctccgacatacgtatctcctgtatctgatcactgacgattcgcctcgaactatcaggattgcgct

SEQ ID NO: 58514 - DNA, 433 bp, Zea mays
  unsure at all n locations
  Clone ID: LIB3069-044-Q1-K1-G12
actgcgactaaaaaccatctttggggcccttcgccgcgatttgcttcgcttctcggactaggttaagttgccttttcgattctcagaaaaagactggctctgcactcggataattttaaaatggatagtgcacagcagcccactggggaattgaacaattcgttcgatactcttatggtttctggaggtgaccagagtcgacagcctcaggatgctggcaatgaaacgagcttcacgaattggaaagacctccccatggagctgctcctgcgtatcatttcactagttggagatgacaggatagtcattgtggcctccggtgtatgcacaggatggcgtgacaccttggggtggggggttgcaaatctttcactatcatggtgccaggaccgcatgaatgactnggtgatatcactggctcacaagttcacga

SEQ ID NO: 58515 - DNA, 401 bp, Zea mays
  Clone ID: LIB3069-044-Q1-K1-G2
cagtctcttcgcctcctatcctcgcgccttcgatgcgtctcctcctgtacaggtaaggggaggaggtgggctaaatggtgaagcgcaacaacgtcatccccaacgggcacttcaagaagcactggcagaactatgtcaagacatggttcaaccagcccgcccgcaagcagaggcgccgcatcgctcgtcaaaagaaggctgtgaagatattcgcccgcccgactgctggtcctctacgccccattgatcaatgccagactttaaagtacaacatgaagtcaagggctgggagaggctttacccttgaggagctgaaggctgctggcatcccaaagaagcttgctccaaccattggtatatctgttgatcaccgccgcaagaacaaattccttgagggactg

SEQ ID NO: 58516 - DNA, 329 bp, Zea mays
  Clone ID: LIB3069-044-Q1-K1-G3
ctggattcctcttgcagccacttcgggcgtgggtgggatcggcccgtggccggcggagatgtccggattcgtcggtgtcgtcgtgtccgacccctcgctgcaggggcagttcacgcaggtcgagctccgatcgctcaaggccaagttcgtgtctctgaagagagattccggccatgtcaccactaagaatctcccggcgatgatgaagaagctgagggggctcaatgaggtggtctctgtggaggagatcgcggccttcctgtccgagtcgtaccccgacagcgatcaggagattgaattcgaatccttcctccgggagtatctgaatc

SEQ ID NO: 58517 - DNA, 195 bp, Zea mays
  Clone ID: LIB3069-044-Q1-K1-G4
gagcacttatgtactcaattaattggacttggctttacattcgggacgggtaatcaacaactggaacagtagatagtctgagagtggccatccaggaggcagaagccaatcccgaccatgttggagacactgagcggagcacaccgagtcctgctgactaacggtctcgacttcgatgacaccgcgctcacgctc

SEQ ID NO: 58518 - DNA, 422 bp, Zea mays
  Clone ID: LIB3069-044-Q1-K1-G5
gtcgctcttgagcttgcgtggatgaacaatatgttggactttgccttcccatacctgttgcagttcatccgtgaatacactagcaaggtggatgatttagtgaaggacagaattgagtcacagaatgaagaaagagtcaaagagaaggaggagaaagatcttgttgctcagcagaacatgtatgcgcaattgcttcctcttgctttgcctgctccgccaatgcctggcatgggtggccctccacctccgatgggtgggatgggcatgcctccaatgggtggaatgggtatgccgccgatgggccctggtccgatgccagcattcgggatgccagcaatgggaagctactgagatgtttttgcagagagcttagacgatgatttgaatcgtccctgtgtaagcgaaggtggaaacttcattgg

SEQ ID NO: 58519 - DNA, 285 bp, Zea mays
  unsure at all n locations
  Clone ID: LIB3069-044-Q1-K1-G6
ctcgatccgcacacctcacgcctttcttcctctcgccccaaggacaacgaaaacatcaaacaagagaaccaaaggaaacagagcaagagcatcgctctcgaagcaaaacgcgcaccacgccgtcgccggccggccacttcgcacgtacgtaggacgcgcacgcaccggtgcatatatggggctcctgaaccagctgtgggacgacacggtggccgggccgcgcccggactccggcctcggcaagctccgcaagtacgcctncttcntcccctcgtcgtcgtcgtc

SEQ ID NO: 58520 - DNA, 410 bp, Zea mays
  Clone ID: LIB3069-044-Q1-K1-G7
gttgacaaagatatgagccatccacaaattccaaagagaattgaggatgctaagattgccatcttgacatgcccatttgagcctccgaagccaaagacaaagcataaggttgacattgacactgtcgagaaattccagacactgcgtgagcaagagcagaaatactttgatgaaatggttcagaagtgcaaggatgctggtgcaaccctggttatttgccagtggggttttgatgatgaagccaatcatttattgatgcacagaaatctgccagcagttagatgggttggtggtgttgaattggaattgattgccattgctacaggagggcggattgttccgagattccaagagttgagtcctgaaaagcttggaaaggctggattagtcagagagaaatcattcggaac

SEQ ID NO: 58521 - DNA, 440 bp, Zea mays
  Clone ID: LIB3069-044-Q1-K1-G9
cccacgcgtccgggcatccgcagagagcttgttccgtccaggcaaccaaaaagcaagttgccccgccgcgcagaggaagaagagagcagaggaggatggctcgtacgaagcagaccgcccgcaagtccacgggaggcaaggccccccgcaagcagctcgccaccaaggtccgtccgtctgcccttctctacccgtttcggatccgctgttctgttctctagggttcccttctgagacgcgccggcggttgtgctgtggttgcaggcggcgaggaagtcggcgccgacgaccggcggcgtgaagaagccccacaggtacaggcccggaaccgtggcgctgcgcgagatccgcaagtaccagaagagcacggagctgctgatccgcaagctgcccttccagcgcctggtgcgcgagatcgcgcaggacttcaagacagacct

SEQ ID NO: 58522 - DNA, 412 bp, Zea mays
  unsure at all n locations
  Clone ID: LIB3069-044-Q1-K1-H1
cccacgcgtccggcgaacgacgccatcattctgttcggcaactacttcggcccgccgtgcgtgacggtgacgccgctccaggtgctgcagggctacgtgaaggacacgagcttcgtcgccggctgcaactcggccgcctgcaacgtcacgacgatccccgaggcggtccaggcggcgagctcggcggactccgtcgtcttgttcatggggctggaccaggaccaggagagggaggaggttgaccggctggacctgacgctcccgggacagcagcagaccctcatcgagagcgtcgcgaacgcggcgaagaagccggtgatcctggtgctgctctgcggtgggcccgtggatgtgagctttgcgaagaccaaccncaagattggggccatcctgtgggctggctaccccggcg

SEQ ID NO: 58523 - DNA, 295 bp, Zea mays
  Clone ID: LIB3069-044-Q1-K1-F5
cccacgcgtccgtccattcgtgcgttcaataaatccaaaataaagcgtgctcactggactgatcattatgatagtggacggtgcaagaatgaacttgatgattaccatgatcttccagatatatctcttccatctgataaacaaatgaaaagaaatcggcatacgtcgctactattatctcactacgatgatgatccagctgatgtatgtactgaaaaacatagcatatatactgatactgaacgctgtttcttcccacaaccttcagacgtgccacctatacatgagcgacgga

SEQ ID NO: 58524 - DNA, 371 bp, Zea mays
  unsure at all n locations
  Clone ID: LIB3069-044-Q1-K1-E1
cccacgcgtccgcccacgcgtccggcacgtaactcgccttcgggccctgagataaaatctcccggcgctcgcttggtccgccaaaatccactccttggaatttcctgagctgtcggaaaatttctctttttgttttggttcttctttgaccccttaggtcgctagcatttgtgcgttccgccgaagctcgctggtttgatccgtcctagttgcggaagcgcctcttgatttggttctaaaatacatcgttccttgttttcatccttccgaaggggggaaaatcatcttttttgggccctgatttgagtgtgtcacctttgcttccggcaatggggaacagcagcagcagcaacaggcgtncgccggggcca

SEQ ID NO: 58525 - DNA, 354 bp, Zea mays
  Clone ID: LIB3069-044-Q1-K1-E10
cccacgcgtccgcccacgcgtccgcccagtatggattgactttccaagagaagggaacaactggagctatgataaatgcagacgacagtggagccttgtggacactgatcaattggggtacaagtacatgaatgcctttgaccaaaccatgaatgcgctcgatgagagattttccttcctttcgtcgtcaaagcagatcgtcagcgacatgaacgatgaggaaaaggttattggctttgaacgtggagatttagtttttggtttcaatttccattccaagaaaacttacgagggctacaaagtgggatgcgatttgcctgggaaatacagagtatccctggactctgatgctct

SEQ ID NO: 58526 - DNA, 424 bp, Zea mays
  Clone ID: LIB3069-044-Q1-K1-E11
cccacgcgtccgggcgcagagaatccccatgcaatcaaacagggtagagggagaggagaggagaggagaggagaggttgggtctgggacaccatggctccgatgaagctgtacggggcggtgatgtcgtggaacgtgacgaggtgcgcaacggcgctggaggaggctggctccgactacgagatcgtgcccatcaacttcgccaccgccgagcacaagagccccgagcacctcgtccgcaacccgtttggtcaggttccagctctgcaggatggtgacttgtacctcttcgaatcacgagcaatctgcaagtacgctgctcgcaaaaacaagccagagctgttgagggaaggaaacctcgaggaggcagcaatggtggatgtttggatcgaggtggatgctaaccagtacaccgctgcactgaa

SEQ ID NO: 58527 - DNA, 434 bp, Zea mays
  Clone ID: LIB3069-044-Q1-K1-E12
cccacgcgtccgcccacgcgtccgcaggcttaacatccatacaactggggttacgaaccccgaacaacttgattcgtagaccacacaactatggggacacaaatcatccccacttaattttggacctgtacaactagggtacacacctgacacgtcctgtccaaagaccaaaggctgttaatccaatctcttggcaccacaactcacctagaagagcatcactgataatgacttacaactatctctacaaaaaaaaaacagccaagcatgcctggacaaccatgctagtccaaaatccaaatgtcagggcaactactcaaagctgcctgtacaaaaccaaaaactaataaggaaaaagagtggcatcaaactagatggaaagtgccaagctacagagctggaatagcctagtgaaaccttcaagaaggtaatga

SEQ ID NO: 58528 - DNA, 435 bp, Zea mays
  unsure at all n locations
  Clone ID: LIB3069-044-Q1-K1-E2
cagaaaatcaactccttcccaaatccacgttgccaccaactcgccgtcctccgcgccaagcaccaaagctccgatggcccgcactaaacagacggcgcgcaagtcgacgggcggcaaggcgccccgcaagcagctggcgaccaaggcggcgcgcaagtctgcgccggccaccggcggcgtgaagaagccccaccgcttccgccccggcaccgtcgcgctccgggagatccgcaagtaccagaagagcacggagctgctcatccgcaagttgcccttccagcgcctcgtccgtgagatcgcgcaggacttcaagaccgatctccgcttccagtcctccgccgtcgccgcgctgcaggaggccgccgaggcctacctcgtggggctctntgaggacactaacctctgcgccatncacgccaagcgcgtcaccatcat

SEQ ID NO: 58529 - DNA, 335 bp, Zea mays
  Clone ID: LIB3069-044-Q1-K1-E3
tgtagttttgctggtgtagtgagtgtttattactcatgcaccaacatcttcgtggcttatgttgtcacgttcaggtctcgttggctttattaagcttttttcacttgaaaagattgattacgaaacaaacatgtgatttattgttaaaaaaagtaaatcaatctatcgcaatagttaatggaggtcaaaaaaaaaaaaaaaaaaaaaaaaaaaaaaataaaaaagataaaaaagtacaaaaaaaaataaaaaaataataatacaaaagtaaaccttaaaaaagaatatatcgtaagatcaaacaagaataaaaaaaaggggctgcccttttaaag

SEQ ID NO: 58530 - DNA, 461 bp, Zea mays
  Clone ID: LIB3069-044-Q1-K1-E4
aaaatatccccaaaccctagctcccgatttcgattgcgaaccctcgcgtcttcttcgacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagttccccgacgagaagttcgtgcgcaagcacaccgtccccggtgtgctctccatggccaacgccgggcccaacaccaacggcttccagttcttcatctgcaccgtcgcgaccccttggctcgacggcaagcacgtcgtcttcggccaggtcgtcgagggcatg

SEQ ID NO: 58531 - DNA, 413 bp, Zea mays
  Clone ID: LIB3069-044-Q1-K1-E5
cccacgcgtccgtggacgcgtgggttgactcgtgggcgctgggccaccagctttgaccgccgccttccttcccctgcgctactgctcctcctcaccccactcccccgcaggagcggcggcggcggcggcgaggtcgtaccccacatcggcgagcggcggcggcaccgccggaggcaaaggcaagatgttcgggcgcgcgccgaagaagagtgacaacaccaagtactacgagatcctcggggtgcccaagtcggcgtcccaggacgatctcaagaaggcctaccgcaaggctgctatcaagaaccaccccgacaagggcggtgaccccgagaagttcaaggagctcgcacaagcctatgaggttttgagtgatccagagaaacgtgagatttatgatcagtatggtgaagatg

SEQ ID NO: 58532 - DNA, 458 bp, Zea mays
  unsure at all n locations
  Clone ID: LIB3069-044-Q1-K1-E6
cccacgcgtccgcccacgcgtccgtccactcgtccgcggacgcgtggggggcgtcttccacccgttcctctccggcggcgtcaccgtgcccgacgccaccgtctccaccgcccaggcgttcttcaccgagttcatcatctccttcaacctcctcttcgtcgtcaccgccgtcgccaccgacacccgcgcagtgggtgaactcgccgggatcgcggtgggagcggccgtaacgctgaacatcctcgtcgccgggccgacgacgggcgggtccatgaacccggtgaggacgctggggccggccgtggcggcggngaactaccggcagctctggatctacctgctggccccgacgctgggcgcgttggcgggggccagcgtgtacacggcggtgaagctcagggacgagaacggtgagacgccgcgcacgcagcgcagctttcgccgctgacgacgcacac

SEQ ID NO: 58533 - DNA, 292 bp, Zea mays
  Clone ID: LIB3069-044-Q1-K1-E7
aagaggtacaaccccaagaagctgacatatgagcagaggaaggccagcctcattgaaaggctcaaccaactcaactcctccggtggtgctgatgacgacgatgaggacgacgagtaaagttaattgccatcgaagtagtgctatctcaatccagcgatcagcaattgtgtactgtcttatgcggggacctgtagtactgcaataggcatttttgttttaaagttttgcgaggtgaacaaaactgtttctgttagtttcgagcttgagctctcaatgtttactctttacattg

SEQ ID NO: 58534 - DNA, 237 bp, Zea mays
  Clone ID: LIB3069-044-Q1-K1-E8
gtccaatgcacgagcacatggatggtctgtttgcatggtctagtttttttttgtgaacagacaaatgaactcacatgtacgcctccatactgcagcagcagcagccgccgccgccgtctcggagctcgagctcctagtcccccggggcccaggcggcggcgccatggaccagctccggcccgagccggccgcgggcgcgcggcacgagatcgagaagacggcggcgccggacgtgga

SEQ ID NO: 58535 - DNA, 106 bp, Zea mays
  Clone ID: LIB3069-044-Q1-K1-E9
cccacgcgtacgcgcgctcagaagccgcatccaatccaacagggcgcagggagagaagaggccaggtcagaagagagggggccgggcacaccaacgcggcgcagaa

SEQ ID NO: 58536 - DNA, 434 bp, Zea mays
  Clone ID: LIB3069-044-Q1-K1-F10
gtttttcctcgtcctcgatccagccccctgtcgcttccagctccgatcgatctgatccctccccaccaccacgcccatggcggaccaactcaccgacgaccagatcgccgagttcaaggaggccttcagcctcttcgacaaggacggggatggttgcatcacgaccaaggagctgggaactgtcatgcgttcactggggcaaaaccctacagaggctgagctccaggacatgatcaatgaggtcgatgccgacggcaacggcaccatcgattttccagagtttctcaaccttatggctcgcaagatgaaggacaccgactctgaggaagagctcaaggaggcctttcgtgtgtttgacaaggaccagaacggcttcatctctgccgccgagctccgccatgtcatgacaaatcttggggagaagctaactgatg

SEQ ID NO: 58537 - DNA, 220 bp, Zea mays
  Clone ID: LIB3069-044-Q1-K1-F11
agccccggtcccccggatcaagagcgaaatgctctacggcgaggacgtacctctcaaggccagggtgagcggcgtgcccgcagtcgacctcgaggacggcgagatgaagagctagctgctgcggctgccgcagctgccgctgattcgttcattcttcttgttcttttgtaactgtgcgcgcgcgatcgctcgatccaaagttgcttgtccgtcagccctc

SEQ ID NO: 58538 - DNA, 363 bp, Zea mays
  unsure at all n locations
  Clone ID: LIB3069-044-Q1-K1-F12
cggaccgcgtgggccggactgcgtgaggcaccactgnnctcttataacccatagtaccaaagcgaaggtaacgtcacgatggcaaccttccaatgggttagtctttcgtcttgcatctgcccttagtttctatcttctcccttctccaagtgctcgtccccttgtgcccacctcatgtgggtggctttggttcccacccagttctatgactcattcgtgcccccaagggcgaaggacgaattgtgccagtccacttgtgtgcacagagccctgtggcccaagggagacccacggatggctggtcatacttnntagtcagacctgcnnatttccatgaaactgctttgtcaaagggcttgcgat

SEQ ID NO: 58539 - DNA, 392 bp, Zea mays
  Clone ID: LIB3069-044-Q1-K1-F3
aaaaaaaaaaaaaaaaataaaatcaaaatttatataataaaaaaaaaaaaaaaagcaaagtggacgtgatcataatgatataagacactagaaagaatgaactagatgatattacatgatcttacaaatatatctcttccaatctgattaacgcataaatagaaatgggccatcgttcgctgctattatctgagtccgatgatgatccagctgatgtaggcactgaaaaacataacatatttactgttactgaagatggctctttaacacaaccggcataagtgcctcctatgcatgggcaaaggatttctgatcagttccattgtcccgttgaatcacgagagacatgtgaaactgctgaatctttccgaaatccacctgaaagcaacatg

SEQ ID NO: 58540 - DNA, 409 bp, Zea mays
  unsure at all n locations
  Clone ID: LIB3069-044-Q1-K1-D9
cccacgcgtccgccgcggcgagttcaaatttcacaatcttcttgtagcacaccactgtcttcgtccaactcggcggcgatgtctgggcgcggcaagggcggcaaggggctgggcaagggcggcgcgaaacgccaccgtaaggttctccgcgacaacatccagggtatcacgaagccggcaatccggaggctggcgaggaggggcggcgtgaagcgtatctccgggcttatctacgaggaaacccgcggcgtgctcaagatcttcctcgagaatgtcatccgcgacgcggtcacctacaccgagcacgctcgccgcaagaccgtcaccgccatggatgttgtgtacgccctcaagcgccagggccgcactctgtacgggttcggtggttgagcgcatctcttncctcgtc

SEQ ID NO: 58541 - DNA, 442 bp, Zea mays
  unsure at all n locations
  Clone ID: LIB3069-044-Q1-K1-F4
gcgtgaccatgctcttggcccaaaggatgattttgattcagtgcccgttgttgggtcagtgatggatggtttcaacgtatgcatctttgcatatgggcaaacaggaaccgggaaaactttcacaatggaaggggttccagaaaataggggtgtaaattatagggctttggaagaattgttcagaatctcagagaaaagaagtgcatctgttgcatacacattttccgtaagcatcttggaagtttacaatgaaaagatcagggatcttcttgatgagagcaatgatcaatcaaaaaggttggatattaagcaaaatgctgatggaacacaagaagttcatggtttggttgaggctccaatttataacatagatggtgtgtgggagaaactgaagtttggcgctcaaaatagatccgntggctcaaccattgctaatgaactc

SEQ ID NO: 58542 - DNA, 428 bp, Zea mays
  Clone ID: LIB3069-022-Q1-K1-E6
cccacgcgtccggtcgaggccgaggccgtatctgaggctgagccgaccgaggcagagccgaaggaagcagagcccgaggccgccgcgccggcagcagagacggaggctgctgctgccccggtcgaggctgctgagccggagatagccgccgagaccaaggaggcggcggctgtggaggctaacgaggaggagggggaggcatcgcctgcggttgctgccactcctgaggtcgcagcgaccgaggaggaagcggcggtccctgctcccgaggccgccgtcgctgccgtcgagaagtccgtcgagtgagtccagcgccggacggcggccgatctagctcgctgcgtcagcctgtcacctggcgtgcgccgctctggtgccactgccacggcaacagcacggcatggcgccggcataggtcgctaggaaaa

SEQ ID NO: 58543 - DNA, 403 bp, Zea mays
  Clone ID: LIB3069-022-Q1-K1-E7
cccacgcgtccgcccacgcgtccgcaaatatatggccctttgcttcgaatatatgcataatggaagccttgacaagttcattattggtattattgcgctcttcttattctcgtatgatcaattgaattcacttgaagtaaccattcttcaaattcacattttgagagactgtttgctccaacagatgaaaatagtgtccatgactggtccacacgctatgcgataatcaaggggatctgtgagggtttgaaataccttcacgaggaattgaatcctcctatttatcatttggatttaaaaccagctaatattttgttggatgacaatatgatgccaaagcttgcagattttggcttgtcaaagatttttgacaggaacgaacacgaatcacacaaagttgtgt

SEQ ID NO: 58544 - DNA, 436 bp, Zea mays
  Clone ID: LIB3069-022-Q1-K1-E8
cccacgcgtccgaaattgacaggaatattacttggtgatcctataagataatgtgctgtgaaccctgatttgttttagctgcttgtgttcgttttgtctacttagtcttgcacactgaggacctttatcgaggttgtcagtctgcaagttgaatcatggcggagcacttggcttcgatctttggtaccgagaaggacagggtcaactgccctttttacttcaagattggggcttgtcgtcatggggatcgctgttctcgtctgcacaacaggccaactatatcgccaactcttgtgcttgctaacatgtatcagcgccctgatatgataactcctggagttgatgctcaaggccaacctattgatcctgagaagatgcaagagcattttgaggacttctatgaggacatctatgaggagttgggcaagtttggtga

SEQ ID NO: 58545 - DNA, 353 bp, Zea mays
  Clone ID: LIB3069-022-Q1-K1-F1
cccacgcgtccgagcagccagcctctttcactggttctgaggttcgaatcattgatgatgacatgcccctcgctcaatttgctgttgctttcaatggagcatcatgggtggatcctgattctgttgcactgatggttatgcaaacaatgcttggttcatggaacaagagtgctggtggaggaaagcacatgggttcagagcttgtgcagagggcagcaatcaatgacatcgctgagagtgtaatgggattcaatacgaattacaaggacactggtctttttggtgtctatgctgttgctaaggctgattgcttggatgatttggcttttgcaattatgcatgagatgagccaa

SEQ ID NO: 58546 - DNA, 447 bp, Zea mays
  unsure at all n locations
  Clone ID: LIB3069-022-Q1-K1-F10
aaggagattctcctcgccccttccactagactactggagtacccgacggcccgaggcggcgagctcgtcggcgactgaccgccgccggagcagccgccgcctcccgctggttcctgtaccacagcctcgcaggagcgcctccgttcgctacgccacccgccactgtgctgtcggaaggcagctcggactactcgcgccgnctcggcttctccgcgctcgccgccccttcgncggcgtgatcaaggatggagctacatcgtgaacctgctgaagctattctgaatgccataaaatttgatctcatgacgagtacggatatggaaaaattgagcagcatgagcataatcgaagtgagtgatgtcactagtccgaagctaggattaccaaatggttccctgcaatgtgagacttgtggatcacaacgtggacgcgactgtgatgggcatt

SEQ ID NO: 58547 - DNA, 392 bp, Zea mays
  Clone ID: LIB3069-022-Q1-K1-F11
aacaaaaggcaggctatttgctgaggccgttgtgggtcataagggatttactgaatcagcagcaggaaaggcaagcagcgagaatgaggaagggcaagctgtctcgttagaagatgatgtcgggataagtacagacgcagatgaagagcttccggtatctgaagatgatccagaagtgctactgaggaggcttcaagagcttgctgatgagaattattcgactgggaacaactgttttgttttccctgaagtagtgaaagctgattcgatgattgatctttacttaaaccgcagcatgtcggccttagctagtgagtccgacgtttttgtaaaaggagcattcaatggttggagatggaaccgtttcacttgaacaatgcatagaagcgaat

SEQ ID NO: 58548 - DNA, 438 bp, Zea mays
  unsure at all n locations
  Clone ID: LIB3069-022-Q1-K1-F12
cccacgcgtccgactgtattttgtaatgtaacatttggtgtggtggatgcaattccatgatagcgaatggcataagatttaatgctaagaagaaacaagttggaaattattactctaccaaggtatatactagagcgaagagcgaacaacaatctaagattgcagcaagaaaggtccagcaaggatggagtcaggacttttatccatgcgagaaggaaccagattatgtacatgtatatgtgtggatagaactaaccgccgatattatcctaaatctaagcacggtcacccacaaaaaatgtgtaatttgcttcttcccagacatacgaaatgtgttatgcggactatgttggctattggaaaggcattctaaatgccgtctgtaatgtttgatggttataaactatngtcgtgctatgtaatatgcggtcttgacat

SEQ ID NO: 58549 - DNA, 439 bp, Zea mays
  Clone ID: LIB3069-022-Q1-K1-F2
atccagattacattaagcacttgaagaagtttgtgtcaagcgttagcaaaaaagcatcagcgaaacctgacccaaaagaaacaacgtcaaaggacgacactaccagtaaagaaacagaggaagcgtacccggagaaacctcaagaggccaagaagtgccctcagatctcgcgaaagagcctggacagccgattcgggaaatccaaaacagtggatgttcctgataaaccacggatgagctcggacgacatcgacaagttccggaggagcagatgcttggtctggtgatgcctgtgttctgcacaaattgtcgaacagtacctgagcgaggatactatagcatggaagtcaagcaactgtattacatcatgctgcgaggaacggcatcagcggttcctgcagcggagaggaaaggactgttaaataagaaaaaaagaatc

SEQ ID NO: 58550 - DNA, 388 bp, Zea mays
  Clone ID: LIB3069-022-Q1-K1-F3
cccacgcgtccgggctactaacgcccccgatgtcgtcgtctggggatcaggctcgccgctgcgcgagttcctgcacgtcgatgacctcgccgacgccgtcatcttcctgatgggtcactactccggcatggagcatgtcaatgtggggagtgggagcgaggtgaccatcaaggagctcgccgaactagtcaaggaggtggtcggcttccaggggaacctggtgtgggactccagcaagccggacggcacacccaggaagctcatggatagctccaagatacaggggatggggtggaagcccaagatcgccctcaaggaaggcctcgtggaaacctacaaatggtacgtcgagaatgtcatctcgaacaagaagtagagccgtgacatg

SEQ ID NO: 58551 - DNA, 400 bp, Zea mays
  Clone ID: LIB3069-022-Q1-K1-F4
gtgctctgtccacctctctcgctctgggcctccgtcgccgccctaagccacgtgctgaggctttcgttggtctcttcgccggcgacgagcacccagcagttctgtagaaatggctgatggtgaggacatccagcctcttgtctgcgacaatggcactggaatggtcaaggctggttttgctggcgatgatgcaccaagggcggttttccctagcattgttggccgtcctcgccacactggtgtcatggtagggatgggacagaaggacgcatatgttggcgatgaggcacagtccaagagaggtattcttacgctcaagtacccgattgagcacggtattgtgagcaactgggatgacatggagaaaatctggcatcatactttctacaacgagcttcgt

SEQ ID NO: 58552 - DNA, 435 bp, Zea mays
  unsure at all n locations
  Clone ID: LIB3069-022-Q1-K1-F5
agagaaactgccaactaagactacctttttttacactgatgaagtgaaggagaggttcaacaggattctcaaatactatattgggacacacaatttccataacttcactacaagaaccaaggcagaggatcctgcagcaaaaagatttatcatttcctttgctgctgaccgtgttgtcagcctggatgggattgattttgtcaggtgtgaagttgttggacagagtttcatgctccatcagatccggaagatgattggtcttgctgtagctgtgatgaggaactgtgcacctgaatcaatttatgatgtcgcctttcgcaaggatgtcaatcttaatgtgcctactgcacctgaggtcggactgtacctagatgaatgtatgttcacatcatacaacangaaatggaaggattcacatgaggcagttttcatgga

SEQ ID NO: 58553 - DNA, 423 bp, Zea mays
  unsure at all n locations
  Clone ID: LIB3069-022-Q1-K1-F6
gaacaaggaaaaaccgaacaacgctgatgtctccaccaacacaaagtctacaaataatgatgaaatggtagaaacctccaacacaaatgatgagaagcatagagaaacactagatctaaatagtgagcagagagcagaatcacccaaagcagatgtcaagatgagagcagagacacctgagaaagacaacgacctgccaggggtccaactagtcactgacgatttgaatgggcaccacgaacagatgcaagaaataaaattggattgataagcattaagcacaatgctcccagcccaaatatcttcgacaccacgtaagtaatatcagagtatntatgatctgatcacacggtgccaggttgtgacagcactgagggtggctaagtttgaaatgatactggtccccccttctttccctttcct

SEQ ID NO: 58554 - DNA, 289 bp, Zea mays
  unsure at all n locations
  Clone ID: LIB3069-022-Q1-K1-F7
gtcatcgcgtggtggccgcgccgctctgttcctccgtcccctcctccttccggctctcgctgtcacatgtcgtgtggtgtgggggcgctctgatccggatggtgcagcgccgcgggatcgcccacggccatgattgatcgcgaacgagcagaggaaatgcaagttaataatgaggcaccactagggtgcctcaagccaaatatttctcagtataactctccagagcagataggtggtgttgaagggtttcctgagaataatgaaaaaaggaatgatatntgtgctgcng

SEQ ID NO: 58555 - DNA, 291 bp, Zea mays
  Clone ID: LIB3069-022-Q1-K1-F8
cccggcccgacccacgcgtccggtcggcccttcgctccaagagcattttagttctcggggtaatacacgtccgagggtcgggtgtactttgcaagcggcgaggtgaacccaccggatctttaaacctagctgatgcccaactcgttattcaacttagatgcgacaattgcactggaaagggcatcgctaattaagctaaacatgtttgaccaaaagctcatttggacaccatcgcaaagtgtgagcaccactcaaaagtatgggataaaaatacactgaaagacacatgtg

SEQ ID NO: 58556 - DNA, 435 bp, Zea mays
  Clone ID: LIB3069-022-Q1-K1-E4
cccacgcgtccgcccacgcgtccgcccacgtgtccgcggacgcgtgggcggagcaacgccgccgccgtcatcttcagcctatccgcgctggacggcaacaaggcgaggatcggcgagctcggcgcgatgaggccgctggtggagctcctcgagcacggcagcacggcagcgaggaaagacgcggcctcggccatcttcaacctgtgcacgctgcacgagaacaagtcgcgggccaccaagagcggggccgtcgacgtgacgctgagggccgtcgcctgcgccggggacggctctggctccggctcgctggtggacgagtctctggccgtactcgcgctgctgtcgggcgaccacgaggcggtggaagaggtcggcgagacgggctgcgtggcctccatgctccacgtcgtgaaggacgacccgtgcaagcgcaac

SEQ ID NO: 58557 - DNA, 428 bp, Zea mays
  Clone ID: LIB3069-022-Q1-K1-D10
ggtcaatgagattctgtctcactatccaatcaactacaagcaatctggtattattccgctgcttgatcttgcacagcagcagcatggtggatgggtgccagttgcagcaatggatgctattgctaaaattgtcgaagttgcaccaatcagggtttatgaagttgcaaccttttataccatgtttaacaggactaaggttggtaaataccaccttctggtgtgtggaactacaccttgtatgattcgtggttcacgtgaaatcgaagagacgttgttggagcaccttggagttaaacgaaatgaggtgaccagtgatggtttattttctgttggagaaatggagtgcatgggttgctgtgtgaatgctcctatgattgctgtggctgactactcgaaaggctcagagggttacacatataactactatg

SEQ ID NO: 58558 - DNA, 401 bp, Zea mays
  Clone ID: LIB3069-022-Q1-K1-D11
ggggaagagaacgcgccgcaccgggcagctaacgaaaccaagccaagccatggcagccaaccccaaccactgcctccgccgcctcgcctcagctctctcccacggtccccggcctccgactcctcccctatccctcctcttcccccgcctcgcgctctccagctccggcccctccacgggcccgccgccgccgccgccggatgccgtaaggaagggggagggagaggaagcggcggaagctagggccgccgaagccgacgccgaagcggggaaggaggaagagcatgaggccgacggcggtgcgcacgtgaacaaggccaccggcgaggtcggcggcccgcgggggcccgagcccacgaggtacggcgactgggagcgcgccggccgctgctccgatttct

SEQ ID NO: 58559 - DNA, 380 bp, Zea mays
  Clone ID: LIB3069-022-Q1-K1-D2
cccacgcgtccgcccacgcgtccgaataaatagcaatggaggtgcaaaatttgatggaatgccaaggttcaccgctcgagttgctgttattgaggcgctgaaggaaaaggggttgtataaggacacaaagaagaatgaaatgagcttgggtgtttgttcaagaactaatgatgtagtggaacctatgataaaaccacagtggtttgttaattgcaaccacatggccaaggcgggccttgacgctgtaaggtcgaaaaagattgaaattattccccagcagtatgagcaagactggtacagatggcttgaaaatatacgtgattggtgtgtctcaaggcaactttggtggggacatcgtgtacctgcatggtatgtgacac

SEQ ID NO: 58560 - DNA, 435 bp, Zea mays
  unsure at all n locations
  Clone ID: LIB3069-022-Q1-K1-D3
cccagttgacgaagagggagctgctgccgttgtcctggcccagctcgagagaagtcttttggtcttggcctcttgctgccgctgccccccaatcggcgccgctttgcttcctggtttccgcaaggttccacacatcagcatccgagacttgggatggaaggcacggcgtcttcttggagccgcgactagggtgggaaggaaagttacttgctgccgtcttcgcggtctttgcgcangcagggtagagccggagatcagagatcttggtgcagacaagtccttcggcgtgcagggtaaatatcgcctacttcttcttcagatatatatgcttgtcggcgaagtcctttcgcgttccgatcatcagcttttcttccaatttgtagttctctctaagcggaatctttgngttcttgaaagagagagagagagagagag

SEQ ID NO: 58561 - DNA, 379 bp, Zea mays
  Clone ID: LIB3069-022-Q1-K1-D4
cggacgcgtgggcgtacccggaggagaactcgcggttcctgcgcacgaacgggatccgcgttcaccagttcgccgtcgaagggagcaagagtggtccgacagtgctggataccatgtcggcgcaggaaccattcgtccacatccccgaagaaacgatccgagaggcgctcaaagttgtccttgacgtgagaaaccagccggtcctcatccactgcaagagaggcaagcaccggactggctgcgtcgtcggatgcctgaggaagctgcagaagtggtgcctgtcctccgtgttcgacgagtacctgcacttcgcggcggcgaaggcgaggaccaccgaccagaggttcatggagctgttcgacgcgtcgagcctgatgca

SEQ ID NO: 58562 - DNA, 425 bp, Zea mays
  Clone ID: LIB3069-022-Q1-K1-D5
cccacgcgtccgcccacgcgtccgtccacgcgtccgctgctgtccagcagttatatatctgtcattttcatgtgcacactatcaagctatatcagtcattcagtactggggtttaagcagcaatgcagcatcctgaatcatgtgttaaatgataacaacaataatgatttaaaaaataagaccttgtcgtccccaccaggccacagacctgggttatcaatgcttaagattccaattgattctactgaaaataccttttctattgataggtatgggcttctacgaggaaccctcagggctccagccctgggctggatgatgtacaatgttctggtgagcaatgaaaagtcgatccagtctcagtacaagtcccacgtctacgccaaccctgacaacgtgacgccagatatcatcgagagccgata

SEQ ID NO: 58563 - DNA, 392 bp, Zea mays
  unsure at all n locations
  Clone ID: LIB3069-022-Q1-K1-D6
cccacgcgtccggaacttggccccgcctcccgtctcttaccgcacatgcgcgtcgggccgcgtcgacatagctgcttgccgccgacacccgcagccgcaatggccgtcgcccacgcgccgccgcgccggggcgtgctccccctcctgctcgtcgccgcgctcgtggcggcgttgccggccacctgcgccgcggccaggagcaagaagtcgtacacggccatcttcagcttcggggactcgctctccgacgccggcaacctcatcgtcaacggcacgcccaaggcgctcaccaccgcgcgccctccctacgggatgaccttcttccgcaagcccaccggccgctgctccaacggccgnctcgtcgtcgacttnctggccgagcatttcgggct

SEQ ID NO: 58564 - DNA, 329 bp, Zea mays
  unsure at all n locations
  Clone ID: LIB3069-022-Q1-K1-D7
ggttgagattgacaacttcatggtccaacagcttgatggaacctccaatgagtggggctggtgcaaacagaagcttggagcaaatgccatccttgcggtttcacttgctgtgtgcaaagctggagctatggtgaagaagattcctctttaccagcacatcgcaaatcttgctgggaacaaaactctggtgctccctgtacctgcctttaatgtgattaatggagggtcacatgctggaaacaagcttgccatgcaggagttcatgatcctnccaactggtgcctnctcgttcaaagaagccatgaaaatgggaagtgaggtgtaccaca

SEQ ID NO: 58565 - DNA, 412 bp, Zea mays
  Clone ID: LIB3069-022-Q1-K1-D8
gatactcttccttttgccaccatgttgctctggttctcttgctgcaatgtcagtgtttgagtcgaagtacaaagaaggccttactagggaggagggaatacagattgtgtgcgaagcaatctgtgctggtattttcaatgacttgggtagtgggagcaacgtggacgtctgcgtgataaccaaggggaagacagaatacttgagaaaccaccagttgccgaatcccaagacttatgctagttcaaagggatacagtttcaccaaggggcagactgaagtactgtcttcaaaggtcacacttctaaagcagaaggttgaggtcgccgaaggtggtgatgctatggaggagtgatcttgcatcctgcattcatacaagcatattctgaatctgtgtaactttgcttagtggatc

SEQ ID NO: 58566 - DNA, 426 bp, Zea mays
  Clone ID: LIB3069-022-Q1-K1-D9
cggacgcgtgggagaacacagggcacacgcactacacgcacggcacgcagatacatatagagagaggttagctatagcttgcacatctatttaactaactaactaactggctagctagctcgatccgcagagcaaagcgaaagcagcaagaagcaaagcaatggagaaccctgcgagtgtgctagttctaccagcgcagttcaccaaactcaccttcggaaacctgtacatccgccgggccgggccgggcagcagggagataaccgaggagggcaagtgcgacctggacaggagatacgtgagtaacttccccgtctacgacggccgcggccccgacgccagccttgtggcccgcgtgcaggggatcaccagcgaaatcgggaacgcgcaccaactgttccgtcgtgtgttcgacaccgacaggct

SEQ ID NO: 58567 - DNA, 390 bp, Zea mays
  Clone ID: LIB3069-022-Q1-K1-E1
cttcaacacattggcaaatcaggctgtggtgcgggcagctggtactgatggccaaaagaggacatacggtgtcataaaacaccgtttgggcgatctattttatcgcctagtatctcaaaagttcgaggatcctgccgaaggtgaagaagctttggtcggcaaatttaagaaactgtatgatgacctcaccactggtttccgcaatctcgaagacgaggcacggtgaactagtgtagattctgtgtaaacaaggactgccaaatgttttataagatacataaattgtagattgagatcatctgtaagaattattcccaccgttgcaccatctcttcggcaccactgttttagtcatcggtgcctgaatggcacccctgttatttcatgtat

SEQ ID NO: 58568 - DNA, 308 bp, Zea mays
  Clone ID: LIB3069-022-Q1-K1-E10
agctgacctcttacacgcgcagttatgcgagtcctgacggtacctgaaattcgtgcactggatcgcgaaccaggccatactagaggtctttgccggctgtcggcgcgtgcacatcatctacttgagaatctaacaggggatgcagtggccggctcttctgcaggcgctcgcgctgcagcctggctgcccaatgtcgttccggctcacccgcgtcagaccaccgtagcccgacgagaccgacgccttgcagctagtgggctgtaaactggcccagttggagcacaccatgctcgtggacttgcagtacc

SEQ ID NO: 58569 - DNA, 382 bp, Zea mays
  unsure at all n locations
  Clone ID: LIB3069-022-Q1-K1-E11
cagcgctcaagttctcgcgcccacagccaaatttttctccactcaatcgcggcataagctgcactgcagccatggacgccagcggagccggtagcaaggcgaagaagggggcggctgggcgcaaggctggcggccccaggaagaagtcggtgtcgcggtccgtcaaggccgggctgcagttccccgtcggccggatcgggcgctacctcaagaaggggcggtacgcgcagcgcgtgggcaccggcgcccccgtctatctcgccgccgtgcttgagtacctcgccgccgaggtgctggagctgggccggaacgcggcgaaggacaacangaagacgcgcatcgtcccgcgacacttgctcctgggcgatcgtaacgacgttga

SEQ ID NO: 58570 - DNA, 332 bp, Zea mays
  Clone ID: LIB3069-022-Q1-K1-E2
cccacgcgtacggctagctagcacctagctgtcgtacacacgggctagcagtcgatcacagaccgatcgcggagaggcaatcacgtacgtatacacacgggcacgtaactagctatctagctagcagtcgtagagtgacgatgaggggtctctctgttgcggtcgctctggtcgtggtggtggccgcggcctgcctcgccgcgccgcggggcgcggacggtgcggtcgagagctgggcgacgccgagggacacggtggcgctgatgctggcgacgcgcgcgtcggtggcggaggacaatgggtccagtgcgtccagctcctgatggatggcg

SEQ ID NO: 58571 - DNA, 390 bp, Zea mays
  Clone ID: LIB3069-022-Q1-K1-D1
cccacgcgtccgcccacgcgtccgcccactcgtccgctcgccttgcgcttcctcgccgccccagttccccaccccctgctcacccacccgtcccctcctgctcgcccatggctcccatcgctgtcggcgacgccctccccgacggccagctcgggtggttcgacgagaacgaccagctgcagcaggtctccgtccacgcgctcgccgccggcaagaaggtcatcctcttcggcgtccccggcgccttcaccccgacctgcagcaaccagcatgtgccaggcttcatcacacaggctgagcagctcaaagccaagggtgtagacgagatcctgcttatcagcgttaacgaccccttcgtcatgaaagcgtgggcgaagacctaccccgaga

SEQ ID NO: 58572 - DNA, 386 bp, Zea mays
  unsure at all n locations
  Clone ID: LIB3069-022-Q1-K1-B6
gtggacagaggataactgaacgacattaccatgttcttgcaaagcaagagttaaccaaggagtatattgtagaagatcttgaaggagctgaccatgtgccagaccttgatcctagccatgttatagagttgaagatattaggactatattaaacatagctgcatattacatcagataaacattgttgatgaatggggaacagcataccggaaacaaatcccaggttgatgttgcaagaaatacgtacgtcattccacttcacctggagacagtgcaaaatgggcctttgtgtgactgtcgcccataaattcttgtgaagcaaaacacaattgctcattcgaagaacaccatttgaaggatctttggtncaatgtaggcctgatagc

SEQ ID NO: 58573 - DNA, 360 bp, Zea mays
  Clone ID: LIB3069-022-Q1-K1-B7
gcgccgggcagaggataactgaacgattttattttgttattgcaaagcaagagttagggaaggtgtatattgaagaagatcttgaacgagctgaccatgtgccagaccttgatcctagccatgttatacagatgaagatattacgactatattaaacatagctgcatattacatcagataaacattgatgatgaatggtgaacagcataccggagacatatcccaagtcgctgttgcaagaaatacgtacgtcattccacttaacctgcaaacagtgcaaaatgcccctacgtgtgactgtggcccataaattattgaaaagcataacacaattgctcattcgacgaacaccaattgaag

SEQ ID NO: 58574 - DNA, 410 bp, Zea mays
  Clone ID: LIB3069-022-Q1-K1-B8
gaacaaaccagtgagaattcttgtgaagagagatgagctgacccttgagggtatcaagcagttctatgtgaatgtggacaaggaagactggaagctggacacactgtgtgacctgtatgagaccctggccattacccagagtgtcatctttgtcaacacccgccgcaaggtggactggctcactgacaagatgaggagcagggaccacaccgtttctgccactcatggtgacatggaccagaacactagagacatcatcatgagggagttccggtctggctcctcccgtgtgctcatcaccactgacctgcttgctcgtggtattgatgttcagcaggtgtccctggtcatcaactatgatcttcccacccagccagagaactacctgcatcgtattggtcgtagtggtc

SEQ ID NO: 58575 - DNA, 372 bp, Zea mays
  Clone ID: LIB3069-022-Q1-K1-B9
gcgcccacgcgtccgcccacgcgtcctgacgatactcgcagctagctgacacggccgagaagcagcttgcattgcaggcgtagtacgtacccagcagcagctagcactagcagtccatcggagcgacgatggtgagaaggacggtgctggcggcgctgctggtggccgccgccctcgccggcggcgcgcgggcgcagctcaaggaggggttctacgactactcctgcccacaggcggagaagatcgtcaaggactacgtgaaggcgcacatcctccacgcgcccgacgtcgccttcaccctgctccgcacccacttccacgactgcttcgtcaggggctgcgacgcgtcagtgctgcttaacgcgacgggcg

SEQ ID NO: 58576 - DNA, 403 bp, Zea mays
  Clone ID: LIB3069-022-Q1-K1-C1
gagctggaatcggtccaggtgtctacgacttccactcgcccaggatcccctccaccgaggagatcgcggaccgcgtcaacaagatgctcgccgtgctggacaccaacatcctctgggtgaaccctgactgcggtctcaagacacgcaagtacacggaggtgaagcctgccctgaccaacatggtctccgccaccaagctcatccgcacccagctcggcagcgcgaaatgagtcagatttggtagatccatggtttgttgaacacaaaagccagcagggtcatttgtttcgaataatttgggtccttactcctgttccatggcgttaggttagcctcattggtgttggtggggtacggcgttacgtgtccgtgttctaagtttggagtgtgtgtttctcttttt

SEQ ID NO: 58577 - DNA, 443 bp, Zea mays
  unsure at all n locations
  Clone ID: LIB3069-022-Q1-K1-C10
ggcagagcgtcttgggaatgcccttatgcatgatcctgctatgtccagtatgcttgagaacttgaccagtccagctcataaggagcagcttgaggagaggatggcccgtatcaaggaagatccatccttgaagccaattcttgatgagatagagaatgggggtccatctgcaatggtgaagtattggaatgaccctgaggttcttcaaaagattggccaggcaatgggtgttaaccttcccggagattctagtgtgtccactgtgctctctggacccgaagagactgaggaggaaggaggggatgacgatgagtccattgttcatcacactgcaagtgttggtgatgaagagggtttgaagaaagctttagaaggtggagcagacaaggatgaagaagatgccgagggaagacnggctttacattttgcatgtggctatggtg

SEQ ID NO: 58578 - DNA, 317 bp, Zea mays
  Clone ID: LIB3069-022-Q1-K1-C11
cgagaagcccagaaggtgagaagatagatagagagagagagagtgatcggtacaaggatcaccgctgtgcctgcgcgtgctgcttcaccgaatcgagtcagaccctgtccgaatccgagccaagggatggcaaccggtagtgaggcctcgaaggcagctgaggctgtggttgactggcataaacaggacagcaagaggatgctccatgcggattaccgtgttggggatctggaccgtacaatcaagtactacacggaatgctttgggatgaaactgctgaggaaaagggatgttcctgatgagaagtacaccaacgc

SEQ ID NO: 58579 - DNA, 308 bp, Zea mays
  Clone ID: LIB3069-022-Q1-K1-C12
acggaagcccagtgcgaaagaacatagactgagagcaagagagtgaggaccacatggatgagtctacttgagcacgtgcgcggaataaccgtatagaatcacaagcagggtttgatgaacccaactgatttaaacaactacagactctcagatggcaccagatgttacatctgactgaaatctacagcaaaaagcgttgaagctaaacccacacaagacactataatacgacttgctcctccactaacactcaacgctgaggagcttgaagaaacatccaaggcacttagatacgtacctgaacatga

SEQ ID NO: 58580 - DNA, 350 bp, Zea mays
  Clone ID: LIB3069-022-Q1-K1-C2
cccacgcgtccgaagatattgtgtcaaagctgttggacttcattgctgaacctcactctgcagctgaatcttgggcctctgatgatcagggatcaaattctaaaaaacgcaagagaggaggtgaaagtgcaagtaagacgcctgatggcacacctagtaggtcgaggaagaaatttgtcgatgacggtacttctagtaaaaggcagaataaagcgctccagtatgatactgaggaggatgaatccatgaagtctgacagtgaggaaaacatagatgaagattcagatgaagctgctgacaaacaggaagttgactatggatctgggaaagaaaaggcaaggaagaagtta

SEQ ID NO: 58581 - DNA, 393 bp, Zea mays
  Clone ID: LIB3069-022-Q1-K1-C3
cggacgcgtgggcggacgcgtgggtccggtacgcgtgggcggacgcgtgggtagatcgcgagcgccgccctttttttttttttttaacaactttctgccttactgaaccactgcaaaaccagaacaggttcactcgctcttgctctcggtctgtctaaacctttgtgcttacacctggcagaacgcacatatccaatatacatccatcaaccatagcaccaggtccaaaagaaaaatccaagaaataatagtcgacttaaatcagacatgatcaatcaagaccaagcaatatccttctatgtatgtactagaacaaaaagatgtgacatgcacacattgtgttggatgtgttggtatcatcaatcaaggaccttcttgacttcctgaacaaac

SEQ ID NO: 58582 - DNA, 413 bp, Zea mays
  Clone ID: LIB3069-022-Q1-K1-C4
cccacgcgtccgcccacgcgtccggatttatttataggaatttgttagtggaatacagggagtattgcagaaatcagcgttttttttcacaggagaaatgtgggtttcaggaaaaaagcactgcattccaaaggggacctgaaattcgtgctagattcatgtacaattcttacattccaaagaggcccaaatgccagcaagctaggatcactggtctctcttggacctgtgcttcctggtgccatccttcctgctccatcaaccatcatgttgactttatgaagctgatcagatggggatgcttgggaaccatggagtgggtttgctttggcttctggttcgggttttattaggtgatatgggatctagcctgtaatcgatgtttttttatttggttcattgtaaatttatat

SEQ ID NO: 58583 - DNA, 380 bp, Zea mays
  Clone ID: LIB3069-022-Q1-K1-C5
cttggagataggtggccctagaaatttatatatggatcaccaatcttccccaaatgagagacccatcaaagcagcagatcatgaaaacaactccaaggagtcaatgatagaaaatttagaggagccaactgttcgagctgctgacctaattggttcaatggccaaaaacatggatacccaacaggcagcaagagctgcagaagatacccctaatttctcttccaaagtgccagaagggaaaggtaagaatgaccagcatgataattatgttttgccatcacttgagctgagtttgaagaggtcgagatcatgtggagatggtgccaacgatacagtcaatgacgatgaacagcggaatagtgcattaaagcgatcgaatc

SEQ ID NO: 58584 - DNA, 440 bp, Zea mays
  Clone ID: LIB3069-022-Q1-K1-C6
ctcgccaaatacacccagggtttcagcggtgcagatatcacagagatctgccagcgcgcgtgcaagtatgccatcagggagaacatcgagaaggatatcgagagggagaggcgcagcaaagacaaccccgaagctatggaagaagacgaggtagacgacatcgctgagatcaaggctgctcacttcgaggagtccatgaagtacgcccgtcgcagcgtgagtgacgccgacatccgcaagtaccaggccttcgcccagacactccagcagtcccgcgggtttggcagcgagttccggttccgcgaccaaccgacggcagctgctgctgcagccgatcccttcgcatccgctgcagcagcagctgacgatgatgacttatacagttaaattagcagtcctgtgttgtgacgcatattgaagactttgctttcgtatatgct

SEQ ID NO: 58585 - DNA, 361 bp, Zea mays
  unsure at all n locations
  Clone ID: LIB3069-022-Q1-K1-C7
ggtgaaatggagaatccaggggatggatgattcatctttacctctgtcagtcaattgctggccgtctgtatctggaaatgaaacctatgtgaacattgaatatgaagcttctgagatgtttgatctgcacaatgttgtcatatctatacctctgcctgcagttcgggaggctccaagtgtcagacagatagatggagagtggaagttggactcaagaaactctgtgttggaatggtctattctccttattgatcagtcgaatcgcagtggttccatggaatttgttgttcccccagctgatccgtcatcatttttccccatctctgntggattttctgcatcgagtactttcagtgatctg

SEQ ID NO: 58586 - DNA, 361 bp, Zea mays
  Clone ID: LIB3069-022-Q1-K1-C8
cggacgcgtgggaaatgatttgaagagccctaagaagcaagacctagagagaactgctggatctgttctttttgactgggagacagaaatatatgtagcaagggcacctggacgtttggacgtcatgggtggcattgctgattattcagggagtcttgttttgcagatgcctcttcgggaagcttgccatgttgctgttcagagaaaccatcccagcaagcagaagctttggaaacatacaaaagcaagacagcttgttaacggaagcttggtacctgtgatacaaattggatcatttggttctgatttgagtaaccgtgcaccaacttttgatatggacctgtcagattttatggaatga

SEQ ID NO: 58587 - DNA, 441 bp, Zea mays
  Clone ID: LIB3069-022-Q1-K1-C9
gttttggagctctgcgcaatgaccatgatatattccaaacgtttgagggggacaatactgttcttctgcagcaggtcgctggagatctcctgaagcagtaccaggagaagtttaagggagggacactttcagtcacttggaattacttaagggactccatgggtacctacctgtcccagcctaatcctgtcactgcccgatgggagggtgaagatcatctgcgggatcctaatttccagctggatgcattcagataccgaacatctcggttgctacatagtgttgctgctcggcttcagaaacacagcaagacgcttggaggttttggtgcgtggaatagatgtttgaatcatcttcttacgcttgcagaatcacacattgagtctgtcatccttgcaaagttcattgaatcagtgaaaagcttgcctgacgaaaaatcgc

SEQ ID NO: 58588 - DNA, 436 bp, Zea mays
  unsure at all n locations
  Clone ID: LIB3069-022-Q1-K1-B5
cagccgtggactctcttccgtaagccctagcccctagcccctagccgccagtgtcatgcgttcgtgctgaggctcaactgctgatccgtcttccaagctctggtatcatccctgagcactgatttaagatgtatctccagtactacatcaacgagaagggggacaaggtctacaccaccaagaaggagtcacctcttggggtgccaacgcagtctgctcacccagctcggttctcacctgatgacaagtactctcgccaacgatacctgttgaagaagagatttggacttctgccaacgcagaatccaggaccgaagtactgaagcttcaagtcaactgtccaacctgcgatgttctttttgtgtcaatgcttngtggttggaatgtactatcttcgttctcgaatatttgtggtccgctagttcaattttgaact

SEQ ID NO: 58589 - DNA, 389 bp, Zea mays
  Clone ID: LIB3069-044-Q1-K1-C4
gaactgcatccatctattccaggagcatgtcatattgagcctcatgcacctgctctagaggagcttcaacgacaccaagtggcacgtgtaccgactgtgcgttctgaaagctagcctgaacctagcgctccagatcgagatgatcaaactcgaggcgaagcacagaagtactactatcttcggactacaacggactgaagtccggagaaactacctgagcctatgacagtttcggagagctctgatgacataactgaatgagtcgaatctactagagcacaaggaccgaagtgctagtttaacagagtgaccaaactgtcaggacggactattcctgacgagttaaaagatgcacgggaattgccagacaaggtatcagatcaacaacc

SEQ ID NO: 58590 - DNA, 430 bp, Zea mays
  Clone ID: LIB3069-044-Q1-K1-C5
agaaccgagatcctcataacccttttccttcctcccttctcccctctcggatcgagtgcttgagctccgaccaaatctcgcagcggctgcaattccgagcccgaagagcggatcaggcgaggacgacgccttcgattctgatctgcggtcggcgcgacccagagagaaccggagatgcagcagggcgacggcacggaggcgcaggtgacgtgggaggaccagcagaacatcaaccgcttcggtcgcctcaacaaccgcctccacgagctccaggaagagatcaagctcgcaaaggagacgaatgagaaccttgatgatgctgggaatgaactcatcttgtccgatgaagacgttgtacgcttccaaattggggaagtgtttgctcacatgccaagggatgacgtccagactaggctggagcagatgaaag

SEQ ID NO: 58591 - DNA, 456 bp, Zea mays
  Clone ID: LIB3069-044-Q1-K1-C6
ggccgagatcaccaacagcgccttttagctatcctccatgatggccaagtgcgatccccgccatggtaagtacatggcctgctgcctcatgtaccgtggtgatgtggtccccaaggatgtgaatgctgctgtggccaccatcaagaccaagcgcaccatccagtttgtggactggtgcccaactggctttaagtgcggcattaactaccagcctccaagtgtggtgcctggtggtgacctggccaaggtgcagcgcgctgtgtgcatgatctccaactccaccagtgttgtggaggtgttctcccgcatcgaccacaagttcgacctcatgtacgccaagcgtgccttcgtgcactggtatgtcggtgaaggtatggaagaaggcgagttctctgaggcccgtgaggatcttgcagcgctcgaaaaagactactaggaaggtggtgcttaatttga

SEQ ID NO: 58592 - DNA, 423 bp, Zea mays
  unsure at all n locations
  Clone ID: LIB3069-044-Q1-K1-C8
gtcggaacattcgtccctcactagctagttcgtagcagaatcattctgagaggctacccatcctgatgatgcatggttgtcttcaactccttccggtttcatttcatggaaatcagttggtagataagatcgagcaaactttctcttgtatgtaatgttgtcatgggaaaaaaaaaagaaaatacagtgtaaaggcacactggcagacaagccatagatatgaataggtatgtgtgttgttgaaggaatgtgctgtgatgcgcatgggggattggtgatgacaagcaggccgttttgagtctccatatcacctatgcagaatcagctgtagaaaaaaaggtagcaaattgtggaagtcgaaccaattgttttgcaaacataaaanaagatgaatgtttgttggcgagttcgttgcgagaaaaa

SEQ ID NO: 58593 - DNA, 266 bp, Zea mays
  Clone ID: LIB3069-044-Q1-K1-C9
cccacgcgtccgcccacgcgtacgcccactcgtccgttttttttttttttttattttgtggtttgattttattgttatggatttttattaatattttcgaggggactttctaaaagacacaaccgaaattaagaatgaatgcgaacgcaaaaatattaaaaaagggaaccaaaatgcaaataagatgaccgacgactaacaacatgggaactgggaaaacactagggatacccaactaaaaagggttgaaaaagaaaaacttttag

SEQ ID NO: 58594 - DNA, 365 bp, Zea mays
  unsure at all n locations
  Clone ID: LIB3069-044-Q1-K1-D1
atctcctcgcatttcttcccatccgatcttcccttcgcaaccaaaaccccaactcgccccgcatcgatggcgcccaaggccgagaagaaacccgcggcgaagaagccggcggaggaggagcccgcggccgagaaggcgcccgccgggaagaagccgaaggcggagaagcgggtccccgctggcaagtccgctgccaaggaaggcggcgagggcaagaggggcaagaagaagggcaagaagagcgtggagacctacaagatctacatcttcaaggtgctgaagcaggtgcacccggacattggcatctnctncaaggccatgtccatcatgaactccttcattaacgatatcttcgagaagctcgc

SEQ ID NO: 58595 - DNA, 413 bp, Zea mays
  unsure at all n locations
  Clone ID: LIB3069-044-Q1-K1-D10
cccacgcgtccgcttgaatcttgagcacatagtatgctcgctcacaggacagtcacttgcctgggaagccagatattattgcagcctcatacaccgcccttccctactgcttcctgagatttgagagctcgggcgccagatctgaaacctcttgtgttgtgcctttggtagttcggtgtagcattgagctagtagaggtgctgttccagttccaggatgagcaaggaggatgtcctcaaggtgcagacattgatgctgagagtgaacatacactgtgacgggtgcgagaagaaggtcaagaagaccctncacaagatcgacggtgtctaccagagcagcatcgacgcggaacagggcaaggtgacggtgtccggtttgctggatccggacaccatcatcaggaagctcaacaa

SEQ ID NO: 58596 - DNA, 407 bp, Zea mays
  Clone ID: LIB3069-044-Q1-K1-D11
cccacgcgtccggtccgccctccttgtgctccgcttgcaatggcgtccaccgccgtcaagctcatcgacatcgcagtcaacttcacagatggcatgttcaagggcatctaccacggcaagcagtgccacgtcgccgacatcccggccgtactcgcgcgcgcgtgggctgcaggcgtcgaccgcatcattgtcaccggaggctccctgaaagagtccagagaggcattgcagatcgccgagaccgacgggagactgttctgcactgtgggagtgcacccaacgagatgcggggagttcgaggagagtggagaccccgagggtcattttcaggcactgctggctctagcgaaggaaggtttagataaaggcaaggtcgttgcttgtggtgaatgtgggttggattatga

SEQ ID NO: 58597 - DNA, 363 bp, Zea mays
  unsure at all n locations
  Clone ID: LIB3069-044-Q1-K1-D12
cccacgcgtccgcccacgcgtccgcccactcgtcctcccacgcgtacgcagaaaatggcgtcacttctccgccctctcgtgctcgtgctcctgatcgcctcctgcgcagcgcagcagtcaccgccggcgcagcccccgccaacgccgaacgcgccaccggccaactcgccgccccaggcgcctacagccggaaacccggcgccggcgccccaggcgccggcggcaggcaacccggcacctgcgcccaccggcactccacctacggccccgaccactccgaccccggccccgaccacacctnccccggcttccacaacgccgaccccggcgccgacaactacacctacgacccccaccacgccg

SEQ ID NO: 58598 - DNA, 458 bp, Zea mays
  Clone ID: LIB3069-044-Q1-K1-D2
aagttcacttgcagctggttatctggatgcttcgacgctggcggattatctcgtgaagaagggagtccctttcagaacttctcacgagatagttggaaggtctgttgctctatgcgtctccaagaactgtcagctagctgagcttgaattggctgacctaaaatctgtccatcctgtatttgaggatgacgtctatgaatacctgggggttgaaaacgctgtaaacaagttcatatcctatggctctactggttcagaacaagtgaaaaagcagcttgaggattggcgcatccagctcggggtgagctcataagggttggcatggtccaagaaataagctcgcaaattagtgcttgcgatttttgaaggtgtatgttgacgtcgtgaacttttactgagcgtttgatcatacatgttcgaaactggaatgaatgatgtaaacatgttagacaccttga

SEQ ID NO: 58599 - DNA, 382 bp, Zea mays
  Clone ID: LIB3069-044-Q1-K1-D3
cccacgcgtccgcggactcgtggggcctttatttataggggaacttgagatgctagaggagctggacatcagtagcaaccagatacgagtgcttccagactcttttgggcatctctcaaagctacgtgtgtttcatgctgatgaaactccactggaagtaccgcccaaagaagttgtaaagctaggggctcaggagctggttaattatatgaagaatatggttgctgcaagggaagtgagccagaatcaaacagataagaggagcttctggacctggctccgctcactgtttggttgttacaaaaagaatcaaggattgggaccagttccagcctagctgaaccatatcgtccgcatgtattgtcatgaattattcaggttt

SEQ ID NO: 58600 - DNA, 404 bp, Zea mays
  unsure at all n locations
  Clone ID: LIB3069-044-Q1-K1-D4
cgcagctggaacagcttagtggatggcattagatatacttcgaaatgaaccatcagatgagaaatgtgacgtcttcagctatggggtcatattatgggagctctgtacattgctgcagccatgggaaggtatgaatcccatgcaggttgttggagctgttggttttcagcaacgacggcttgatattcctggtggtgtggatcctgctgtagcagagataataaggagatgctggcagactgatccaaggatgcggccatcattttcagagatcatggctactttgagaccattgttaaaaaacatgcctgccaaccaacctaccaggaagcgggcacagcanacagatgattaagaatatattggtcagtatcagctgaagacacaggccatagagagactgc

SEQ ID NO: 58601 - DNA, 367 bp, Zea mays
  unsure at all n locations
  Clone ID: LIB3069-044-Q1-K1-D5
cccacgcgtccgcttaagggttcctgtactagaaaatctcgcccgttacgggaacagcagctcaaatgggagtccaagcagtgagggtcaaggatccttgttggatcagtacaatggtgtacatgatgcttcccatggcttgcatcggaagcgaaaaaagcaccttgatggtgccggcgatgatgatcatgcagatgcctatagtaacaaaatgatggaggatcactaccgtgcgatgctcagtgaacatgtccagaagtaccgaaggtcaaagtttaaggaaggtgcttttatttccgatccttctcaggtggcaatcccccanattaaacacaaaaacggtgggtaaaaagttatgaagcacatt

SEQ ID NO: 58602 - DNA, 428 bp, Zea mays
  Clone ID: LIB3069-044-Q1-K1-D7
cgctcggatcccttcttcctccatttcactccaccgtcgcctccgcctgcaaatccattgctagactcgagctgtagctgcgagcgagctcagcttggggctcaggcctgtagggtgatagccttactgctcctggtgctcatcgcctaggaccttggtctgtctgtttagggctgtcgcggctgcaggagccgatgatcgtcggatgcagccgatgctgctagcgtacgcatatagtgaggactgaacggctcgctgggcacgcgatctgatgagtggatgctacagcgattgacgtagacgcactatccatcatgcagggcgccatgcttcggaacctcactgacaagctattctagaagaggaataacgcccagctcgagattgaggggattgttaagcaacttgcaatggctgaagaacattag

SEQ ID NO: 58603 - DNA, 429 bp, Zea mays
  unsure at all n locations
  Clone ID: LIB3069-044-Q1-K1-D8
ctcatgcgtcatctcctgccgaccctggctatcccaaactctagtccagccagatgtacggcgactccggcgagagcacgggatcagatccgccgtgatggcgttgcgccgcatattatccacagcggtgcgccgccgctcgggcatcgccgcggcagcatacgggaacgcgcgcgagggctccacggacgtcgccgcggcgcccggcgtgctagccctcgactcgaccccggtgcgcactcccgggatgccgtacgatcgcatcgacgaatccgttaacgccaggctccatcggcttgagcacccagacccgcgctttctacgctatgcaagccccgttccgtcccacgccgaccacacggccatncttgcagcgccggagacctcggtcaccacgctagccaacggcctgcgcgtggccactgagtc

SEQ ID NO: 58604 - DNA, 405 bp, Zea mays
  Clone ID: LIB3069-044-Q1-K1-C3
cccaaagttgtgcaccgtgacatcaaatttagctttattttgattgatgatgagttcgagtccaaagtatcagatttcggtttagccaagcttcttggcgctggaaagagtcatgtcaccactagagttatgggtacctttgggtatgtggcaccagagtatgcaaatactggactcttgaacgaaaagagtgacatttacagctttggagtcgttctccttgaagcaattaccggaagggatcctgttgactatggacgcccaccaaacgaggtgaatctagttgactggctaaaaatgatggttgccagcaggcggtcagaagaagtagtggatcccaccatagagacacgaccttcgacgagagctctaaagcgtgcacttttgacagctctgaggtgtgtg

SEQ ID NO: 58605 - DNA, 309 bp, Zea mays
  Clone ID: LIB3069-044-Q1-K1-B1
acgtgagctgacgctgtcactcgcgatagttgctagagagagagagagagagagagggcccgagagccgaggacgagtgcagtctggctggcgtgatgctgcttcggagcgcgtcctcgccgctgctcaactgcgggcgcgcgccggctgccacggcgatcgtcgagcacctggccgtggttacgccgatgttatcaccggcagtggctgcgcctaggcaagggccggtgctgcgccgcgccatgtacgacggggaccatatcgcgccgatcgtgcccaagaaggacgattgacacggcatggcgccga

SEQ ID NO: 58606 - DNA, 310 bp, Zea mays
  Clone ID: LIB3069-044-Q1-K1-B10
cccacgcgtccgcccacgcgtgcggccaatcccttattgcgacctgcgttccgccaaaaccctacggccatggacggcggacgcagcggtgtagggcgaggaggagttgaggcaagtgtcatggtgggcggaggagttgagccgatcagcggcgctagagactgcagacacttggagactcgcagatagacgctgaagcttgagcacaagctgtactactgcaatctgaacgataactccaggcggaggtacctcaagatatgcgcatagactctctacacgcgctctacaatcattgctctcggcaact

SEQ ID NO: 58607 - DNA, 395 bp, Zea mays
  Clone ID: LIB3069-044-Q1-K1-B11
ggaacagaggtgcactcgccagttgttctttcaaatgccactccatacaaaacatttgtggacctagtaccttctagtgttcttccggaggacttcctctgtgcaattaaggcagcagattacagctctgcaacaacaaagattaatgtggctgtcgacagactgccacagttccagtgttgcaacaccaatcttgaaggtggtccagagcacatgggcacaatacacattgggtccgaaagcatggaggaaattgacgttgcatacagggaagcagcagacggcatctcgtccaaaagacctgttatagaaatgacaattccttctgttttggataagaccatctctccgccagaaagcctttgctgagcgatgcttctctttgattgatgagt

SEQ ID NO: 58608 - DNA, 393 bp, Zea mays
  unsure at all n locations
  Clone ID: LIB3069-044-Q1-K1-B12
ccaaaccttggcatgaatgatgtttatcttgcttatcttccattggctcatgtctttgaactagcaggggagactgtcatgttagcttctggcagtgccattggatatggttcagcattgactatgactgatacatcgaacaagattaagaagggaacaaaaggagatgtttctgtactgaatcctactcttatgatttcagttcctgcaattttggatcgtatcagagatgcagtatttaagaaagttggtgagaagggtggcctgacaaaaaagctgtttgattnttcatataagcgaaatattgcagcaattgaagggagttggtttggatcttgggcaccagagaggatgttatgggatcacatttattataaaccaatacnggcaatg

SEQ ID NO: 58609 - DNA, 285 bp, Zea mays
  Clone ID: LIB3069-044-Q1-K1-B2
cccgacccgaccgacgcgaccgacttgagcggacgcggtaacacgcgagattagattaccagacagagagagagagagagggcgagagccaaagacaagcggggggaggcaagcgagatgctacatcggagcgcgaccacaccgacgcgcaacagcaggcgcacaccagacagacgagaaaacagtcgagcaccacaaagaagaaacgccgcagaaaacaccaacagaggcgacgccaaggcacggaccgggacaggaccaagccaagcccaaaggagaccaaaa

SEQ ID NO: 58610 - DNA, 365 bp, Zea mays
  Clone ID: LIB3069-044-Q1-K1-B3
cccacgcgtccggggacgacatggagaatatctttcatcacaccttctacaacgagctccgtgtggctcccgaggaacaccccgtcctcctcactgaggcgcccctgaacccaaaggctaaccgtgagaagatgacccagatcatgttcgagaccttcaacacccccgctatgtacgtcgccatccaggccgtcctgtctctgtatgccagtggtcgtaccacaggtatcgtgctcgactcgggagatggtgtcagccacactgtccccatctacgagggatacgccctcccccacgccatccttcgtctcgacctggctggccgcgacctcaccgactacctcatgaagatcctgactgaacgc

SEQ ID NO: 58611 - DNA, 169 bp, Zea mays
  Clone ID: LIB3069-044-Q1-K1-B4
gtaacttgtttaaggataataaggaccctttgcttctttccctttgactgaagtgcagcccggcacaccggttgcttgttgaagaatgcttttttattattattgtagttaagagtccagacgtcgttattaccacttatcgtcgtattggaaaaaatgtctttttctt

SEQ ID NO: 58612 - DNA, 418 bp, Zea mays
  unsure at all n locations
  Clone ID: LIB3069-044-Q1-K1-B5
cccacgcgtccgggaagccgaggatgcattttcttcagcaagttatgatgtctctaatgaaggaaggatggcggtcataacaaccactgatgcctctggcagtccattggccatgagagatttcgacggcctagccgactccatgactatgaggagcagcaaatcagaaacccttcgaagtttgcaatcctcctacgagcaagaatcccctagtgtaagccggcgccgccgtgttcgctttgaggtaccagaggaggatggcatgggccggcaagtgaaagaagaactcatggcgctggtggaagcgaaacatgctggggtggcatacatcatgggccattcttatatcaaagctaggaagagctcaagtttcctgaagaagttgctattgatgtggctactctttanctcgaagact

SEQ ID NO: 58613 - DNA, 371 bp, Zea mays
  Clone ID: LIB3069-044-Q1-K1-B6
gcggacgcgtgggttactgcaaacttggtttgcatccatcccattagcattggatgaggctgttcgcagtggcaaggtgaagactggtgatattattgccgcatcatgttttggcgctggacttacctggggttcagctattgtcaaatggggctaattattctacgtgagccataacaacatcaatgagatcttcataggccttggggacctacatctatttggtcttcccccccttcacccattttctgtgcaacatttttctatcgcatgtgtcggtcttacttgcacatgaaaatctagtgccattttaccgtatttctttggcttcatacacaactgatagtagattggtggatgaacatgggtga

SEQ ID NO: 58614 - DNA, 384 bp, Zea mays
  unsure at all n locations
  Clone ID: LIB3069-044-Q1-K1-B7
caatttagttcccaggtaccacaatttagttcacaagctagttcacaagctcacatttgaatggagcaatacacaggtagcagtttgacaagctattacacaagctcacatttctgggagcaatacacaggtagcagtttcacaagctatcacacaagctcacatttctgggagcaaaaaacaggtggcgtagtagcagtcgtgtgttcatcttcatttgcagcaacgacaagttcacggcttggtgcttcatcttcatttccagctacaacaacgacaagccacctgctttggcgcggactagggttgtggtcgcagcgccgncgtcacctgctttggcgcggngccgcgagcagcaagggagaagacgcggagtttggagag

SEQ ID NO: 58615 - DNA, 446 bp, Zea mays
  Clone ID: LIB3069-044-Q1-K1-B8
cccacgcgtccgccgtcgacggcgttcccttcgacacctacctcactaggttcgtgtgggatgagggcaagtaccccacaatgtcccctctcaaggagatcgtcggcagcatacagtcacaggttgccaagatcgaggatgacatgaaggttcgagcatcagaatataataatgtaaggagccagcttagtgcgatcaacaggaagcaaagtgggagcttagcggttcgtgatctttccaatctggtaaaaccggaggatatgatcacctcggaacatctcgtgacacttcttgcaattgttcccaagtactcccaaaaagactggttgtcaagctatgagaaaattgacacattcgtggtacctaggtcctctaaaaagctctatgaagacaatgaatatgctctctacactgtaacactgtttgctaaggttgttgacaatttt

SEQ ID NO: 58616 - DNA, 434 bp, Zea mays
  Clone ID: LIB3069-044-Q1-K1-B9
gccctgatcacatcatcctgcttgtctctttccaatctagctccatctctctttcatctactcttccatcgatcgatccatcgtactgcgtgaggatggggaggggaaagattgagatcaagaggatcgagaacaccaccagccgccaggtgaccttctgcaagcgcaggaatgggctgctgaagaaggcctacgagctctccatcctctgcgacgctgagatcgctttgatcgtcttctctacccgaggccgcctatatgaatattccagtaacagcgtaaggtcgacgatcgagaggtacaagaaagcctctgccagcacttcaggaacagctccagtgacagatgtcaactctcttcaatactttcagcaagaagcgggcaaactgcgccagcagatacaaaccttgcagaattcaacaggcacctgatgg

SEQ ID NO: 58617 - DNA, 378 bp, Zea mays
  Clone ID: LIB3069-044-Q1-K1-C1
gacgccgctcccttgtctttccaacgtcttatctcgatccgcccgtcgcggcccccagatctctctctgctttagcgcaactcgcgctccggtgcgcgtccactcatcgcgatcgcctgctcgaccgatcgatagctcaagcacgacgagaggagagctacctatcgcagttgcgcgtcttccttcttgctcactctcagtctcttgctcgctcgccagctctttcccacttgcatggatccctccgggcctggcccgtcgtcggtcgtgggggcaggaggcggcgaggcaccggccgtggcgccgcagcggccggcgcagctgagtaggtacgagtcgcagaagcggagggactggaacacgttcctgcagtacctg

SEQ ID NO: 58618 - DNA, 206 bp, Zea mays
  Clone ID: LIB3069-044-Q1-K1-C10
ttcccgtcgccacgcgtccgattaccgacttaatgaacgctgactcacctctgtcctatactggaaccagagcacggttacgtggacacggagcgcgacaaagacgatcgtgagcaccctcggtgagacgggtctcactgagatacctgggtcagaacgcgcaaaagtacacggggcgatggttctgtccactgacctcaccgaat

SEQ ID NO: 58619 - DNA, 371 bp, Zea mays
  unsure at all n locations
  Clone ID: LIB3069-044-Q1-K1-C11
aagagagctgatgctgagaaggctcttcttcacatggatggtggtcaaattgatggaaatattgttaagttgagattcactcttcaaccacgccaaagggctgcatcacctgtaaaagctccgccccctcctccaaaaagagatgctcttcagattgaaaaaggtgttagcagtgctgaaaaggatgctcagcagcgtcctaaggaatcatctccacgaaggaaaccagcttcacctctacggaaacgatctccaaatcgaagggctgaatcacccaggcgtccacctgacccatcacctaggcgccgtcctgattctccgcctatacgtcgccgaccagatccttctnctgtcangcgtggtgacacacc

SEQ ID NO: 58620 - DNA, 397 bp, Zea mays
  Clone ID: LIB3069-044-Q1-K1-C12
gttatagatcgcgagcggccggcccttctttgttttatggaatgtagcagcacatcagagcgaagggagctaaatgatgtgattgcagtgttcgccagcatggattgccctgccacaatccataaggggctgcaatacctactgagctacaactggaccctggtcttagaggggattcattccttgcaaagctagcgcaactagagaggtctcccattacttccgacgcattacaccgttcgaggatggtgaagaagaagaccatagcctaaacacgggtgatgaagacgacgaccacacctgtagcattagctacaactgtgactccgatgcaacattccagccatgccatcaccggtcctgctatggctgcataagcaggcatctcctgaacaac

SEQ ID NO: 58621 - DNA, 420 bp, Zea mays
  Clone ID: LIB3069-044-Q1-K1-C2
cccacgcgtccgatcacatgctctcccactatactcaagctagtgcgagcatagcaatggggttctcccggaagagtggagttgcagcaatacgggtctggtggctcctcctgctcgcctgcgtgctgttgcctttggcggcggcatttggccggcacgccgatgccggcaacgacatgtgcgacatcaagtgccagcatcacatcgacccggtcaggaggcatcagagcgtggatgagtgccataggcgtgagcaccatgaccctagcagagagttttgcgagatgaagagccagcaccaccaggaccctgcaaggaaagagatctgcgtgcagcaacgcatgagctatggtctcgagcaccgtgcgagtgccagtgttgttgatgacggtgaaaagcgcttgcatggctgggaaacga

SEQ ID NO: 58622 - DNA, 279 bp, Zea mays
  Clone ID: LIB3069-044-Q1-K1-A9
gcccacgcgtcgccaccgtcgccattttcctgacccgggccaggccatatgggttggaaaggcagttggtaaccttcccttggtcaatggcaagggccaattagagaaacacaatgacttcttccttaacaagcctcttggtgggggtcctgccggaagggtgaagcggaagaaccagaagaaggcctcatggggcggcgacgctgaggaggacgaggagtagagggccacgtagggattctgcgaccgcaattggttgaaatgtgaggtggacacttt

SEQ ID NO: 58623 - DNA, 200 bp, Zea mays
  Clone ID: LIB3069-043-Q1-K1-H2
ctacgcgtagacggtctcctgtgcagattcaggtgttaaccttatggactgctttcatgcgacggcatacttctaatctcgctggatctaaacgcaatatagagacctatattctacaacttcgtatctgataaaaacctttcgttaatcaatttaaggacttggcataagatcctccaatatcatgcatgacaagtact

SEQ ID NO: 58624 - DNA, 431 bp, Zea mays
  Clone ID: LIB3069-043-Q1-K1-H3
ctcgatccatctcactctccgctggtcgctcactcttgcagctccacccttcactcagtggtagtctcttattagctctaggctctagctagccgcgccactccttcgtgtagccatcagccttctcatcgccaccaatggccactgccgaggtccagaccccgaccgtcgtggcggccgaggaagcgcccgtggtggagaccccgccgccggccgtcgtgcccgaggagtctgcccccgccgaggccgaggccgaggccgaggctgctgctcctgctgatcccgaggagcttcccgcggccgagcagcaggtagccgccgaggcggaggccgcggctcctgctggtgccgaggagcccgtcgcgggcgaaccggccgcctaggcggaagctgctgctcctgctggcccgaggagactcctgcggtcgagc

SEQ ID NO: 58625 - DNA, 346 bp, Zea mays
  unsure at all n locations
  Clone ID: LIB3069-043-Q1-K1-H4
acaccttgcagctccatggtccctggctttagaattccaatgtggggagaggaattcaatttttgtgttgatagtcttcctgtaaagataaatgtcacgatatatgactgggacattgtatggaaaagcacaatccttggctcttttactgttactgttgaatctgaggtaccgagtggaccaatttggcatacacttgacagcacatcacgccaggtgtgtcttcatattaaagtaatcaaggttcatgaaagttactccagggcaataaatagctcagctgangctggtgctcgtagaaggatttccttggatatgcaaggtcctactgtaggtcatcaaaagc

SEQ ID NO: 58626 - DNA, 450 bp, Zea mays
  unsure at all n locations
  Clone ID: LIB3069-043-Q1-K1-H5
cccacgcgtccggcagagcacaaaagaaatccatccgtctcattgcttccgcttgttcaccaaacaaaaccgaagccacactccaccgctctcctccccaatcagctatgctcgcccaccgcttcctcctcctcgtcgtcgtcgccgcggctgcggcgagcggcatcgcctccgctaagccgacggcgtacgaagccctcgccgactacgacttccccccggggatccttcccaagggcgtggtcgcctacacggtcgacaacgccacgggcgccttcacggccacgctcgatgcctccgcgtccggcgcgggatcctccatctgcgagttctccatcgagggctcctactcgctacgctaccagaccaagatcaccggcaagatctnccccgaccaccttaccgacctncagggtgtctccgtcaaagtcctcttcttttggctcaaca

SEQ ID NO: 58627 - DNA, 425 bp, Zea mays
  Clone ID: LIB3069-043-Q1-K1-H6
cccacgcgtccgcccacgcgtcctacggtgcgggcatcggccccggtgtctacgacatgcactcccccaggatcccgtcggctgaggagatcgccgaccgcatcgacaagatgctggcggtgctggacaccaacatcctctgggtgaaccccgactgcggcctcaagacccgcaagtacacggaggtcaagcccgccctgaccaacatggactccgccgctaagctcatccgcacccagctcgccagcgccaagtgagcaccgtttttttgcctttttcgtttccgaggagggcgtcgtcgatgccaattgggttccaataaacagggctgtgcccgccgttctgttgtactccgactgtggctaggttagtaagtttcttgatctcgcccccacgcggtacctggtttactactctctgtttgg

SEQ ID NO: 58628 - DNA, 452 bp, Zea mays
  Clone ID: LIB3069-043-Q1-K1-H8
ccaaatttgaagctgccggcatatggtattagcaccgccttatcgatgacatggtagcatacgcacttaagagtgaaggagggtatgtctgggcttgcaagaattatgatggagatgtgcagagcgatttcttagctcaaggttttggctcattgggtttgatgacttcggtactggtgtgccctgatggaaagacgatcgaagctgaagctgcccatggtactgttacccgtcattaccgtgttcaccagaaaggaggtgaaaccagtacgaacagtattgcctcaatctttgcgtggacaagaggactagcacacagggcaaagcttgatgacaatgctagactacttgacttcacccagaagcttgaggctgcctgcgttggagccgtcgagtctgggaagatgaccaaggaccttgcccttctcgttcacggatctttaaatatcacg

SEQ ID NO: 58629 - DNA, 363 bp, Zea mays
  unsure at all n locations
  Clone ID: LIB3069-044-Q1-K1-A1
gatctccatctccatccgctagctagctatctaggcaagacagtcgagagtcgacaccatggccatggcgacgcaggggcaggccgaccagcagcagcagcacgggcggtctgagcccaccaccagcgtcgccgccaaccgctgggggccctactccggcgccggcgacttcgccagcaacatggccgtcatcctggccgccctgctggccgcgctcgcgctcggcctggcgctcaacgccgncgtgcgctacctgctccgncgcagccgccgcgccggctctgttggtggacagggcaacggcagcggcgtgctgatgccgtcggacgacccggctgagaagccctctgtggaggtggagct

SEQ ID NO: 58630 - DNA, 436 bp, Zea mays
  unsure at all n locations
  Clone ID: LIB3069-044-Q1-K1-A10
cccacgcgtccgcggacgcgtggggtgctcccctgcagatctatcagcatctagaacatgatgatgacactggacccgggtctattctgtgtgttggaagtgagtggcatcgctatccatcatcgttcttcataccctcttatatcagtgaagtccggtggatagatgatggcttccgtgggttacttccatttcccttcaacgagacactgggtgggaccactgcagctccgtcctacttcaataacaagaacaaggcggctgaagggcaatatctgaaagacattggagcatgtaacttactggtggaacttgatctaagacggccttacccctcgcgcgggagtgactngtcgacatgggaggcattggccgcactgccgttcctggacagagagctnntccctgcatatatcggtccttcttataccatacc

SEQ ID NO: 58631 - DNA, 62 bp, Zea mays
  Clone ID: LIB3069-044-Q1-K1-A11
aaaaaacatacaaaatttcgaaaaaaattataattttaaatcaaaaaaaaaaaaaaagggaa

SEQ ID NO: 58632 - DNA, 364 bp, Zea mays
  unsure at all n locations
  Clone ID: LIB3069-044-Q1-K1-A12
ccagtcgctgcagaagagtccacagcgagttncatatccggatttcgccctgctgtgcgtgtactgttcctccttttcgggctagtttggagccacaaaactagagcagattggaggggccaaaatacacttcttattcaaaatttgaataataagtggatttttgtttctccaatcccttccggttttatggctcccaaactagtccatctagtgcgtcggttttacatgtggttcaagtggggtactgtgtgctaacagatacaacaacgaggcttgtctgtatgtctgctgacactagagaccaatgcatataatgattctaatttaggccccgtttgatgattctaatttaggctcanaa

SEQ ID NO: 58633 - DNA, 454 bp, Zea mays
  Clone ID: LIB3069-044-Q1-K1-A2
cccacgcgtccgcccacgcgtccgctggttccatcccaccccatcaggctcgggcttgctctcgacttctcagtgttctactacgagatcctcaactcccctgaccgtgcttgcaaccttgcaaagcaggcctttgatgaggcaatctccgagctagacagcctgggagaggagtcctacaaggacagcactctgatcatgcagctcctgcgtgacaacttgaccttatggacttccgacaccaacgaggacggcggggatgagatcaaggaagcagctgctgcccccaaagaatccgcccccgagggccagtaagacggatccgatctaccgacctgatgcgtgtctgctgatgtcggagagtttaccaggactgtgccgttcttgatttctgatagcttatcttctagtacacctcgtgttggtctcttcgtcacggcgccggtgcgcgtgc

SEQ ID NO: 58634 - DNA, 219 bp, Zea mays
  unsure at all n locations
  Clone ID: LIB3069-044-Q1-K1-A3
cggacgcgtggggccgtgctgcccagaatancatctctcacccatggccgcggccaccgccgggcgccccatgcagagccgaacccccaactagcatcagcgaccgcccagcagacagcagaggaggagcgcggcaaatcctcggcgccccaccaccactcacatcacaaggcggactacacgcaccacaccatacgccgagccgaggagcgcccgcac

SEQ ID NO: 58635 - DNA, 384 bp, Zea mays
  Clone ID: LIB3069-044-Q1-K1-A4
cccacgcgtccgcccactcgtccgcccactcgttcgcccacgcgtccgctatgacattgtgaccttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggcctataaaaaaaaccaaatttaactaacacggcaaaggaataaaaaaattttaaaaaggggaaaccaaaataaaataaaagggacacgtttaaaaaaagattaaaattggaaaaacctgtggaaaaacaaaaaaaacccccatgaaaaaaaattccatatagaaagggagggaaaaaggaaa

SEQ ID NO: 58636 - DNA, 318 bp, Zea mays
  Clone ID: LIB3069-044-Q1-K1-A5
ggtgagaacaaatagctgcgggtctgggatttgatttgttggatgatatcttgttgggggataaatctgaatgaccaatggatattggcattacaatagacacactaaaaatatatgctgaaagtcagaaacaaaatacaatagagttgtgaagaaggtatttttgacaactatgcatcgtacctatcttggtggcgaaatcaacttcactgatggatctattaacccaaaatctacagtgggaactcctgcatacattgctcatgaggttcttctggagaaggaatacaatggaaaggttgctgatgttaggtcatg

SEQ ID NO: 58637 - DNA, 424 bp, Zea mays
  unsure at all n locations
  Clone ID: LIB3069-044-Q1-K1-A6
cccacgcgtccgcccacgcgtccgttcactcgtccgcccacgcgtccgcccacgcgtccgagcacagcaccaccgcgctagtcatccccttcgtcgtcccccagcacacacacacccttcctccgctgcctcagctatggcagcgccgagctggatccggctccggcagtcgcgtgcaaccctcctcatcctgctgctcattgccctcaacatctccctttcctccgccgccaacttcgagggcttcgactccgacgaccttccctccgcggccggtggcctcgatgctgacgatgacgaggaaggtctcgacggcgtcgacctcccgccccctccggccatctccctctccacctctgcgccatcacctnccgtcacgacgacatccgcgccgaaccctaaccccgctacgcgtacgcctcgg

SEQ ID NO: 58638 - DNA, 424 bp, Zea mays
  Clone ID: LIB3069-044-Q1-K1-A7
ccccaattcctccttcggatctcgtatttttcgcagcgcaggtgtgaaggaagggggacgcggaggaagatggggctcgcgttcgggaagctcttcagccggctcttcgccaagaaggagatgcggatcctcatggtcggcctcgacgccgccggtaaaaccaccatcctctacaagctcaagctcggcgagatcgtcaccaccatccccaccatcggtttcaatgttgaaactgttgagtacaagaacattagcttcactgtctgggatgtcgggggtcaggacaagatcagacctctttggaggcattacttccagaacacccagggtcttatttttggtgtggacagcaatgaccgtgaccgtgttgttgaagccagagatgagctccacaggatgctgaacgaggatgagctacgtgatg

SEQ ID NO: 58639 - DNA, 227 bp, Zea mays
  Clone ID: LIB3069-043-Q1-K1-H12
ccatcctccattatcctttatttcaattctttcatcatcgtcgtgtgtaaattaaataaataaagctcttgtgcccatattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagagagagca

SEQ ID NO: 58640 - DNA, 181 bp, Zea mays
  Clone ID: LIB3069-044-Q1-K1-A8
cattttggtgctatggttctgactcaatgttatgtgacttgtgatgtggttttgtcgtgtggtgtgtgttttgctgccatgttcctccaaatgacccgggggttctgtcgtgttagggatgatatgcttggtgtacagcatcaaaatgttttaaatcttaaaagtgatgttgcctggcttt

SEQ ID NO: 58641 - DNA, 331 bp, Zea mays
  Clone ID: LIB3069-021-Q1-K1-H8
ccctctccgaaatcaaggtagcgtacacctttgcagtctctagagccctctctgccactggtgatcccactagtcacaatgcctgccctcgccaagcccgccttccgcaccggcaagcccgccgcggctccgaagccgaagcctgccgccgccaagccgaaggcggccaccgctggtgccgtccacccgccttacttcgagatgatcaaggacgctatcacggcgctcaaggagaggaccggctccagctcgcaagcgatcgccaagtatgtgggggacaagcacggcgcgtctctgccggccaacttcaagaggatgctttccatccagc

SEQ ID NO: 58642 - DNA, 428 bp, Zea mays
  Clone ID: LIB3069-021-Q1-K1-H9
ggtgggttggcttctcctccccctccggtttgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctaccgcggtggcgggcgccgtgat

SEQ ID NO: 58643 - DNA, 334 bp, Zea mays
  Clone ID: LIB3069-022-Q1-K1-A1
gttggtatggtcatatatcagaaaccaatgtacaatatttgctatgagaaaagatctgaaaacagcccgccattgtgcaaggaatctgatgatgcagatgctgcttggaatgtaccgttggaagcatgcatgcacaaactgcctggtggctcaaaagtccgaggatcaaaatggccagagttatggccgcaaaggcttgagaagacccctttctggattgatggttccaaggttggtgtctatggaaagcctgcaaatgaagattttgaggcagataatgcccactggaaacgggttgtaagtaaatcgtatgtgaatggcatgggaattgact

SEQ ID NO: 58644 - DNA, 368 bp, Zea mays
  unsure at all n locations
  Clone ID: LIB3069-022-Q1-K1-A10
cccacgcgtccgcggacgcgtgggctggctccgtcctgatggtcttctaccgaggcccatctctgatcgggaccggaggcgcggccgatgcaactgccctgtcagtggttattgaccacagccatgcctataactatgctcctcagtggctggccgcggccatgctccggaacggcgtggaggcatggcatctcggcgtcgtctgcctcatcggaaactgcttcctgatgggcgcttacctcgtcatccaggccccggtgctgatcaaataccccgcgagcttatccctgaccgnctactcctactccttcgcaaccttgttcatggtggtcaccggcgcgttcgccaccagtgggcttcacgagtgg

SEQ ID NO: 58645 - DNA, 439 bp, Zea mays
  unsure at all n locations
  Clone ID: LIB3069-022-Q1-K1-A11
cccacgcgtccggttccccgcctcacccctagccagccgtctcgctagggtttcgccggcgccgccgccgccgccgccgctatgcctcgccgcagctcaggaaggtctgccccacgcccagctccccgtgctgctccagtgaggaacccgccacagccagcacgccaggctcctcctccagctcctgttcgagatggtggtggctccatgtttggaggaatcgggtccaccattgctcaaggtatggcgtttggcacgggtagtgccatggcacacagggctgctgatgctgtattaggtccccggaccattcagcatgagactgttgcctcagaagctgctgctgctgcccctgcccctccagtgatgaatgctgacgctngcagcatncattctaaggctttccaagattgtctcaacaactatggcagcgagatca

SEQ ID NO: 58646 - DNA, 300 bp, Zea mays
  Clone ID: LIB3069-022-Q1-K1-A12
cccacgcgtccgcggcctcaagcagaggaagctttccgcccgggaacgccatggggtcgcttcctctccttgctgcctgctgctccctcctgctcacggtcgcagctcctgcccgggacagcactaccagcgtctgcccttcgcaaatcagcgatttcccgcaccggaacagttcgggccttcacctgacgctgcaccacccgcagagcccctgctcgccggcgccgctcccgtccgaccctcccttctccacagtcctcacccacgacgatgccgcgcgtcgccacctcgcgtcgcgac

SEQ ID NO: 58647 - DNA, 384 bp, Zea mays
  Clone ID: LIB3069-022-Q1-K1-A2
cggacgcgtgggcggacgcgtgggtctagatcgctagcggccgccgcgatctagaaccgcgtttccgtcttctcctccgacgagttgccccaatccgcccagacctccaacatcgcaacggagcccaccctgcctgcctcgccgcgatccctccgcgctgctcgaggctcctgtcctgaaccaatcgagaacgccgacttccggggacgggatcatctaaagccgcctccttcccgttgaatccgccgagattcggcgtgaggcgaggttaccgacttcccttgcgcgtagggccggcaggagcgcccgctggccatggcgtgccggggcttctttgagtgcgtcctcaagctcctcaacctcgtcgtcatggcggttgggctg

SEQ ID NO: 58648 - DNA, 444 bp, Zea mays
  unsure at all n locations
  Clone ID: LIB3069-022-Q1-K1-A3
cccacgcgtgcgttcgcttccgatctttccggagtggtatagggcggatttggtggcggcgactgtgaggcgggcgagcgaggtggtcattgggctcgcgccggagaacgctatgatcccgctgttcgagacggggggcgtgcagctcgagctcatacgggatgccgagattgagccgtgtgcctacgtgaggtgggagcaagggaggccgagaggatccgcttcatgagttggatgcacacgagagacggtggggatcccagcttcccaatgcgggagatccagaagagtcaacggcggatcgatcaagtggattagcactcttccctgtctgcgtgatctgtagaacanggataagtcggngacgctgttctgctttgccgcgatggaacatgtgttccaatccgagaatttcaagctggggcggttgggatgagggggaag

SEQ ID NO: 58649 - DNA, 363 bp, Zea mays
  Clone ID: LIB3069-022-Q1-K1-A4
caaagttcggagtcgaggccgccgcccagaccgccttcccttccccgcctccggtgcccaaggccaggccaacagttttgaggtggtaatggcggaccaggctaaccaacccactgtccttcataagctaggtggccagttccacctgagctccagcttctctgaaggtgtacgggcccgtaacatctgcctttctttctcatcttatgaaaggagatttgccacgaggaactacatgacccagagcctttggggcccttcaatgtctgttagcggtggcatcaatgttccagtgatgccgactccgctttttgccaatgctccagccgagaaaagtggcaaaaacttcatgaatgatttcat

SEQ ID NO: 58650 - DNA, 357 bp, Zea mays
  unsure at all n locations
  Clone ID: LIB3069-022-Q1-K1-A7
gaccccgacccacgcgtacgcntgggttcgcttaccatatttcttgaatgttataagcctactttcgcgtccgtgactcgcatgattctacctaggtgggcactgatctaacgccctagaactctattaaccccctcttcaatacaaaaggcgtgcacctccagctcatactggatgcccagatcgagccctgtgcctacgttaggtgggaacaaaggaggcccacaggatccgctttatgaaatggatgcacacgatagaccgtggagatcccaccttctcaatgcgggagatccacaagagtcaactgcggatctatcaactcgattagcactctcccctgactgcgtgatctgt

SEQ ID NO: 58651 - DNA, 369 bp, Zea mays
  unsure at all n locations
  Clone ID: LIB3069-022-Q1-K1-A9
ataactgggatcatctcgaaaaccatctctaagaaagggatgcttgaagtgtacaactctttgagcgaggaaggcaaaaaggagttcaacaaggcttatagcgcatcgttttacccatgcatggatatactctacgaatgctatgaagatgtggcctctggaagtgaaatccggagcgtggtgttggctgggcggaggttttatgagaaagagggcctnccagcttttccgatgggcaacatcgaccaaactcgcatgtggaaggttggtgaaaaggtgcgctcaacccgtccggaaagtgatcttggcccgctccatgcctttactgctggaatgtacattgccctgatgatggctcaaattgagatc

SEQ ID NO: 58652 - DNA, 304 bp, Zea mays
  Clone ID: LIB3069-022-Q1-K1-B10
cccacgcgtccggcatggtggaaagagtttttcactactcagaactggtgaacatgatcggcaccatgtatcctacctttcctcttccggacaagtgtgcagatgacaagccgttggtccaaccttaccaagtttcaaaggagaggataaaaggcttaggcttcgagtggattcacactggacacgaccgtcaaggacaccatcgaaggctagaaagagagggggtccgttggtttgagactcgcgcactctgagacacataagtgacacgtgctatacgagatgtcacattgtacacacgtat

SEQ ID NO: 58653 - DNA, 355 bp, Zea mays
  Clone ID: LIB3069-022-Q1-K1-B11
cccacgcgtccgccgacgcgtggcttctttaggagcctagctcattgatcatcgggagggcttctttgcaaaaaatgccatcaagtatagctaagctgatgtagacaggctctgacactcgttgctagaaatgaactctggaaattaacttgagtcccccaatgattgcacactgtaaccccgctgggatatatatgtgacaactctcacgctaatgtaacgaatgctgctgccaagaataaatgatctatctggctggtgacaaatgctgctgacaaggggcgatcgtctaacaggctccaagcttacctagccggtcatgcaccttcatgactcttaaattgtgtcacctaaa

SEQ ID NO: 58654 - DNA, 374 bp, Zea mays
  Clone ID: LIB3069-022-Q1-K1-B2
gcgccattggccagctagagccaaccagattagcttgcagttactgagagtgtgtgtgagagagaggatgggtggcagcggcagggctgctctgctgctggccctggtggtggtggccgtgagcctggccgtggagatccaggccgacgccgggtacggttacggcggcgggtacaccccgacgccgacgccggccaccccgaccccgaagcccgagaagccccccaccaaggggccgaagccggacaagccgtccaaggagcacaagccgaccaaggagcacgggcgcaagccggagaagcgcgccaaggagcacaagccgacgccagccacgtacaccctgagccccacacccacgccggcgacgtacactc

SEQ ID NO: 58655 - DNA, 371 bp, Zea mays
  Clone ID: LIB3069-022-Q1-K1-B4
caaaatgttgttgaagaacttgagaaagatctgaatcatatgatagttcgccattcgtatgtgacagttgtacatgcctgtatcaagtgcctttgtgctctgagcgagtcagcaggtagaggtccaggattagtggaaaaccttgtcaatattttctacaagcatctgtctggagctaattcagatagtcagttattgggtcgatcactgttttgtcttggactcctccttcggtatggttatcaattgatgcaaacatctgaaaatcagcttgattttcccaagattatcaacttgctccagagaaaatatcttctcagggatgattttagcttgaaggttcgagctttgcagactttgggatacatact

SEQ ID NO: 58656 - DNA, 341 bp, Zea mays
  Clone ID: LIB3069-021-Q1-K1-H7
ataatctcttcttcacctcactaacaccagctagcaactctttctctcctgcaataatggccgctcgctcctcctgctcccagccgcagctggtcgcggcggcggcggtcctggcagcggcgctgctgctgctggcggcgggggccgggacggcgtctgcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaggccacctgcaactgcctcaagagcatgaccggccggctc

SEQ ID NO: 58657 - DNA, 435 bp, Zea mays
  Clone ID: LIB3069-021-Q1-K1-G4
aatttggatagagatatatgccaattggcaattgctaaagaaaagaaaagaaaaatctcggtctggaccggcctggcatcagcacacgtccacacctaacggcgccaattctaccatccattccaataatccaaggtaaccgaaagcagcagcggaggtcgcaagaacacttccctcctctccggatcaatcatcgatcagccaagcccctacaaaaaaaccatcgccacatgttggctaatcccacgacgcactgatatttttcttccttgattgtcttgctgctatttataatcgatctccagcttacagcgacgtccaggtccaggtctgagctcgaggcacaggactccctctataatttatccatccatggcttcctccaattccaacagcagcagcaacccgcttgaagccatgggcgccttcttctcg

SEQ ID NO: 58658 - DNA, 419 bp, Zea mays
  Clone ID: LIB3069-021-Q1-K1-G5
ggggttccttgacaggttccttgcttgaccacctacagcagctgcttgacaggttccttgcttgccgccccactggtggcgcaaagcaaagcaggatggtgctggttgcgctgtatcagattgtgagagaaagcttccagctctactctgatatctgcgaggtgctggcggtgctgctggacagattctttgacatggagtatgcggagtgcgtgaaggcttttgaggcatatgctagtgctgcaaagcagattgatgagctctctgcattctatgcatggtgtaaagatactggagttgcaaggtcatctgagtacccagaggtgcagcgtgtcactgataagttgctggagacgctagaaaagttcatgatggaccgggctttcccttcaaatggtggcaacgaggtgacttcggca

SEQ ID NO: 58659 - DNA, 456 bp, Zea mays
  Clone ID: LIB3069-021-Q1-K1-G6
cataaacacaatggggatgccgtttataattccgttgaaacagtagaagaatctgttgctggcaccgacactgaagaaaatggaggtggcggatgtctaaaattatttacaaactggccgttgatgtcagctattactttatattgtatcttctctcttcaggatgtggcttatgcagagacattctctctttgggctgtcagtgacagatcgtttggtggattaagctttactaccacagatgtgggcaatgtccttgcgatgtcaggtctcttcctttttctatatcaaatgttgatctatccgttccttgccaaaacggtagaccacatcacattagtccgtgcagtggcgttattgactctaccggttcttgctagctacccattctttacttcgatgtccaggttcgggctcatggtggtagtaaattgtgcatcttttctgaagaataca

SEQ ID NO: 58660 - DNA, 436 bp, Zea mays
  Clone ID: LIB3069-021-Q1-K1-G7
ccctcgttcctgtcgcgcagccacgacctttacttccacatcttccccggcggcggcgcggtcagttgaaccatggcggactccaaggccacctcggcggtcaccctccgcacccgcaagttcatgaccaaccgcctcctggcccgcaagcaattcgtgcttgaggtgatccaccccggccgcgccaacgtctccaaggcggagttgaaggagaggcttgccaaggcgtacgaggtgaaggaccccaacaccatctttgtcttcaagttccgcacccacttcggaggaggaaagtccactggtttcggcctcatctacgacaacctcgaggctgccaagaagttcgagccgaaataccgcctcatcaggaatggtcttgctactaaggttgagaagtcccgcaagcaaatgaaggagcggaagaacagggccaaga

SEQ ID NO: 58661 - DNA, 452 bp, Zea mays
  Clone ID: LIB3069-021-Q1-K1-H1
cggacgcgtgggcgaggccgccgcccagaccgccttcccttccccgcctccggtgcccaaggccaggccaacagttttgaggtggtaatggcggaccaggctaaccaacccactgtccttcataagctaggtggccagttccacctgagctccagcttctctgaaggtgtacgggcccgtaacatctgcctttctttctcatcttatgaaaggagatttgccacgaggaactacatgacccagagcctttggggcccttcaatgtctgttagcggtggcatcaatgttccagtgatgccgactccgctttttgccaatgctccagccgagaaaggtggcaaaaacttcatgattgatttcatgatgggcggtgtttcagctgctgtttcgaagactgcagctgctcccattgaacgagtgaagctgcttattcagaatcaggatgagatgat

SEQ ID NO: 58662 - DNA, 458 bp, Zea mays
  unsure at all n locations
  Clone ID: LIB3069-021-Q1-K1-H10
ggcggcaagcaaccacgggcggagctcgtgtgcgtcctcctcctcccgtctataagttccgctccttttcttcctccatatataggggccatcagatccaagaagagggaagagcaccaaggaccttcggcgcccgttcaggatccacatcttcccgagcgagttcttggttgacctcttcctcttcggaccacctccaaggctcttggtgtagcttgccactctcaccaatcaagttttcatgtctgatctcgacattcagatcccaactgccttcgatcccttcgctgaggccaatgctggggactctggtgcggcagcagggtcaaaggactacgtacacgtgcgcatncagcagcgtaatggtcgcaagagcctgaccaccgtccagggattgaagaaggagttcagctacagcaagatcctcaaagatctcaagaaagagttctgctgcaatg

SEQ ID NO: 58663 - DNA, 410 bp, Zea mays
  Clone ID: LIB3069-021-Q1-K1-H11
ctctctctcacccatggcttcggcggcggttgcgactcaggtggggacttacttcgtgcggaactactacaacctgctgcagcaaacccccgatgtcgtccaccagttctacagcgaagccagcaccatggtccgcgtcgacgacctcaccggcacgaccgcggctgccaacaacatgatggacatacactcactcatcatgtctttgaacttcacccaaattgagatcaagactgccaattttgtgaactcatggggcgatggggtgctagttatggtctctggtctagtgcagaccaaggagtacagccaccaaaggaaatttatccagatgttcttccttgcccctcaagagaagggttactttgtcctcaacgattactttcacttcgttgaccaagaacatgtgc

SEQ ID NO: 58664 - DNA, 321 bp, Zea mays
  unsure at all n locations
  Clone ID: LIB3069-021-Q1-K1-H12
cccacgcgtccgcggacgcgtgggctaactctagacgtcgcccggccgccgccatggaccccgacggcgacccgggcttccaccgcaacgaggccatctccgcggtccaggatgtcgaccagtactatggcgacgacgacgacttcgacgacctctacaacgacgtcaacgtcggggacggcttactccacgcctcccaccaggcgccgncgtcgctgccgtcgtcaccttcgactcagcaggccccaccgccgcagaagcaccagctccctccgncgtcccagcagctgccgccgacccagcagcatccacctggccacg

SEQ ID NO: 58665 - DNA, 379 bp, Zea mays
  Clone ID: LIB3069-021-Q1-K1-H2
acccacgcgtacgcggacgcgtgggcaggttcgcgccagattgacttccttccaccctacggtgcccacgccggtcaacagttttgaggcctgatggcggaccacgctaaccaacccactgtccttcataagctatgtggccagttccacctgagctccagcttctctgaaggtgtacgggcccgtaacatctgcctttctttctcatcttatgaaaggagatttgccacgaggaactacatgacccatagcctttggggcccttcaatgtctgttagcggtggcatcaatgttccagcgatgccgactccgctttttgccaatgctccagtcgagaaaagtggcaaaaacttcatgattgatttcatgatgggcggtg

SEQ ID NO: 58666 - DNA, 447 bp, Zea mays
  Clone ID: LIB3069-021-Q1-K1-H3
gaatgatggattcagtgagaaacttcttattctgttcattactcataagtttgatggaagctacttcatcgagacagaagatggcacttctggtttagatgtcaaagttgatcacaagggtgaccacgattttcgtgtggatgtttctggtctgcaaactgatgtgactctagcatcttattcaaagggaaacagcaaacacatacatgtctggcatgggaatcatcaccaccattacagacagactgtaagagctgagcatgcagttgaagatagctcccaacctagtcatgcttctgaagggaagtcgcatccaaaagggagtgttctggcaccgatggctggcttggttgtgaaagttttgcttgaagacggtgctcaggtggacgcaaggcagcctgtcatggttatggaagcaatgaagatggagcatggtgtgaaggcgcc

SEQ ID NO: 58667 - DNA, 404 bp, Zea mays
  Clone ID: LIB3069-021-Q1-K1-H4
acgtatcaaaacaaagcatgcatttaagtaaactcgactctctccccaatcggattgtttcattggcatttgatgtgatttctcgagttttggaaacaggaccgggatggtgactagtttcaccacatttttcttcacttcttgattcagcaatttttccagcattagcattgaatgagaaggatatagaagaatgggaggaggatactgatgagtatatgcaaaagaatcttccttctgaacttgatgacatttctggatggactgaggatttgttcactgccagaaaaagtgcaatcaatttacttggtgttatagcgctatcaaagggtccaccagttgcatctgcagcatcaaagcgtaagaaagggtgataaaataaagggaaatctgaaatgagctca

SEQ ID NO: 58668 - DNA, 448 bp, Zea mays
  Clone ID: LIB3069-021-Q1-K1-H5
cccacgcgtccgatgaagtgaagcaattctttgagggaacatgtggtgaagtttctcgtctgaggctacttggtgattatgtgcactccacatgcatcgcttttgttgagtttgtccaagcagatagtgctattctcgctctgaactgcagtggcattgttcttggaacgcttcctgttagggtgagcccatcaaagacaccagtccgctcgcgatcgccccgtgtgacgtcatactgaattcggctcatctgaagccgtcgtccagggcagcaaatttctgggcaacaaagccctagtcgtgtggccttagagactgccgcatcgcggataagtaattgtcgttgagcagagttctccgtggttaaagtccagtctagtaggaagcgcaaagacccgtctgtatggtcgctgggagatctatcttgaccttctttttctggtctttt

SEQ ID NO: 58669 - DNA, 355 bp, Zea mays
  Clone ID: LIB3069-021-Q1-K1-H6
gcgcacacaccacgatctcagcttacttccacttcagctccaatcacagtcgtgaccggggcgagtgctagctagaggggcgtgaaaatgccgatcaataggatcgccctgaggagccaccagtatgtgttccactcgtgcgccctcaaggcggcgttcgctgagttcatctgcaccctcatcttcagattcgccggccagggctccggcatggtcttcaccaagctgaccggtgggggcccgactaccccggcgggcctgatcgcggctgcggtggcacacgcgttcgcgctgttcagtggccgtgtcggtgggcgcgaacatctccggaggacacgtgaaccccgccgtgacc

SEQ ID NO: 58670 - DNA, 419 bp, Zea mays
  Clone ID: LIB3069-021-Q1-K1-G3
aaccgccaaccccccaccccaaggaaggaaccctacccgtgagaaccgccgccgcacaaccccggacgtggtggcaggcgaccgatccggatccatcatcccaagcttcctttctgtctcctcttcatccatctccacaaggataatcaaggaaggaaggccatggttttgttcgaacttgacccggacatcatccgatggggtcttcaccatctcctccccgctccggctggatactctcctcattgtcgcacccaaaccacccctaccacaccttgtacagcttttgctcgccctcctcatcagcccatcggagacatgggtacctcaagctccgttgagatcaaggtcgagcatgtcgatggggttgacaacgacgcgatcatcgcacaagccctccaggaggaattgtccaatgt

SEQ ID NO: 58671 - DNA, 413 bp, Zea mays
  unsure at all n locations
  Clone ID: LIB3069-021-Q1-K1-F11
ccccaacgaagtgcgagcgacccacgtccacacgacacgaaccaccaccaccaaccagcaggcgcaccacgcacccagcgcaaagcgatggcgtcgctcaccatgatggcgtccttcgccgccgtggcggtggccgcgccctcgcgccgcggcaccttcgccgtggtcaggtccgccaaggtcgaccgctgccaggagcccgccacgctagcagcaaccgaggccaggcccgccgtcgacggacgccgcgccgtcatgctcgcggctgctgcggcggccgtggcagccatcggcggcgccggcgccgncatggcgggccccaagaacgggacccccgaggcgaagaagaagtacgcgggcatctgcgtcaccatgcccaccgncaaggtctgccacaactgagcacgcccgcg

SEQ ID NO: 58672 - DNA, 347 bp, Zea mays
  Clone ID: LIB3069-021-Q1-K1-F12
agttagtccgtgtgatgagatcatgtcctgttggcgccgacgccgtggtcgtcggcggcggatacataggaatggaatgcgcagccgctctggttgccaacaggatgaaagtcactgtcgtcttccccggaaaacacttgatggcaaatctgttcacaccgaagatcgctgagttttacgagaactactacgaatcgaaaggagtcacttttataaaaggaactgcggtttcatctctgcagatctcgtctgggaaggtgacggcagcaatcctgcgagacggcaggcgcctacctgcggacatggtcgtggtcggcatcggcgcgcgcgccaacacggagctcttc

SEQ ID NO: 58673 - DNA, 431 bp, Zea mays
  Clone ID: LIB3069-021-Q1-K1-F2
cacatttgttctctgccaggtgttcaacgaattcaattcgcgtaaaccagatgagctgagtatattcaagggcatttcagggaaccatctgtttattggcatcatagctataacagttgtactccaggcgcttatagttgagttccttggcaagtttgcctcaacggtaaggctaagttggcagctgtggttggtatctataggtcttgctttcttcggctggccgctggcattcgtggggaagcttattcctgttcctaaacgtccattgggagaattctttgcatgctgctgtatctgcaaggggagcaaacaagcccctgacgacgcaacctctaatgataaggaagacaacaagcccgagccttgagatgtcagcaagattgatggttgccaacaatgaccttgttgctgttcttacccggttttga

SEQ ID NO: 58674 - DNA, 401 bp, Zea mays
  Clone ID: LIB3069-021-Q1-K1-F3
gcggtttctattttaaatactttatttccttcataaatttaggatcgctgcaacagacatgcaactaaaactcgtaatgaccattttatgctatatactgatactaaatatgctacactgtgtagataattatgcaattcggtatactgcgtaaaaatctgctacaggctgcatgcacacgaatttatgatggaaagaatatgcaatgaaaggaaatgaattgcatgcatagaaacaaaaaatcacatttaatgttttatttgcttcataaatataggatccctgcaacagccatgcaactaaacgcattagaactagtttatgatgtatactgaaacaaattatactacacggtgtaggtaattatgcaattacttacactgcgtaaaaaaatctggcat

SEQ ID NO: 58675 - DNA, 425 bp, Zea mays
  Clone ID: LIB3069-021-Q1-K1-F4
atagaatcccattcccctcgaacactgcgtcggggacccagccagctagccacatccactgatccacgcgcattccccctaccaccgccaccgcgccgcgtcacggaaggaggaggatgtcgtcgactccctcgccggcggccacccgcctggatctggatggcaaccccatcgcgcccctcaccatctgcatgatcggcgccggcggcttcatcggctcccacctctgtgagaagctaatggccgagacgcaccacaccgtcctcgctgttgacgtctactgcgacaagatccgccacctcgtcgaccccgcgccgacgcacctcgccgggcgcatctcattccaccgccttaacataaaaaacgactccaggctagaggggctcatcaagatggccgatctgaccataaacctggccgcgatc

SEQ ID NO: 58676 - DNA, 265 bp, Zea mays
  Clone ID: LIB3069-021-Q1-K1-F5
gcctggcaactgtgctgtacaggaacctgtatagaaagacgaagttcactatctgagaggatacctgtgggactgaacctgggatcgttgaagcgagaaatacagcagaagcatatgtccatactcgaaatgctgaccttgaaacggtctctgggcaattactacacaggcaagaactgcgggtatatcgggtaccacagccttaaaggcggatatgtgactgcagatgaaaaggtgccaagagaactggaccctgacacgactg

SEQ ID NO: 58677 - DNA, 451 bp, Zea mays
  Clone ID: LIB3069-021-Q1-K1-F6
cccacgcgtccgagggacgaagcatgctgtttacgtggtgcccgcaggcagctgggctggagcatgatgccgtgggggtgttcctgacgcactccgggtggaactccacgctggagagtatttgcggcggcgttcccatgctgtgctggcccttcttcgccgagcagcagaccaactgccgatacaagtgcaccgagtggggcatcggaaaagagatcggtgacgatgtacagcggggcgaggtagagtcgctcatacgggaggccatggagggggagaaagggcaagagatgctccggcgcgtgactgaactcagggacagcgccgtggccgctgcagggcctgacggacggtctatgcgcaacgtagacaggctcatcgaagaggtgctcctagcctagattgagcactggtgagcatcctagcagtcatgtgtcttcgcgtcttgcac

SEQ ID NO: 58678 - DNA, 318 bp, Zea mays
  Clone ID: LIB3069-021-Q1-K1-F7
cccacgcgtccggtggagagctgccacagggttctagccttgctctcccatccgcatgagcccgcgcaggtcaggagcatagctttggggacggacgaagcatgcaccaagttcaagaaggtggtctccctgctcagcaatggaggagagggaacaggagaagccggaccatcaagcgcaagcgcaagcggaagccattctagagctaagcttggtagccgaagacagaatccaagggtcttggactaaaaagggtttctggacaggaacaacccggtcgtggggcttgacaagggcggccattcttcttcttccttc

SEQ ID NO: 58679 - DNA, 451 bp, Zea mays
  unsure at all n locations
  Clone ID: LIB3069-021-Q1-K1-F8
cgctctatgtgcttgtgctgcttgttactgggaggtactcacaaaggctctacgtggccgacaattgcatgtatgtgcttgggatgttgcttgcgatgcagatccgttttgttggattccaacatgtgcagtccggagagcacatggctgctatgggagtcttcttccttttgcaggttttcttcttcttggactgggtaaaatacctaaacgatgccagactgttcaagtcattccttcggattacccttacatgtgtgattactgttggcaccctggctctcggtataggtactgcatctggttacatctctccttggacaggacgattttactccctgctagatcctacctatgcanaggaccatataccaatcatcgcatctgtttctgagcatcaaccaacagcatggtcatctttcatgtttgactttcacatcctcctttttct

SEQ ID NO: 58680 - DNA, 473 bp, Zea mays
  Clone ID: LIB3069-021-Q1-K1-F9
gcagttcttcgttgcaatagaacaattgtgttttccgaatctaatgcatgtgtcatgggctgagtatccccggacagcagggccttgactacgcagttcgtagtcacgacccgtcttctccggcaaggttttgcccctcagccgcaggctccttggtgatgtcgtcaacatcatcttcctcgatgccctccaggaggaacagccgctggcagacacggttgtgaccccgggtgtacttctcgtcgcagttgtagcagaggcctttgcggcgccgctcctcttgctccgcctgggtgagtcgcttgatctggcagccctcgacggagatcatcgtgggtgctgctgctcggggacctagcggcgccgacagaggccgtggcggggcccgggatatcggggcggcgtactgctcacgcggctggaattgcctggccaggctcatggtggctgccaggtactgtgggttctggatg

SEQ ID NO: 58681 - DNA, 455 bp, Zea mays
  Clone ID: LIB3069-021-Q1-K1-G1
gaaggctcctgccaaggaggaagaggaggattacgaagaggagtctgacaagtccaagtcggaggtcaatgacgaggatgacgaagagggtagcgaggaggatgaagatgatgacgagtgatggagagctcgctcgagacaatggacggtgcttcatccaacaatggagcggctacacaaggccccgtggcgatcaaaaaaaaggagcctatatccatgtactagaattattcagtttcactccacatcgtgatgttttatttttacttttgtcgtgctataacggatagcgctcctcgttggcgccactggcgggtggttctgcctctggtctggtgtgtttgtgtgtggtcacacttgccagctagcagaggcgcctgcttgtacctagattactggttccattgtcgtcgtcatcggctaacattgtcataatgtcaagttgggtaatgtta

SEQ ID NO: 58682 - DNA, 382 bp, Zea mays
  unsure at all n locations
  Clone ID: LIB3069-021-Q1-K1-G10
gaaatatatatatatatatacatgttagtttctccccctgcagccttcaccttccggttcagcttcattccacttccacttggatcgatcgatcgcatatggcggtactgtggtggtggtcatcgtcctgcttgtcctcccgcgccgtcgctgctgcgctgctttgcctgctggtggctcacggcagcgatggaaccaggcacaacagcaacaatggcggtggtagtggtagttccagcagcagcaagagccacaagcaaggcggaaggggacgagcccatgccgcgccgacgacaccgtctncgtcttcgtatccgtctccggcggctggcaacaacagcagcagcgacgacgggtggctgaacgcccgtgcgacatggta

SEQ ID NO: 58683 - DNA, 416 bp, Zea mays
  Clone ID: LIB3069-021-Q1-K1-G11
ttcgtccgcgcaaagctgcttaccggaatagctagggctacgtctacgccgcttgatctagtcggctgtgccggttcgcgaggtagggcgcaccgtcgatggcggcggcaccggcggacgctaaggcggaggccgccaagatggacctcctcgaggacgatgacgagttcgaagagttcgagatcgaccaagaatgggatgaccaggaagaaggcaacgaagccgtccagcagtgggaggatgattgggatgacgatgacgtgaacgatgatttctcgctgcagcttaaggaagagctggacggaagcaacggccagaagagctgaagttttatttctctactctatataaatgatttttatatggcagctacttttggaaccgttgatgtgctctggatatgaaagcttttggac

SEQ ID NO: 58684 - DNA, 465 bp, Zea mays
  unsure at all n locations
  Clone ID: LIB3069-021-Q1-K1-G12
cccacgcgtccggcgagaatagggagagatcagacaagctgttgtcggaatccagtccggcgaggaggagtgctgaggtcgaaatggggggaggagcggatgaggtggtgaaggtcgtggattcggaggacggcgagggggaggaggaagaggcagaggccgcggcggcggaggggtcgagcaaggagacgccgatgctgccaaggatgccggtgcgcgtgctgctcgccgagggcgacgactccacgcgccacgtcatctccgcgctgctccgcaagtgcggctaccgagttgctgcagcctctgatggtgtgaaggcgtgggacatattaaaggaaaaatctttcaacatagaccttggtttaactgaagttgaactgcctttgatgtctgggttcctcttggtatccacgatcatggaacatgatgcattcaaaacatnncctgtataatgatgtcttcaca

SEQ ID NO: 58685 - DNA, 459 bp, Zea mays
  Clone ID: LIB3069-021-Q1-K1-G2
cccacgcgtccgctccctccctcccccgcgtcgcggcaagacgacctcgccgctccctgcctccgtctccccgccgcaggtgctggagatgcaggcgactgccgcctccttcctcgcccgcccactcccgcggcttcgccgcattggcagctggggagcggatgcggcggtggtgcgtgagggcgttatcgcgctccctctgcggctgcgggggccgcggtgctccattagcctctccatcggcgccggcgccggcgctggcgccgaagctgaccacgagttcagctacgagcatgttccggtgttccctagataccgaatacgagatccctacaagcttcttggtgttgatcgtgatgcatctgaagaagagatccgaggtgcgaggaatttccttattcaacagtatgctgggcatgaaccgagtgaagaagctattgaaggtgcttatgagaagat

SEQ ID NO: 58686 - DNA, 439 bp, Zea mays
  Clone ID: LIB3069-021-Q1-K1-F10
gcaacaattagttcgaagatcattctgaacagtgcgcagtgccttctgtgctacggattggaaaatcattcagaacttgtgctttttgaataaaaccagctgcagccgctaggcaactcgcggtttcgacagaaattagatgtttgcagcagacaagttgggcttaaataattgcagggcgtaatcctaggttctttctagtagctcacagtaccgactaccgagttcaatcattggcatgcagctgctgcagcagcaagtccaacatctgctaccaacctgtacctgaaagagagccaggctctgggcggcacgagtggttcggactccgacagcgattcgctgctggacatcgaaggtggcccgtgcgagcagagcacgaacccacaggacgtgaagaggatgcgacggatggtgtcgaaccgtgagtctgctcgac

SEQ ID NO: 58687 - DNA, 466 bp, Zea mays
  Clone ID: LIB3069-043-Q1-K1-F5
cccacgcgtccgcccacgcgtccgcccactcgtccggaactctagaagaaatcctaagagagaagccactaacgactaatgaacatcaatggagatctctagttggaatttggtgccaagagcaacataagaaattatgttccacaaactctcgttgtgcaaaagaacagaagactgcacacacatgtgggaggaaaagccttgctagattaaaaaaagagatggaaacaagaactaaacgaaaggttcataggatagaactatgggaggcagctcataaaaagaagaatggtagatacacaacagaaaaggcagagacactgatggctgcatcttatgaggaatttaaaaaaggcgagggaacaacgatggtaatcgtctttcatctaaagattacaatgaaatgttcaatgatattgttgccaagggatttcaaagcacgtgggtactatgatgataagtactg

SEQ ID NO: 58688 - DNA, 460 bp, Zea mays
  Clone ID: LIB3069-043-Q1-K1-F6
cccacgcgtccgcggacgcgtgggtgctacggcggcggcggcggcacagcaggggaagaacgtacacccgcagtcgaaagaggacggcgagacagctctcttcctatccacattctatataatctatggctaatcaggtagagattagagtgattgagagagcggggaaggaagttttgtacagagaagagaaagaggtagttgatgggaagggtttgatgtgattgccctttcttttctctttgcttcctggacacaacagccgccgccacttcctgccatcctttcgtcgttgattcggtgttcttggatcggatgccttcatctgcctagatcggagctagagcaaggtgcgtggtgtaaatcccgagaggaggaagaggggaaggggtccaggccggttggtcttgccgcgtacgggtcttccaagaacccgcggcgggggatggatctctacgat

SEQ ID NO: 58689 - DNA, 458 bp, Zea mays
  Clone ID: LIB3069-043-Q1-K1-F7
cccacgcgtccgcccacgcgtccgcccactcgtccgctctattcccagatcgagagggtaatcacggaggcggcaaagcagtcccgggaaggctggggttcgactggagattggaccgaagtcgagggatcatgggtgttgagaccgaagtccttggagccatcatttgttgtccactttgttggaggaatttttgtcggagccgctccccagatcacataccgcttcttcctcgagtgtctcgcgaacaggggagctttggtgattgctacgccttatgcgagcggctttgaccatttcttcattgcagatgaagttcaatttaagtttgacaggtgtttgagaaacttggatgagcctgtaaatgatctcccaacgtttggtgttggacattcattgggatctgttatccacatgttgattggatcaagatatgctgtgcaacgaagtggaaatgt

SEQ ID NO: 58690 - DNA, 272 bp, Zea mays
  Clone ID: LIB3069-043-Q1-K1-F8
cccacgcgtccgcgctcgcggactgccattcgacccaacacgcactggacctcgcttgcgatgatgaatctattcactcggtgaagagtgactgctcctgtgcaactacagcctctttatctaccatgtaagactttaccttacgcagttctgcacttgtaaacggacgcttaaccacactgcagacctggtcctgctcatcaccatatgtgtcactggcaggcaaccatcatgagtcctcctcatcgtccatattctggtcgactttatta

SEQ ID NO: 58691 - DNA, 373 bp, Zea mays
  unsure at all n locations
  Clone ID: LIB3069-043-Q1-K1-F9
aacgcattaaggcagttggcaagcatagcatcattggagcaagcggagagttcagtgactgccaggagattttgcgctatttggatgaactaactctgtctgatcatatgtgggatgatggaaactcgctgggccccaaagagatccacagctatttgacaagagtgatgtacaaccggcgcaacaagtttgatcctctctggaactcacttgtacttggtggggtgaaaaagggtccaaagggtgatgagaagtatcttgggatggttaacatgattggtacccacttcgaggaaaaccatgtcgctactggatttggaaatcatatggcaatcccgatactccgtgctgaatggcncgatgatatgacttt

SEQ ID NO: 58692 - DNA, 340 bp, Zea mays
  Clone ID: LIB3069-043-Q1-K1-G1
gtgtcttttgatttaccttcacctgaattcgagtctcgtgatactaccattctggggtgcggtaatcaacctgtatgtggatgggaaggttgtaagttttaaatcttggaccggcagaggaacaatgtgggacccatatataagattctcaagtctggttacttaggattggttaatgaaaacctattttaatgaggctggtacaaagcagtggtctgtgaaggaaagaagcagtgcgatatgagaatactcctgctgagcggaatcatgctgatatattgagacgctctttgatttgagatttggaaagccacttcgagctggcactacatcttaagct

SEQ ID NO: 58693 - DNA, 282 bp, Zea mays
  Clone ID: LIB3069-043-Q1-K1-G10
acccacgcgttcggtttccacagtatggctcccgtttggctacaccattgctcatactcaatggggcctgcgatacgtggcagggcacgagcgcgctatcacctagaacagctgagccgaagaagactagcccccaatgcaagcttgacatcaagatctgctccgccatccaactcacagccagccaaattctcaggacatatgttctgaaagcacaccgtataactcatgctcaactcatgctcatcaactcatgcaacgctcactgcgaattacgatcta

SEQ ID NO: 58694 - DNA, 391 bp, Zea mays
  Clone ID: LIB3069-043-Q1-K1-G11
ctcaaggtcgaagtcgacagactggctgcttagcaggaacctgaactccaaaaccgcaatgtgggtgatgatggataccggctgtggcagcaggtcgattgggaaggatttgggatagggagttccatgttgccatcagaaccttcagctgctgcgcaagtgccatcaagggaagccgagcctgaaccgcacctggaagtggagcaaagcgtgtctccagccccaagtgcagcaacctcatacgatgttgctgttccacactggttccagcgccatgcggacccttctgagctcatggggttcgcttcccgtggcctgatcaaggccccgtttgtttccgcttttgagcggcttctggcggccataatctgcccgggtcatccaaacgcgc

SEQ ID NO: 58695 - DNA, 385 bp, Zea mays
  Clone ID: LIB3069-043-Q1-K1-G2
cggacgcgtgggcggacgcgtgggttggttagatcaccaccaaggccaatgttgactacgataagattgtcagggagacctgtcgctacattggttttgtgtcaaacgatgttgggcttgacgccgaccactgcaaggtgctcgtgaacattgagcagcagtcccctgatattgctcaaggtgtgcatggccacttcaccaatcgccccgatgagattggatctggtgaccagtgacacatgttcgggtatgcgaccgatgagacccctgagttgatgcccctcagccatgtccttgccaccaagctaggtgctcgtctcaccgatgtccgcaagaacggaacctgcctctggctcatgcctgatgggaagacccatgtgacagt

SEQ ID NO: 58696 - DNA, 466 bp, Zea mays
  unsure at all n locations
  Clone ID: LIB3069-043-Q1-K1-G3
ggaagactggctagatactgccaaggcaattacaataatcaaccagtgggttaccaatgttcagaacgagtacagagcgactccacatgatctgctgcggctcaacagaaatgtaagaagccacatgcatcgctacagcgacggtgacggcattgaggaagttctgtattgtgaatggcccgagctgctcatggtcatgcagaagatgttgcacttggaaggcgagctcgaaggcactgacattcagaacaagtttggctaggcgtcctacttaagctactgttcttcgatcgagttcaggggccgaaagtttatgctggtggagtgatggtcgatgtaagtttgtcgctctcatcataaaggtaaagctggatcagctntataaaatgtatgctaaaatggtaagtaaactntaaaccattttctctgagaaggtctcttattaatataaaggctggagtctgtg

SEQ ID NO: 58697 - DNA, 427 bp, Zea mays
  Clone ID: LIB3069-043-Q1-K1-G4
cgccggcaaggttgctgtggtctgcggattcggtgatgtcggcaagggttgtgctgctgccctcaagcaggctggtgcccgtgtcattgtgaccgagatcgaccccatctgtgccctccaggctctgatggagggtcttcaggtccttcccttggaggacgttgtctctgaagctgacatcttcgtgaccaccactggcaacaaggatatcatcatggatgaccacatgaggaagatgaagaacaatgccattgtctgcaacattggccactttgacaatgaaattgatatgctcggccttgagacctaccctggcgtcaagcgcattaccatcaagccccagactgactcgctgggtgatccccgagaccaacactggcatcattgtccttgctgaggggtcgctgaagaaccttgcgtgtgctac

SEQ ID NO: 58698 - DNA, 374 bp, Zea mays
  Clone ID: LIB3069-043-Q1-K1-G5
cccacgcgtccgcccacgcgtccgcccactcgttcgcccacgcgttcgcccacgcgtccgcggacgcgtgggcaaaacagtacattgagaaccactacaagacccagatgaagtccctgcaagataggaaagagaggcgctggatgttggagagaaaattacaagatgccgaagttcctgtagaagagcaaaataacattcttaagcatttggagaaaaaagagactgaatatatgcgcttgcagagacacaagatgggagttgaagattttgaacttttgactattattgggagaagtgcattcggagaggtgcgtctttgtagagagaaggcctctaagaatgtttatgcaatgaaaaagcttaagaaatct

SEQ ID NO: 58699 - DNA, 382 bp, Zea mays
  Clone ID: LIB3069-043-Q1-K1-G6
acaacatgaactcaagggctggtagaggctttacccttgaggagctgaaggctgctggcatcccaaagaagcttgctccaaccattggtattactgatgatcaccgccgcaagaacaaattccttgagggactgcatgccaatgtccagaggcttaagacatacaaggccaagctggttatcttcccaaggcgtgcgcgcaaggtgaaggctggtgactctactccagatgagcttgccaccgctacccacgtccagggtgactacatgccatttactcgtggtgagaaacgttcagttgacgttgtgaaggtcacagatgagatgaagtcatttgctgcctatggcaagctccgtcttgagcggatgaacaagaaacatct

SEQ ID NO: 58700 - DNA, 419 bp, Zea mays
  unsure at all n locations
  Clone ID: LIB3069-043-Q1-K1-G9
gttcccacagtatgttgtcccgacaatgcgtacaccattgttcatacttaatgcagcctacgattcgtggcaggtcaagaacgtcctagcacctagtccagctgatccgaagaagacttgggcccaatgcaagcttgacatcaagagctgctccgccagccaactcacaaccttgcaaaatttcaggacagattttctggcagcactccctaaaacgcagtctgtaggcatgttcatcgactcatgcaatgctcactgccaatcaggatctcaagacacgtggctagccgatggttctcccacggttaacaagacgcanattggcaaggcggtggnggactggtactacgatagggaggtccctcggcagattgattgcccgtatccctgcaacccaacttgcaagacccgtgatgatg

SEQ ID NO: 58701 - DNA, 427 bp, Zea mays
  Clone ID: LIB3069-043-Q1-K1-H10
gcaaaagctcaaagttttgcatggttccggtatcactgctctggatgaattagcaggtgaaatcgacatgaactcgcggacaacatttgagagattaaattcacagatacagtcacacacatcagcccttgagaactgtttcggaggaatcgcttcggaagcagataacttgttagatgagcttcagcgcagcctatcgaaacaagaagagaggctagcccatttcgcagtgaagcagagggagggacacctgagagctgtggaagcgtcacgttccatctcaaagatcactgctgggttcttccactcgctagatgtccatgcatctaggctcaccagtattctggaagacacacacagcgtgcaagaccaacaacttcttgaccttgaaaagaaattcgaggagtgcgcagctaatgaagaaaaa

SEQ ID NO: 58702 - DNA, 407 bp, Zea mays
  Clone ID: LIB3069-043-Q1-K1-H11
cccacgcgtccgtgtagattcgtaatgaattggccaggcgctacttgagcagtatgaggcgaaaaaagcctataccgtttacgcaaaagttcccaaatgcagatccacttgcactatgtttgttagagcgaatgctcgcttttgagccaaaagacaggccaagtgctgaagaggctcttgctgatccttatttcaagaatatagccagtgtggatagagagccttctgcacaggctgtcacaaagcttgaatttgaattcgagaggcggagagttacaaaggaagacataagggagcttatatatagggaaattcttgagtatcatccaaagatgctgaaggagtttcttgaaggaactgagtcaagtggtttcatgtacccaagtgcagtagatcattttaaaaag

SEQ ID NO: 58703 - DNA, 426 bp, Zea mays
  Clone ID: LIB3069-043-Q1-K1-F4
cggacgcgtgggcggacgcgtgggcaggtcaccaccattccttccttgttccttccccagctccgcaggctgctcatcgccctccctccgcgcccccgatccagatccagatccaggggcttgtcatggcatccaaacgtatcctcaaggaattaaaggacttgcaaaaggaccctgcaacatcatgcagtgcaggtcctgctggtgaggatatgttccactggcaggcaaccatcatgggtcctcctgatagtccatatgctggaggtgttttctgggtgaacattcatttaccgtcagactaccccttcaagcctacaaaggtatcttttaagacgaaggtcttccatgcaaacatcaatagtgatggaagcatatgtcttgacattcttaaggagcagtggagccctgctttgacaatctcta

SEQ ID NO: 58704 - DNA, 391 bp, Zea mays
  unsure at all n locations
  Clone ID: LIB3069-043-Q1-K1-E10
cggacgcgtgggctttggccctgtttggatccttcaagcccggctagagctagagctaggttctagctctaactctagcccaaactagctctagctctctacgtgtttggatccaagggctagtttacaataaatgctattttataatcatttgtctcgtttaaacctttccttatccggatttagtgtggcaaactcttgtgtggcttctcccacacacaaataacacaaataaatttattttcacaaatcaaacatccaaatcacaataaattagtaaattacaatagtcgaaaatgcattcaataagaaattagacaaaacaaatccgttgttttcctgttctttccaatgtggccagccgtgcccctncactacctttccatggatc

SEQ ID NO: 58705 - DNA, 382 bp, Zea mays
  Clone ID: LIB3069-043-Q1-K1-E11
cggacgcgtgggtcatgacggatgagatattcggcccgctgctcccgatcatcacggtgaagaagatcgaagacagcatcaagttcctcaggtccaagcccaagccgctggcgatctacgccttcaccaggaacgagaagctgaagcaacgcatcatagacgagacgtcgtcggggagcatcacgttcaacgacgccatcgtgcagtatggcctggacagcatcccgttcggtggcgtggggcacagcgggttcggccagtaccacggcaagtactcgtttgacatgttcagccacaagaaggcggtgctcaagaggagcttcctcgtcgagttcatgttccgctacccgccgtgggacgagaccaagatcggaatgctcag

SEQ ID NO: 58706 - DNA, 417 bp, Zea mays
  Clone ID: LIB3069-043-Q1-K1-E12
gcggcggcggggacacggtagtgggcctgacggcggtggcgctggcgcacacgctggtggtggccgtcatggtgtcagcggggctgcacgtctccggcggccacatcaacccggccgtgacgctgggcctcgccgccacgggccgcatcacgctgttccgctccgcgctctacgtggccgcccagctgctcggctccacgctcgcctgcctcctcctcgctttcctcgcagttgccgacagcggcgtgcccgtgcacgcgctgggcgccggcgtcggcgcgctccggggcgtgctcatggaggccgtgctcaccttctcgctgctcttcgcggtctacgccaccgtcgtcgacccgcgccgcgccgtcggcggcatgggcccgctgctggtgggcctggtcgtcggcgccaacgtgc

SEQ ID NO: 58707 - DNA, 373 bp, Zea mays
  Clone ID: LIB3069-043-Q1-K1-E2
gcggcggcgagttcgctgccaaggactacacggaccctcccccggcgccgctgatcgacgcggctgagctggggtcctggtcgctgtaccgcgccgtgatcgccgagttcatcgccacgctgctgttcctgtacatcacggtggccaccgtgatcgggtacaagcaccagacggacgcgtcggcgtcgggtgccgacgcggcgtgcggcggcgtgggggtgctgggcatcgcctgggccttcggcggcatgatcttcgtcctcgtctactgcaccggcggcatctcggggggccacatcaaccccgccgtcaccttcggcctcttcctggcgcgcaaggtctccctggtgcgcgcgctgctctacatcgtggc

SEQ ID NO: 58708 - DNA, 415 bp, Zea mays
  Clone ID: LIB3069-043-Q1-K1-E3
cccacgcgtccggacgagttgaaggacattaatgaccaacctcatggaacatgggaggaggtgtacagaaatgtgaaaagggtagataggttaaaaaatgaattgcatgaaagagatgacaaggagcttgagcggacaggtcagccactttgtatatatgagccttttttcggggaggggacctggccatttctgcaccagagctctctttatcgtggagttggcctgtcttcaaaaggtcgaagaccaggagcagatgatattgatgcttcttctcgtcttccacttctcaacaatgtttactacagagatattcttggtgaatttggagctttctttgctcttgccaacagaattgaccgaatacacaaaaattcttggatagggtttcagtcctggaaaggtacagcaagaa

SEQ ID NO: 58709 - DNA, 445 bp, Zea mays
  Clone ID: LIB3069-043-Q1-K1-E4
acaggcttagcactcaggtaaaacctcttatctgggtcgaagcacagattgagaaacattctagaagccgtatagaactcatggtgaaggcaaggagtcagttcaaggaaagaagcacagcaacaaatgttgaaattgaagtgcctgttccttcagatgccacaaacccaaatataagaacttcaatgggttctgctgcatatgctcctgagagagatgcaatggtctggaaagtaaaatcattccctggtggcaaggaatacatgtgcagagcagaatttagtcttcctagcataacagcggaagaaggggccccagaaaagaaggcaccaatacgagtgaaatttgagataccatatttcaccgtatcaggtattcaggttccgtatctgaagataattgaaaagagtggttaccaggcactcccctgggttagatatatcac

SEQ ID NO: 58710 - DNA, 442 bp, Zea mays
  Clone ID: LIB3069-043-Q1-K1-E5
ctctgcctcgccggggaagcgatgcagcctctgcaccaaccgccgatgaacgggcaacacggcccgcctcctccgcagggatccggggttcccacgccttcgcagcagcaggcgccacctccgtcgtactaccagcagcagcagcagcaggcgccaccgcctcagtactaccagcagggtcccccacagccgtgggcgcagcagcaacagtacgctccaccgccgccgcagtacccgcctcagatgcagcagtacgctccaccaccgcagcagtacgctcctccgccgccgcagcagtacgcccctccgtgcgagcagcagtccgctacttcgccgccgcagtacgctacttcgacgccgcagtacgcgcagccggcgcagtacgcgcagtcaccgcagtatgggacaacgccgggaaagcgtgaggtcagaaccctgtgga

SEQ ID NO: 58711 - DNA, 236 bp, Zea mays
  Clone ID: LIB3069-043-Q1-K1-E6
gttgtgacaagttctgcgaaaactcattactgtggtttgctttgtataacgccgccgaaacaatcgaacggtttcctttatcacctgctgttctgttaagcttgtaatctttctgaacgtgcagttacctgcccagagctgagttcattatacaataaataccgggatgttaatgtttggactctggtgcatggagatgcagtggtgcttgttattaccatgaaaataatgttttt

SEQ ID NO: 58712 - DNA, 453 bp, Zea mays
  unsure at all n locations
  Clone ID: LIB3069-043-Q1-K1-E8
aaacacgcatgataacgcggattaccatttctcaaagatcagatcaaaacatggatcaagatccaacacgtccatgtacaaaaactagccactacacatcacgcgaggtggctcccgattattcgacttgctgcacggctccaattcagttcatcaccatacacgcatgcatcgtggcgcacgccactcacgagcgcggcgcccatgcgcccacaacttattacgactcgtcaccaaccaaccaaaccaagccacccagcaggtccagtccaggcgtgtgtgctgtgctctcctctaccggccgccggccacatcacgccgccgaggcgcccttggcgtcgccgctgcagtagtcgcgaacggcctcgagcttgaaaggcggngcgtcngtggcgagccactgctcgacggtgaacagctgcttgccgcaccccttgtgcgggcccgtggtgg

SEQ ID NO: 58713 - DNA, 247 bp, Zea mays
  Clone ID: LIB3069-043-Q1-K1-E9
cccacgcgtccggaagtggtcgttttggggccgcagctactgattgcctttgctgggagtccttttggattcagtagtgaaccatgtaacttcgagattttggatacaaatcggaaaatccatttacattgtttttacatcgacttgcagttctgatgtcatcacagctgaaaaaaagccattgattccagtggacattacttccgagttttgatgttgcaaggatgagaagacatacattcctttt

SEQ ID NO: 58714 - DNA, 441 bp, Zea mays
  unsure at all n locations
  Clone ID: LIB3069-043-Q1-K1-F1
cccacgcgtccgcccacgcgtccgccgagccaacgacgacgttcgacggccgtagccaagaaggtatctcgcccaaacaaaggccgtcaagccaccatggccgtgtccggcgagaagccgccaccgccaccgccaccggccacggcgtccggcggaacggcaaggaagctcatcctagcgctgcttacatgtctgtcgtcggcgctgctgtacaggcagattcagccgctaccgcccaagatccccggcacgccgggcggcccgccggtgacggcgaccaggacgaggctcagcgacggcaggtacctggcctatctggaaaccggcgtcccgagggagaaggccaagcacaggctcgtctttgtccatgggttcgactcctgcagacacgacgcgcttncgatctccacggagcttgcgcaagagctgggcgtttacatg

SEQ ID NO: 58715 - DNA, 460 bp, Zea mays
  Clone ID: LIB3069-043-Q1-K1-F10
attcatttatgcaacatgatgtacaagaattgaacagagttctttccgagaagttggaagataagatgaagggaactgttgtggagggaacgatacaacaattgtttgaagggcaccacatgaactacattgagtgtatcaatgtggatttcaaatcaacaagaaaggaatccttctatgatctccagcttgatgtcaaaggttgtcaggatgtctatgcttcatttgataagtacgtagaagtggagcgtctggaaggtgacaacaagtatcatgccgacaaacatggcctgcaggatgcaaaaaaaggagttctttttatcgacttccctcctgttttgcaacttcagctaaaacgttttgaatatgattttatgcgtgacacgatggtgaagataaacgatcgttatgaatttccactccaattggatcttgatagagataatggaaaatatttatc

SEQ ID NO: 58716 - DNA, 397 bp, Zea mays
  Clone ID: LIB3069-043-Q1-K1-F11
gtgccacagaagtggtactgacaatatttgttaagggtgttcctgctgatagtgtagtcattgattttggtgaacagatgttgagtgtatccattgaagttcctggtgaagaaccataccattttcagccccgtctgttttctaagattatccctgagaaatgcaaatatcaagtcttatccaccaaggttgaaatacgccttgcaaaagctgagcaggtgacatggacaaccctggattatagtggaagaccaaagactgttccccagaagataagcacgccagctgaaacagccccaagaccttcatacccatcttcaaaggcgaaaaaagactgggataaactggaagctgaagtcaaaaaggaggagaaggaagaaaacttgatggtgatgct

SEQ ID NO: 58717 - DNA, 462 bp, Zea mays
  Clone ID: LIB3069-043-Q1-K1-F12
accttatccttgcctttgggagtaagccctacctacatctggaggcttcgtcgagccttggaaggcctttttgttgattacggctaatttccaatggcagctgagatgtaacaaatttgctcagttcagttctctaggaaaagttcccgtggttcagcaatgtgattggtttcataggttttttcgtgtgttggtgatcaaagcaatctggtgtaagcttgcgtagttgacatcagagtttgtttcttatggttaggttcttttgcttttcatcctctactgcacatcacagatccaaggaggttttttccccagcagatgaaaccatgcatgcagcgtcaaagaaggattatcagttggagtccatgactggctcagttcgttcaaaccagatgacagaagaaaataaccgttcagctgttagtggtcattgtggcagtagcccatcatctcatcaagaat

SEQ ID NO: 58718 - DNA, 419 bp, Zea mays
  unsure at all n locations
  Clone ID: LIB3069-043-Q1-K1-F2
ggccttgaagcttgtgtgcagcgagggtgacgacggcattgcgtcaggaagattcagccaggagttgcccatgcaaactacagcggtttatgacgcgactggcatggaagctgagagagtgctaatatccgagatatttggctccacaccactctttactcgcggtgccgattcagattcttttcgcaagcagtcaagttcaggtccgctgatgacaggcaagaacaggaagttctggcagaggttgcgaagcctgtcaagagggagcatgagtgagcatggcatctcaccagactatgaaacccgctcgcaatatagtggtaggtgaggaaacctttgcttggctntgattagaaaacggattgatactcagactgggaataaaagagttcaagctgagctagtgtaaactacgcatc

SEQ ID NO: 58719 - DNA, 279 bp, Zea mays
  Clone ID: LIB3069-043-Q1-K1-F3
gtgcctactgggagaatacatttggggtatcatcgtaggtagattatagctcactaataggaatgatgactgtggagagtttttctggtaccagagaagggcagaaggcacggaaatcctcctgttcccgtctgttatataccttatcgtaggctgatatgcccaacagtatgtcagttttaggcggtgccataggacatgaggctggatccagtgccatttttcgatcatactttttatctattatactgttccagtgaaaaaaaaataatgtatgtg

SEQ ID NO: 58720 - DNA, 420 bp, Zea mays
  Clone ID: LIB3069-043-Q1-K1-E1
ggtggacggacggtgctggcatcgccaattcaacttcgcatctgcatcggcagcgcgccagctccataggaggagatggcgctcacaagaatcggtcttgctggccttgcggtcatggggcagaaccttgccctcaacattgcagagaaagggttccccatctctgtgtacaacaggacaacctccaaggtggacgagaccgtgcagcgtgccaaggcagaaggaaaccttcccgtctacggcttccatgaccccgcgtcctttgtgaagtccattcagaagccacgggtggtgatcatgctcgtcaaggccggcgcgccagttgaccagaccatcgcgacgctcgcagctcacttggagcagggcgactgcatcatcgatagggggaacgagtggtacgaggacacggagaggagggag

SEQ ID NO: 58721 - DNA, 411 bp, Zea mays
  Clone ID: LIB3069-043-Q1-K1-C5
gatctacgggaagcccacttgcaggtgctcctcggaggcggcggacagagatccagcgacaacaacagcagcagcgccacgaacatttcggctgatcctcttctgtcgtcgttcggccttggcttccctacctcggacgctgagcaagcatccaagtcgaccgtttccattcctgatgatgctacgacggtgaaagaagcgcccgctcaggcacggaagctaagtatcgattcgtcgctcacaagtgaagaaagggagctgaagcggaagcaagcccgcgtcagagccacgttcgtgcaggacctgctgctctctactctattcggcgactgatgacaaaccaatgctccagagttcagacgtacacgcacaaccgttacttgcgtgcgtaccgtaccacacacagatcgt

SEQ ID NO: 58722 - DNA, 454 bp, Zea mays
  Clone ID: LIB3069-043-Q1-K1-C6
cccacgcgtccgcaaccctcagaaccttgtcatagctgtcgagagtgggatctcatttggccagttcttgctgggagttttcccagctatgatcgttggggttctcacaaacgctgctatcctccttttgtacttctggaaatacttgtcggtggagaaggatcaggagggtgggcagcccacaggaccagaggtggttgccgacgatgaggttacttcccatcggttcacaccggctagaatgtcacatgtttcttctctgaatccagatgacatggattgcgtaagcgaaccgatcatcaggagcaacagtgtcagtactactgggaatgagaacctgagaagcagaagcatcaattctgaggctgacattcagcttgcgatcaagtctctgcgggcatcaagcatgtcgcatgagatggtagaggtctcgacggttcctgatcggagagat

SEQ ID NO: 58723 - DNA, 394 bp, Zea mays
  Clone ID: LIB3069-043-Q1-K1-C7
ccaatggtcacatcctccactttggtagatctaacaactagactagatttcttcaaggagcgaaggtcgcaactgatggaacaacttcatagccttgatttgggacgtggatctgctccgcaaggttttccattcaagccaccctctccttggaaccacccaaggtaggaggatgaccgttcgatttcatgattgtaaattcttcagtagtggttcttttctccccgcctggcgattgcagaaaactgcatatacgagtgtaaatgtattttgctcttcgatatggttttagctttcgtgttgtgcgaggatagctccttaagtgggatgtgtgatatagtcttttctgtataacacgttgtcatggagagatgccttttagacaagtttttcc

SEQ ID NO: 58724 - DNA, 452 bp, Zea mays
  Clone ID: LIB3069-043-Q1-K1-C8
catgaactcctcaagttaaaacttatcctatatatgccatgagaccacaactgcaactcgtacgaataaaattgatatccttttacgttattctagtgttgtttttactcatccctcatattcaaatgaattgaacaaaagtacagaactttattgtttattttctcaacctaacatgcaacatttcatcgttttcgtatccagatgtgtgttgttatctttattggaacaaatggccagacgtatttcatcacggcttcacttgttacaagcatccagaatttcccaaagagcaggggcccaacagtgggcatcctcaaaggatttatgggcctaactagcgccattctgacacaagtttatacagtgatgcacactccagaccatgctgcgcttatcttcatggttgctgttggtccgtcgctggttgccattggcttgatgtttgttat

SEQ ID NO: 58725 - DNA, 356 bp, Zea mays
  Clone ID: LIB3069-043-Q1-K1-C9
ggcttgatgtgaacaaagagcctttcaagttcacaggcatatatattaggaaggctggatgatgacatcaaagagctgtacctagttatagaaattggacatcaccctataaggatgaccaaggatgtgctaagtacattggaatacatccagattttccgaactaagcgagcgaagtgaacgaggcaaatggagatgaacacttagatgctggtcaaaagggcaggggtcctaatgggaaggactgaagatgaggattcaccggcaagataaatggatgcaactagtaagacacctgaggatgcgacagtatgagagcaaagagatgggcatgttaaacctgatagtcccgacta

SEQ ID NO: 58726 - DNA, 421 bp, Zea mays
  Clone ID: LIB3069-043-Q1-K1-D10
cggccatggcggagcgggagcagtaagagcaggtggctagcgacgacgcggcggagtggaagcaggtggcggagctgagggccgtcacccaggcccaggacccttcctgcaaggatgaggacgactacacgctccggcgcttcctccgcgcgcgggaccacaacatcggcaaggcgtcggcgatgctgctcaagtacctcaagtggaagcccgcggccaagccccacggcgccatcgcagcggcggaggtggcgcgggaggcggcgcaggggaagctctacctgcagggccacgaccgggaggggccgcccctcatctacggcttcggcgcgcgccaccacccggcgcgcagggacctcgacgagttcaagcgctacgtcgtccacgttctcgacgccaccgtcgcgcgcctgcccccttc

SEQ ID NO: 58727 - DNA, 420 bp, Zea mays
  Clone ID: LIB3069-043-Q1-K1-D11
cccacgcgtccgcccacgcgtcctaagaaattgaagcaaatcgctttacgaagatgtatacaagaaattttggatctaagggctctaaccactttttgaggcttgctactatttgatgaacatgtttgtaagttattagctatgctctatggagaactataaatgattcaccataataatatgaaagcctggtagtaactcgtgaggcacatactatttatgattgttatgtgccatcttatttgtttaccagtgccatattacttacgaaggcttttgtgatcattcagggagccaagaggatttgggttcgtggagttcgttgatgcttatgacgcttctgaggcacagtaccacatgaatcgccagatgtttgctgggcgtgaaataactgttgtacttgctgcggatacacggaaa

SEQ ID NO: 58728 - DNA, 428 bp, Zea mays
  Clone ID: LIB3069-043-Q1-K1-D12
ctttccacaagaacatcacacggcgatagcaaaaccttccgtcggaggatggcttccgccggcgctggagaaggcaaggagacggggacggctgccgggagcagcctccacagcaagactctcctcaagagccaaccactgtaccagtacatactggaatccaccgtcttcccacgcgagccggactgcctgcgggagctccgcgtcgccaccgccacccaccccatggcgggcatggctgcgtcgccggacgaggtgcagctgctgcagctcctgatcgagattcttggcgccaagaacgccatcgaggttggcgtcttcaccgggtactcgctgctcgccaaccgcctcgccctccccgacgacggcaagattgtggccatcgacgttacccgcgagagctacgaccagattgggtcgcccgtgat

SEQ ID NO: 58729 - DNA, 379 bp, Zea mays
  Clone ID: LIB3069-043-Q1-K1-D2
ggaacagaaggaatgttctggaggaagaaattacatcgagtagattggtcttcgatcctccggacatctcgcttgagaaaactgtacactcgctcgcggacgcaaacacgatggttgctagtatttacacgctcacgccggctggccggtcgacccgcgcaggctcgtctcgacgaagaagagaaggattcttggcacgcaccaccaggggggggggcgtcattccgcggcaacgactgccgctggccgcgtgcggaggctcgggctccgcggctgccgcagcatctcgatcagcgactccgccttggttttgagcttggggcgggcggaagaggactgggagagggcgacgaggggcgggatggcgccctcgcgggcg

SEQ ID NO: 58730 - DNA, 457 bp, Zea mays
  Clone ID: LIB3069-043-Q1-K1-D3
cccacgcgtgcgcccacgcgtccgcttactacggtcctctctgtggtctattctgctgtacgcgctggctcctctgcaactgtgctctcgccaccagactcaccacgtgggaccgacaagccattgcttcccttcagcaaggcagacgaacaagaagataagaaggatgtgccgaggccggtgacatactcctactctttctttcacctcatcttctccctggccagcatgtactcggcaatgctcttgactggctggtcaacttcggatggtgagagcggaaagcttgtggatgttgggtggccatctgtctgggtcaggattgcaacccagtgggcgacggcaggtctgttcatatggtcgcttgttgcacccgtactctttcccgacagggaattctaagttcaaccacggtaagcctggagcatcaaacgtgtctactgggggagctaatata

SEQ ID NO: 58731 - DNA, 446 bp, Zea mays
  Clone ID: LIB3069-043-Q1-K1-D4
gatggactttgccttcccgtacctgttgctgttcattcgtgaatacactagcaaggtggatgatttagtgaaggacaagattgagtcgcagaaggaagaaagagccaaagagaaggaggagaaagaccttgtggctcagcagaacatgtatgcacagctgcttcctctcgctttgcccgccccgccaatgcctggcatgggtggccctccacctccgatgggcggaatgggcatgcctccgatgggtatgccgccgatgccagcatttgggatgccaccgatgggaagctactgatttggttttgcagcataagtggaacttcattggagttgtagatggttgacagtttggaatcaatattcttcattgtaccaggaaactttttggcgagtgagtgaaatcagtcttacccgtaagttgagaagtgcaacctgtgatattgtta

SEQ ID NO: 58732 - DNA, 457 bp, Zea mays
  unsure at all n locations
  Clone ID: LIB3069-043-Q1-K1-D6
cccacgcgtccggtgctggccgtgtgcgctttcacggcggcggaggggttcgacatcctgcagatcctggggaagcacgacgagttctcgcagttctgcaagctgctcaacgagacgcacctggccggcgacatcaaccgcgaccgcacaatcaccgtgctggccgtggccaacggcgacatgggccacctcgccgccggccactactcgctcggcaccatccgccacatcctcgagctgcacgtcgtcgccgactactacgacgacaagaagctcaagcagctgtcgcacgccgccaccgncgcgtgcaccttgttccagcgatccggatttgcccccggcatggcaggatacgtgaacataacgcagcaccgcggcggcaaggtgtcgttcatcgtggacgacgcggcggacagcgtcaagcccgtcacctacgtgaagcagatcgagagccacc

SEQ ID NO: 58733 - DNA, 461 bp, Zea mays
  Clone ID: LIB3069-043-Q1-K1-D7
ccgggacagtttggcatcccggacgccggtcccatcggcgcattgaaggagctggagctcgggaacggccgggacgagtcgtcggtgtccgatccggcgtccggcagcgcggagatggcgctcaacaaggggccttccgacggcaatgcgaagaaacggaaggctagcgggaagggcaaaggcaaggatggccccgggtccgccgccgccaaggaggagtcgagtgggaagcggtgccgatcggcggacgagagcagtggcgcggaggacaacaaccccaccaccaagggcaaggccgcgcagagcagtagcgagaatggtggtggcaagaagcagcaggggaaggagagcgcgacgaagccccccgccgaggcgcccaaggactacatccatgtccgggcgcggcgcggcgaggcgacggacagccacaggctcgcggagagggtgagaagggagaagat

SEQ ID NO: 58734 - DNA, 439 bp, Zea mays
  unsure at all n locations
  Clone ID: LIB3069-043-Q1-K1-D8
caggaaaaaaggcccagaggcagtgccgttaccgattcgagacgcaagagaaggatcgagacgaggcggcggttttccggggcagcatcgtctcggccacgaagatgtcttactcaaggggctcaaggtatggatctcgctcaccttactcgagaagcacaaggtaccgaagtcgctctaggagtgtcgactctagtgatgctgaaaaccctgggaacaacctgtatgtgactggtttgtcggctcgtgtaacggatcgagatctggagaagcacttctccactgagggtgaggtgattgatgcaagcgttgtgtatgatccttggacaagggaatcacgggggtttggttntgttaccatggctgctgttaaagatgcagatcgctgcatcaaatatctggaccgttctgtgttgcaaggtcgggtcataactgttga

SEQ ID NO: 58735 - DNA, 468 bp, Zea mays
  unsure at all n locations
  Clone ID: LIB3069-043-Q1-K1-C3
gagaaggaaaaatatccccaaaccctagctcccgatctcgatggcgaaccctcgcgtcttcttcgacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagttccccgacgagaagttcgtgcgcaagcacaccgtccccggtgtgctctccatggccaacgccgggcccaacaccaacggcttccagttcttcatctgcaccgtcgcgaccccttggctcgacngcaagcacgtcgtcttcggcaggtcgtcgagggcatg

SEQ ID NO: 58736 - DNA, 451 bp, Zea mays
  Clone ID: LIB3069-021-Q1-K1-D7
gttccccgtgggaactgtcgcaaatagcctctccctgatagtgcacccaataagggtagggtgatgtgctcctactgcaggcatcatactgagtctgaagttccagatccttattatggaggccctcacggatttgaaaaggtgctggacttattggaagatgcttgcgagtcgctgcttgatagtatcgtcgcaaacaatgcaagcatttctgggtgacatcgatgtaaatctccacatacagacatctattttcagacgcaccgaaggctgtagcatccatgcacaaccggagtaatttggtttctaatgcaacattgatcatgtcgtcattacccaggtcttggtctggtttgtatataccaccatccttatacctggatatgtgataagtgacaaaaaaactgctcatcatcacttttttccacttaagataatcagaaacaatcag

SEQ ID NO: 58737 - DNA, 293 bp, Zea mays
  Clone ID: LIB3069-021-Q1-K1-D9
cggacgcgtgggcggacgcgtgggcaaactcaagcttgtgggttttcttgtttggctgtgagttcgtgtttggtcagcaactggacgataaggctaaccacgcttgttgatagatggaatccaacagtcccattttttgttctgttctgttctgtagtacatccgctaaactgtaaatcctgggtttcatgtgttcgtctgtctttttattcaataattgcttccttgaaggccgtttatgttgtttgtggaccaatattgtgaaaaaagaaagaatgtatggaacctgttgc

SEQ ID NO: 58738 - DNA, 411 bp, Zea mays
  Clone ID: LIB3069-021-Q1-K1-E1
cccacgcgtccgcaaggggatcgaagcggttagcatgggagcggtcgagcgggtgacatgatcggcatccagggtttctcaatcggcagcgatggcgaccagggcggcggcgaggttcctgcagcgcaggtttctgtcttctggcggtaaggtcctcagcgaggaggagaaggccgccgagaacgtgtacatcaagaaagtggaacaagagaagctggagaagctcgcacgcaagggccccagctcaggagagcaaccctcgtcaaccacaggctctgcagcaagtgatgtgaaggccgatgctgggccaacggagtcagcatctgcaagtgtgtcgacggacaagaacaggaactatgctgttctggcaggcgcagttgctgccctgggtggcttgggttggtatctatt

SEQ ID NO: 58739 - DNA, 464 bp, Zea mays
  Clone ID: LIB3069-021-Q1-K1-E10
ggaacttcacagagcaggctctccctgactacctaatcaagagaggcatggcggtcgcagacccgtcgagcccgtacaaggtacggctgctggtggaggactacccgtacgcgtcggacgggctggccatctggcacgccatcgagcagtgggtgacggagtacctcgccgtctactaccccaacgacggcgtgctgcgggcggacgtggagctgcaggcgtggtggaaggaggcgcgcgaggtcgggcacgccgacctcaaggacgcgccctggtggcccaagatgcagacggtggccgagctggtcaaggcctgcaccaccatcatctggatcgcgtcagcgctccacgcggccgtcaacttcgggcagtacccgtacgccgggtaccttccgaacctgccgtccgtcagccggaagccgatgccggcgccgggcagcgacgagtactccgagctggagcgc

SEQ ID NO: 58740 - DNA, 443 bp, Zea mays
  Clone ID: LIB3069-021-Q1-K1-E11
cccacgcgtccgcccacgcgtccgttgcttttgagggcccactcaagggtatcatgggctgcgtggaggacgatctggttgccaccgacttcaccggtgacagcaggtcgagcatcttcgacgccaaggccgggattgccctgaacgaccacttcatcaagctcgtctcgtggtacgacaacgagtggggctacagcaaccgcgtcgtcgacctgatccgccacatgttcaagacccagtaggctagtagagagatagatttctgcctccctatcgtgggtcgtccccaatggcctttggtcgcagaccatgtttgctgcttgtctatgctgagaataaatgtgaacggtgcccctggacgctggatccatgctgggtttggacacgctgtctttatgtgtttaacttatctgctgccgtcctgtaacgaattcgcaagtttt

SEQ ID NO: 58741 - DNA, 457 bp, Zea mays
  unsure at all n locations
  Clone ID: LIB3069-021-Q1-K1-E12
ggaaggaacaatcctagctccaatcagtgttaaatcctggggttctggcttgctcgagtggctcgagttcaccaaactaaatgggatagttattcaagggaacggcattataaatggcagagggcaacaatggtggacctactcagacccagaggatgaggatgatgatgacacgtaccatgtagagtttcaaagaatgccacagattaaacctacagcgttgaggttttatggtagtttcaacgttgtagtgtctggtatcactattgtcaacagctcacagtgccatcttaagttcgacaactgtcaaggagtgatggtccatgatgtgaccatatcctnccctgagaacagtctcaacactgacggaatacacctgcagaactccaaagatgtcagcattcatcatacaaccctggcttgtggtgatgattgcatctncatccagacaggatgc

SEQ ID NO: 58742 - DNA, 338 bp, Zea mays
  Clone ID: LIB3069-021-Q1-K1-E3
cccacgcgtccggacctagccaaccttgtatacattgcagcaataaaggctgcggttgaaggtgcggacaaattgaatgctgttcagttggagtttgccaaagatcgtattatcatgggaaccgagaggagatcaatgttcatatctgatgaatcgagaaagcttactgcctaccatgaaagtggacatgctattgttgcactcaacacccagggtgctcaccccatacacaaggcaactatccttcctcgtggatctgcccttggaatggtcacacaacttccctcacaggatgagacctctattagcaagaaacaacttcttgcacgtcttgatgt

SEQ ID NO: 58743 - DNA, 290 bp, Zea mays
  Clone ID: LIB3069-021-Q1-K1-E4
atcaaccgaaattatggcgcgcttcaatcgtggctacgctgatggggacctgatccgttgtggtgtgcttgaatcgtggctgtggagatgtgtggaactcattggttaaagtgtgctttattaataatggtgatgctgatggaactgattttgctcccgttggacggcctgattggttactttgccctgttgactgtttgagaacgtaccgcccaggtttacttatacttactgctttttgacggtactgtacatacagttcgacaatttatttattggcagttcaattc

SEQ ID NO: 58744 - DNA, 425 bp, Zea mays
  Clone ID: LIB3069-021-Q1-K1-E5
cggacgcgtgggcggacgcgtgggcatcactgcccaaatcatatctgctagtatagcgggtgatatggttcttgcttctgcctactcgcatgagttgccacgatatggtcttgaagttggtctgaccaactatgcagctgcctactgcactggccttctgttggctcgccgtgtgctcaagatccgtggtttggatcaggagtacgagggcaatgttgaggccactggtgaggacttctctgttgagccagctgatgagaggaggcctttccgtgctctcttggatgttggccttatcaggactacaacagggaaccgtgtctttggtgccctcaagggagcattggatggaggcctggatattcctcacaacgagaaaaagtttgctggattcaagaaggacgacaagcaattggatgctgata

SEQ ID NO: 58745 - DNA, 458 bp, Zea mays
  Clone ID: LIB3069-021-Q1-K1-E6
cggacgcgtgggaagcttcaacaagtcatgctttgattagtagccatgtaacagggctggctggtctcatgaaccgtagctcaaatgcaatcccttcaccaggaattagtaattttcaaagcggaaatattcattatgttgttaatcagaacgctatgggagttagctctaagccaccaggtgttctaaagaccgagagcactgactcactgagttgtagttatggctatattggtggtagcaccagtgtggactctggcttgttctcttctcagtccaaaaatccacagtatggtctactgcagaatcaaaatgatgttaacggcagctggtcgccttcacaagattttgatagttttggaaattctcttgggcaaggccaccctggtaccacttcatctaacttccagagttccgcccttgggaagttgcctgaccaaagacgagggagaaatcat

SEQ ID NO: 58746 - DNA, 444 bp, Zea mays
  Clone ID: LIB3069-021-Q1-K1-E7
cccacgcgtccgcggacgcgtgggagaagtttgacaacattaggccttttgaaagtggtggagaatcttctctggaatttttctcccttaaggcagactgtagccttatagtgtatggttctcattcaaagaagaggcccaacaatctgattttgggtagaacgtatgaccaccacatatatgaccttgttgaagtaggagttgagaactacaagtcaatggaatcttatgtttatgataagaagctagcaccattacttggatcgaagcctttctttgctttcataggggaacactttgagagtgctgaagagctgaaacatttgaaagaagtgctgcttgatcttttcagaggagaggtcgtagagaatctgaaccttgctggtgtggatcggatctatgtgtgcacggcaatctctcccactactgtttacatgatgcact

SEQ ID NO: 58747 - DNA, 110 bp, Zea mays
  Clone ID: LIB3069-021-Q1-K1-E8
gcacagactagttgccagtcatgaactttttcagtctgatgtaaaattgggaaagttatggggaatggttgaacaaaaagaaaaaacttaaagcaaactggggccttcga

SEQ ID NO: 58748 - DNA, 461 bp, Zea mays
  unsure at all n locations
  Clone ID: LIB3069-021-Q1-K1-E9
agcgcgtaaagttacagatatgggatacttttggtcaagagcggtttcgaactatggcaggcgcctactacaggggtgcaatgggaattttgcttgtctatgatgttactgatgagtcatctttcaataatataagaaactggattaggaacatagagcaacatgcttccgacaatgtgaataaaattttggtaggcaacaaagctgacatggatgaaagcaaacgggctgtgccaacttcaagagggcaggctcttgctgatgagtatggcatcaaattttttgaaacgagtgcgaagacgaacctgaatgtggagcaggttttcttctccatagcaagagatatcaagcaaaggcttgctgaatctgattcaaagccagaggatcgcacgatcagtatcaacagacctganggtggtgaggcttcagcgtcacaaaaatcagcttgctgcggatcgtga

SEQ ID NO: 58749 - DNA, 440 bp, Zea mays
  Clone ID: LIB3069-021-Q1-K1-F1
ctcggataaatgccgccgtagatttgaccttggatatgcagattatcttagatatcgtgggatgcgttagtttgaccaggcgatgcagcaccttgagggaaaatatgaattcatgacatctgatcactcatatgtatcacggaagcatgaggaggataaggtgatcatctttgagagaggagatttggtcttcgtgttcaacttccactggagcaatagctattttgactatcgcgttggttgtttcaagcctgggaagtacaagattgttttagattctgacgatggccttttcggtggatttagtcggcttgatcatgacgctgagtacttcactgctgactggccgcatgacaacaggccgtgttctttctcggtctatgcacccagcagaacagccgtcgtatatgcacctgcatgtgcagaggacgaatagggca

SEQ ID NO: 58750 - DNA, 459 bp, Zea mays
  unsure at all n locations
  Clone ID: LIB3069-021-Q1-K1-D6
cggacgcgtgggtggagacgcaaagagcctctccctgatagtgcacccaataagggtaagctgatgtgctcctactgcaaacatcatactgagtctgaagttccagatccttattatggaggccctcagggatttgaaaaggtgctggacttattggaagatgcttgcgagtcgctgcttgatagtatcgtcgcaaacaatgcaagcatttctgggtgacatcgatgtaaatctccacatacagacatctattttcagacgcaccgaaggctgtagcatccatgcacaaccggagtaatttggtttctaatgcaacattgatcatgtcgtcattacccaggtcttggtctggtttgtatataccaccatccttatacctggttatgtgataagtgacaaanaaactgctcatcatcactttnttccactaaagataatcagaaacaatcagaatgaccg

SEQ ID NO: 58751 - DNA, 471 bp, Zea mays
  unsure at all n locations
  Clone ID: LIB3069-021-Q1-K1-C10
cccacccagaattacactgaatatgttggttgaaagagtacatttcgccttctgaagagaggatccgcaaaggcactagataaagttgttgagttagatggtaagtctgccatctatattttgtcccctatcagtgagatacaaatatgaaaaggcatgctgattttatggttgcagaaacaaaaaaagaggcactgatcgttaagacgacaatacatgatatcatgaaccaaatgattcgggaacttccaataaccaatccagtatacctcatgctaagcacatcatttggttcctcagctaaaggaaccgggcttaaagctcttgaatttgccctctncatctgtgacagtgttgatatgtatggcttcaccgtagacccaggttacaaggaatggacaaggtacttctcagaggtaagaaagggacacacttcactacatggtagagcatattatcagatgatggaat

SEQ ID NO: 58752 - DNA, 230 bp, Zea mays
  Clone ID: LIB3069-021-Q1-K1-C11
acttgtgtagagtaggcagagggatttggctgagaggtgctgaaactcccatgggggtggaatgggaggataggagcattgaggttcgagaaggatcatgggcatacattggtagtacaagctctggtggttatgctcctggtaacttcagtttgggcaataattggctttcttggagatcaccattattatgataatgggggctttttggtccccttattgggccaaaa

SEQ ID NO: 58753 - DNA, 452 bp, Zea mays
  Clone ID: LIB3069-021-Q1-K1-C12
ggaatggagaagatctaccccctcctgattctaaagctattagggatatctgcgtgctggctggcgggcatgttgttattgcatcactaagcaggaagttcccttttcatgtctataaagaaagtgtgcaagttctattcttcactgttatttttgctacatttactgaaatatgacattcgttcatatgatctactggtaattcttcgacctttcaatttcacaaaacttgcaactatttttatgctctgcatcctaccaaaagtatacattgtctttctactacttagacctaagtatgagcaagtctgttgcatttctattctttctactacttatacatgcactgcattatgtatttaacttttaagaagatcaagcaagtgcttggtaatcaaagcacttgtttttgatagagacatgcattctttttccttaaattgattttaaag

SEQ ID NO: 58754 - DNA, 237 bp, Zea mays
  Clone ID: LIB3069-021-Q1-K1-C3
cccaggcatccgcccactcatcctcgggtttgcgttccacccaccccctcgcgtctcgaggtaggtttctaatcctcgagggccgccccacacaaaccgagctcccacccgcttctctttccgccatccaagaggccccacccctgataccacgcttacggcactgaattaggagattaaccatcgccaagcgaacttacggcggcacttcttgcaaacgctcttgacgcccatcta

SEQ ID NO: 58755 - DNA, 457 bp, Zea mays
  unsure at all n locations
  Clone ID: LIB3069-021-Q1-K1-C4
cattcatattataaggcgcgaatctatccatctatctaatctacttacgcacgaacatgcgtaacatcggcatgctgcgggcgctggtcctggcgctcgcggtggccgccgccgccgccgccgagaagaggaggacgtacatcgtccacatggccaagtcggcgatgccggccgagtacgcggaccacgccgagtggtacggcgcatcgctgcgctccgtgtccgcctcagcctccgccgccaagatgctctacgcgtacgacaccgtcctgcacggtttctccgcgcgcctcacgccgcaggaggccagcgacctggcgtccgccgagggggtgctcgccgtcaacccggaggcgcggtacgagctgcacaccacgcggacgcccgagttcctgggcatcgncggccagggactgtccccgcagtcccgcacggcgggcgacgtcgtcgtccgcgt

SEQ ID NO: 58756 - DNA, 299 bp, Zea mays
  Clone ID: LIB3069-021-Q1-K1-C5
gaactctaccccgcagtctcggccgcggccatggcggaggacgcccccaacgccgtcgccgagggcagccagcccgcggcctccgagggatccgccgacgccgccctgccggctgccgcgggcgccaaggccgcggaggcgctgctcccgtcgctcagtatctggccgccgtcgcagcgcacgcgcgacgccgtggtgcgccgcctcgtgcagacgctcgcggcgcccagcgtcctctcccagcgctacggtgccgtcccggagcccgaggccgagcgcgccgccgtggccgtcgaggc

SEQ ID NO: 58757 - DNA, 421 bp, Zea mays
  Clone ID: LIB3069-021-Q1-K1-C6
cggacgcgtggggaagagcgcaagatgttttgcttcgggcaccacggccaccacggccagaacccgccggcgcacggcggcgtgcaccagcccaccttcaagatcttctgcaaggccgacgaggggtactgcctcaccgtccgcgacggcaacgtggtgctggcccccgccaacccgcgcgacgagcaccagcactggtacaaggacatgcgcttcagcacccaggtcaaggacgaggagggcaaccctgcgttcgccctggtcaacaaggccactgggctcgccatcaagcactccctcggccagtcccacccggtgaagctggtgccgttcaacccggagtaccaggacgagtcggtgctgtggacggagagcggcgacgtgggtaagggcttccgctgcatccgcatggtgaacaaca

SEQ ID NO: 58758 - DNA, 334 bp, Zea mays
  Clone ID: LIB3069-021-Q1-K1-C7
ggttttggaggtgaacctctcctacgtgggacggtacccgtccccgctcggcgccatgaacctgaccgccaacaccctcaagggaacgcacttcgagatccacggtgcagcccaaccacacgattatggttgtgaagaacaatattgaagagatacaaggaaaagacagctatccatggagccaacaactgctgattttcaatggaaaggtcttgaaagatgaaagtacattgcaagagaataaagtcaatgacgatggctttctagctgtcatgcttagtaacgataaaacatctgggtcaactggaactttatattcccagcactcatacac

SEQ ID NO: 58759 - DNA, 349 bp, Zea mays
  Clone ID: LIB3069-021-Q1-K1-C9
cccacgcgtccgaccaacccagctttcttttcccagctgatcaggtcgagcacctggtagggacctgctcgatcatcagtggagagtgtcggtaggtgtctgtctctcttggtggctggttgcaacggtcatggcgacgtcgtctcgtcgggtgcccttgctgctgctgtgcctgggcgtgctggtgtcctgctccttcgcggcgggcagcttgcaccaggagctggacatcacgtggggcgacgggcggggcaaggtccttgacaacgggcggatgctgacgctgtcgctggaccgcacgtccggctccgggttccagttcacgcacgagtaccatgtcggcatgatc

SEQ ID NO: 58760 - DNA, 408 bp, Zea mays
  unsure at all n locations
  Clone ID: LIB3069-021-Q1-K1-D1
agacggctagccggcgcacggaagcgggcttcggttcggaggtgagcctctcctgcgtgggactgtccccgcccccgctaggcgccatgaagctgacggtgaagaccctcaagggaacgcacttcgagatccgggtgcagcccaacgacacgattatggctgtgaagaagaatattgaagagatacaaggaaaagacagctatccatggggccaacaactgctgattttcaatggaaaggtcttgaaagatgaaagtacattggaagagaataaagtcaatgaagatgggtttctaggtggcatgcttaataagggtaaaacatctggttcaactggaacttcatcttcccagcactcaaacactcctgcaacaaggcaagcacctnctctagaggccccacaacaag

SEQ ID NO: 58761 - DNA, 390 bp, Zea mays
  Clone ID: LIB3069-021-Q1-K1-D10
cggacgcgtgggcgcccagctgctgctgctcgcgccgccgcggtgagacccgggaggagggcctggtggtgggcgggcccgatggagtgggcgtcggcggcgtacacggccgcggcgctggtgtgcgcggcggcggcgtgcgtggtagcgctcgcgcacatctaccgccacctcctccactacgccgagccaatctaccagcggttcatcgtccgcatcatattcatggtcccggtatatgctgtgatgtcattcctttcccttatcctccctaacaacgcgatatactttaattctattcgggagatttatgatgcttgggtcatctacaattttctctcactctgcttggcatgggtgggaagtcctggtgctgtggtggtaagtttg

SEQ ID NO: 58762 - DNA, 446 bp, Zea mays
  Clone ID: LIB3069-021-Q1-K1-D11
cttgcacagtggctcacgaacaaggtgacttacagggactacgaggccatcgtggacccgaagctgccggagaagccgtcctccaaggctctcaagaaggcgctcctggtcgcgctgaggtgcgtggatcccgactcgcagaaacggcccaagatggggcacgtaatccacatgctcgaagtcgacgacttcccgtatcgagaggaccgtcgaactcttcggccgggcaacggcagccccctggagaaggcgaggaatccggcggcggggtcatgcgacggcagcagctgctacgggggcgacacgaccaccgcgagcacgccgtccagactagtgcaggacatgtagtagtgatgtgtttgtagccagctgctgctggccttctgagctctgcctgcgggctgcggagcaacatggagatggacatgctgcaactctgctccgtc

SEQ ID NO: 58763 - DNA, 453 bp, Zea mays
  Clone ID: LIB3069-021-Q1-K1-D12
cattggatggaatctgtgggctttatgaattgaaaattagggatatcaacccaatgatcggaaacataacttatgacatcagcgacctctataacttcattgatggcctagccgacattagtgcgctggtttatgatcactcgattcaggcattcctgccatatgatcgacagtggataaagcaaaagttgtttcaacacctgaagaaattggctcagcggtagcacaactgttgtttgttctgatgccttttatccaacaagcaagcatgcgtgacaataggtgtccaatcagtggtattgggagttgtttcttgtaaactttgtaatgttacatggcagatttgctcccttgtattctggatgtttgactcggatttcattggtggcttgcttgtggttgtggtatgctaaacttgttttgtttcgcagtgctgggaatcagataaccctt

SEQ ID NO: 58764 - DNA, 430 bp, Zea mays
  unsure at all n locations
  Clone ID: LIB3069-021-Q1-K1-D2
gtgcatacaggctccaagagctaaccgtgtgaggtcatcacggggatcactaaaaagcatacactgtaattcactagctaggcaagcatcaagtctgcattggcaaaacattgtcaagtgcctggatcatacactggaaacgatgaaagaaaactatgtagctccggtgataatcaggaaaacatttaaccaagtatttgcatacttgaatgtgcaactcttcaacagcttgctgcttcgtcgggaatgctgctcttttagcaatggggagttcttaaaggctggtttacaagacctggagcagtggtgctctaggacaactgaagagtatgtatggacatcctgngatgaactgcaacacattangcaagcagttcggttcctggttttgcatcagaaatcacacaaaatcctggagggaaatacgaat

SEQ ID NO: 58765 - DNA, 434 bp, Zea mays
  Clone ID: LIB3069-021-Q1-K1-D3
cccacgcgtccgatggaatccattgaaaaacttgtcccagatttagcatctctacggggtgggctctgtccttcttacatggatgaagacatattctggaagatttactttaggttgcttgagtcaaacataaatgagcatagttctgaggaagatatccggagcgtgccaaattctgtacatcacaacaatgagatagagtctgattctccacctcacgtctgtgagatagaaagtgtgaaaagcaaccaagaagggtaccaatcttcggatggtcgtgctttccccaagacaagatctgagcgaagcattgaccaatgggtatttgcaaagtcaaaatctgaagaaagcatggatcagtggtctgaaataccttcagatgtggaatccttcagagaaggtaaaaggtacctcagtagcgaggagctgagtga

SEQ ID NO: 58766 - DNA, 190 bp, Zea mays
  Clone ID: LIB3069-021-Q1-K1-D4
cggtcgaccacgcgtccgcccacgcgtccgaccaattgcattcaaatttatgttctaaatttagcatctatactatgggaacggtaaaattcttacttggctcaatacatattatggtagatacactttaggtaactcaattcaaaattcaattaccatacatctaaacaataattcctgagcataccaa

SEQ ID NO: 58767 - DNA, 286 bp, Zea mays
  Clone ID: LIB3069-021-Q1-K1-C1
accaaccccgtcgcgtttcgggcgtggcttcctactcctcgaggaccgccgtacaggagcggagctccccgccgattctctctccgccttccgagaggcccgacccctgataccacgctgagggcggtggtattaggagattaccgatggcaaggtggcggccgtcggcgctgctggtagtggctctggcggcggttctatcggcggcgtggcgggcggatgcgctatcggatacggagaccgacaccgagtgcatccacgagttcgtgccctatgagggcaacac

SEQ ID NO: 58768 - DNA, 425 bp, Zea mays
  unsure at all n locations
  Clone ID: LIB3069-021-Q1-K1-D5
aggggaatcccaagcggaagggtctcctcgctctcctatctccgttatatcagctgcggggggcggcgatgggggcgcggaggaggctgctggcggacacgccgccggagcatcgccataggcagggcgcgccggcgtcggactggagcgcggggtaccttaacgggtggctgtcgcagccgacgccgatcttcggcctacgcctctgggttctcgtcggcatcgccgtcggcgccgccatcgagctcgtgctcctgctcatcttcgtctgcctctcccaccgccgtcgacgccgcggcggtgacctgctcgccgccaacctctaccccgccgccgacaccaagctgctcaagcagcacctncagcaccaggccacgcccaccaaggacatccaggagattgttcgtcgccagcaggcggagacg

SEQ ID NO: 58769 - DNA, 291 bp, Zea mays
  Clone ID: LIB3069-021-Q1-K1-A2
gagagagagagagacggaaagggggagatgagccttagcctggggatcccggtgaagttgctccatgaggcagcgggtcacgtggtgacggtggagctcaagaccggcgaagtgtaccgggggtccatggtcgagtgcgaggataactggaattgccagctcgagaacattaccttcaccgccaaggatgggaaggtttcgcagctggagcacgtcttcatcagaggaagcagagtgagaattaatgatatacctgatatgctcaagaacgctcccatgttcaagcgcttg

SEQ ID NO: 58770 - DNA, 458 bp, Zea mays
  Clone ID: LIB3069-021-Q1-K1-A3
ccggcccacgcgtacgcaagttacaagggaggggaaatatgttcattcagatgtcccaaagcagctgctttatgggacaatggtttttgttcgccagacaatagtcgcagatgcttctaaggctttgtcccgtgctgtttgcattgctgtacgatacagcgccatccgaaagcagtttggctctcaagatggtggacctgagactaaggtccttgattacaagactcaacaaagcagactctttccgttgctggcttcagcatatgcatttagatttgtgggtgactggctgaagtggctatacatggatgtcactcagaaactggaagctaaagactactcaacactgcaagaagcccatgcctgtactgctggtttgaaggctgtgacaacatctgcaacagctgatgccattgaagaatgtagaaagctctgtggcggacatggttacctgaaca

SEQ ID NO: 58771 - DNA, 453 bp, Zea mays
  Clone ID: LIB3069-021-Q1-K1-A4
gagcgatcccactcccgatcagcagctgatcgctcactcttgcagctcgatcattctttagctgctctagctctagcctctagccctagctagtagctagccactcggtcgtgtagtcatcagccttctgatcgtcacccatggccactgccgaggtccagaccccgaccgtcgtggcgaccgaggaagcgccggtggtggagaccccggctccgcccgccgtcgtgcccgaggaggctgcccccgccgccgaggccaaggtggaggagccagctgccccggcggagaccgagccagctgccgccgctgagcccgaggcggcccccgtggcggcggaggaagagacgccaaaggaggaagagacggcaaaggaggcggagccggagccggagccggcggcggctgaagaggtgaaggaggaagcggcagcgcccgctgccgagacagaagcag

SEQ ID NO: 58772 - DNA, 257 bp, Zea mays
  Clone ID: LIB3069-021-Q1-K1-A6
cccacgcgtccgcggactcgtgggctgactgtgtgaaaaaaaaaattaaataaggaaggtctaatttaaaaaattgaagtgatatataaaaaaatataaaataacattatacaaaaaaatagtgcactccattttaatattccaagctatcgtcccctagcttactacacataacatcatctattttttaacctaattttatttacttggctcattattcataacattatgatttgcaaaaatcattatttacctaa

SEQ ID NO: 58773 - DNA, 449 bp, Zea mays
  unsure at all n locations
  Clone ID: LIB3069-021-Q1-K1-A7
ggagctctttaatctgtgctagcagcggttccagagaatgcggcagatctcgtcgctgctgcagggcctggcccggtcactctcggtggggagggacagggacagggacagggaccggaaagggaacggcgcaggcgaccgcaagaccgccgtgccggcggtgctgcggacgtcgggcaccctgtggggcgacggctcggacacgttcgccgccgtctgctcgcggcgcggcgagaaaggcatcaaccaggactgctccatcgtctgggagggattcgggtgccaggagggcaccatcttctgcggcatcttcgacggccacgngcccgggggccactacgtggccaaggtggtgcgcgactcgctgccgccgtcgctgctgtgccactggcaggaggcgctcgcgctcgcgtcgctcatcgacgacggcaagaaaaagctcggcgact

SEQ ID NO: 58774 - DNA, 426 bp, Zea mays
  Clone ID: LIB3069-021-Q1-K1-A8
ggagctctttaatctgtgctagcagcgggtctagagaatgcggcagatctcgtcggtgcgtcagggcctggccggggcacggtcggtggggagggacagggacagggacagggaccggaaagggaacggcgcaggcgaccgcaagaccgccgtgccggcggtgctgcggacgtcgggcaccctgtggggcgacggctcggacacgttcgccgccgtctgctcgcggcgcggcgagaaaggcatcaaccaggactgctccatcgtctgggagggattcgggtgccaggagggcaccatcttctgcggcatcttcgacggccacggcccgtggggccactacgtggccaaggtggtgcgcgactcgctgccgccgtcgctgctgtgccactggcaggaggcgctcgcgctcgcgttgctcatcgacga

SEQ ID NO: 58775 - DNA, 333 bp, Zea mays
  Clone ID: LIB3069-021-Q1-K1-B1
tcccacccacacgtacgcgtccgaaatctctaaattaaaataaaaattttaaattttaaaaaaaaaaaaaaaaaaaaaagaaaagctaaaaatcaaaaaacgccatctctcaacaacaacaaaaacataaacatatcacacaaacaaccaacgcaccccctcaccaaaacccctccatcccaccccatcaacccacctactccttccaaaaaatgcacccactaaacccatctcactccccatcacttcacactctctataaacccaaaaaccaacagttacccaaacaccataaatcactacaccttcccttacttcccactttctacataa

SEQ ID NO: 58776 - DNA, 405 bp, Zea mays
  Clone ID: LIB3069-021-Q1-K1-B11
cccacgcgtccgaaaaaaaaaaaaataaattaaaaaaaaaaaaaaaaaaaaaaaaagaaaagaaaaaaaaaaaaaaaaaaaaaaaaaaaaaaaaaaaaaaaaaaaaaaaaaaaaaaaaaaaaaaaaaaaaaaaaaaaaataaaaaaataaataacaactaaaaacaaaaataatggtacaatgacaactgcatatgaaattacttaaacacataatatctgatgactgaccctcagccaatgactgaaaatttggcaaggctaacacctttaacatcattcctaacaacaccggtgctaacaaagcttttggaaaagtgcttcctaatctgaatggcccgctcactggcatgttctaaaaaattcctactgtggatgtctaaattgaacacctcactttcagaat

SEQ ID NO: 58777 - DNA, 85 bp, Zea mays
  Clone ID: LIB3069-021-Q1-K1-B12
gaacatttatactattgagtgattgattttttattaaaacaaaaaaaaaaataaaggtaaggaaaactaaaacacataaaaatga

SEQ ID NO: 58778 - DNA, 425 bp, Zea mays
  unsure at all n locations
  Clone ID: LIB3069-021-Q1-K1-B2
cccacgcgtccgcccacgcgtccgcccacgcgtccgcacaaccagaagccacccattggcgtacgcgaggcgatcggagcatcccgtcccaagaggagaaactccggccggcgacgcgggggaaaatggggaagacgccggtgcggatgaaggcggtggtgtacgcgctgtcgcccttccagcagaaggtgatgccggggctgtggaaggacatcaccaccaagatccaccacaaggtcaccgagaactggatctccgncacgctcctcctcacccccgtcgtcggcacctaccaatacgccatgtggtacaaagagcaggagaagctttcccacagatactaaatgggatgtcctccaagttgctgcggcttgtcgcagttgaattttccatgatgggttgtataatctgtcaatgtcatttct

SEQ ID NO: 58779 - DNA, 387 bp, Zea mays
  Clone ID: LIB3069-021-Q1-K1-B3
gacccacgcgtacgcggatcgtcacccgtgcaattgtcaatactctagttttcctccgtattgccccagcaggcggcatgggagcctacaacgtgctgatgagtgcctctgatggccttctaaaaggtggccgggaaggtatcttcacagcgaccttcttcgtcctgggccgcaagcctatcaaggaagctgatatggtgaacggcggcgtcctttgagctgcaacattagtatggggttgtactcataagagctatgaatcatggccaacgtgttctgagctgatgtgtgattactgggttgtcttatgggtactgggttatgaatcatgttcccgcattagccctgatctgaatgtgtgctgtgtactatgcgctatctgaataa

SEQ ID NO: 58780 - DNA, 453 bp, Zea mays
  Clone ID: LIB3069-021-Q1-K1-B4
cccacgcgtacgcacaattgttgtggtacgtacacgtgggtgctacgtcagaactaatggcttgatatatcgtgcaaaccctgctctagataaaaaaaaaaacaaataaaaagaaaccaaaaaaaaataaaaaaaaaaaaacttaaaaaaactaaaacaaaaaacctatcaaagaaactgatataagaaaacgaaggcaaactttgaagcatggaacattagtatgggattgaactcataagagctatgaatcatggccaacgtattctgtgcttaagtgtgtttactgggttgtcttattcgttatgggttatcaatcatgttaccaaactaaccactatctcaatatgtgctgtgtactatgcactatctgaataaaaatgcagaattactcctaaaaaaaagagtcctctaacaatgacatttcttaaattaggtttagtttaaaccatt

SEQ ID NO: 58781 - DNA, 372 bp, Zea mays
  Clone ID: LIB3069-021-Q1-K1-B5
acgcgtgcgggaagatctccagagctgaatacagatgctctcgctccttctccggtgagctgaaggacctgcttttcagaatgctcgatccagatcccagtaccaggatatccatttcaaggatcaagagaagcacttggtacagaaaacctatcgaggcaaacgcggcaaagatcaagcacggcacagcaagagacaccaccgtgcgtgacggtgaagccgccacggcctctagctcgatagagtgcagtaaccgggcagaggaagaccaagggtcgtcgagccttcctaacctgaacgcattcgacatcatttctctctcgactgggtttgacctatctaaccttgtcgaagaaagacacgggcggaagg

SEQ ID NO: 58782 - DNA, 342 bp, Zea mays
  unsure at all n locations
  Clone ID: LIB3069-021-Q1-K1-B6
gggtggtcaggtggctggagtgtgagggctatattgagacaaacttcaggatgaagtttgttacatggtttagcttacgtgccaccctgcaagagagaaagatagttagcgtatatgtggatactcttatcgaggaccctgtcagtctctctggccagctcgtcgacagcttctcggagaggatatatagcanaaagcggacttccatgccttctggtttctgcatggatctgtggcattaaggaactgcagggtcttaccgttcgctttgtagggagcatattcggcccattcttttgttgcagatcgttgcattgattcttcattggaaatttagctgaa

SEQ ID NO: 58783 - DNA, 216 bp, Zea mays
  Clone ID: LIB3069-021-Q1-K1-B7
tacacctacgcgtatcgagagcccatgctgactcaatgcggtcacttcttctgctggctgtgccagtaggcgtcgtttgacattactgcgcattcatcagagcgtctaatgtgcaaggctcttgtggacgaagacaatcttgtacccctttattgacgcggcaaggatcgtgttgacccaaaggcaaatgacatgcccaacggtgacattccttaa

SEQ ID NO: 58784 - DNA, 346 bp, Zea mays
  Clone ID: LIB3069-021-Q1-K1-A12
gtcagcattcaggttggagctcaggttgtgtattctaagtacgctggaaccgaggtcgcgttgaacgatcacagccatctggttctcaaagaggatgacgttataggtatcttagaaactgatgacgtgaaagacatgaagcctctgaacgaccgtgttctaatcaaggttgctgaagctgaagacaaaactccaggaggcctactgcttacggaaactgccaaggagaagccatctatcggaacggtcgtagcggttggcccaggccccctggacgaggacggcgagaggctcgcgctgtccgtctccgcggggagcactgtcctgtactccaagtacgccggca

SEQ ID NO: 58785 - DNA, 374 bp, Zea mays
  Clone ID: LIB3069-021-Q1-K1-B9
cagtactatagcagagatgcttcccactgtatcactgatcgttgatcagtgttccaatattttggcaagtgcagctttgaataaattgaacagattggcctcgtggccattttcctgtatttatctgtagtcaggtccaattcttttctgttggtgagcgcaagttattcatagatgactcggtcatgggaatatttgtaatattatgtcatgtatcgttaaatttcagttgttttgtttcagctgccagaactgttagcaagagtattctggagctggaagctcgaacgcaactggttgtatctatatccgtgaatgccgaataaaggaggggcaataaactgcagcgaaatatgtgctgtcagacattgttg

SEQ ID NO: 58786 - DNA, 389 bp, Zea mays
  unsure at all n locations
  Clone ID: LIB3069-046-Q1-K1-A6
cgccacgcgtnccgtccattattgccgtctcccttttgcgtgagcaaaaaaagaaaacgagaagagcaatccccatgtctggcatcatccacaagatcgaggagaagctccacatggggggcgaccacaagaaggaggatgagcaccacaagaaggccgaggagcaccacaagaaggaggagggggagcaccacaagaaggacggcggggagcataaagaaagcatcgtggagaagatcaaggacaagatcaccggcgagcacggcgacaagtccggcgaccacaaggaaaagaaagacaagaaaaagaagaaggagaagaagaagcacggcgagggccacgaccacgaccacgacggcggtcacagtagcagcagcagcgacagcgac

SEQ ID NO: 58787 - DNA, 211 bp, Zea mays
  Clone ID: LIB3069-046-Q1-K1-A7
tgatgctctttgtgtggcaaggaatctgatccggaacaactcaatcgtgtacggcggtggctcagcagagatatcttgctcaattgctgttgaaactgctgcagatcggcaccctggagttgagcagtacgctatcaggtcattcgctgatgcattagatgctgttccactagccttggctgaaaacaagggtttgtcgccaattgatacc

SEQ ID NO: 58788 - DNA, 311 bp, Zea mays
  Clone ID: LIB3069-046-Q1-K1-A8
actagtgcgagattaatatgcttattaggatgagatggatccatgaagataagacggaatctcttgcggttagcaagatctattaggatatgatagaatcttattgaaataagatggatctattaatattagaaagactattgtctgataagatgggtctattgaaataagagagaatcttttaagaatagaaggatctatatgaaatagatgatctccgctgtttaggtatcttatggactctatctatgattatatgtatatgcacatgtaattatggacattactccacaacccatcacactcaatta

SEQ ID NO: 58789 - DNA, 397 bp, Zea mays
  unsure at all n locations
  Clone ID: LIB3069-046-Q1-K1-B1
ggcgcgacaaaaagggcgccgtgccccctcatcgcccccgacgccggcatctggccctggctctccttctcccgatctgatccgaagcgcggcgtcnacgacgacgacctaagggcacgatgcattcgaccaacctgctgctggaggagcccatccggatggcctccatcctggagccatccaagaccagtttcttcccggcgatgaccaagatcgtcggcacgctcggccccaagtcgcgctccgtcgacaccatctcctcctgcctcaaggccggcatgtccgtcgcgcggttcgatttctcgtggggagacgccgcctaccaccaggagacgctcgagaacctcaagctcgccatcaagtccaccaaggagctgtgcgctgttatgcttgacac

SEQ ID NO: 58790 - DNA, 340 bp, Zea mays
  unsure at all n locations
  Clone ID: LIB3069-046-Q1-K1-B10
gactgcattacctgagagcattatcctttagcaagtgtcagctgctnttaaggctttcgtgactggtgacctgcgacatgaactnattgagcttcttgaaaagattgttcttcagaattctgctttcagtggaaatttcaatctgcagaacctgctcatcttgactgctatcaaagcagatccatccagagtcatggactatgtcaacagacttgataacttctatgggcctgctgttggacaagttgctgttgaatcacaactgtattaagaggcttttgctatattcaagaagttcaacttaaatgtgcatgctgtcgattttctcttggacaacatc

SEQ ID NO: 58791 - DNA, 321 bp, Zea mays
  unsure at all n locations
  Clone ID: LIB3069-046-Q1-K1-B11
ccggcccgacgcacgcgtccgcccaccccttcgaccaaatctttatatctttctagctatcagcctttcangccgccacggtgcattctgcagctctctcgactncacactanancgagcgagctgccacagacaaggacacaatgccacccatacccaagagaggcgagcatctcctggtcctcctagttgtcgcatgcgctgccaccgccgccaccgccgtcggcaccgtccccttctacccgtccgcggagtcctctcccgccgctcactgctacggcactctttacccggagctcttcctgtccacactcgcataca

SEQ ID NO: 58792 - DNA, 373 bp, Zea mays
  unsure at all n locations
  Clone ID: LIB3069-046-Q1-K1-B12
actagttctagacgcagaaaaaatgattgaggagcttaaatcanagatagctaatgcgcaaaaggtcgaggaagacatccgtcagcagttagaagaatggaagcagaagtcagtatcacttgagatgaaattggaggaagttactctatctgagaagttcaaaagtgactcacttgtttccacgactgaagagctgtacaagatccagtcgatattgcaagatcgagaatcggaaattgaagttcttaaaggaaagacaactgccttggaaatcgaggtgacaaggcttttagcagatgtgactgattcaaatgagcatcttgatgcatcacagcaagaggtgtttgggctgcagacaacaatagatgttctg

SEQ ID NO: 58793 - DNA, 317 bp, Zea mays
  unsure at all n locations
  Clone ID: LIB3069-046-Q1-K1-B4
cgttcgccacgcggttcgccacgcgttcgacacttatagcaatggctggctacctcaacaaaatcgggctggtctcttggttcaatgggactggtgtgaaatttggtggaaggcttggcatgtcatggcaactctcattcngggggctggtgctgctgtacttctactcgcactatttctttggcagtggggccgcacacatcggagcaatgttcaccgcgttcctgtcgggggcgagtgccctgggcaccccgtcgcttttcgctgccatggttctttcattcctctcgaacctcatgggcgggaccacccactac

SEQ ID NO: 58794 - DNA, 332 bp, Zea mays
  Clone ID: LIB3069-046-Q1-K1-B5
cggacgcgtgggggctcatgctcaggttattcaatcactctgcctggaggaaaataatgggcaaggggggtatccatatggtccaaggttcaactccctgacttattttttcactaagactcaaggattcgaaattgaaaccatgctttctcccttgacgatgaaacttccaggggttcggtgggaaatgcaagtacctggaagagagcaagtgccttggcatttgcatcaacacatgcaaactgcccactcagactttcttcaaagatcacatgggtgttgatttgtacatggagccaaattttgaagactatagctgccagttcaacttc

SEQ ID NO: 58795 - DNA, 151 bp, Zea mays
  Clone ID: LIB3069-046-Q1-K1-B6
tagttagctactacttcaatgtcttcatgttgaggaagagggctgagcagaacaggttcgacccagcgaacattgacagtgactactattagtggcaggcaggtggtgattttgagtttccaataaacacgaataactgatgaatacaatc

SEQ ID NO: 58796 - DNA, 254 bp, Zea mays
  Clone ID: LIB3069-046-Q1-K1-B8
gaaaggctgacaacaacatatgacgacacagattccatgcaagggacatttaacactaatgcacagatgcacgtaggaagaaataatcagcaccttataaacggatgcaacgggaacccagcaacgttacctccgactgaactatcagtactggaagactccacgtttaaggtcgttcgcttgtcgcctgaagagagaaaggaaaagatccataggttcataaagaaactgaacgagagaaatttcctccaaaa

SEQ ID NO: 58797 - DNA, 322 bp, Zea mays
  Clone ID: LIB3069-046-Q1-K1-B9
gggcttggggaggctcgtgacaagtgttcttaagaaaaatctaaccaatttcagctgaataaactaagtgatgagatttcaatgctggagaaaacgctctcggggctccaacagtcagtaggattctgccataacgatctgcagtatggaaatattatgatatatgaagagaccagacaagtcaccttgatagactatgaatatgcgagttttaacccagtcgcattcgacattgctaatcacttctgtgagatggctgctgattaccatacatcaacaccacatgtgttggattttacgaaatatcctgacactggggagc

SEQ ID NO: 58798 - DNA, 399 bp, Zea mays
  Clone ID: LIB3069-046-Q1-K1-C1
gtgatgggaacgtttggctacgtggcgccagagtacgctagcaccggcatgctgaacgagaggagcgacgtgtacagcttcgggatcctgatcatggagatcatctccggccgaagccccgtcgactacgccaggcctgccggagaggtaaaccttgtagagtggctcaagaacaaggtgaccaacagggactacgaggccatcgtggacccgaagctgccggagaagccgtcctccaaggctctcaagaaggcgctcctggtcgcgctgaggtgcgtggatcccgactcgcagaaacggcccaagatggggcacgtaatccacatgctcgaagtcgacgacttcccgtatcgagaggaccgtcgaactcttcggccgggcaacggcagccccctggag

SEQ ID NO: 58799 - DNA, 398 bp, Zea mays
  unsure at all n locations
  Clone ID: LIB3069-046-Q1-K1-C10
cagcaaataaggagtctaggaaacccgatgacggccactggactcctctcacggactacagcaagtcacggtcgaacacctcancgaagacagcgaccacagggagccgtacatcaacgttgccatccaatctgtgccgccatttctcgtttggcgagatccaggcggccaccaagaacttcgaccaagcctctctcctcggtaaaggcggctttggaaacgtgtaccttggagagatagacagtggcacgatggtggcgatcaagcgcgggaacccgacgtctgagcagggcgtccacgagttccagacggagatcgagatgctgtcgaagctccggcaccggcacctcgtgtcgcttatcgggtactgcgacgacatgaatgagctgattctagtg

SEQ ID NO: 58800 - DNA, 403 bp, Zea mays
  Clone ID: LIB3069-046-Q1-K1-C11
gattcacaagaagtaaacagcttagcatggtgagggatgacatccaatggaaacgtaaaatgtacacgaaagctctaatagaaaagataagcaacttgtaccagatacgcacaacaaccaatatgtagatgtacaacgtgaaaattcttatgtcagaacaatcagaagtacaaatatcaaggccttctgattctggccgttctagtttcattacaagagaagtgttcacataatgtgattcatagacagcttctgcaatttctttaatcctggcaagttttcagttagcaacagtaagtccatatttggttatttttatttttatgttattttatttaattatttttattttttttttttatttactttatgtttattttttttttatttttttttttttttt

SEQ ID NO: 58801 - DNA, 378 bp, Zea mays
  Clone ID: LIB3069-046-Q1-K1-C12
atgaattttagtgagaatagagacaagtggtgttgtgtaatggcacttgtaaagagagacagtacacctagggttggtccattgatgatgaacctctgtgcaaactttgtcaaggactttgcaatggaaggcttgcagagtcaacataatattttgaagatctattatgtggtctagcttgtttctaggaatacagattaagaaccagtggtagagccctacggcagttgagtcttctttttgttactcacataagtcaacattttttgttgtttccattgaatagttaggactattttcagttattcaaaatcaaagaaagttgcaagttaattcatatatatgtaataaaagttcttggtaattatctataagcac

SEQ ID NO: 58802 - DNA, 186 bp, Zea mays
  unsure at all n locations
  Clone ID: LIB3069-046-Q1-K1-C6
actcggcatcccctccttcgtcgggccagccattgttccaagccacatgatcacattctggctctggattatactccgtcagggggaggctatcgagacacatancggctttgattttccattcaccccgacaaaatatattccattctatggaggagcagaataccatgactatcatcattatgt

SEQ ID NO: 58803 - DNA, 365 bp, Zea mays
  Clone ID: LIB3069-046-Q1-K1-A5
tcggccacgcgttcgcaaaagggacgaccaccaacggcgggcggggaggaaggttaaaccctaattggcgttcggcggggacgccaagacgatgggccgcttccaacgggccattaacggtttcttccccgaccggcacctttttcaagtggagtacgctcttcaggccgtccccaagggcaacgccgccgtgggcgttcgcggcacggacaccgtcgttctcggcgtcgagaagaaatccacacccaagcttcaagacttcaagtccgtgcgcaagatcgcgtgcctagacactcacataactctggcgtgcgcggggcttaaggcggacgcgcgcgtgctcattaaccgcgcgcgggtcgagt

SEQ ID NO: 58804 - DNA, 269 bp, Zea mays
  Clone ID: LIB3069-046-Q1-K1-C8
ttaaccaatttcaacttaataaactatctcattaaaatacacagcttaataaaactctctagtatctccaacatacattattattctgccataacaatcatcactctttaaatattatcatatattaatagaccatacaatttaccttaatatactataaatatcctaattttaacccaatcttattccacatttcaaatcacttatgtgaaatatctttttattaccatacatcaacaccacatttttttatattttactaaaatatt

SEQ ID NO: 58805 - DNA, 306 bp, Zea mays
  Clone ID: LIB3069-046-Q1-K1-C9
ctacgcctacaacatgcgcaacacgatcaaagacgagaagatcgcgtccaagctggctgccgacgacaagaagaagatcgaggacgccatcgacgcggccatcagctggctggacgccaaccagctcgccgaggcggacgagttcgatgacaagatgaaggagctggagagcctttgcaaccccatcatcgccaagatgtaccagggcgcgggtgccgacatgggtggcgccggcggcatggacgaggacgctccggctggaagcggtggccctggccccaagatcgaggaggtggactaagcgga

SEQ ID NO: 58806 - DNA, 411 bp, Zea mays
  Clone ID: LIB3069-045-Q1-K1-H1
agcaagtaatatggcttggtcttgtgctcgttcgatgagcatcgccctcgctgccgtcctcctgctgtgcggcggcgcgtggctgcagcaggcggcggaggcgcgcccccaccacatggacaccgacagcagcatcgacatggaccgcggcagcgacgacttcttctccatcgtggggtactcgccggaggacctgacgcagcacgaccggctcgtcaggctgttcgaggagtgggtggccaagtaccgcaaggcgtacggcagcttcgaggagaagctgcgccggttcgaggtgttcaaggacaacctgcaccacatcgacgaggccaacaggaaggaggtcaccagctactggctgggcctcaacgccttcgccgacctcacgcacgacgagttcaaggccacatacct

SEQ ID NO: 58807 - DNA, 430 bp, Zea mays
  Clone ID: LIB3069-045-Q1-K1-H10
gcgcaggccgtcatgaagcccattctcgttttcctggcgcagaccgggtcgtacctcatggtgaacgcgtacccgttcttcgcttactccggcaatgcgggagacatctccctcgactacgccctgttccgccccaacgccggcgtgctcgacgccgggaacggcctcaagtactacagcctcctcgacgcgcagctggacgccgagttcgccgcggtcagcaggctcggggagggctacaacgccgtgcgcgtcgtggtcttcgagacggtgtggccgtccaagggcgacgccaacgaggcgggcgcttcagcggccaacgcctcggcgtacaacggcaacctggcccgccgcgtgctctacggcaacgcctgcaccacgcgccgccccgacgccgacatcgacgtgtacctcttcgcgctcttcaacg

SEQ ID NO: 58808 - DNA, 329 bp, Zea mays
  Clone ID: LIB3069-045-Q1-K1-H11
gcctgctgctcgcctctcgattttccctttcggacatgtgctttgtgcgagttggttgatggttaatggttaatggctaggaactggtgcttaatcctgaaacccgtactgctgtttttcttgccaactgtggcatcgtcgtcttgtggctgcgaagctgcagccacctcgttcgtgtatggcggcagatgagacaattcataatctaagtatatagatataaatagtagtattaccggtttgtttgcatttacgatttatcgtgaactgatggaacataatgtgtatacagcgaacatttatctgattccatacatttgttgtttaac

SEQ ID NO: 58809 - DNA, 433 bp, Zea mays
  Clone ID: LIB3069-045-Q1-K1-H12
cccacgcgtccgcccacgcgtctttccattcgtccgcccacgcgtccggcacctcctagggacacactgagaaaacctggagtgctgcaatgtagtgccaaagagaaggtccttgatcctaagaaggcacagaacattgccatcctgctgcgcgcgctgaatgtcactccggaagaggtctccgatgcactgctagatggcaatactgaatgtctgggggcggatttgttggaaaccttggtaaagatggctcctacgaaagaggaagaactgaagcttcgaaactttaccggggactcatcgaagcttggttccgcagagcggtttctcaaggcagtgcttgacatacctttttctttcaaaagagttgatgctatgctctatcgagcaaattttgagagcgaaatcaattacctcaggaaatctttcgaaa

SEQ ID NO: 58810 - DNA, 422 bp, Zea mays
  unsure at all n locations
  Clone ID: LIB3069-045-Q1-K1-H2
tttcatatggtgggtgctaatctaatattttactctcgccgttctgactatgtattttccaggtatcgaacacccaaagatggcaatggcaaccttcacatcatccccagttctctgcagcttcaggaccatcgaacagaagaaggcccctctgctgaacaacagcacaaaacggccgcttcacttgggcttcccaaggagcgtgccgacgtcgccgagcttcagagcgaggctagacctgcgcgtcgccgctgtctacaaggtgaagctcatcggccccgaagggcaggagagcgtgctcgacgtgccagaggacagctacatcctggacgcggccgangaagccggtctcgacctgccctactcctgccgcgccggcgcgtgctccacgtgcgccggcaagctcctggagggctccgtcg

SEQ ID NO: 58811 - DNA, 368 bp, Zea mays
  Clone ID: LIB3069-045-Q1-K1-H3
cctgcccaagaagaccgttgagaaggcggctgccatggaggccaagtcgcccaagaaggccgctaagtcccccaagaaggcatagaggggcgcctttaccgctgtgatgttgaatgctcgtgttcagtagatctttacttctgtagtgtcgtcggtgttattggaactggttagtagatctgagcattgtggttgaaacgtgattccctgatttcagaaatctaatttgcaaataaaaatgaacatcaacaatgaatacaaggagaaactaatcggtacatgaaaggaatgatagagtgctctacgtgccaaaagaacatatacatactggacgcatgcgaaagaagaaagggtcgtcctttttaaat

SEQ ID NO: 58812 - DNA, 437 bp, Zea mays
  Clone ID: LIB3069-045-Q1-K1-H5
cccacgcgtccgggtgcagctaagggcttatagtaccttcacgacaaggcgagtcctcctgttatttaccgggattttaagtcgtcaaacattcttcttggagaaggatttcatccgaagctatcagactttggccttgcaaaacttggcccggttggtgacaagacccatgtttcaacacgtgtgatgggtacatatggctactgtgccccagaatatgcaatgactgggcagctcacagttaaatccgatgtgtatagctttggagtcgtgttccttgaacttatcacagggcgcaaagcaattgacaacaccaagacccaaggggagcaaaacctagtggcatgggctcgtccactgttcaaggaccgcaggaaattccctaaaatggctgatccaatgcttcagggccgcttccctatgaggggtctatatca

SEQ ID NO: 58813 - DNA, 416 bp, Zea mays
  Clone ID: LIB3069-045-Q1-K1-H7
cccacgcgtccgcccacgcgtccggtctttttcaagactaatgctgatgggaacacaacatgtgccaaggaaatgacaaagctctctggcatctctgaaatcatccccgagatggagatctgcgattttgactttgaaccctgtggctactccatgaatgcgatccatggctctgcattctccacaatccatgtgacgcccgaggacggtttcagctatgccagttatgaggttatgggcttggatgccactgctctgtcttatggtgaccttgtcaagagggtccttcggtgctttggcccctcggagttttccgttgccgtgaccatcttcggcgggcgtggccatgccgggacatggggaaaggcacttggtgcagaggtctatgactgcaacaacatggtggagcaggagct

SEQ ID NO: 58814 - DNA, 367 bp, Zea mays
  Clone ID: LIB3069-046-Q1-K1-A1
tcgggaaggggcacggtggaaagttgaaaacttgaaactcagcggagcccctcggcttttcatcttctcctgctcctgctgcccggtagccccccgagggagacgctgctgacctgacgaactgagcccacggacgagaaggaggggcacaccacgcaggagacctggagagagcgcgcgcgcggatccacctcgtatacactctcctcttcttctccgtgtccttggctcagatttagttgctgcgccgcttcttaggattgattgctgcttcacccagtgatcgcgtcgtcatcttcgcgtttgcttaatcgcctggttgctgcatccgttttttttttggtgttgtgtggttgggggtgccggc

SEQ ID NO: 58815 - DNA, 292 bp, Zea mays
  Clone ID: LIB3069-046-Q1-K1-A10
gccacctcgccacgcgtttccattctcgcataaatggcctatatgctagcgctatttgcaccttgcagtaagtcatggtttcaagacctgcatatttgcgagatggaccttgctttgcttgcttagagatggtgcaagatttcctatcaagtgagctgggcagcgagcattatcaactgacaaaggtttcggatcccttttgtaataaagaaactgatgatccgcatactgagcgcggattaatgtcctttgatgttatatatgacagaatatagaaatagcagatgttagc

SEQ ID NO: 58816 - DNA, 366 bp, Zea mays
  Clone ID: LIB3069-046-Q1-K1-A11
cggacgcgtgggctgcgtgcatggcgctagcgcggagggcacgcccaagaggctgacctacgactagatccagagcaaaacgtacatggaggtgaagggcacgggcacggcgaaccagtgcccgaccatcgacggcggcgtggagtcgttcccgttcaaggccggcaagtaccagatgaagaagctgtgcctggagccgacgtccttcaccgtcaaggcggagggcatcgccaagaacgccccgcccgagttccagaagaccaagctcatgacccgcctcacgtacacgcttgacgagatcgagggcccgctcgaggtcggcttcgactgcacgctcaagttcgaggagaaggacggctttgacta

SEQ ID NO: 58817 - DNA, 384 bp, Zea mays
  unsure at all n locations
  Clone ID: LIB3069-046-Q1-K1-A12
cccacgcgtccgatgagcagacttgttgttatattcttcaatggagttatgggtgctattgtangaaacacagctggtccaggtnattcttttcccagtcaaccaccgctatggcctaggggcttcattcagcagcatcctttggattgcaacatgatgagacacattaatttttctaatgcatcctatggtccaacaacaatgtgggctcccattcagacaggaaatataagttccgaatcaaccatgctaccagccacacaatctgcagtatattggaatcattatatgaactttgtcaggaatcctcttggttcagttcgaggaaatccttttccagattcgttttcaggtacaaatactagtacacctttgcagggttcg

SEQ ID NO: 58818 - DNA, 366 bp, Zea mays
  Clone ID: LIB3069-046-Q1-K1-A2
ctgacaagcacactgacttggctgaaaaatatggtgtttctggtttccctacattgaagttcttccctaagggaaacaaagccggtgaagattatgatggtggccgggacttggatgactttgtcaagttcattaatgagaagtgtggcaccagccgggatccaaagggccacctgaatcaagaggctgggcttgtgccaagcttgaatcctcttgtgaaggagtttctcaatgctgctgatgacaagcggaaggaagtcctctctaaaatagaagaggatgttgctaagctcagcggttctgcagccaagcatggaaagatatatgtgacagcttgcaaagagatcatagacaagggctttgact

SEQ ID NO: 58819 - DNA, 375 bp, Zea mays
  unsure at all n locations
  Clone ID: LIB3069-046-Q1-K1-A3
cggacgcgtgggcgccagacttcgcagttctcctccactaccagagcatgcgcgttgccgcgacccgagccgccgccgccgctcaccctccgagcgccttcctgctcctcctcgtactcctctgttgcgcgtccctcgcgatcggaggagcagccatggccggccacgtcctcggcggcgtgaaggagaacccagccgcggccaacagcgccgagtccgacgggctcggccgcttcgccgtcgacgagcacaacaggcgcgagaacgcgctgctggagttcgtgcgcgtggtggaggccaaggagcangtggtggccggcacgatgcaccacctcacgctcgaggccgtcgaggccgggaggaagaagctctacg

SEQ ID NO: 58820 - DNA, 334 bp, Zea mays
  Clone ID: LIB3069-045-Q1-K1-G9
gcgtttcctccctccgcgcatcgtttccttcctcaccctgtgcctcagatctcgcccacctggtagactcgccactccgtccgcctcctccccgcctcgatcgccgtcgagctcctctcccccacgcttgactaaccccacctgcgcttggattggtggccagggagaggcgcggaggcgacgcgcccagctacctaccggttccatactctgaagtctgaactggcctcagctgttccaccacctcgctgttcttggcccagctgctctgctcttgtcgagggatgatggtccagtgctcctccaacaaggctccacaccgacattgagctac

SEQ ID NO: 58821 - DNA, 430 bp, Zea mays
  Clone ID: LIB3069-045-Q1-K1-F12
cccacgcgtccggagagccatggtatcctggccgtcctcttcttggctctcaacctcctgttcttcacggtggccaacgcctgcggcagctgcccgaccccaacgcccccggtcgagccaccgccgccgcctcctgctgctaccccacccccttcgtccagcggcaagtgcccgctgaacgcgctcaagttcggcgtgtgcgccgatgtgctcggcctcgtcaaaggcgaggttggcaaggtgcctgccgagccgtgctgtaccctcatcaaaggccttgcggacttcgaggccgccgtctgcctctgcacggccatcaaggccaacgtgctcggcgtcgtcatcgatgtccccatcaagctcagcgccctcgtcaactactgtggcaagtgcgtgcccaagggctacttgtgcgcgtaagcagctccgc

SEQ ID NO: 58822 - DNA, 436 bp, Zea mays
  Clone ID: LIB3069-045-Q1-K1-F3
gttcatagatttgtccaggctgactgatgtctggaccatacaatacttttgcattcaggcaaggactcgagaggaagagattacgtatgttatcggtgccgctagctgttgtttatgatgatgttttgttgtgctagtttactgtgatgctggtggtgcccccacctaactaacaagagagctgtcacttgcagactcttgaattttttttgtcctagcgccatttctttagcggtatcaagtcaatttatataggcttacaaattctgcgccttttgtatggccaaagtgtaatattcttgttcttgtattatgaacctccatgctgcagaatgcaagagcaaatcttattgtcgatggtgttctcattgccagcatgtgtacacagtagcggttcatgttgttttgagctgttctgttttaataatatctcaaa

SEQ ID NO: 58823 - DNA, 423 bp, Zea mays
  unsure at all n locations
  Clone ID: LIB3069-045-Q1-K1-F4
cccacgcgtccgccttgctgtgccatggctctgccttgcttcttgggcagctctgctaccagcgctactagcatctggaaatgtgggtgcagcagcttcgacactgagagcagagtacatgaatttgaacttcagcaccgcttcggcgacccccgacaagtacaagagcttcatcgcttctgttcgtgctggcttggtgagcaaagcggggggcaacagcagcgggatccccgtgctggtcgacgaagacgacccgctcgcgctcgagtcgtttctaaacatcactctggtgaacaaggcagggcgctccgtaagcttgaagatggatgtctccagagcctacttcgtggcttacgtagcanggcagcgctcgtgccttctcaagagatcaggccgcacgttctcgtcggcgatctgttacta

SEQ ID NO: 58824 - DNA, 380 bp, Zea mays
  unsure at all n locations
  Clone ID: LIB3069-045-Q1-K1-F5
tcgcggacgcgtgggcgcctgtgaaagttcggatccgacggcccgttcagcttcctctgcggcgtccgttccgaagggcaatagttttcaagtggcaatggcggaccatgctaaccaacccactgtgcttcataagctcagtggccagcttcacctgcgctcgatcatctttgaaagtgtactggcccgtaacatatgcccatctgtctcatcttatgaaacgagatttgccacaaggaactacatgacccatagcctttggggcccttcaatgtctgttagcggcggcatcaatgtcccagtgatgcagaccccgatctgtgctaatgctactgctgagaaaggangccaagaacctcatgattgatttcatgaatggc

SEQ ID NO: 58825 - DNA, 446 bp, Zea mays
  Clone ID: LIB3069-045-Q1-K1-F7
ctctccttttgctcggaacgcacacaccgtccggtccccgttctccgatcccctcgtcgatccaaagatgcagatcttcgtcaagaccctcactggaaagactatcaccctcgaggtggagtcttctgacaccattgacaacgtcaaggccaagatccaggacaaggagggcatccccccggaccagcagcggctcatctttgctggcaagcagctcgaggacgggcgcacacttgccgactacaacatccagaaggagagcaccctccaccttgttctccgcctcaggggaggcatgcagatcttcgtcaagaccctcactggaaagactatcaccctcgaggtggagtcttctgacaccatcgacaacgtcaaggccaagatccaggacaaggagggcatccctccagaccagcagcggctcatttttgccggcaagcagctcg

SEQ ID NO: 58826 - DNA, 436 bp, Zea mays
  unsure at all n locations
  Clone ID: LIB3069-045-Q1-K1-F8
cccacgcgtccggctcgctcgtcccagcttatcaggtcgagcacctagtagcgacctgctcgatcatcagtgtagagtgtcggtaggtgtctgtctctcttggtggctggttgcaacggtcatggcgacgtcgtctcgtcgggtgcccttgctgctgctgtgcctgggcgtgctggtgtcctgctccttcgcggcgggcagcttggaccaggagctggacatcacgtggggcgacgggcggggcaaggtccttgacaacgggcggctgctgacgctgtcgctggaccgcacgtccggctccgggttccagtcccggcacgagtacctgttcggcaagatcgacatgcagctgcggctggtgccgggcaactccgncggcaccgtcaccgnctactacctgtcgtcgcagggcggcgcgcacgacgagatcgacttc

SEQ ID NO: 58827 - DNA, 413 bp, Zea mays
  Clone ID: LIB3069-045-Q1-K1-F9
gcagtacagcagcattatcagggttcgtgtcgtgggagtgggaggttgcctcaggtgcggagcagtcgccggcggcgaccatcggtgtctgagatgaaggagagaggcggctccagggcggcagtggacgagcgctacgcgcagtggaagtcgctcatccccgttctctacgactggtttgccaaccacaacctcgtttggccatccctctcctgccggtgggggccacagtttgagaaagctacctacaagaatcgtcaacgcctttacctatctgaacagaccgatgggagtgtgcctaatactctggttatcgcaaactgtgaagttgcgaaaccaagggttgcagctgctgaacatatctcgcagtttaacgaggaagcacgatcaccttttgtaaagaagtacatgac

SEQ ID NO: 58828 - DNA, 436 bp, Zea mays
  Clone ID: LIB3069-045-Q1-K1-G1
gcacaggcagttcgagagagagagagagagttagatagataaagatgtcgtggttcgggcaccaccaccacaaccagccggctcccccggcgtcgggccccaaccaggtgttcaagatcttctgccgcgccaacgagaactactgcctggccgtccgcgacggcgccgtcgtgctggccccggtcaaccccaaggacgaccaccagcactggtacaaggacatgcgcttcagcacccgggtcaaggacgaggaaggcatgccggcgttcgcgctcgtcaacaaggccacggggctcgccatcaagcactccctcggccagtcccacccggtcaagctcgcgcctttcagcccggaccaggaggacgcgtcggtgctgtggacggagagcaaggacgtgggcaagggcttccgctgcatccgcatggtcaacaacac

SEQ ID NO: 58829 - DNA, 341 bp, Zea mays
  Clone ID: LIB3069-045-Q1-K1-G11
aggaaggtgagttctctgaggcttgtgattacctggcggcgctcgagaaggactacgaggaggtcggtgctgagttcgatgagggcgaggatggcgacgagggtgacgagtactagagaagtttgctgatgacgcagcatcaggccagtgtgctgcccttatcccgtgatctgccgagagttgctcctgctatcgtgttatgtgtgtctgttctgaagtattgtgtggtttacaacacctgatgttgtaagagttgttaattcccctgcattgctaccgggttattgagaataattatggctgtttacgttgttgcttcatctcggagatgctttacattt

SEQ ID NO: 58830 - DNA, 423 bp, Zea mays
  Clone ID: LIB3069-045-Q1-K1-G2
gtgaaggatatgaaaccactgaatgatcgtattcttattaaggttgctgaagctgaagaacgaactgctggtggtttgctattgacgcaggcaactaaggagaaaccttctgttggatcagtggtagccgttggcccagggccgttgggcgaggacggcagcaggaatcctctgtcgatcactcctggaagcaacgtgatgtattccaagtatgcgggaagtgagttcaagggcgaggacggtgagtacatcgtgctcagggcgtctgacgtgatggctggtctttcctgatcaccaaaccatacagcgccaggtgtgcgataggaagttttgatgttgaggccgagccttatcttttatttgctcttgtttggaattgttggaggcttttgaactgtaatctggtgcgaattataaggaaaa

SEQ ID NO: 58831 - DNA, 440 bp, Zea mays
  Clone ID: LIB3069-045-Q1-K1-G3
cccacgcgtccgagaaaagaaaaaaaaggcttcgactagccgacgagagcaacgacgaccatggcgacgatggtcgcttcttcctgccacgggcaacttctcctgtttctcctcgtggccgtcgcgtcggcctgcctcggctccgcggcagcgcatcaagccggatctggagagggctacacgatagctggccgcgtcaagatcgatggcatgagcgtgaagggctttggtcttgcaacaaagacatcaaacacaaaagtgatacttaatggcggccagagggttacatttgccaggccagacggctactttgcattccacaacgtgccagctggaactcatctgattgaggtctcctcaattggttacttcttttccccagttcgagtagatatcagtgcaaggaatcctggttatattcaagcagcattgactgaaac

SEQ ID NO: 58832 - DNA, 248 bp, Zea mays
  Clone ID: LIB3069-045-Q1-K1-G4
cggacgcgtgggcggactcgtgggcggacttgagttttgacgcgtgggcggacacgtgggcggcgatctagtcggctgcgtgcggcgcagcgatagcggggcaaaaccagctgctgatcgtcgtgccgactttgacgatgctcggcgcaatgaaggcgccactagttagcgccacccgctggcacgcgctgttgaagaagaagtcatactcgctcacgggccagttgcgggccttcatcaagaagatc

SEQ ID NO: 58833 - DNA, 218 bp, Zea mays
  Clone ID: LIB3069-045-Q1-K1-G5
cgccacagacaacagcgaccgaggccacccagagccgaagcagcgcccggaccaaccaccgacgcaacggacgaaaccgcgaacagcagaaggctacacgacaacccgcccccgcaagaacgaacgcatgacccggaacgagcccaggcccacaacaaagacgaccaacacaaaagagagacctaaaggccggcaaaagggtacaagtgccaagccaa

SEQ ID NO: 58834 - DNA, 433 bp, Zea mays
  Clone ID: LIB3069-045-Q1-K1-G6
ccccagtgttcctgccaagccctacaactttaagaaggttttgggtggatttgtaggttggtcatgtgaattgcatcaaacagggagtcagggacgatattgaagttgtggctgtggatgacccttttgttgatgctaagtacatggccgttcgcaggatagaggtggtgaggcttctaagcatactaaatttctgcatcatgatgaatcatatgtgatttgtttcgattcaactggatagaagaatcagttgctgatttgatggagtcgcagcttgcttggcggacatagggtctgttgcatggattatggtttatgtgccagcgcccagtggtagacagtgtgattcaatgtgcttgctgttcatctgtccaaaactgctaaagtagcttctgaaaatggatgacatgctggacacttgctcactcggttc

SEQ ID NO: 58835 - DNA, 438 bp, Zea mays
  unsure at all n locations
  Clone ID: LIB3069-045-Q1-K1-G8
cccacgcgtccgcccacgcgtccgtccactcgtccgcccacgcgtccgcccacgcgtccgattcctatgtcaccttgaggaaaacataccaaagtagccttggtaacaacaataagagggttgagctctttgatatgggtgctggaagtagtgagcctgctgctgaggacaatattcaaatggcatcagccatgacaaatcaacaactcattgatacgggaaggaaccaaatggaccaaacagatcaagctattgaacgttcaaaaatggtcgtagcacaaactgttgagactggagctcaaactgctgcgacattaacacagcaaacagagcaaatgaagagaattggtaatgagctagatactgtccacttctcactgaagaaagctagccaactagtgaaggagattggtcgccaggttgcgactgacanatgta

SEQ ID NO: 58836 - DNA, 404 bp, Zea mays
  Clone ID: LIB3069-045-Q1-K1-F11
gagctcctgcagccatggcggtttctctgcttctcctcctcctgctgtccgtgtgcacagcctcagatgcggcgttctgcgtgtgcaagccgggcatgtccgacccgatgatgcagtcggccatcgactacgcctgcagcaagggggccgactgcgcctccaccaccaagggcgcgccgtgctacggcaacggcaacaaggtggccgtctgctcctacatctgcaacagctactaccagagccgcagcggcatgggcgccacctgcgacttcaacggcgtcgacaccctcaccggcaccgaccccagctccgggacctgcaagttcgcctccggccccagcagcgtacgcaccggcggcggcgctggtatgggcacccgcggagcatgcgctggcgtcggcggt

SEQ ID NO: 58837 - DNA, 337 bp, Zea mays
  Clone ID: LIB3069-024-Q1-K1-A4
cccacgcgtccggtggtgctggcggcggcgctggctgccatgtggtggcgtcggtgctccaagaccggcggtgtcgacagcctgccgccggggcctccgggttggccggtggtggggaacctgttccaggtgatcctgcagcgacggcccttcatgtacgtggtgcgcgacctccgggagaagtacgggcccatcttcaccatgcggatggggcagcgcaccctcatcgtggtcacctcggcggagctcatccacgaggcgctggtgaagcagggccccatgttcgcgagccggtccgaggacagccccacccgccttctttcagcgtcggcaagtg

SEQ ID NO: 58838 - DNA, 373 bp, Zea mays
  Clone ID: LIB3069-024-Q1-K1-A5
gggggacgggcagagcagagctgagctgatctgcctccaactccgacccacacccacggcacggcagtcggcagcagccagcgtcgagcgcaatgccctcttgtctgctgcctcctacctccccgcccagtctcactcacacgctcccacttccgagtctcgctcgcagcctgttctcctggggtccgatcggaggggggtgaggagatggagccagattcggcgacgacgaggctcgcattgctggcgctgcttctcctggcggcgcccgcccgcccggcctcggcggctccggtggaggatggcctgctcagcaatggtgactgtgagacggcaccaggcggcggtttcgtaagatctgcgtctgttgctg

SEQ ID NO: 58839 - DNA, 428 bp, Zea mays
  Clone ID: LIB3069-024-Q1-K1-A6
gggggacgggcagagcagagctgatctgatctgcctccaactccgacccacacccgcggcagggcagtttgcagcagccagcggcgagcgcagtgccctcttgcctgctgcctactacctccccgcccagtctcactcacacgctcccacttccgagtctcgctcgcagcctgttctcctggggtccgatcggaggggggtgacgagatggagccagattcggcgactactaggctcgcattgctggcgctgcttcttctggcagggcccgcccgcccggactccgcagctcctgctgatgatggcctgctcagcaatgctgactctgaaaccggaccagcctccagattcgtaagatctgcgtctgttgctgagggtgcatacgatatccctggttggacaatcaatggcacagtcgagctcatttc

SEQ ID NO: 58840 - DNA, 477 bp, Zea mays
  Clone ID: LIB3069-024-Q1-K1-A8
cttccccgccccctccgatggggaacccgtcggagctgtaccacaagatcctcaacatcccggaggacacctcgccgcacgaaatccgcgccgcgtacaagaacctcgtcaagaagtggcaccccgacaagcacccgccgtcgtccaggccggaggccgaggcgcgcttcaaggccatcagcgaggcctacgaggcgctcctggaccagcaggagaacaggggcgtgttcgagctgtgcaacgacggccgggcgggtgagaggacgcgcggcgccttcggcggcgccggcggcggcggtggcggaggaggaggaggcctcggcgccggcgtcggggcgcgcatggagaggacgcgcagcgacgggttctgcacgaggagcgcgcccggcacgccggcgagggagttcaagaaggtgtacagctccggcgaccccggcgggcgccgcgccttcggcgagttcttcagcttcatcgtgc

SEQ ID NO: 58841 - DNA, 463 bp, Zea mays
  Clone ID: LIB3069-024-Q1-K1-A9
tggacctttgggctgcattatgtgcttgtttatgtgcttggttctgctgatcgcagcggttcagtgatcgtcgcggcgtctaggagtagcttctgcgatgtgaagtaggcctcttcttatgtgggtttcctcaagacagtgcgtgttatggtcgtcgtgccgcgtgagaggggtgcttaggctgctacgaatttaaataaggaacacgatacgtctaagctatagaccgtagacagtaaagtaagtcaccgggaatgatgtcttgataattattatatgttctaggcccggtcagcagatagtactgatgatgaggaatagaagacggtattgaaaggagttgcacctgctctaactctatagccttttactaagaaaacttgtaaggaccgtattcattcgagtatcttagtaacgaagactttcgaaattacgtaaaacacttacgttcgtgagaatcggt

SEQ ID NO: 58842 - DNA, 102 bp, Zea mays
  Clone ID: LIB3069-024-Q1-K1-B1
gtcgcacacggtcacctacgctttgactttcgcatagtatatgccacactcactataaccggagtgggcatatacgtatactgaggggtcatgcctcaaatt

SEQ ID NO: 58843 - DNA, 371 bp, Zea mays
  Clone ID: LIB3069-024-Q1-K1-B10
gacctttgggctgctttatgtgcttgtttatgtgcatggtcctcttctttgtattggccttcgcctaggcctcggcctgcgggtgagagggaagagatggtggtgctagatgtcgagcattgaggtcctgacggtggttctgatcgggttattgatgattatccttctaataatgttccgagtattcatcgtgaggcttctgagctgaagactacttcggactgggagatgtagaggctttgtggtcctggtcctgctattcctcttatggaggatgtgacgtgtagtgttactgagggtacgaatcgtcaggagtctgatggttgtaatactattgccaatgaggtttagctttgtggtagttgcggagg

SEQ ID NO: 58844 - DNA, 443 bp, Zea mays
  unsure at all n locations
  Clone ID: LIB3069-024-Q1-K1-B11
tttgggctgatttatgtgcttgtttatgtgcttgtggatgtgcgggttatcttagtatcgaatatccgaccgacctagcaggcagtcagtcagtcgaactataacggacttcattaagccttgcttgcttagcagttatgatatgatggcgatgatgatgaatgtgggtgtcttcgcgcggaatgataatgaggtgtcgatcgcggggttctgtggctttacttcgtcggaggatcattattcgactgagaaggcggtgtatcctgtgtgtgagtgtacattggagtgtgcggcgtatgtgtgtggggttcntgataagggtcctcctgagcgtatttatgatgcgatgctgtcgatgcgtgttgatccttcgtgtgtgtttggtgcgtggatgtttgcgactgcgtgtcctctgatggcgacttatgagtgggggcttttgg

SEQ ID NO: 58845 - DNA, 430 bp, Zea mays
  Clone ID: LIB3069-024-Q1-K1-B12
cactggcccggacctttgggctgatttatgtgcttgtcgtctcttgattctactaattctgcatctctgggttgtattgggaagactactgttgagcatactcgggccggtggccttgggacggatgctaggagtaaagttaggatgtcgcatggattcgccgacgattttagtaagtccttgaagcggaatcctaatggtcatagtattggttaagtcttgggtgatgatagtgaagctacttcccgtttctgggttactcctaaggatttgcctacgaaggggtagaatacatcggctacgcgtgatcgtcatgagttgaatggggagttgactttgagtaataagtggtatggggttgtgaagactcccagttatttcgatgctaaggtcgatgaattacggcctgggaccgagtaagagcatattt

SEQ ID NO: 58846 - DNA, 410 bp, Zea mays
  Clone ID: LIB3069-024-Q1-K1-B2
catcttctgcctgcctcggcacccgggcctttgccttgtgaacaaaagtcgtcgcgttcctggtggctgatgaaatcctcttctcgtctagatctgagcctccgcctgtctttcggatcagatgcttggtccgatcgaacaacggtgagtcttgctctggtatttgattgttctaaacgcatggttttgtttttgtgatgatgtgcaggttccgatctgtttcgtttgattgatgagttgacgcatcggctcgaaacgaggctgcatggtttttgtgcctggaggtttctgattagcgtgtttaaggaaactgggtgccacaatttgttgctagaagtgctcgatccgtcgaattgatatctgccgagctgcgacgttccgggggatctggatcttagcggactggacat

SEQ ID NO: 58847 - DNA, 242 bp, Zea mays
  Clone ID: LIB3069-024-Q1-K1-B3
atcgagtcttatcgtccgtctctgcgcctttacgctgagacggtttgtttgggttaattaagttagctttcgtggagatttcgtcccggggcatcaataaaatgttggcatgcgtggtgggatgctatccttgatcttattttattgtattttatttttagcttggatcagttggggttctgaacattgctagtgtcatgtgattgggaaggctaatgtgatgccttcgatgcagagttttc

SEQ ID NO: 58848 - DNA, 333 bp, Zea mays
  Clone ID: LIB3069-024-Q1-K1-B4
aatgcatgcgtcctgcactcctgctccacctagattcgtacacagcacactcccaaaaccagagccacgccggtcggcacaccgtcgcctgctttgactagcctcgccgccgcagcgacagccatggccaccgctgcccgctccctccacctccctggtccgacgcctcctaaatcctctacccccttctcccaccgcctccctgtcccttgccacctccgcccgcaacgccggcgcctggccgactcgtcctccgacctcacctgcttccccgaaccgactaccgtcccgaacggcgtctacgtgccgtgggcggcggccttctccgtggcc

SEQ ID NO: 58849 - DNA, 454 bp, Zea mays
  Clone ID: LIB3069-024-Q1-K1-B5
tgctcgtgctgttgccgcagcattgtgtatgaagaatatcaaggtagtaatgaccagcaagcaggattaccattttcttaagcctaacatggcagaagatgcagctgagaaccttttgttttcaaagacaactactgcaaaggtgtggttaattggggatggtctagatgcttctgagcagtttaaggcacagaaagggacccagtttatcccatattcacagtttccaccaagaatggcacgcaaggacacctgcacctactcgacaactcctgcaatggttgtacctaaaacactacagaatgtgcactcctgtgagaattggctgccaaggagggtcatgagtgcatggcgcattgctggaatggttcatgcattggaaggatggaacgagcatgagtgtggggacatcgtgctagacatggagaaaatgtggtctggtgctcttctgcat

SEQ ID NO: 58850 - DNA, 470 bp, Zea mays
  Clone ID: LIB3069-024-Q1-K1-B6
aacaacagcagcagccgtggcagcgaagaagtataaatctctatgcgagaatatcgagaagggatacccaacagttctggcttctcgcatcacatattatatcccataatcccatgagttcgcattcacatctgcggcagtgtgatgaataaaatgatccatgttaaatctcttggacctaatacggctatagcaataatcctgtgtcaacttagctcgagctgttctacgagtgttgagacgcttatactctgtgtactagttatcgaattcctgtatagcagcttgtatgacactacataatgtgctataatagtcatactagctgccaaagaaggtcatgagtgcatggcgcattgctggaatggttcatgcattgcagggatggaacgagcatgaatgtggtgacatcgtgctagacatggagaaaatgtggtctggagctcttctgcatggtttccgccctgtgg

SEQ ID NO: 58851 - DNA, 445 bp, Zea mays
  unsure at all n locations
  Clone ID: LIB3069-024-Q1-K1-B7
ataatctgttcttcacctcactaacaccagctagcaactctttctctcctgcaataatgggcgctcgctcctcctcctcccagccgcagctggtcgcggcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaggccacctgcaactgcctcaagagcatgacgggccggctcggcggcggcgtcagcatggccaacgccgncaacatccccggcaagtgcggcgtctccgtcggcgtgcccatcagccccaccggcgactgcaccaagatcaactg

SEQ ID NO: 58852 - DNA, 492 bp, Zea mays
  Clone ID: LIB3069-024-Q1-K1-B8
cactaatacaaaacataagaattcaacgactgcttattgggcagataactgggatgatattggtttggataagagaggcaaccatccatgttttgatccaagaaaggatctagtgcttccggcatggaaggaacctaacccaggggccatatggttaaaactgtgggcaaggccaaggaacaaccgtacaacacttttttatttcaacggtaatctaggttcagcatacgaaggaggccgtccagaagacacgtatagcatggggattcggcaaaagctagcagctgaatttggttccacaccaaacaagcagggaagccttggacggcagcatgcggccgatgtgacagttacctatttacgaactgagaaatattatgaagaactagcaagctctgttttttgtggtgtcctgccaagggatggctggagtggccgtatggaagatagcatgcttcaaggatgcattcctggaataattcatgatggaat

SEQ ID NO: 58853 - DNA, 440 bp, Zea mays
  unsure at all n locations
  Clone ID: LIB3069-024-Q1-K1-A3
gacgccacgcgtacgcccacgcgttcgcgtgttcacaaacgccggcgcaaactctcgcccgagcccgacagatcttgaattgcccattccggccaccgatcgaccttcacgccagtctcggtctcttccgaaggcgtcgcgcgcggttgtttgagaggagaggaggaagatgagggagtgcatctccgtccacatcgggcaggccggcatccaagtcggcaacgcgtgctgggaactttactgcctcgagcacggcatccagcctgatggccaagtgcctggagataagaccgcgggacatcacgatgatgccttcagcaccttcttcagccagactggtgctgggaagcacgttccccgtgcaatcttcgttgatctagaacccactgtgatcgatgaggtgcgcactggcacgtaccgncagctttttcaccctgagc

SEQ ID NO: 58854 - DNA, 297 bp, Zea mays
  unsure at all n locations
  Clone ID: LIB3069-023-Q1-K1-G2
gtccgcggggcgcacacgttccggtgccccaacctggggctcaccagcttggtgcgcctgcccatccacgacgcggacttcgggtgggggcggcccgtgttcatgggccccgggggcatcgcctacaaagggctcgcgttcgtgctccccaacgccaaccgcgacggcagcctgtccgtggccatctcgctgcaggcggagcacatggagaagttccggaagctcatctacgacttctgatctccaactcctncccacaagtcatcagtaccagtacgcgcaacacaaagaagcaag

SEQ ID NO: 58855 - DNA, 398 bp, Zea mays
  Clone ID: LIB3069-023-Q1-K1-G4
ggcaaaacatatttttgggaaaaacctttttctgatttaaggttacaggtagaatggggtcccgaaggaggcctttgaaggtggcaatccgattcctaacctaactattccaaaaaagttggtggaccccttggtcttggaaaagcaatcctaaatggtgagccctctggattttgtgctgcagcttatggagatgctgaccgcaacatgattcttggtaaaagattctttgtgacaccgtcggactctgttgccattatcgcagccaatgctgttcaatcaattccttactttgcttctggcctgaagggagttgccaggagcatgccaacatctgctgcccttgatgttgttgcaaagaatttgaaccttaagttctttgaggtgcctactggatg

SEQ ID NO: 58856 - DNA, 307 bp, Zea mays
  Clone ID: LIB3069-023-Q1-K1-G7
atgtacttgtctcctccacagttattaagccgcccatccttgtagcggttatatcaggtgagaaacacacccacactgtcaccagaggacagacagcgggcggcgtacgcagtcgcgatcacgagcacggacgagcggtcacgcgaaacatcacagtcaaaagagaaacccagccaacagactggaggcgcccatgcgcgccttcattacaaacacagaaaagaccgaccccacgccagatcagagagtccggcgcgcgcgcgctcgcgtcgctcagaccccagagagagaccagagcagagcgcgc

SEQ ID NO: 58857 - DNA, 404 bp, Zea mays
  Clone ID: LIB3069-023-Q1-K1-G8
gcgctacaactagaatcacgatttctcatttactggagcatccttggttcaaaaaggggtgcaagcctcctgtttttgacgagaaatatcaaactagcttggatgacgtggatgctgcttttggagattcagaagaccggcatgtgaaagaggaaactgaagatcagccaacctcaatgaatgcattcgaactgatttcactaaaccaggcactgaatctggagaatttgtttgaagcaaaggaggagtataaaagagagacaagattcacctcacagtgccccccgaaagagataatcacaaagatcgaagaagctgcaaagccgcttggctttgatgttcaaaagaaaaaatacaagatgcggatggagaacccgaaagcaggtagaaagggcaatctgaat

SEQ ID NO: 58858 - DNA, 415 bp, Zea mays
  Clone ID: LIB3069-023-Q1-K1-G9
aacaaacagcaacaagaacatactggttttacaccacagaagggccccagcttcccgggatcaccagctggccgggcaacaacttcaacccgccgggcaacacaacaagcggcagccaaaactaaaggagtggctggtatgggatcttaacacatggagccgcccaccggatgtatattttaaccaaacaagcaaaactgttccagcgattgacagttgatgaaggtcattggttgtattgtatgctaaactgctgcagcaatagaacacactgattgcgtggaagttactcttccatgtgcctcgagtgcaaagcagagacaaaaaaactgtacgtgttgtagacttgtagctggtgcttgaatcagttttgtacccacatcgaaaacaattcctgttggttacaccccgaaaa

SEQ ID NO: 58859 - DNA, 252 bp, Zea mays
  Clone ID: LIB3069-023-Q1-K1-H1
acacacaccccgcacaccgcaccagctcagctcagctcagctgaccaagacaatcaatcatggctctgccgcgccagggtcgctgccgctgcccccctcctcctgctgctgctcgtcgccgccgcagcgcagctcgtgtcctccgtgtcgccggcagacagcgacattcgtcacaagtcctgccgcacgacccattacccgcccgcttgcgagcagagcctggcctcgtacaggagctcgtcttccacgcgg

SEQ ID NO: 58860 - DNA, 322 bp, Zea mays
  Clone ID: LIB3069-023-Q1-K1-H11
gcgcctctgaaagttcggagtttccggtctgttcgcctacgtctccgcctagcgtcccgaagggtaatacttgtcaagtggcaatggcggaccaaggtcaccaacccactgttcttcataagctcggtggccagctacagctgcgctcgatcatctatgaacgtgttctggcacgtaacatattgccatctggcttatcttatgaaaggagatgtgtcacaaggaactacaagaccgagagcctttggggcccttcaatgtgagctagcggtggcatgaatgtaccagcgatgcagaccccggtttgagctaatgctcctgc

SEQ ID NO: 58861 - DNA, 429 bp, Zea mays
  unsure at all n locations
  Clone ID: LIB3069-023-Q1-K1-H2
cccacgcgtncgcaaaggttactacattttttataagggtgcgaagccaaagccagacgctagtgttaagcatgtgatcgaggagtaccgaaagcaggcaaacacaattgcctggtggaaagcctgttactttaatggatcaagatattttggagatgattttcttcccagttgtgaatgaggcatgcagggttatggatgaaaatgttgtaattcgagcttccgatcttgatattgcttctgttcttggaatgggctttcccaaatacaggggtggtcttgtcttctgggctgacactgttggagcgccttacatacattcgaagctaagcaagtgggccgaaatgtatggtcccttcttcaaaccttcatcgtatttggaacaacgagctaaaagtggtgtaccattgagcgcaccangaacatcac

SEQ ID NO: 58862 - DNA, 224 bp, Zea mays
  Clone ID: LIB3069-023-Q1-K1-H3
aacacaaacttgtatttgaagaacttaaaagagaacattggtgatgagaaattgcgtggactctttgctgagtatggcaatattacttcctgcaaggttatgcgggattcggatggtgtcagcagaggttctggatttgttgctttcaaatctgctgaagatgctaaccgagctcttacggagatgaatggcaaaatggttggaagcaagcccctttatgtagc

SEQ ID NO: 58863 - DNA, 219 bp, Zea mays
  Clone ID: LIB3069-023-Q1-K1-H4
tttggaaagcaatgacaaaaacccctgcatctattgccctaatcatctacacattcattgcaagttggtttggtggtggcctctctgtgttccatctgtatctcatgagcacaaatcagacaacatatgagaacttcaggtatcgctatgatcagcgagacaacccatacaacaagggagtcatggaaaacatcaaagagatcttctttacaacgatcc

SEQ ID NO: 58864 - DNA, 287 bp, Zea mays
  Clone ID: LIB3069-023-Q1-K1-H6
gtcgccttcgaggccacgcgcctcgtgctcatccagatcctcctcacctccaagggcatctccctcaaccccatcacctcgctctactacgtcgcgccctgctgcctcgccttcctcgtcgtgccctgggtcttcgtcgagctgcccaggctgcgcgccgtcggcatcttccagccggacctcttcgtcttcggcaccaactccctctgcgccttcgcgctcaacctcgccgtctttctgctcgtcggcaagacgtcggctctcaccatgaacgtcgccggcgtcgt

SEQ ID NO: 58865 - DNA, 371 bp, Zea mays
  Clone ID: LIB3069-023-Q1-K1-H7
cccacgcgtccgggccctcaggttcgttgggaaggacctttgcctgctcaccgggtgggcgtggcggcccgtccagacgccctccttgccgttgagagctgaaatcgttgttggttacccagccagtggtagatcttcttcgtactatactcctgcttgagtttcttgtgccacttcttttgcatctgtagctagctagctggctgctcgatttggtcgtcagttccgagatgggaaaacgaaaacatctcttctcgtcactaatcgctagatccattcacagtgatagttactgatgtaagcctactaattagtttaatggcagatcaaccttgtttagcctaattagttacttggtactactgttcttt

SEQ ID NO: 58866 - DNA, 427 bp, Zea mays
  Clone ID: LIB3069-023-Q1-K1-H9
atcatttcaatgctctctattacgattgtctagtctgcagcacacaatgaagctgctcggtgcctttgtacagagaagcggtgatgagttctcacagaaggtgacgcaaagtgtactgctgtcttatgagatgctgacttagacgaacattgtggagtcgaatgagtctgcaatcggtgagctgcaattcacaaccaattatctcatgccatcattcttttgctttcccctgtatattttttcaaccggtgtcactcgtatagtggtgttgggtctctttagacaaactcgggacggttgcttatcctaaaaattcgattgtactgcgtggcatgaaatgatcgattcgaagaatattttgaacatgctgccacctaatcaaaaaatttcatgtttaacttcataaggaataacttgtgcttattct

SEQ ID NO: 58867 - DNA, 300 bp, Zea mays
  Clone ID: LIB3069-024-Q1-K1-A1
accgctcggacgtgcgcgcttaacgcaacggctcagccctcagaccgagcaccaggcatcggattctgatcgtaccgccggtggactaccgcttgagttggcagcagagacttgacagtggctccaacaaggcaacacattccatcggcaccaacccagcgcggcgccaccggcgacccgtgcccactttctaggagagcgatagccacggagctgacctctgcgcaactgagcacgtactactgcacctgcacgctcaaggccatctacgtgctcattgcgcggcaaggtctacgacgt

SEQ ID NO: 58868 - DNA, 139 bp, Zea mays
  Clone ID: LIB3069-024-Q1-K1-A10
tggctctggacctttgggctgatttatgtgcttgtttatgtgcttgtttatgtgcttgtcgatgtgcgggtcgtagaagctgccccgagagaggaccaagtagttctacctaggagcggaccgattattcagttcacaa

SEQ ID NO: 58869 - DNA, 438 bp, Zea mays
  unsure at all n locations
  Clone ID: LIB3069-024-Q1-K1-A11
ggcctggacctttgggctgatttatgtgcttgacgtatgcttagacgcgactatacccaatacatctacagacctacanaggagaaaatagataccccacaagacggagtaggcgcctaagagttcatcgtggctaaaggggaggttcatatatttgatgcccaaccttacgacaataaaccacgggagagtaaggtctatagagaaagtggagctcgcggccgagaagacggaagaaccgggacctaaattaaatcacgcgatataggaacgttctactacaacgcatgtctaccgcgaccgcgcactacaggtttggtatgcgcccgacgagtccgcgattctgtagaataaagcgtattcactcctgccgaatctgacgtcggaagttcatcgtacgaatcgtccgtatatagaagtagactggtcgtcggacat

SEQ ID NO: 58870 - DNA, 468 bp, Zea mays
  Clone ID: LIB3069-024-Q1-K1-A12
tggcttggaactttgggctgatttatgtgcttgggaaggggtatggcggagagcggagaatcggagatgtagtggagtttctgttcccctgactcggcttcgtcttcgtcgtttggcagtttgttgagggagatgtcgtcgattcgatgaatcgagtttatggatgagaaggaggggtatattatgtaggagattggaggagagtgtgtgtgtggacttattctgcacatatctcttctcctcctcttgcgcttccggtctagacccagccgtcgtgttgtcctccaggaccgaccgtcgtcctatttagcgactgtgctgctactcctgtgcccgtccaactgttcggccgtcgtactggccccccccccggcgccgcgcggccgggggcgtgggtataaggcccttcttcgcccagttcggaccggcgcaggaccctgacgcgactgacgttggttgaaaataaaa

SEQ ID NO: 58871 - DNA, 363 bp, Zea mays
  Clone ID: LIB3069-024-Q1-K1-A2
aacacatgctcctgcgcgttctactcacacacttagcgcctacaccgctcaccatgcgatcgagtctgacagcaccggcaagtgccaatgactctacagctgatcatgcagtagctaatgcatctgactgggcaatactgtgcataccgaccaacccagcaggatgaaaaccatgatccttgctgcttctaccaccaagggaagggcacgcagcttacaggcgggcaactacggccgtactagcgactgtaacagctgaaagcgatgtaccagttgatgctgctcactgtgtacgatgtaactcagcggccgccggtcctacagactgctctcacgactactaccgaatgaccaccacgagag

SEQ ID NO: 58872 - DNA, 280 bp, Zea mays
  Clone ID: LIB3069-023-Q1-K1-G12
gcgtcccagtcctcggacgtctacagtttcggcgtcttcgtgctggagctcctcacggggaagtcgcccgtccagataaccggcggcggtggcggcgacgtggtccacctggtgagatgggtgcagtcggttgtgcgggaggagtggaccgccgaggtgttcgacggcgagcttctgcggtaccccaacatcgaggaggagatggtagagatgctgcagatcgccatggcgtgcgtgtccaggacccccgagcggcgtcccaagatggcggacgtggtga

SEQ ID NO: 58873 - DNA, 306 bp, Zea mays
  unsure at all n locations
  Clone ID: LIB3069-023-Q1-K1-D9
aaatttcctttgctcccccaaanctaccggtaatgggaattcattttgatctttaaactttgtaaccatcttttacttgagcttcatttaatcaatttgatgcactgctcattaaattaattggaacataactttctgtcactagatctggttgagcagctttagaactctaacatatctaaaagcataagaagttaatgtattttataatcaaaatgactcatcttgacaaaattgaattacttctggattatggttcaccttatgatatttggagctgctgattccaatattattttcaatctt

SEQ ID NO: 58874 - DNA, 308 bp, Zea mays
  unsure at all n locations
  Clone ID: LIB3069-023-Q1-K1-E1
tacggattgtcgctggatgaggaagccttacccagatgcacactanctgttttctcagcctactactgttgcagctaacgggagatccatatttgcatgcttgcttgataaagtgagccaatacttaactgaagggcttgaccgtgctagagagagtntaaatgaggccgcagctttgcgggatagatatgtcatcgggacaagtgttagtaggagagtggcagctgctgctgcttctgcacaagaagtggcagcttcagctggtgagagcagctntagatcctttatgattgctgtgcagcgttgta

SEQ ID NO: 58875 - DNA, 293 bp, Zea mays
  unsure at all n locations
  Clone ID: LIB3069-023-Q1-K1-E10
ccacccaancgccatggccgccgccgcccccgacgcagacgcctactatatcccgtgggtggagaagtaccgccccgcccgcgtcgctgacgtcgtcggaaactccgatgccgtcgcccgcctggaggtcattgcccgcgacggcaacatgcccaacctcatcctcttcaggcctccggggactgggaagacgacgagcatcctggcgctggcgcatgagctcctcgggcccagctatcgtgatgccgtgctggagctcaatgcctcacatgacaggggtttggatgttgtgc

SEQ ID NO: 58876 - DNA, 462 bp, Zea mays
  Clone ID: LIB3069-023-Q1-K1-E4
tcggggcttctttgaaaactggtggaagattgttttttttctggccctttttcttttcggggtccttgtaaggttttctttttgcttgcttgcacatgggattcctacatccatgaatcgtgatatccgtcgtctaacctagtacgcaattctagctagtaaccagcaggatcaaatatacttcctttttcttcataaaaaaaaatatatagattcccattacaagtgctagctagtgcgcatgcactaactggtatagaatagatagatacaatattattctcgttggtgggcggagatgaaatatactatcgatcacgttgtatttgagaacgtagagaatatgttagtacacaacgactatatatagctaggcagcatgcaggtggccacgtactcattatcaatcacgttggattatgtctttgtcattatatataactctataaaaacctaatatga

SEQ ID NO: 58877 - DNA, 362 bp, Zea mays
  unsure at all n locations
  Clone ID: LIB3069-023-Q1-K1-E5
ggtagcgattcggaattcgagcgacgcgtcacgcgtgaacaggaacttcctgatggggtttgaggttatcgaccacattaaggcttctctgtaggctgcctgcccaggcacaggctcctgtccccacattgctacgcttgcggctcgtgattccaccgccctgtttgagtgaccatactgggacgtgccactcggcccgagagacttgctcggtgcaagcatccagagctccaacaatgacatnagagactgcaacaacacactacctactataatctcaaagtttaagcgccacggcctcaatgttagacgatgatgcatccctctcatgtggccacaccattggtatgtctcgttgcact

SEQ ID NO: 58878 - DNA, 405 bp, Zea mays
  Clone ID: LIB3069-023-Q1-K1-E6
gtgcatgggaagagggctatcttgctaatattattcatggagatggtgcaaaggagatgaaagttggtgaggtcattgctataactgtggaagaagagggtgacattgagaagtttaaggattataagccgtcatcttcagctgaacctgtagctcctgctgaatcaaaggctcaaccagaaccttcacaaccaaaggtggaggaaaaaaagcttacccaggctcctgaggttaaggccccaaagattgaagaagcttctcaatctggagatcgcatatttgccagccctcttgcccgtaaactggctgaagataacaatgtcccactatcaagtgtgaaaggtactggtcctgatgggcgtattttgaaggcagacattgaagattactttggccaaggtgggc

SEQ ID NO: 58879 - DNA, 484 bp, Zea mays
  Clone ID: LIB3069-023-Q1-K1-E7
tgatcatccaatatcaagaaatccttgttgctcctatagaatctgatgaagagcttgctaagaagacaaaaagtttctttgctaatgcagcagaaacattcaatgctgcatttatgtatatatcatcattgacgttagcataaaatgcagcattgaatgctaacgtcaatgatgatatatacataaatgtcgatactttgagtgcaatgctcgaaactcactgggacaggcctcgtgtctatataggttgcatgaaatcgggcgaggttttctctgacttaacccacaagtggtacgaatcagactggtggaaatttggtgatgggaaatcgtactttcgacacacttctggtgaaatgtttgtcatatccagggccatagctcagttcatttctataaacaagtccgctctccggacatatgcccatgatgatgttagtgttggatcgtggatgattggccctgccgtgaatcatgtaaatga

SEQ ID NO: 58880 - DNA, 394 bp, Zea mays
  Clone ID: LIB3069-023-Q1-K1-E9
ccgacgccgtactgctagcacaagccttgaaatgggcgcgctctgcctgctctacccatccacgccgccgcgctgcccatgcggcgcccgcgcggacgcgaccgcggccttcgcgccttcccctttcctctcatcatgtgctgccaccggtgcacaaacaaggctgcagctctgcggcaggagccagaggcgcggcggcgtggcgcgggtaggtggcggcggcggtgggggcaagggggagagtggcaagaacggcgcggcggcgttctttgatgaagacggggtggtggacgacatggacgggtacctcaactacctgtccctcgagtacgactctgtctgggacaccaagcctgcctggtgtcagccttggacaatattgcttacgggaact

SEQ ID NO: 58881 - DNA, 390 bp, Zea mays
  unsure at all n locations
  Clone ID: LIB3069-023-Q1-K1-F1
agagacaataccttgcaacactggctgttcctttctctttttttttgttttttcccgttcacaaatatgcttcttctgtagtcgtaattttacagttagctacaataatctaataacatagcaattccagaatttgagccgaagttgtggttgaagcctgtacttatcattattttccatatatacacaactaatacagaatatgacaccacanaaagtattcttcaagagaactaaatagatatttgcactaacacttgctcttgtctcatcctaaatttgacattatctgaaggttataaaatagtgagctacaactgatacaacccactgcaaccgaagaagaaattcagaattcctagccaccaaactacgaagacaaaaatgtcg

SEQ ID NO: 58882 - DNA, 370 bp, Zea mays
  unsure at all n locations
  Clone ID: LIB3069-023-Q1-K1-F10
cccacgcgtccgcccacgcgttcgcttttcaccacacctcctcctcctcctgctcctagcacagctagcgcctgctccccttnccctgtgatcatgtcttgcagcagcggcaagtgcgactgcggctccagctgctcctgcggcagctcatgcaactgcatgtcccctaacgtggagaccgccgccgccagcagcatcaagaccatggtcctcgctgcgccgaccaccaaggccagcgccggcggcttcgaggcggccaccgagggcggcggctgcgactgcaacacctgcaagtgcggcaccagctgcggctgctcctgctgcagctgcaactgagcgccggccggcccggcgatggcgcgcacgagtc

SEQ ID NO: 58883 - DNA, 143 bp, Zea mays
  unsure at all n locations
  Clone ID: LIB3069-023-Q1-K1-F12
gctatncntacggaaatttttctgctctctcatactcccactcgtgcgctcgggagagcggctcgcataacggaagaacccaaatccaatacaactgcaaaccttctaacattcaaaatacaaacacaaggtagtcgactcac

SEQ ID NO: 58884 - DNA, 355 bp, Zea mays
  Clone ID: LIB3069-023-Q1-K1-F5
cgcagccgtattcctgtctcgaatcctctctcgtcgctccgatggcccgcacgaagcagacagcaaggaagtcgaccggcggcaaggccccccggaagcagctggccactaaagctgcgcgcaagtcggccccggccaccggcggcgtgaagaagccccaccgcttccgccccggcaccgtcgcgctccgcgagatccgcaagtaccagaagagcactgagctgctcatccgcaagctccccttccagcgcctcgtccgcgagatcgcgcaggacttcaagactgatctgaggttccagtcctccgccgtcgcggcgctgcaagaggccgccgaggcgtacctggtgggtctctt

SEQ ID NO: 58885 - DNA, 410 bp, Zea mays
  Clone ID: LIB3069-023-Q1-K1-F6
ccggaattccggtcgcccacgcctccgggaatcttcctctgggggaccggtcttggttttaaaaacctaccatcgccttggggtggatggggaacccccccctgataatttccgtgctggtggcgtgcaacatccttcccatgttcatccgtggcttctattggagggaccccaacaacagccttctgaaagtcattggtatcggggcgtgaagccatgaccttctacatgttcaggcccaaacttggacatgcacagcgctctcgcatgtttaagagcaataatctaggtgctcaggccaagttttgctatgcggttagaggaccatagcgcgctcaggtcatgcgccatggggctgcctatattctcagcactgccgagatgcctgttgccacttgcagatgcatgga

SEQ ID NO: 58886 - DNA, 139 bp, Zea mays
  Clone ID: LIB3069-023-Q1-K1-F8
gaccggaacggaatgcccgacccaacccacccgtccgcccactctttacgtccacgcatctattttttactatatcactagaacattctacactgagctcgttgctagcttagtggctcctcgctgagactccactatg

SEQ ID NO: 58887 - DNA, 425 bp, Zea mays
  unsure at all n locations
  Clone ID: LIB3069-023-Q1-K1-F9
ggggaggcgccagaaagtatccccggggttctgagaacaacngcccgtggaggtggcgcgcgcggtggcccgcccaaatggagtacatatcccctgaaagaaatctggaggggacttgtggagatcctgggccgttatttgccgaccaaagtggcagcttgttggaccacttgggttatcaagggggaggaattccacaacatgagtctccaacactggatcatggacttttggttgatccagctggtgcaattccgtatttatctacagattctccgcccttcatgaatgatcaaatcacttgcaatgttataaaatctgcttcagctagtccagaatcttgtacaaaacaacctcaagaacctcttaatgtagaatctgatgtacaagatgacgcagctgaacaaaatgttcacaatagtaac

SEQ ID NO: 58888 - DNA, 429 bp, Zea mays
  unsure at all n locations
  Clone ID: LIB3069-023-Q1-K1-G1
gcggaggacaaacanacagcaagagagcggatcgccgtaaggcaaaggcaaaggcaacggcaacgcaagccagaggcagagcgcgccccgccacgatgaagaaggaggaggtggcctcgccggcggcggcgacggtggtcctgctgctcctgtcgtcgtcgttggcggccgtctccggccagccacagccgcagccgcagcccgggggcagcaagcagactgcggcgaacaacccgcggctgcagaaggcgtacgtggcgctgcaggctttgaagcgcgcggtgacggaggaccccaagaacctgacgcggagctggtgcgggccggacgtgtgcggctacttcggcgtgtactgcgcggcggcgccggacgagccgcggtcgcagacggtggccggggtggacctgaaccacggcgacctggcgggga

SEQ ID NO: 58889 - DNA, 398 bp, Zea mays
  Clone ID: LIB3069-023-Q1-K1-G11
gcgcaagtatgcaatgctctaattttagcttaattcttggcaatgtgactgcacgacccaccactggtggctgcagtgtctcatcttgcaactatgatggctatgtcaatggaaccattgcaacatcgctatcctcaggtcttcaacccatgtgtccaggaccgcatcaatttcccccactcacggcggtgccaactgcggcaaaccatgggtcttattctccatcacctgcaccaggacctggagatgctggtggtgccaccccaggaggttccagcctttctccatcaaatgagcctgctgggaacagctcacaagcggctgcgataaatcaaccatgccgtttcctcctcattttcattctttctgtgacattgtccttgcgggtgtggattcct

SEQ ID NO: 58890 - DNA, 424 bp, Zea mays
  unsure at all n locations
  Clone ID: LIB3069-023-Q1-K1-D8
cccacgcgtncgccgcgctgtggtacttctccagcgtcgtctccgtgctcgagccgcgctgcgggctcgctgccatggccaaaagcaagcagctgctccagggccgcaccggcaccgcagccacgcttgtcgtctcctacttcgcggtctgcggcgcgacctcgttgctgttccgtgcctctgtcgttaagggacgcaccgaggaggggagcttcggcctggccttgcctggccggctgcttgtcggcgccgtgctggtgtgcgttcttgtctctgtcaatctgctaggactgctcgtgcagagtgtcttctactacgcctgcaaggccttccacagccagcagattgaccgcactgcattgtatgagcaccttggaggctaccttggggagtacgtgccactcaagagcaatatccagatgga

SEQ ID NO: 58891 - DNA, 438 bp, Zea mays
  Clone ID: LIB3069-045-Q1-K1-D7
cccacgcgtccgcccacgcgtccgtccacttgtccgcccacgcgtccgcggacgcgtggggttgatcttgcacatggtaatggacaaccaagagcaaatactgtcacagcccacaggggctctttcataactgagcatattctgcatcatggagtttcttcggatgctataggaaattcttccaggaatgcagagtgttttgttggtgcagcaggccaagacagtcatcatgcagcctttaagagaaagtatcttgatggatgtcatgcagagtcttctgctaacggaagctcacgcaatcgtcaccagaataatagtactctgctacctcctccgaccacctgtgaaagttttactatacccaccgcaacaaattttagtgttccgtaccatcctgtggagcagctaaaccagagtactaatattgctgcaagctct

SEQ ID NO: 58892 - DNA, 433 bp, Zea mays
  Clone ID: LIB3069-045-Q1-K1-D8
agcacctgcaagcgcaagaagaccttgccgtgctactcggggcctcgtccaaaggcggtgcacttcgaggagtgccgggaggtgagcgtgcagggcgtgacgctgcagaacgcgcagcagttccagctgacgttcacgcgctgctcctgcgtgaaggccagcttcctccgggtggtggcgccggcggacagccccaacaccgacggcatccacctcaacgacacctcccacgtccgcatcacggacaacctcatctccacaggggacgactgcgtctccatggtcggcaattgctctgacgtccgtgtgaaagacatctcatgtgggcctggccatggcatcagcatcggaagccttggaaagaaccggaccaccgacatggtggaagacgtgaaggtcgacacctgcttgctcaccaacacgaccaacggcg

SEQ ID NO: 58893 - DNA, 431 bp, Zea mays
  unsure at all n locations
  Clone ID: LIB3069-045-Q1-K1-D9
ctttctgcgtccgtgaagtccaatgtgccttccggccgccgggtgaagacgaagaggagagtgccctccgcgctggctgagaagaagcgtaccagtcgggcgctgcggcgccgtccatggcgagagagagcgtctgcaggccagccgagagcccgagaccagtctgctcgtgccggtgtgggtgacgggcgttgcgtcgtgtccaagagcaaggtacgccgtacgctgaagctgctatgccttttggccctgcgtcgtgtctttcgacgttggctggtggccctggcaccacgccgtggagcggtggagccgccggtgggccgggacgggaggcaggccgccgccgggtgctcagctcagctctgtcctagcgcgcgccatccatcgatctncgncaccggccacaccaccaactgcaagctggctgttga

SEQ ID NO: 58894 - DNA, 439 bp, Zea mays
  Clone ID: LIB3069-045-Q1-K1-E1
atgatccattcctgggaaagcgcattgaatatggttattttgtcagtgttcctttgagagatgagttccttgaaaatgctaggctttttattttcgagacatactgccgtatccatcggtgcatcgatatcagcatgcttgctcagaagttgaacatgagctacgatgaggccgagttgtggatcatgaatttggttagaagctcaaaactggatgccaggatcgattcagtatcaggaactctcatcatgacaaccaatcacgtcaatgtccatgagcagattgttgagagcttgaagggccttaatatgaggacctacatgctcgcaaagaacatcgttgagccagctcagcaggcaactcggtgaggatagcagacttcacagttttgagacgccaaggactagtttagagacaacttgtaacttttcgagctcta

SEQ ID NO: 58895 - DNA, 430 bp, Zea mays
  Clone ID: LIB3069-045-Q1-K1-E10
caattttgcaatatgcacggcattttattttgctatatctattataggctacctcatgtttggagacaagatgctctcataaataactttcaatcttctgaaagattcatttgcagcaaaagttgcacgatggaccacgataactattattgtcggtttctctgattcaattaagtgggaacccttggtagtgattcaattaagtgagaagtgagaaccctcattgtgctatttttttgtttcaggtgatcattcctttcacaaaatattctttagtgataaaaccattagcttagagtatggaagggttgtgtccagcaaggtttatgacggatagtcttcgctgttatgctgcgtactcgatgtgttgcctttctcctaccattctttgggttggtatctatctttgtagccgaagaaacaatcctga

SEQ ID NO: 58896 - DNA, 434 bp, Zea mays
  unsure at all n locations
  Clone ID: LIB3069-045-Q1-K1-E11
gtcacaagcaaccaccttgcatatttctttgcctcatggaattctgcccctaccctgcattgtctgccctgtgaagagagagaccagagagagagagagagggcttcgatgctcttctcaggctgcaggtcaaggagtgagaacaagaaagccttctttgaagttgggttgttgaggtgctctgaagaagtattagcgtgtcttccatcagtcagttctctcataatttcatcttcctttccttgtgttgtccttggcctctctttctgtgtccctgcactctcttgttatggactcctctcagcttactggggacaatactgaagagtgcaacagtaatgaatctgggtggacgatgtacctgngctccccagtgaacagtgatgatctcaaagccaatggcagcanatggagtaataatgttggcagtggct

SEQ ID NO: 58897 - DNA, 431 bp, Zea mays
  Clone ID: LIB3069-045-Q1-K1-E12
gttctagatcgcgagggccgccttttttttttttttttttttgacacgcatttagcttggcactatatgttgcatacaatccatttacattagctgaaacgctatacatcactctgaaatccagttaaccatacacatacacttgcgatagtgtggcacagcatgtgcaactgtggatatactcatcttgcacgcagccatcgtcgccgctgccatcgtgcatcacctgagcatgtctccaaagtccacgaatgggccgccgccgctcagaatcgatgaggcgctgaaattggtttcgccttcgtcgaacgcgatcctctggccgaacggctgcggcctgtccggcaggtcgggcacgtccatatccccctccagcatcctcagtgcctccggcatggtcgggcggaacgccaccgtgacgtgggcacaca

SEQ ID NO: 58898 - DNA, 225 bp, Zea mays
  Clone ID: LIB3069-045-Q1-K1-E2
cagaattgggatttgctgaggcgtaacgattcagttgagtgtggtggctgtcgccggccggccttgtgtttttgttgtctgcttttctcttgaacgaagatgtgatgaactcagctgaagatgtagtgtgtatgttgtcatggtttatttttctattttatttatctatctataatatctatcggagaaggtttgatatgaagcggaacactgattaacgatgcc

SEQ ID NO: 58899 - DNA, 434 bp, Zea mays
  Clone ID: LIB3069-045-Q1-K1-E3
ggtctactgaagtcaggcggacattcttctatggtgatgctggatcatttctgtgatgattaagtctttgtcacttcaataagcgtcctgtatggtgttgcctgtagccctgtatggccgaagctactaaaggtaattagggtttgataaagttaaagcaaccgagtcccaaacttttgatcttgattcgtgcaaacggggacgatgcaacacattttcaaggtattctggacctttatgaagcatgctctgggcaggtcatcaacaaagacaagtcttctgttcactaaaaatacgagaagtgagacgaagatggcggtcatgcaagctctaaatttaacacaagggactttcaacgacagatatctgggcttaccagttcgctttgggcagtccaggacaaaaacttcttagtacttaaatgataatgtgac

SEQ ID NO: 58900 - DNA, 320 bp, Zea mays
  Clone ID: LIB3069-045-Q1-K1-E4
cggacgcgtgggcggactcgtgggcggactcgtggtcggacgcgtgggcgacccacacgggccagatttatttgttgcaggatagcacgtataacgctgaacaattcactttacctgctccaataaactgaacgatcctaagaccaataagacgtactgctagaacaaagagagcatgaagcacacacttcacaaggtgactcactatacgaagggcaatgatagcctgtatgaccagggaaaaccccgatttgaccacaagcagacattatatagtggtcagaccaagcctgtattccacaagaagaccaagaccacca

SEQ ID NO: 58901 - DNA, 341 bp, Zea mays
  Clone ID: LIB3069-045-Q1-K1-E5
aaaaaaaaaaaaaaaacataaaaattataaaataacaaaaaaaaaaaaaaaaaaaaagggcagggaaaaaaaggaagcgaagagaagacaaaatacatggacaaacaaccaacgcaaaacaggggcgtccgagctcgagctcccaggctaaacgcccctaccttgcccccgccatgcaccagcttcggcccgcgccggtccaacgcacgccccgcgagatcgccaggacggcaccgccaaacccccggccggccccaacggctgcggctcccgagccataccgcctgccgcccttgcgctagcagggaatcggcctcgggacctccccggtcccgcccatc

SEQ ID NO: 58902 - DNA, 419 bp, Zea mays
  Clone ID: LIB3069-045-Q1-K1-E6
ggtgaatctgccaccacctcttcttctttttgccccctcttctcttcccccaccggcccctttcctcctccactatttgtgcttctgccaccgccaccttcctccacgccgtcagcagatctgctctgtcttctcctcccttcaccagatctgctgggtgcagggagcttcacagtgatggatctgaagagaagtgggaaatggcagaaaagacccggcagctaggtattgtgcacgtctctgtgtccgtccgtcgccggatctggtcgtagtggagacgtagtgtctgatcaggcagcaacagcagcgacgcgtcgatagatactagttgacgatagggttgttgtggcaggggcagctgcgtgttggacgacaacgcggtgcccatgccgttggcaagcgtcgcggccgtggcggca

SEQ ID NO: 58903 - DNA, 435 bp, Zea mays
  Clone ID: LIB3069-045-Q1-K1-E7
caagaataagtgatgccttatactgctatgagaaactgcatggtcgatgcactgataatcaaagaagttcccaggctgatcctgcagatgctgattctaaaccaaccagtggttcaaagggaagccatattcgcactgggactaaagttactgaagaagcaggacagcccattccacgtaggcgccaaaataaaggcaacagaaaagcgcacagctcacgtaaacagagattctttgctggtaattttgtgaataatcctgatcagtatggtggtgtgtcagaaagccctccaggcaattcagttggatatttctatggatctactccagaaaatcacagttataaaagttcaaagctgagttcatctcctcatggaattcctactgggagctcgcctgttgggtctgtgcccaaatcttctccacaatctcagc

SEQ ID NO: 58904 - DNA, 270 bp, Zea mays
  unsure at all n locations
  Clone ID: LIB3069-045-Q1-K1-E8
ccaggagttggttgttaaacttgttaatagtangaaacagctggcgcagaaggatggtgagctaatgtaagcagaggaggaagttcaagtattgcaagaaaagaaccaggaactctgtggagttgttagatctctacaggttgcaactgaaggtgctaacgtggtggacggtgaactgtaggagctaatcacaagactgatttaacagtgatatctcacggatgtagaaattctacgctggtaataatacgattaagcatggtcattcat

SEQ ID NO: 58905 - DNA, 431 bp, Zea mays
  Clone ID: LIB3069-045-Q1-K1-E9
acgcccacgcgtgcgcccacgcgtccttaagtagggaagccaccaacagaacgtgctactgcagatttttctggtgcaacgcttgctactgccgcaaatattggacgccatgcacaggcagatgttgatctgtcacgaagagcaatggataaagcgatgatggatatgctgagagcttcttttgccaatagaaggaatgagcataattggtctggcgagcggaaatttgaaagatttgaagagtgctcaggttataggggtacatggtccgcaaaaatggggaagaggccaattctgatggaagatagtcgccgaagcacatattgtgagactcaaccatccaattcaatatatgagctgccggtatcgtcatcctacaatgggacaaagaagctgctagtaccagttggggttcagttacagcagtccta

SEQ ID NO: 58906 - DNA, 426 bp, Zea mays
  Clone ID: LIB3069-045-Q1-K1-F10
cggacgcgtggggtgtgctgcatgttgatattgatccttatgctgttccaaagagcatgggcatctttcagacaatcaggagcccaaaatctataacaacattgtcagtggcgacaagaatagttgacaatcatgaagcttacaagaagaggaacctgaaaaagaaggctagcgaagaccggtactacacacaaaagaaattcgtttctggagactagtgctgcacaaggagtgtatatttctgccagcagtccgaggaaatgcatgtgccaccctgtattgatgttattctacagcagagactggaacagataatcagcattagaaaggtcacaatgatagtttgacaggcaagcaatggtgtggatggaaccaagctagggaagagagagagagagagggagaaaactgtcacattcttctgct

SEQ ID NO: 58907 - DNA, 371 bp, Zea mays
  Clone ID: LIB3069-045-Q1-K1-C12
agcattgcgtcccaatgccctggttccataatccaattgcagatgttgaaaaaatcaagcatgaagggatccctgcgcagctgtgctcccgtagctgcaacagtctgttggatgcaagtatcgtgatgtcacgagtttgggatttgttgcattccgactgcatgggcggtgttgtgaatgggcatgaaatgccgtgtcctgtttgttgttgatacttgtgtgtagctgctgaagtgttgttgttgatgcagtactacttgtgtatacttgtggaaagagagtgcgcataggcttagaaagtacagtatcttcatactaggtaaagggatgtttctgaagctcatgtgtaccgcgattgcatgttggcaccg

SEQ ID NO: 58908 - DNA, 441 bp, Zea mays
  unsure at all n locations
  Clone ID: LIB3069-045-Q1-K1-C2
agacggctagccggcgcacggaagcgggcattggatcggaggtgagcctctcctgcgtcggactgtccccgcccccgctaggcgccatgaagctgacggtgaagaccctcaagggaacgcacttcgagatccgggtgcagcccaacgacacgattatggctgtgaagaagaatattgaagagatacaaggaaaagacagctatccatggggccaacaactgctgattttcaatggaaaggtcttgaaagatgaaagtacattggaagagaataaagtcaatgaggatgggtttctagttgtcatgcttagtaagggtaaaacatctggttcaactggaacttcatcttcccagcactcaaacactcctgcaacaaggcaggcacctnctctagaggccccacaacaagctcctcaacccccggtggcaccaattacaactt

SEQ ID NO: 58909 - DNA, 430 bp, Zea mays
  Clone ID: LIB3069-045-Q1-K1-C3
accaccgctccacacacaagaagagagccgagagctagctacctagcgcgcgatggcgatgtccgcttccaagatgatggcggtcgccgccgctgccctgctagccctggtcctggccgcgtcgaccgcggaggcgaggaacatcaagacgacgacgacgacgacggagaagaaggacgatgcggtggtgcagccgcagaccttcccgcccttcgaccgcctcggcggcggcgcgtccccggcgtccggtggcctccccggcacctcgtcgggcggcagcagcattccagcgttcagcatgccgggcagcggcagcagcctccccggcgggtcgttcttgcccggcagcagcggcagcatcggcagcatgcccctcttcagcggcggctccccggccttcagcggcttcggcggcatgcccgggtccccc

SEQ ID NO: 58910 - DNA, 430 bp, Zea mays
  Clone ID: LIB3069-045-Q1-K1-C5
caaggatcgggatcaggattaggtttccattcctcctcaaagagtccacaaatgtatacccttcccttatgtacatcaccacacgaagggaagttccccgacgagaagttcgtgcgcaagcacaccgcccccggtgtgctctccatggccaacgccgggcccaacaccaacggctcccagttcttcatctgcaccgtcgcgaccccttggctcgacggcaagcacgtcgtcttcggccaggtcgtcgagggcatggacgtcgtcaaggccatcgagaaggtgggcacccgcaacggctccacctccaaggtggtcaaggtcgctgactgcggacagctctcctagatctctctgatctggtctgttcggcccgcctccctccgtcatcgtcgactccccctgcgtccgttcctttggatctgaataagat

SEQ ID NO: 58911 - DNA, 434 bp, Zea mays
  Clone ID: LIB3069-045-Q1-K1-C6
cggacgcgtgggcggacgcgtgggctgactcgtggggcctgtttgtccttgcatggccggagccagacgtcgcaccttgcctccaccctcgcattccgatcacccgcttccagctcctctccgtctcgctgctcctcctccgctcgcagagctgagctgatcgatggaccacgagcagcggcgccagcggcagcagcacagtcccagaggcaatgctcctgggagcgggaggtgcggctcctcgtcgaggaagcacaagggcgggggcaagaaacccatcaaagtggtgtacatctccaaccccgtgcgcgtcaagactagcgccgctggtttccgcgccctcgtccaggagctcaccggccgcgacgctgacccctccaagtacagccccgaggacctcgccggcgccgccgtggcggcgggcgaccctgact

SEQ ID NO: 58912 - DNA, 376 bp, Zea mays
  Clone ID: LIB3069-045-Q1-K1-C7
gactccggtcaacaccataatcagttcgactaattttcgagttcaccaccagatggtctgttccattaagattcagcgggcatgtgtctacctacgtcatcactttaatcctacaccctattcggtatagtcttagtcactgaatcctacagctggtcagaacttgagggcataagcataccctcatggctcgcaacagcactcgctgaacgtatgcttaaagcatctggatcagatactctttgaccaggaaacgcatcgtcggcggctagaaacgcattagtattgagtacatgtccaacttcctacgcgtcaagactagctgcattggtacacgagccctagttcaggagcataccggccgttacgatgacct

SEQ ID NO: 58913 - DNA, 243 bp, Zea mays
  unsure at all n locations
  Clone ID: LIB3069-045-Q1-K1-C8
cccacgcgtccgcccacgcgtccgttcaggtgntcttgaaataaaacggaggggactgtattctagagtctagacaaatggaggcgacttgggtgtcagctctgagcaaaatctattggatcatctcaagtcaaaagagaaacagaacaagcactacaaataaatgctgcatgtgctacaacaatatgttttttttgtccatgcatgtgaaagtgaaataattaactattgtgtggatggagt

SEQ ID NO: 58914 - DNA, 422 bp, Zea mays
  Clone ID: LIB3069-045-Q1-K1-C9
cggacgcgtgggatctcactctctgctgttcgctcactcttgcagctccaccctgcactgagtcttagtctcttattagctctaggctctagctagccgcgccactccttcgtgtagccatcagccttctcatcgccaccaatggccactgccgaggtccagaccccgaccgtcgtggcggccgaggaagcgcccgtggtggagaccccgccgccggccgtcgtgcccgaggagtctgcccccgccgaggccgaggccgaggccgaggctgctgctcctgctgatcccgaggagcttcccgcggccgagcagcaggcagccgccgaggcggaggccgcggctcctgctggtgccgaagagcccgtcgcggccgaaccggccgtcgaggcggaagctgctgctcctgctggtccccgagagac

SEQ ID NO: 58915 - DNA, 410 bp, Zea mays
  unsure at all n locations
  Clone ID: LIB3069-045-Q1-K1-D1
gcctctcccgcgtgttcctggtggcgaatgtctactgcgtgatccacgtcgtcaacgaccacctctgctcggtgaccttagtgcggggcgccagcatgctgccgtccctgaacctggcgggcgacgcggtggcggtggacagggtcagcgtgaggctcggccgggtcgcgccgggggacatcgtgctgatgatctcccccgaggacccgcgcaagtcggtcgtcaagcgcgtcgtcgggatgcagggggactccgtcacctaccttgtcgaccccggcaaaagcgactcctncagaaccgtcgtggtaccgcaagatcatgtctgggtgcanggtgacaatatctttgcttctaacgattcgaggcaatttggagctgtgccttatgggctgattacagggaagatcttt

SEQ ID NO: 58916 - DNA, 432 bp, Zea mays
  Clone ID: LIB3069-045-Q1-K1-D10
acggagagcgctcgctcaacagctgtgcttctacagcggcggaccggcacgccacctggaactgcctcaagagcatgacgggccaactcggcaagcggagtcagcatggccaacgccggcaacatccacagcaagtgcagcgtatccgtcggcgtgcccatcagccgcaccgtcgactgcaccaagatcaactgatcgatggaaccatagtggagagagctcgctccttggataaccgcggacgtggccattatcagcatgcagtcagcgtagtaccatagatgtactagctacatgtgtgtcatgcatcagactggcacataatacaaaagtagatcatgcacgcactagtgatcactcaccccagtgtccctccgatcaatgtcgtcgtcttcgtcgtgtaccttacgtgacacgctgtaacacgtacgc

SEQ ID NO: 58917 - DNA, 432 bp, Zea mays
  Clone ID: LIB3069-045-Q1-K1-D12
gagttcttttgttttgatagcatttcctttaaaatagtaggaaaaccttgtgacaaccttgttacagcagttacaacttctcaaggtcccccggtagacctagccactgttatgtgactgaaatttaccctttgcagttgccatcaatatgtcagcctactctgtcacaaacagtcttctctattctgtctattttaacaaatcatgtaagacatgccttcatgccatctaacatgcctaaccatcctcaagagttgtatacacaagatgaagaacctagccttccggtcacacaaaactcttcaacaacatctttggcgaaactatctacctgtagcaacgaaagaaacgaggtacaaaacttcttgttttcttgccatgtactacctattaaaaacatcttatttttttcacgcatacaacttgataaag

SEQ ID NO: 58918 - DNA, 393 bp, Zea mays
  Clone ID: LIB3069-045-Q1-K1-D2
cggctgcaggggaggcgcaaagcaccaccttatagggcaccagcagcgagctcaacttgaacctcgagctggaagacccagacgacgacactgatgccgacatgagcaccgacgagccacgcgatgtagaagataacagcgcccgtctagaagccgcttgaagcggaaagcattttagccgctggtcacctagagatgcggatcggcctgaatcgtctgccctagctaggcggattttgtgtaacataatgtagcagcatgtaacttgtatccgccacctcgtcgtccttcgtctgttccagtttagaacaatggcattgtccatgactgttcaagtccaagtgctcatgttatatttcatagctgttggttatgacttgccactttgtcctg

SEQ ID NO: 58919 - DNA, 432 bp, Zea mays
  Clone ID: LIB3069-045-Q1-K1-D3
cccacgcgtccggacagacattgcatttgttgttgttggagagatgtttcctgcccacaaggtgattctttcagcccggtctcctgtttttagggcgcaactttttggtccaatgaaggataaggacatgaagtgtataaagattgaagacatggaggctccagtattcaaggctttgctccatttcatgtactgggatgagttgccggatcttgaagagcttactggtgtaaatacaacttgggtatccaccttgatggctcaacatttacttgctgctgcagaccgttatgcattggagagattaaagttgctctgtgaacttaagctgtgtgaagatgttgcaataaacacagtggcaaatactttggcactggctgaacagcaccactgctatcagctaaaaactgtttgcttaaaatttgtggctct

SEQ ID NO: 58920 - DNA, 435 bp, Zea mays
  Clone ID: LIB3069-045-Q1-K1-D4
cggacgcgtgggcggacgcgtgggcgaagtcatcttggatcgggagacgcagaggtcccgcggcttcggcttcgtcaccttctccacggaggacgcgatgcgcagcgccatcgagggcatgaacggcaaggagctcgacggccgcaacatcaccgttaacgaggcccagtcccgcggcggccgtggaggcggcggtggcggatacggtggcgggcgccgtgatggaggcggctacggcggtggcggtggaggctacggcggtggtcgtggaggctacggcggcggtgggggatacggtggtgcaaaccgcggcggcggctacggcaacaacgacgggaactggaggaactgagcggtggggtccgctgaggcctagttatcttgttcgcttctgctaccgtgttcaccctagtctagagggggtttatcttcgtc

SEQ ID NO: 58921 - DNA, 434 bp, Zea mays
  Clone ID: LIB3069-045-Q1-K1-D5
ggagcgcgaagatgggagcgggggtcggtttggtcgctgcgagcaaagacaaggccagcggcggcggcgccgagcggacgtcgctggacggcgtgcgggataagaacgtgatgcagcttaagaagcttaatacggcgctattccctgtccgctacaatgaaaaatactaccaggacgccatcgcctccaaggatttctccaaactagcatactttagcgatatttgtgttggtgcgatagcttgtcgcctggagaagaaggaaggaggagcagtccgagtttatatcatgaccttgggtgtactggcaccgtatcggggtcttggtattgggacaaagctgctgaatcatgtgttcgatctctcagcaaagcaaaacatctccgagatatacttgcatgttcagaccaacaacgatgatgcaattgctttctac

SEQ ID NO: 58922 - DNA, 437 bp, Zea mays
  Clone ID: LIB3069-045-Q1-K1-C11
ggagaatagtattatgctaagcttatgcttcggcccctttcgtcggctccagtcccggctcggcgttgctcctcccctccattccctgtcggcctcttgcgctttccggcctcggattctttgtcgtgtgcgccccctccgttgcatctcgctgcttctccttcttcttcgctttgcatctgagttgagctggagcatcgatcccgtccgcctcgtcctccccgacgcggcttcggctggactccaccgcgctctttagttcggtttccccgtcagagcttccaacctgttctactcggtttagattttggagctagagtttccaaagcaaaagctttccttttttttccctccctcccctttgcatttggcatgaggggaaacgctgcggtttcgccccttttctgagcatgctgtccttgaacaaaatgcatttt

SEQ ID NO: 58923 - DNA, 432 bp, Zea mays
  Clone ID: LIB3069-045-Q1-K1-A8
gcgatggacccggacgcggtggcgttagctttcgtggagcactactaccggacgttcgacaccaaccgcgcggcgctggtggggctgtatcaggagacctccatgctcaccttcgagggccagaagttccagggcccatccgccattgccggcaagctcggatctcttcccttgcaggcctgcgagcaccagatcgtcaccgtcgactgccagccgtcggggccccagggaggcatgctcgtcttcgtctccggttccatccgcaccggccccgaggagcaccccatcaagttctctcaggcattccatttgctgccggcagctgggtccttcttcgtgcagaatgacatgttccgcctgaactatggctaaaagacagccgaaaactcttgtgatgaaccgaattttaaaggcttcatgttgagacgatga

SEQ ID NO: 58924 - DNA, 184 bp, Zea mays
  Clone ID: LIB3069-045-Q1-K1-A9
ggaaaacaactccacccgcaccgtcacactcgtagggcacgactagcacgaccagggcccggtgaaacaccctggggcgcatccaatgccacatacaaagccaccaatccgacaacgacaccaacatatccctagacaaacctgtcggcgatcgacgggccagacgactagagcggaacaacca

SEQ ID NO: 58925 - DNA, 433 bp, Zea mays
  Clone ID: LIB3069-045-Q1-K1-B1
gcttggtgttgaaaccagaagcacaggctttattttctccattggaaaagaacctctgaaaacccgtccttcagtgtttgctctgggtgaacgaataaacattttgaaggaaatcgaccagccagcattgatacctcatatagctgaagcgaagtcacagaaatactcgtatgaagttcttttcagaagcttgcagaaacttcttattgatactgccacttcagaatacctgtttactgatgatttctttggcgaagaatccatattccatgatatatttgcaggaccgattcaagttgttgatgaacatttcaatactgtactcctgaactgttatgatgcaattggcataatgcttatgatcagaataattcatcagcaccagctcatcatgtttaagcggcgaatcccatgtttggactcttacctagac

SEQ ID NO: 58926 - DNA, 200 bp, Zea mays
  Clone ID: LIB3069-045-Q1-K1-B10
ctagttctagatcgcgagcggcttttccttaatcgactaccacaaaaacaaaaaggaaggtttaaactaaaaaaggggacggaccatatcaaacaaaaaaaagaaagaaacaaaatcaaccaagaccaggacacaaaaaacagatcaaacaacacaacacaccgagaacactaaacagacatcaccgaaaaaggcaacaa

SEQ ID NO: 58927 - DNA, 409 bp, Zea mays
  Clone ID: LIB3069-045-Q1-K1-B11
ctagttctagatcgcgagcagccggagccggagccggatccggatgcctagtagatgaagacgttcgatccgtggccggtcttcttccgccgggagtggaagcgcaattggcccttcctcacggggttcgccatcaccggcttcatcatcactaagatgacggccaacttcaccgaggaggacctcaagaactccaagttcgtccaggagcacaagaagcgctgaccaaccaggtgttgtccgaattgcctgtctggacagccagttatgttatgctgtttgaatgaaaaattagcttctttttcttcatctaaatgcgtgcagcctatgctccatctgtaatgtaataagaggcaactgacttgatccacaagctaccagcttctgattatgaatgatacttcaagtt

SEQ ID NO: 58928 - DNA, 413 bp, Zea mays
  unsure at all n locations
  Clone ID: LIB3069-045-Q1-K1-B12
cggcacgcagcgctacgggtctgttcgtctaggcgctcgatccgtagcctggtcgttaaggctgcaactgtcgtcaccccaaagtacacttcactgaagcctctgggagatagggtgcttgtgaagcttggtgccgcagaggagaagacagttggtggcattttgcttccatctactgcccagactaaaccacaaggaggtgaggttgttgctgttggagcaggaaggaccatcggggacaagaaaatagctgtggatatagagactggagcacaagtagtatactcaaagtatgctgggactgangttgaattcaatgactcanagcatcttattctcaaagaagacgatatcattggtattcttgagacagatgatgtgaaggacatgaagcctctcaaatgaccgtgtct

SEQ ID NO: 58929 - DNA, 408 bp, Zea mays
  unsure at all n locations
  Clone ID: LIB3069-045-Q1-K1-B2
aagaagacgacccataccatacccaactgtttgcttgagaatagatagacagaaagaacaggaactcaaccaacacaagacacaacaagctgcagccgcggcaggcatggggcaccgcgcgcactgacaccgggccccaccaccattaccacccgacgcacactttatttagcccacgtcactcgcagcccgcaccggacacgtccacgcgacagtcactgctagctacgtaccgggctacgtacgacacacacacacacacacacagagagacgccagtaaccgtagcgtactgaacagcaaaatcccgtgtcatactgccatgtacgcgcgcgagagactaccccgncacgcgcgcacgccgatcccctggggcctgggccctggccgncgncgctgcgtgcgcac

SEQ ID NO: 58930 - DNA, 262 bp, Zea mays
  Clone ID: LIB3069-045-Q1-K1-B3
ggcgtctcctcctcggcggcgaccgccggtgctgttctcacggtgctgctcgccggctacctcctcctgctcgtgccagagctgtcgcctagctcgttctagaccctctgtcaagttgtgccaccagtaggatttgatgtgttgttgttctttctagtacgtgacgtgacagacaatttgctgctggtgtcgttcttgtagtagttgcactgtgtgttcctgttatgctatgggtacgagatgttagggcatgtgttaagct

SEQ ID NO: 58931 - DNA, 425 bp, Zea mays
  Clone ID: LIB3069-045-Q1-K1-B4
cggacgcgtgggttcttgagcgtggcaggctcaagtatgtctgccaggccactgggccgtccatttggctctggccctcctggtgaccgcccaaggggccctggtcgttttgaagacagaccaaggtttggagacagggatgagtaccgtggtggtcctcgtggtgcttccggtgactttggtggcgataagagtggagctcctgctgagttccagccatctttcaggagttctggcgcgaggtctggctttggccgtggtggtggcagcggctttggcgctggcccgacctcttcttccatggagtgaacagtgaagctgcccttagtttggacatgatgtttcccctcccgtgaggcgtttaattttgaaagacggttattatgtactagtaatgttttccggatcggctagtgctgacatgc

SEQ ID NO: 58932 - DNA, 388 bp, Zea mays
  Clone ID: LIB3069-045-Q1-K1-B5
gatttatcaggaaatccgtttgctttatgttatgcaggctcagatctgattgctggattcggcatcttacgggcttgaatagagctaggactgggagaaaacaacaaacccgcgttggatcctgtatcggttagtccttgccttcaaggttcatgttgttttgttttggtggtcgagcatcgcatgttctgcttctggttccagatctggagaaatttctaagtcgtcgtcgtcgtcgtcgttcggttcggagcggatctgaggcgacgatggctggaagcggcgggatctcttggtctgcagtcctgcttcacctcgatggatgatgtctctgcgctgataattattggatcaatttcgataattattagtagatctatgagatatg

SEQ ID NO: 58933 - DNA, 432 bp, Zea mays
  Clone ID: LIB3069-045-Q1-K1-B6
cccacgcgtccggggtcctcctcgtctcagtacctacacaaacaaagccaccaccatcccagcccagacacatcggccgaccacgggcgccgccatgtccaccgctgacgcggcgagcccggccctggcgccggacggggacgcgccggcgggcgaaggcctggccctggcccagttcgccgcgggctgcttctggagcgtggagctggtgtaccagcgcctaccaggcgtggcgcgcacggaggtggggtactcgcagggccaccgacacgccctcacctaccgcgacgtctgcggcaacggcacgggccacgccgaggtggtccgcgtgcactacgaccccaacgcctgcccctacgacgtcctgctggacgtcttctgggccaagcacaaccccaccactctcaacagacagggcaacgacgtcgggac

SEQ ID NO: 58934 - DNA, 434 bp, Zea mays
  Clone ID: LIB3069-045-Q1-K1-B7
cccacgcgtccggagggattgcactccatttgatgattcacttcatcacaatggcccttggaggtgatggctacttgaattttatgggaaatgagtttggtcacccagaatggattgactttccaagagaagggaacaactggagctatgataaatgcagacgacagtggagccttgtggacactgatcacttgcggtacaagtacatgaatgcgtttgaccaagcgatgaatgcgctcgatgagagattttccttcctttcgtcgtcaaagcagatcgtcagcgacatgaacgatgaggaaaaggttattgtctttgaacgtggagatttagtttttgttttcaatttccatcccaagaaaacttacgagggctacaaagtgggatgcgatttgcctgggaaatacagagtagccctggactctgatgctctg

SEQ ID NO: 58935 - DNA, 436 bp, Zea mays
  Clone ID: LIB3069-045-Q1-K1-B8
tgtttacatctaacgttctttttgttgcatttgaaaatcaatattgcattgtggaccatgggctactgaagacatatgttttgtttacacaaatgaaatagaaatctgaaaaaaaaatgttctgtgaacaggttaccattagcctggaactgcgacaaaataagaataatcgaaaccaataaagcctagcgttttgttgttctactcggtcattttcgtgtcctaaacttgtaattttgctggaatattgtacagggcatctgatgcaaggtgcaaagactggtgtttggtctgcggttgctttcaaggagttgtgtgccggttgcttgcacatctttaactctgggtctgaagagcaaatcagaagtatttatggtttaggaaatatgcacctgctttgctggagaactttgtcctgctatttatttatagacac

SEQ ID NO: 58936 - DNA, 434 bp, Zea mays
  Clone ID: LIB3069-045-Q1-K1-B9
ggattccggtcctattgtgttgttctacttgatcggttccaacaccagccggcgtcatgtcgaagcgaggtaggggaggttcggctgggaacaagttccgcatgtcactgggtctaccggtggcggccacggtgaactgctcggactacacgggcgccaagaacctctacatcatctccgacaagggcatcaagggccgcctcaaccgccttccgtccgcctgtgtcggcgacatggtcatggccaccgtaaagaagggaaagcccgacctcaggaagaatgtgatgcccgacgtcatcgttcgccagcgcaagccgtggcgtcgcaaggacggtgtctacatgtacttcgaagataatgctggagtgattgtgaatcccaatggtgagatgaaaggttctgcaatcactggacctatcggcatggagtgtgct

SEQ ID NO: 58937 - DNA, 425 bp, Zea mays
  Clone ID: LIB3069-045-Q1-K1-C1
ctgaaatgaagggtgggtgggtgggtcgactcactgtccgccgccgaagccgagctccctcgcaaatctctcgcatcgcgttcacagcagatggcggggaaggaggagaggaagcgggtgttggtggtgggcggcagcggctacctgggccagcaccttctcgcggcgtcctgcaccgtcgaccgcctcgacgtcgctttcacccaccacagccccgacccgacgcagccgctcctggagacgctcccctccgtgcgcgcattccgcgccgaccttcgctccggcgacggcttcgaggcgatctccgcgtcctttggccagccacacgtggttgtcaactgtgctgcgatgtcagtttctcgggcatgcgaattggatccacctgctgctatggctaccaatgtgccttcttcgcttgtgaattg

SEQ ID NO: 58938 - DNA, 430 bp, Zea mays
  unsure at all n locations
  Clone ID: LIB3069-045-Q1-K1-C10
ctcgtcgcttccgctccacaggattctcttcgccacccacaaccgtgtgaccgtgcgtgctgccggcgacccctatccgccgacccgtccgtcccaccacaccccaccgccgctcgcagctatgtcgccgtcggagccgacgcgggaggagagcgtgtacatggccaagctggcagagcaggcggagcggtacgaggagatggtcgagttcatggagcgcgtcgcgcgctccgccggcggcgccggcggaggggaggagctctccgtggaggagcgcaacctgctgtccgtcgcctacaagaacgtcatcggcgcccgcagggcctcgtggcggatcatctcctncatcgagcagaaggaggagggccgcgggaacgaggcgcacgccgncttcattcgcgcctaccgctccaagatcgagaccgagctc

SEQ ID NO: 58939 - DNA, 424 bp, Zea mays
  unsure at all n locations
  Clone ID: LIB3069-045-Q1-K1-A7
cggacgcgtgggcggacgcgtggttgcgttactggtccacggacgtaaacctgtcgtggctgggcatgggcgagctgggccacgtccacgtcggcttcctcaaggcgctgggcctgcaggaggaggacggcaaggacgccacgcgggcgttccccaaggccgcccccaacgccgtcccgggcaagccgctggcctactacgcgctgcgcgaggaggtccagaagcagctgcagaagcacccgaacgccaacgtcgtggtcaccggccacagcctcggcgccgcgctggcgaccatcttcccggcgctgctggcgttccacggngagcggggcgtcctggaccggctgctctccgtggtcacctacgggcagccgcgcgtgggcgacaaggtgttcgcgggctacgtgcgcgccaacgtgcccgt

SEQ ID NO: 58940 - DNA, 354 bp, Zea mays
  Clone ID: LIB3069-023-Q1-K1-B6
caagaaccacaagtttctgttttattcttaaacatggccaagaacatggaactgatcgcacaatgatacactagaacacaacaccgtcaggaacgtggaagtgagcacagacagtggtacagtagtaggaagacaagtcgagcacgatggacagagtaggcatcacccaacagatcgatcgtcatgagctcagaaggattttatgagatcaaccaaatcggttaaatccgtgcggggcgacgcagtttcgtcgacgtcgacgccgatgccgatgcctttggccgcagcgatcttgaattccttcatcctctccttgatctcctccccttccttggtgccaaagagcctgtcgat

SEQ ID NO: 58941 - DNA, 412 bp, Zea mays
  unsure at all n locations
  Clone ID: LIB3069-023-Q1-K1-B7
aagagttagagaatgaagggattgtttttgtggaaaaaattattcagaagcacttttgctcctggtttaagaagcatgtgagtttcaagttcatatcctcagcatcaataattgacttattttcaccatggatttttttatgtcttcagattgcaagtttgcgttttgtcgatggagaagacattgatgatgacctatatgcattggcatgcgaacctgatttgcgagttcgaattttttctgcatgtcttgttgatggtgtccggtaccacaccattgaccgtgagagaaatagaagaacccaaaatagtggagtcatggttgagggcactcataataatgaatgcattgatttttatggctgcttaaaagaaattatcgagttgcagtataactcanatttgatggagca

SEQ ID NO: 58942 - DNA, 407 bp, Zea mays
  Clone ID: LIB3069-023-Q1-K1-B8
cccaaaaggcaaaccaaccaccagtcttaccaccctccgcctccgcctgcgccacagctgccgattcgaaagccctcgtcctgacccctcgcaaaaccctagctccaaccaccatgaagggcaaggccaacgcctccaagaaggatgagggcaggctccgggccggcggcggcggcgccggaaagcgcaagaaggccgccgcgagcggcaagcccaagcgccctccctccgccttcttcgtcttcatgtctgaattcaggcaggagtaccaggcgcagcaccctagcaacaagagcgttgcggccgtgagcaaggcagcaggggaaaagtggcgctctatgtcagagcaagagaagcaaccctatgtggaccaagctgggcagaagaagcaggactatgagaagact

SEQ ID NO: 58943 - DNA, 242 bp, Zea mays
  unsure at all n locations
  Clone ID: LIB3069-023-Q1-K1-B9
atcctcactcgctgggaggcctgcacgaagcagacggcgaggaagtccaccggcggcaaggcgccgaggaagcagttggcgactaaagcggcccgcaagtctgcccctgcgaccggcggagttaagaagccccaccgcttccgccccggtaccgtcgcgctccgggagatccgcaagtaccagaagagcacggagctgctgatccgcaagctgncgttccagcgcctggtgcgggagatcgc

SEQ ID NO: 58944 - DNA, 385 bp, Zea mays
  Clone ID: LIB3069-023-Q1-K1-C11
aaagcagcatatgccgaggaatctcatttcaatacggaacgaggtacacccgcgtctcgaacatgcaaattgtgcagctggtctttttgatgtcaagaaaatccctctacaaatggaactcattacgagcacggatgtggtcatgaatctcttgaagaaaatggctccccctcttgttactctttttgcagcaaatcctgaaattcaccatgtaatcttgaggaacattaatctgatagttcaaaagagggctaccatactccctcatgagattaatgatttcttttggaagtacaatgaccctatatatgttcagatggaaaagctggagactatgatgcagcttggctcagatcgaaatatacatcatgtgctcttggaattc

SEQ ID NO: 58945 - DNA, 279 bp, Zea mays
  unsure at all n locations
  Clone ID: LIB3069-023-Q1-K1-C2
cgttgcaagaagatcttgggaccccggcattgttctgctaacggccgaagtgatgccttggaggtgaggcactattctcctctattgtaattccctaaccttggacgcaacctgatccccaagaaagaccgtgcagcgcgggctgctcgttgatcatgccagcggggaacagcaagcagacaaagcagcacgcaccacgggccttcgctggtctgcctgcctgtgcaggcgtcgngtaaatgtattgtatttgcagggatcctgtttacagcgctagta

SEQ ID NO: 58946 - DNA, 312 bp, Zea mays
  Clone ID: LIB3069-023-Q1-K1-C3
cccttcttgtttttaatccttatcccttgaccttttaagaatgggttggcggcggcgacttccggcgcaagcgcaaccccaaccggcggggggttcggaccgccgccggccgggccagggggggggaacgccttcgtgcattaatactacaacattctgcaccaatcggcggagctcgtctaccgcttctaccaagagtccagccgcctttggcgtccctccggcaccggcgacgacggcatggagacggtcacctccattgacgcgattaacgacaagatcgtgtccatgggcatcgaccgggcggagatc

SEQ ID NO: 58947 - DNA, 270 bp, Zea mays
  Clone ID: LIB3069-023-Q1-K1-C4
tttttgggcattattaaaccttcgcacacttctatgcataaagtgctccggggtgcacccaagatctgggaaagcatattatcaaaagcttgatctatcacactggatgtcagagtttggcagccatatctaatcaatcattctcagtcattacgcaacatgtttgacaacactatttaggaagacatgttgacagataatcatataagcgctaatggatcatacacatcacacttcctctctgctagcacgcctaaacacacagatgca

SEQ ID NO: 58948 - DNA, 377 bp, Zea mays
  Clone ID: LIB3069-023-Q1-K1-C5
cgtcggccacgcgttcggccaagcctgccaattttttgttatattggcctaaccctttgacttgacctattgaacaaaacaaggctcagctcgttgtcatcgctcatgatgtggatccgattgaactggttgtttggcttccagccctgtgcaagaagatggaggtcccatactgcattgttaaaggaaaggctcgccttggatcgatcgttcacaagaagactgcatcagtcttgtgtctgaccactgtcaagaacgaggacaagcttgagttcagcaagatcttggaggctattaagtttgatgaagtcaagaagaagtggggaggtggcatcatgggctccaagtcgcatgccaagaccaaggccagggaaaag

SEQ ID NO: 58949 - DNA, 304 bp, Zea mays
  Clone ID: LIB3069-023-Q1-K1-C6
ggcacctggcacaactattccaagtaaagggcgtcattgctgctccctattttggtccatatagtgctgctacatcattcaaacgcctatttaaacaatcttttcctctactgtacaagtactttcaagaagctcctgcaaatacggtctgctggactgacattatccattggatgtgggcactcttcatggaaagttggggatcatggagaaatgagtgtctgaatcttagccccattcctttcacagatccagtaaccaatcttcctttgtggcatgtgcgagaggagtcacctttattact

SEQ ID NO: 58950 - DNA, 429 bp, Zea mays
  unsure at all n locations
  Clone ID: LIB3069-023-Q1-K1-C7
cggacgcgtgggcgcgagaacgagatgtctagaccgcatncagtggtggngctcggtatgggcggaagcgaatgcgccctgngcgacgccgctataggcgaggaaaccctaaattacgacggcgatgacgttgagatggccgacgccgactcggatacggaggaagcccgagcagctgaggtctccgctgcaactggaggatccgccggaggtgttaggcaggcggagaaggacggaccggatggaaagaagaagaggaagaagaggaggaacaaagggaagaagaacaaagggaggcaagatggggcgcccaccaacatcgcggacattaatcgatttgttcttaacacttgcaagcgcttgaaggagaagaagtcgtaccttgtctggaatgctgttggctgccttggtgtcactgctgtcaatgat

SEQ ID NO: 58951 - DNA, 237 bp, Zea mays
  unsure at all n locations
  Clone ID: LIB3069-023-Q1-K1-C8
gcgcccacgcgtncgnatacctcatgtcattataaaatagtaagtatatgcctagagagcggagcgaggagcgagcgagctcactccgtgttcaatcgagagagctcgtttagcttggccaacgacgagcagagcagtagctatgatagatccatggcgaacgcgggcatgaagccggtggccggactcctgctggtgctcaacttgtgcatgtacgtcatcctggcggcggtgggc

SEQ ID NO: 58952 - DNA, 458 bp, Zea mays
  Clone ID: LIB3069-023-Q1-K1-C9
cgtctcgctcgtggctgtcctgctcatactgcttgccctcgccgtatcgtccacccgcaacgcacaggaggattccatggccgacaacaccgggacgttggcgggcggcatcaaggacgtgccggggaacgagaacgaccttcacctccaggagctcgcccgattcgccgtcgatgagcacaacaagaaggccaatgctcttctggggttcgagaagcttgtgaaggccaagacacaagtggttgctggcacgatgtactatctcactattgaagtgaaggatggcgaagtcaagaagctctacgaagctaaggtctgggagaagccatgggagaacttcaaggagctgcaggaattcaagcctgttgaagagggtgctagcgcctaaagatctctccttctccatgtgcgagcctgaagctcaaagcaaaagtgcagaataagaatcatgctccctt

SEQ ID NO: 58953 - DNA, 394 bp, Zea mays
  Clone ID: LIB3069-023-Q1-K1-D12
caactgccagattggagcattcttctttcggctggcactaccatcttcctggcagcagagaatcaggggacacttgttgactggaagcccaagaaacccgacatgcttgttgatacatttggttttggcgggatcatccaggatgggatggtgtttatgcaaaacttcattattcggtcctatgagattggtgccgatcgtactgcttctatagagacattaatgaatcacttacaggaaacagctcttaaccatgtgaagacagctggcctttttggagatggttttggcgccacgccagatatgagcaaacgaaacttgatctgggttgtcagcaaaattcaacttcttgttgagaagtacctcttgtgggaagacacggttcaagtggaca

SEQ ID NO: 58954 - DNA, 350 bp, Zea mays
  Clone ID: LIB3069-023-Q1-K1-D2
gcaattgatgctcctggagggtttctctttgagtgggggtctgtcttttgggatatattcatcgcaaggacaaatgaaaagcattctgaagttgcagcggcatatctagaggcacagcaaataaaagcaagagagcaccagcagcagatgcagatgcagcaattgcaacttatgcatcaaagacatgctcaacttcagcgaactaacgcgaatcatccttcacttaatggtccaataaatgctttaaattctgagggcattttggggccatcaacagctagtgtcttagctgccaagatgtatgaagagcgattgaagcacccacattcaatggagtctgagggatcaca

SEQ ID NO: 58955 - DNA, 259 bp, Zea mays
  Clone ID: LIB3069-023-Q1-K1-D4
ccggggttcccccggggcaaaggcccgccccccacagggtcgggcccttgttgttttgagacatggcccacataaccgggttcgtcgccgcccaggaagctgcaaatccttttgaatattgtgatgtggttaccacaaccacgcacaagtccctcagagggccaagggctggcatgatcttctacaggaaaggccctaagccccccaagaagggccagccagagggtgctgtttatgattatgaagacaagatcaactt

SEQ ID NO: 58956 - DNA, 350 bp, Zea mays
  Clone ID: LIB3069-023-Q1-K1-B3
aaaattggaaaagttgattctgggggtgacccgagtcgggaaaggagaagagaaagggggagatctagagggcgggaacgtgatgctaggggtagggattctggatcatgatagcaggggtcgtgactctgatcgcgagagggatcggagacgtcgctctagggatagaagttcaggacactcatacaaggagaaatcaaggcgccatccatcacacgaccgagttgactactacagttcgcattcatctcgtgaaaaagatcggcatagacaccattgatcccgggtctgcagggctttgctgcatggagaccaccacatggcattgccgacaagatcatgaaaacttg

SEQ ID NO: 58957 - DNA, 221 bp, Zea mays
  Clone ID: LIB3069-023-Q1-K1-D6
ctttggaatatcttttcttgttgcctacaagttgtgtttctttttgcttactatgtggactctgttagcaggagtcttcatttgcgccagcacctgctgaacctacactggatcatttaagatccttggcgaggaagctgcttgctggttatattgacatacccacaatcacaaacctgagatggtccctgggatactattaaaagatggaaactattgac

SEQ ID NO: 58958 - DNA, 449 bp, Zea mays
  Clone ID: LIB3069-023-Q1-K1-D7
cttggtctgatcccatcttaattttttttagaggtcctgaaccaatggaaggacaaatcattaaagcgagcagggctgactgaagaacaattgcaagagcagattgagcagagaaatgtcgcaaggaagaataagcagtttgagatatctgatggaatcaggaaaaaccttgctaccaaaggcatcgccctgatggacgagccttctggtacagtatggagaccatgcgaaccagagcggtctgaagagtcatgattagctcactgactcaacaagtgatggtggtgtaaaatgagatttttgcctgagggcagttatcacattttgaagactaacaaaaatcgccatctctggatgtggtattctacagggtaggggttccaggttgactcaccagttaaaacatgcatttctggttgtataacaagcaatgaaccccgtatatatac

SEQ ID NO: 58959 - DNA, 388 bp, Zea mays
  Clone ID: LIB3069-022-Q1-K1-H3
gcgacacacgctgacagctcacggctgaccttcccgacggcctccagctccatcttgattgttgaggcgaagccccggtgcgtaagagtctgccatggccagcgagaataaggtctttgggttcgaggaagtcgccaagcacaacgtcaccaaggactgctggatcatcatcgccggcaaggtgtatgacgtcactccgtttatggatgagcatcctggtggagacgaggttttgctagctgtaaccgggaaagatgctacagctgatttcgaagatattggccacagtgattccgcaagggacatgatggagaagtaccacatcgggcagatagatgctttaacaatcccagcaaagcgtgctcatgtgcagccccagcaagcaccc

SEQ ID NO: 58960 - DNA, 401 bp, Zea mays
  Clone ID: LIB3069-022-Q1-K1-H5
gagcactgaagcagagcgagcgagctgtcctgccaaaccctcacggccgcctccacaatgccgcgccatctcgcgctgctcctgcccctgctactgctggcctcgccggcggccacgcgcctggcgtccgccgcctgcgcgggcgagaagttcccggcggggcgtgcgtacgcgtcgtgcgaggacctgccgaagctgggcgcgtcgctgcactggacgtacgacgcgtccaagagctccctgtcggtggcgttcgtggcggcgcccgcggcggcgggcggatgggtggcgtggggcctgaacccgacgggcgagggcatggccggcgcgcaggcgctggtggcgctggcgggggccggggccgcggcgcccgccgtgcggacgtacaacatcacggggta

SEQ ID NO: 58961 - DNA, 434 bp, Zea mays
  unsure at all n locations
  Clone ID: LIB3069-022-Q1-K1-H6
cacccttgaggtcgagtcttctgataccattgataatgtcaaggccaagatccaggacaaggagggcatccctccggaccagcagcggctcatttttgccggcaagcagctcgaggacgggcgcacgctggccgactacaacattcagaaggagagcaccctccacttggtgctgcgtctcaggggtggcatgcagatcttcgtgaagacacttactggcaagacgatcacccttgaggtggagtcctcagacaccattgacaacgtcaaggccaagatccaggacaaggagggcattccaccggaccagcagcggctgatcttcgccggcaagcagctggaggatggtcgcaccttggctgactacaacatccagaaggagagcaccctncacctgggtgctcgnnctcagggtggtatgcagatttttgtga

SEQ ID NO: 58962 - DNA, 440 bp, Zea mays
  Clone ID: LIB3069-022-Q1-K1-H7
cggacgcgtgggcaagatgtcttgaggttaatgcaccatacctatcgaaaccagggatttcagttgtatgttagcttctttgagatatatggtggcaaattatttgaccttctcaacgataggagcaaactttgcatgagagaggatggaaagcaaaaggtttgtattgttggtttgcaagagtatagagtgtccgatgtagagactatcaaggagttgattgaaaaaggcagtgctaccagaagtactggcacaaccggtgcaaatgaagagtcctcaaggtctcatgccattcttcagcttgccattaaacgccgtgtggatggcaatgactccaaaccacccagaccagtcggcaagttgtcatttattgaccttgctggcagcgagcgtggtgctgatacaactgacaatgataaacaaacaagaatcgagggtgc

SEQ ID NO: 58963 - DNA, 310 bp, Zea mays
  Clone ID: LIB3069-022-Q1-K1-H8
gcggtggggcacgaacgaggcgctcatcatcatcatcctcggccaccgcgacgccgcgcagcgccgcgccatccgtcgcgcttacgccgaggcctacggcgaggagctcctccgctccatcacggacgagatctccggcgacttcgagagggccgtgatcctgtggacgctggacccagcggagcgcgacgcggtgctggccaacgaggcggcacggaagtggaagcccaggaaccgtgtgctcgacgagatcgcctgcacgcgcaccttcaagcagatcatcgcgaccaggcaggccttatacgagcgg

SEQ ID NO: 58964 - DNA, 290 bp, Zea mays
  unsure at all n locations
  Clone ID: LIB3069-023-Q1-K1-A10
cccacgcgtncgggaggcatttacaagtttgtgatcgaaaggttcgagaaggaggctgctgaaatgaacaagcggtccttcaagtacgcgtgggtgctcgacaagctcaaggctgagcgtgagaaaggtatcaccattgatatcgctctgtggaagtttgagaccaccaagtactactgcacggtcattgatgcccctggacaccgtgacttcatcaagaacatgatcactggtacctcccaagctgactgtgctgtccttatcattgactccaccactggtggttttga

SEQ ID NO: 58965 - DNA, 314 bp, Zea mays
  Clone ID: LIB3069-023-Q1-K1-A11
ggcccttgagctcccctcccttatgacttccccatggtgcctctcggcaccgcccgcggccctaggcttctgcgcgtctgcctccaccctcgcgcgtgtgccggttcccggaagtaggcggcgcaagtggaacgcgctcgtggtctgcgcgggccccgatgaggagaagattacgaagcggtcgcccctggatttccccatcgaatgggagagaccaaaacctgggaggagacctgatatcttccctaagttcagcccaatgaagacaccattaccgcatccattggcagctgatgatcctctggatgatgatg

SEQ ID NO: 58966 - DNA, 334 bp, Zea mays
  Clone ID: LIB3069-023-Q1-K1-A12
tccacttgtcctccgccccatattcgggctattctaactcacgatgttctccggcaccaggacctcccgcggggccacccactctacgtccaccggtggtgggggtggctcgccttccaacaggggcgggcccgcgccctcggccttcgagtaggtctccacgccagccagcgagagcaccgtcgcccgccggctaaaccgacttgacccccacggcgacgacgctccatcgtcgcaaccagccacgagcaagaagaaaaagagaggggcacgggcagttggtcctgacaaaaatggccgtggattgcgtcaatttaacatgagagtatgtgag

SEQ ID NO: 58967 - DNA, 278 bp, Zea mays
  Clone ID: LIB3069-023-Q1-K1-A2
ggcccttattttttttaatataaaaaataaaatgggataagacatctaaaaataagttggtgggtgggtgctcaactcagctcaccctatctttctcttatcttacgccgtcgtcgtcctgctccggcgacggccaggcagccgagcagataaaaagagccgaagcagcaccaccaccacgtgcctctcttctcagcttgcctgcctcactgcacccggccacaagggcaagatgcccgcctctgtcgctgtctacccggccaagatggcatgctgtc

SEQ ID NO: 58968 - DNA, 265 bp, Zea mays
  Clone ID: LIB3069-023-Q1-K1-A5
cggacgcgtgggctcatgttattgaatatagaaatttcaggtctattggttttacacagatttggttgtgatgcttcaaaccgcttatgatttttgttaaaaaagttgtgccatgagcatatcacataatatatgagaatcttaggaataaaccaaggtgcttatgagtgaaattttggctttgcttttttaaaaatattggttcaagttggttctgacagatgccactgcacaaatggacgttgacacgttgtagtgatcacac

SEQ ID NO: 58969 - DNA, 382 bp, Zea mays
  Clone ID: LIB3069-023-Q1-K1-A6
aggaatcaaataatttgggaacttcctttttaacactccttgtctgagacaaaaacactgcgagaacttttaggccatacaccaacccatgtggttgctggtgcattgcttgggtgtacaataaccacagcaggacaattattcctttgaactacgaaggtgcggcagaaatgttgtagcatttgtatcgcagggacttgagaagaagtttctccagtgttctgctactttaggtattggtaagatttgcaagttggtgctgtagtgttggtgaatgttgtatgttctgatggaatgtggttatatgtcaaaaaagtgacgttcacaggattgctgtacagaacatttgtcatgggtatgattgatgaaatctaacatgtga

SEQ ID NO: 58970 - DNA, 440 bp, Zea mays
  Clone ID: LIB3069-023-Q1-K1-A7
gcggatcgtggaaagcaaagcctagaaacaatatgtcttcttttggcttacaaggtcaagtacccggagaacttctttcttctaaggggcaaccatgaatgcgcatcagtaaatcgcatctatggtttttatgacgagtgcaaacgcagattcagtgtaaagctgtggaaaacattcacagactgttttaactgcttgccagtgtcagcattgatagatgaaaagattctctgtatgcatggtggtctatctccggagttgaacaagcttgagcaaatactcaacctgaatcgccccacagacgtgcctgatactggattgctctgtgatcttctttggtctgatccttccaatgaagcaacaggctgggccatcaatgatcgtggtgtttcattcacatttggtcctgataaaggttctgaatttcttgagaggcatga

SEQ ID NO: 58971 - DNA, 106 bp, Zea mays
  unsure at all n locations
  Clone ID: LIB3069-023-Q1-K1-A8
agacgttttatcatcatgttttgttgcttttggttcttgaacagcgtttgcagctagctgtaatgctttaattcgactttctatatattgntgaaccgtgttgtcg

SEQ ID NO: 58972 - DNA, 264 bp, Zea mays
  Clone ID: LIB3069-023-Q1-K1-A9
gggcaggcagaaccgctcgccaacaattgtcatcgtttggtccatccggcttgcgtgtatcttctccttgctgtgggtgaagatcgatcctttcatctccccgacacagaaagctgccgccttggggcaatgtggtgtgaactgctgatccagattgggacctcttatctgaagaggctcatccaaagatctgccccctcgtgtaaatacctgagggggctagatgggaattttttgttgaaaatgaggatggacctccatcca

SEQ ID NO: 58973 - DNA, 307 bp, Zea mays
  unsure at all n locations
  Clone ID: LIB3069-023-Q1-K1-B10
aaaccctcacngggcggggcacaaggacattccatatggcgctgctcctgcccctgctactgctggcctcgccggcggccacgcgcctggcgtccgccgcctgcgcgggcgagaagttcccggcggggcgtgcgtacgcgtcgtgcgaggacctgccgaagctgggcgcgtcgctgcactggacgtacgacgcgtccaagagctccctgtcggtggcgttcgtggcggcgcccgccgcggcnggcggatgggtggcgtggggcctgaacccgaacggcgaaggcatggtcggcgcgcaagcgcttgt

SEQ ID NO: 58974 - DNA, 414 bp, Zea mays
  Clone ID: LIB3069-023-Q1-K1-B11
gcggacgaggtacctgataaaaatgtagataattagattgagaaaggttgcgagcagtgttggtgttggcgacaaacatgatgctgagtgggtacactctattctggcagacgctggtgcagctaatgataattcttggatcctacttccatacctttgtgctgcattcatggtgtccaacatttggaacggtgctgtttatgatgtcaatataggtggactcagtaacaatttgcactgcctagcaaggtgtgtaagtgctgtgattgggggaagcgaatacactcgggtcgaaagggagcagcgaataaattctctttcaaatgtgcatacagatgagctgcaagaggccgagttaccgagccgtgtctcagcagaagcaaatatcaaatcttgtatgcagatctacgtcaa

SEQ ID NO: 58975 - DNA, 137 bp, Zea mays
  Clone ID: LIB3069-023-Q1-K1-B12
gccgatcatccaaagacacgttggcgttaataacgattagaatgaacaaagggctcggaaaaagttccatttgatcgctcccctccggggaaaattgagtggaggattccaaaaaaacccccaaaacgaggcccatt

SEQ ID NO: 58976 - DNA, 277 bp, Zea mays
  Clone ID: LIB3069-023-Q1-K1-B2
tgggcgtgggttgcgtgccctctccaggcccagattgactctgttctggatcttgcacggtgcacaattgtgtccgagctctccaacaaggatttcgactcatatgtcctttctgagtcaagcttgcttatctatcctctgaagattgtcatcaagacctgtggcactaccaagctcctgctcaccattccaagaatccttgagcttgctgaagagctgtctatgccacttgctgctgtgaagtactcccgtgggacgttcatctttcctggcgcac

SEQ ID NO: 58977 - DNA, 323 bp, Zea mays
  Clone ID: LIB3069-022-Q1-K1-H2
gtttgtcatggcgcgatccaataccaacgtttcatttaagtcggccccaacaaatgcttcgagcaggtctattcctaatgtgccgcgcgtcatcaaaaagcctaccggttctactattgcctatcatctttacaaaaaagccaccaacttcagcgagaagaatatcctgacctattaccttacacgtggtaccctctatgtgaccctatttacaactgacgaacgtttctctcaagttaatgcctcagctcgcgactcccatctttgtacctatgacttacacaacacgatgacctaccactttatccaagactcccagacaa

SEQ ID NO: 58978 - DNA, 239 bp, Zea mays
  Clone ID: LIB3069-022-Q1-K1-G1
gcagacatgatgagtcatcatccactggggaaaaacaagcaagcaaatggtggtgggtttttggatggggccctcgctttgatagaacatagcaattgtagcgtcaaaaataaacaagagttgggtagtttaggtaccgtgtttgcgttcattaaagtgaagtattctgtatcaccacaggtaaccttgattgtggtgactagtttttttttgtttgcctcaccgtgttccagtcccct

SEQ ID NO: 58979 - DNA, 154 bp, Zea mays
  Clone ID: LIB3069-022-Q1-K1-G10
cccacgcgtccgcgcttttgtatttgtcggacccgtaactaccagggctctgctattagcggcacggagcctgtaattgtattgtatgataatgtgatcgagggtgctacttcccctcggcattcctagtgttggttaaaagtcgttcgacagc

SEQ ID NO: 58980 - DNA, 412 bp, Zea mays
  Clone ID: LIB3069-022-Q1-K1-G11
ctccacttcgaacgccaagtggagagccgtcgccagtccggcacacctccgcgagaagtggatgcacggctgcgcgtcgctcgacgggaaggtcgttgtggtggcggaccgtggcggcttgtcctacgatccttcggcgccacctgcggaggcgtgggcaccggtgtcgccggtgcttgacatgggatggaagggccgagctgcagtggttgagggaatcctctactcttacgattacctgggacaggtcaaggggtatgatccggacactgattcttggagcacagtggaggggttggagagggagctacccaagttcttgtgcggcgccacgcttgccgatgttggaggattgctctacttggtttgggaaggaaagtggaaagggaaattgaaaggtaagatggaagtg

SEQ ID NO: 58981 - DNA, 451 bp, Zea mays
  Clone ID: LIB3069-022-Q1-K1-G12
aaagcccacgcgtccggggagacaagacttgtatttggattccaaaggctattgtaactaaccttgtaggacccaacaagagttgggtacctaaaacccaagcgtaaattgtcttgcaggtttatgcatctgggggctcaagctggattatcgacagcggatgcacaaaccacatgacggaggagaagaagatgttcacctcctacgtcaagaacaaggattcccaggatacgatcatctttggagatgggaaccaaggcaaggtcaaaggcttgggcaagatagccatcaccaacgagcactccatttcaaacgtatttctagtagagtcgcttggttacaaccttctttctgtaagtcaattgtgccacatgggctacaattgtttggttacaaatgttgatgtttctgtctttaagagtgatggttcattagcatttaagggtgtatt

SEQ ID NO: 58982 - DNA, 429 bp, Zea mays
  Clone ID: LIB3069-022-Q1-K1-G2
cccacgcgtccgctttgctacaatgatatataatttatttgtaaatatatggcaccaagatttgtgtattctttgcatttcctttattaatatatctgaattatgaagcataactattacccaactggttatagaagtaagttgtgttttctctagttttaatgttatcataaataagtttaaacatgtttgaacaataacttatttgaacaccgtagcaatgtgtgagcactcttcaaatgtttggtataaaaatacttgtaaatagatttgttagttcttactgcgaaccaaggatggtttcgattctgtggcgctgacggtgtttcacgcgacctgtagcaggtccgacaactgcctagaggcacacactagagcagacagaaaggatctctgtatactctctgtgatcttggaatcagatcgttt

SEQ ID NO: 58983 - DNA, 373 bp, Zea mays
  Clone ID: LIB3069-022-Q1-K1-G3
cccacgcgtccgcacaaatccttggtgcggtcgataagtacatatgccagttctctgaggaatcaaacaatttttggggaagtaggcatgaactaatgctgggaaacactttcatttccaataaagagtcaaccccaccgcaaggggaggtgccccctcaggatttctctaggcgtgttttggaagggttccaagtcaccccaatatggcatcaaggtttcatacgtgatgatggaaggtcaaactacgtgccaaatgtccaaacagctcgctgggagtacagcactcgtccagtttatgggtggggtgatgtcaaatctaagcagttgtccacagctggttggcttgcagcttttcctttctttgaacctca

SEQ ID NO: 58984 - DNA, 431 bp, Zea mays
  Clone ID: LIB3069-022-Q1-K1-G4
caaggtcgtcgatgttcagatcatgctggagaggctcacaaaccgccacaggggctttggcttcgtgacattcgaagatcgaagggcagttgacagcgctatcaaagagatgcgtggccaagagttagatggtcgtaccatctcagtgaacaaggctgagcctaagatgaatacagatgacacaaggttcgacaatggcggtggacgagactatcgaggtggtagaggtgatggtccaccccctggcaattgctatgagtgtggccgtcctggtcattgggtccgtgactgcccgagtgctgttggtggtcgttctggcagattcccgtccaagttcagtgatggtggcaggggagaccgcttttctggatcagataggtttagtgatcgttacatggatgatcgttatgatggtgggtcgtatgggtacc

SEQ ID NO: 58985 - DNA, 347 bp, Zea mays
  Clone ID: LIB3069-022-Q1-K1-G5
cccacgcgtccgcccacgcgtccgtccacgtgtccgaaaaaaaaaaaaaaaaaaaaaaaggggaaaaaaaaaaaaaaaaaaaaaaaaaaaaaaaaaaaaaaaaaaaaaaaaaaaaaaaaaaaaaaggaaagaaaatataaaagaaaaaaagcattaagattgctacagtgaaacaaaaatggtttagtttagcaacacaaaaatacaatatacatgggggtggattaacaacgtattaaagggggaaaacaattgagatacatgaacttagattggatggaagcacatttcattttggtcaattggtgataattggtaaaaggagcagaaggatggcattatgaaaa

SEQ ID NO: 58986 - DNA, 428 bp, Zea mays
  Clone ID: LIB3069-022-Q1-K1-G6
cccacgcgtccgccaaaagcagcttctttctcgggggtccggccacttccaggagttcttgcctgcgaagcttgctccgttctttcgcctgcttgccctcactcctctatcgccttggcctgcttattgcccagacagtttctgcttgaccccacgattcttcactgatgattcacagaaagcttggcgagcacgtacataacttgccgatcggacagttgatggacggcacgagcccaaaccgtacaagtccacaataatttctccctccggctccggctccgcctagactcactcgtccatgtcgcgcgccggccgctccctgcccctgcccgtggcggcgctcctgctcgcggtggtggcgctgtgcgcggcgcggcgcgcgcgcgcgatcggcgtgaactggggcacgcagctgagccacccgc

SEQ ID NO: 58987 - DNA, 407 bp, Zea mays
  Clone ID: LIB3069-022-Q1-K1-G7
cccacgcgtccggggcgactcagtcaacatgaaccaatgggtctctctcgtgtgcatggtggaggcctcaatacctgacgacaggctcaagatacgcaccttcaatggctcactcatctccttcaaggcattggaatacaacgcaacgatagatttctactggtcaccactactggtggagtctaacagcgacaaccccattatccaccgggtggagtaccggatcataagggcagacagaattgagaagcatgccagtgtctggagggatgccgacatcattgtcttcaattcttacctgtggtggaggaagcagaaggatgacatgaggatgaaggtcatgtatggttcgttcgaagatggtgatgcaaagttagacgagatggaaaatggtccatggtttcgag

SEQ ID NO: 58988 - DNA, 387 bp, Zea mays
  Clone ID: LIB3069-022-Q1-K1-G9
accgtacataggcagggacgaagcgttggttggagccaatggagtcggtgggtcggagtccgagcggaagccgctgtcagaggtggtcggcgactgcgtccagcgctggttccaggacgcgtacaaggaggcgcgcaaaggagacatcgccaaccaggtgcttgtagcgcagatgttcttctcgggttatgggacccccaagaacgagtacaagggaaaacaatggatggatagagcatcaaggttcaggtcttccgctttgaaggttggcatgaaacgtccaggatacaatgcaagtgactcagactctgatgacgatgcaaatgatgacgccaaccaataacactcaattacaaattgagttattagttaggagattcacaagga

SEQ ID NO: 58989 - DNA, 397 bp, Zea mays
  Clone ID: LIB3069-022-Q1-K1-H1
cccacgcgtccgcagctaataaggtaaggtgcgactaaaatggctccaacgaccgccaccaaggacgacagtggctacggcgacgagcgccggcgcgagctgcaggcgttcgacgacacgaagctgggggtgaaaggcctggtggactccggcgtcaagtccatcccgtccatcttccaccacccgccggaagccctgagcgacataatttctccggcgccgcctctgccgccgtcgtcgccctccggcgccgccatcccggtggtggacctctcggtgacgcggcgcgaggacctagtcgagcaggtgaggcacgcggccgggacggtgggcttcttctggctggtgaaccacggcgtggcggaggagctgatgggcggcatgctccgcggggtgc

SEQ ID NO: 58990 - DNA, 443 bp, Zea mays
  Clone ID: LIB3069-022-Q1-K1-H10
cggacgcccacgcgtccgcttccctttgaagatgtacaatgagttgaggagagtggaacatgttgaccattctagaaagtctgcagagcaggctgtaaaggcgatcaagggcaaagagtccggtgaaccagttccggagtatgactacctgccatacttctactcccgatcattcgacctggcgtggcaattctacggcgacaacgtgggcgaaaccatcctgtttggcgacagtgaccccacctccagcaagcccaagttcggctcgtactggatcaaggacggcaaggtcttgggcgccttcctggagggcgggtcaccggacgagaacaaggccattgccaaggtggcgaaaacccagccgtcggtcgctaacctcgaggagctcaagaaggatggcctccagttcgccagcaagatctgagacgctcccgttccatgta

SEQ ID NO: 58991 - DNA, 314 bp, Zea mays
  Clone ID: LIB3069-022-Q1-K1-H11
cctaaatccatccccttgccaagctctctctttgctgcgggaggtcgaggccggggagggcttgttagaaaggatgcagagcacgctgcaaacccgatcaaggtcataactgtacgctgaaccagttgcccaatatcactacctaccatacttctacttgcaatcactagacctgccttggcaattccacgatgacaatgtagtcgaaaccatcctgcttggagacagtgaccccacctacatcatgcccaacttcggctcgtactggatcaacgactgccaggtcttgtgcgccttcctggaggacggtccac

SEQ ID NO: 58992 - DNA, 445 bp, Zea mays
  unsure at all n locations
  Clone ID: LIB3069-022-Q1-K1-H12
ctcgggagttgagaggcatgtgaccctcttcactcgcttgaccctcctcttcactcgctggtcccagaagtcacgcaccaaacaccaccaccaaagaaggcgagaacgtactccgtccctcccctcccctcccctccccttcccctcgaggctccaggaccgtctcctcgcctgctcatccgccgctgctccccttctctgggctcggagaaccggagagaagcgcgcgcggccatggcgtccagcgcctctcggttcatcaagtgcgtcacggtcggcgacggtgccgtgggcaagacatgtatgctcatctgctacaccagcaacaagttccccactgactacatacctacggtgttcgacaatttcagtgcaaatgtagttgtggatggcaccactgtgaatttgggcctttgggataccgctgggcangaagattacaacc

SEQ ID NO: 58993 - DNA, 402 bp, Zea mays
  Clone ID: LIB3069-022-Q1-K1-F9
ggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggccgcggcgggtacggtggtggcccgtgaggcggcg

SEQ ID NO: 58994 - DNA, 252 bp, Zea mays
  Clone ID: LIB3069-049-Q1-K1-A10
aatggaggaagagaaagcggcggcgtactacgtcgagctcaatcgcaagggcgagggcgcgcgccgcttcaagcaggggcttggcttctcctcctcatccgccactgccttcccttccaagcccaccgcctcctccttcctatccggttttgttcgcgcgggcgcagcccctggccccgccaaacagccgttaccgcattccaggaccccatccagtccgcaccatcgctcaagttcaccgcctctttcgcg

SEQ ID NO: 58995 - DNA, 399 bp, Zea mays
  unsure at all n locations
  Clone ID: LIB3069-049-Q1-K1-A11
gcccgaccgacgcatgcgatcatacacaacacagcctcttgaattgctcaattcattaagatttcagaaatcaaaacgccagcagttactttcaagagaagaaagcaatgcacaaggcaatagttaccttgacagccggggggaacccttcatcagtgacagtaataatggtgagcataatcatccagaggcaggtctgcaaactatcctggagaattcagaagatttaccgtcaccatcagggagaacacaacctgccgttttcccacgtggccaaagctttggacaaagaattatgggcaatatgatggataatatttttntcagaagtcttacgtncaaatcaaaaagtcgaacagatgatattgcttcaaccttaactgtgaaagcccctgatga

SEQ ID NO: 58996 - DNA, 301 bp, Zea mays
  Clone ID: LIB3069-049-Q1-K1-A12
attgtatcctcatgtcaataacatggatgtattttttgtagctaagctgaaaaagttgagcagtacattcccggtgacgtctgagccgtctaaagcatctgaagaagcagctaaggttgatggcgaagatgagaaagctatttctaatgaacaagagactggtgttcctgataaagatgagaaaactgttgagataaaaaatcataaaaatgtgactaatataagaacaagtgtcaccaaagagaatggaagccataaacgtgaatccaataagccaagaaagcatctcaaggaaaattag

SEQ ID NO: 58997 - DNA, 447 bp, Zea mays
  unsure at all n locations
  Clone ID: LIB3069-049-Q1-K1-A2
cccacgcgtccgcaggtttatctgcttccctttcgcgtgttcacccggcgagagcagcgtcggtgaacggatttcctttttccctgagcgaagctcggattctgttgcaactaaccggatcactcgcctaccgtgctaatcgcttgcgggccggctcccctagacttagaacccagtagccttataaaaccgagccatcccttttcgcttatgtcttgtccgccattatcgagagcagaggaatttgagcgatgccgccaacattgatttcgggctgcgttcgggttggggccacggtgtactgccagggcgcttcgccagggcacaatgactgtggccgtggcaccggtactaggaaaagagcatcagaagtcctattatccctcattggagttagagctccgncgtggacccaaatatcgccgtggtctgggttctgtgctgcgt

SEQ ID NO: 58998 - DNA, 462 bp, Zea mays
  Clone ID: LIB3069-049-Q1-K1-A3
ggtcgaccacgcgtccgcggcgaccatggccggcgcgcaggagtccctttccctggtgggcacgatgcgcggccataacggcgaggtgacggcgatcgcgaccccgatcgacaactcgcctttcatcgtctcctcctcccgggacaagtccgtgctggtgtgggacctgaccaacccggtccactccaccccggaatccggcgtcaccgccgactacggcgtccccttccgccgcctcaccggccactcccacttcgtccaggacgtcgtccttagttccgacggccagttcgcactctctggctcctgggacggcgagctccgcctttgggacctctgcaccggcctcaccacccgccgcttcgtcggccacgagaaggacgtcatctccgtcgccttctccgtcgacaaccgccagatcgtctccgcgtcccgcgacaagaccatcaagctctggaacac

SEQ ID NO: 58999 - DNA, 309 bp, Zea mays
  Clone ID: LIB3069-049-Q1-K1-A4
accacccgtccgccaggccatcgcgccgctttcagaattccctttaactttttgacacgatgcgaacccataagagctaggggactactataacaagctagggccataactctactttcattctctactcatcactggacaactccgcgcaggaactacacctcaccaacccgatactctccacccaggaataacgataacaccgtacactactatcttcccctttcatcgcctcaccgatcactcccacttataccagtacgacatacttacatacaactaccaattaacactctctagctcctgtga

SEQ ID NO: 59000 - DNA, 450 bp, Zea mays
  Clone ID: LIB3069-049-Q1-K1-A5
cacgcgtgcggtgcgacacggtcgccgcgctcattcgcggttcgctgcgctgctacgcccgcgagggccgcgggccgctgctcgggaccgacccggccggcttcgtcctctccaccgccaacggcggatccggcgcactcggagaagacgagaggatcagcttcaacgggtgccggaacttcctgctttggcagaaggctgcggctcagggtgccgccgccagccacgccgggtccgatgctctgacggcaaccctgagccccggcaggaagggcagcggtggattcaaggctactgatccgagccatggcaggaaaggcggcggcggctggaatgctggactgaacaagttcctgctcagcttcagcatcaaggtgtgatccatgcgtggacgagagaaggggggcgtttcttggtgtcgaggcaccgtgcaacaataaaaatgcattg

SEQ ID NO: 59001 - DNA, 443 bp, Zea mays
  unsure at all n locations
  Clone ID: LIB3069-049-Q1-K1-A6
accgggaaccggaggagatttctcgggggtgtagtggcggccaggacctctgattgggctcgagtgcccgatctttgaacgcagatttggtgcccgcaatctgccatggatttggtttaagatttggggagatcggtcgggttcgcgctgcaagattcggtctctgtgcctgttttattcacgagatcgcaacaacgatattgctaagcaagataagatttcaacttttttcctggatcgatctcagattaggaggagcaaataaagcaagaatagaaagatttttggggggagaaggcatgatgctggaagggaagtcctaccttgtgtcgcgctccgtgccgagctcctgcgagccggagacggagtgggagtacctcgcccacgcggtcctcagcggcaagcgcccggngccggaagatgacgtcgaggtcgaagacccg

SEQ ID NO: 59002 - DNA, 254 bp, Zea mays
  Clone ID: LIB3069-049-Q1-K1-A7
gtcggtggcggccatcgaccgcgcgatgcattgcgacatttacctggccgcggtttatgcgagcaagcagacgcgatgccactcggtcgggtggcaacaagtgaaggactgagaactcgatcggcaccagtagattaagtgggcatgacgtcaataactaaatgattacctacctagccgcttgtactagtcatgctctactttatattactttaaaagatacatttcgttgtgtaatcatcttatggttcatc

SEQ ID NO: 59003 - DNA, 449 bp, Zea mays
  Clone ID: LIB3069-049-Q1-K1-A8
cccacgcgtccgcccacgcgtccgcggacgcttgggtcctcgcgccgccgccgccgccgccgggacggaaggaagaggaggagcaaggagcacgacgcgatgggccactccaacgtgtggaactcgcaccctaagaactacggccctggctcccgcgtctgccgggtctgcgcgaaccctcacggtctgatcaggaagtacgggctcatgtgctgcaggcagtgcttccgcagcaacgccaaggacattggtttcatcaagtaccgttgaagaggccactgtgctgctgtggagaacttcctacatcaaagaaatgggtccttcattagaaggcctaatttatgcgctttagctttttgttcagaacttgagactcatgtgttaaactcgacttgttaaagttttgatggctactttgtgcttgttggaccagctataatcagaagatt

SEQ ID NO: 59004 - DNA, 281 bp, Zea mays
  Clone ID: LIB3069-049-Q1-K1-B10
ccacgcgtccgtttgttgtttttttttttttttcttaattttatattccacttatctctcatctttctgggaggtttttttttttggaaaagggccaatgcttatggcaaaaaattttaactgcctaatttcttcaccacgctttccgcgaaaccaccggctatttaaaggaaaaccccggtaaaaaccatttcaaaacgcgcacacttcactattgaaaaacctatccattagaaaaaaaagggataaagaaaaccccctaaaaaaaccgttccccaacc

SEQ ID NO: 59005 - DNA, 118 bp, Zea mays
  Clone ID: LIB3069-049-Q1-K1-B11
cccacgcgtccgcatgcatcaaccagcatttactgcggatcgatgggtgctgttacccgcgtcaggctttattctaagttaaatcctaaggaaaaaaaatggtgcttcttggtgctgc

SEQ ID NO: 59006 - DNA, 357 bp, Zea mays
  Clone ID: LIB3069-049-Q1-K1-B12
ggagaaactgtattttgagacagagcggtttgtccgagaaaagcaacttaaggagcaggaggaatcactgcaggaatgggagaaaaagctgaaggaaagtcagaatagacttaatgagttgcagagatctataaatgagcgagaggagagagcaaataagaatgatcaacttttcaagataaaacaggacgaactggaggaggcacgaaggacagtggaggccgctaaagttactctgaaagtcaaagaggatgatattaacaaaagactaaatgaattgcatttacaggaaaaggatgctgactcaaagcgtattgcattggaagagcacgggaaaaaattggatgagagagaagc

SEQ ID NO: 59007 - DNA, 454 bp, Zea mays
  Clone ID: LIB3069-049-Q1-K1-B2
aaagagaatcccggcccgtgtccagaagacttctcagttaccgcaaaatccccaaatccgcgggggagaggagagagccggagagaggggcgcagccagagagatcggagaaggggaagaagatggtgcgggtggcgacctacttcgcgatgaccttcggggcgttcctcttctggcagtccatggacagggtccacgtctggatcgcccttcaccaggacgagaagaaagaaaggatggaaagggagctggagataaagagaatgcaggcagagttactggcccaagctaaagagaatgaatcatgattgtcatttgtccaatggtttcaggcagttcctttatcgtatttcctctgctgtattttccatgcaatatcttgactgatgtatgctcatgctcagcacctccaataaagcgagacatgctatagccattgtgaatgccagtgggt

SEQ ID NO: 59008 - DNA, 444 bp, Zea mays
  Clone ID: LIB3069-049-Q1-K1-B3
cttcatggttttgctatttctcggttataattattgcttctcttcctctaaagaccaatgagaagtcagtgtggttcgtgatgattggcatgatcatatgaaaagtttgaagagatattcttttataatgacatgttccctcacatgcttggatgtttggcatttttcagtcatttagcagaaccaaagacatgacatggcgacctgatctatttagtgatagcatggcggctagtggaatagaaactggtacaaaattgtacatttcaaacttggactatggggtctctaatgaggatataaaggagctgttttcggaagttggtcatttgaaacgctttgctgttcactacgatggttatggcccgccaaatggcactgcagaggtggtgtttacacggaggagcgatgcaattgctgcactgaaacgttataataatgttc

SEQ ID NO: 59009 - DNA, 273 bp, Zea mays
  Clone ID: LIB3069-049-Q1-K1-B4
acaactgccaattcaattacaatatgctaatactctcatatgccatcataaacttatacatttaaataatgttagtcctctagaggactcaaagtcatgacgagttcaacatgtactacatatctgatctcataactatacgtggattgtataccagctcaaacaacttcattttaaaagttaacaaagaatctctttgatacttatttaaagagcctgaaatatcacatagattattttaataaactatccaaataatactatgaatattta

SEQ ID NO: 59010 - DNA, 427 bp, Zea mays
  Clone ID: LIB3069-049-Q1-K1-A1
cggacgcgtgggcaaacatattgaacataatttaaactgttcgaaagtattcaattgatcgggatttagtaccaactggatcagaattccaccctgggcctatccccattctcaataagcatggagatgatgtcgaagaggatcacgtggatggtgcattttcattgtcatctcgcaattttgatagcttttcacaccaatatcctgttttggttgtcaacttctatgctccctggtgttactggagcaatcgactgaaaccttcatgggagaagacagcttaaataatgagggagagatatgaccctgaaatggatggtagaatccttctaggcaaggttgactgcactgatgaagttgaattgtgtaggagaaaccacatacaaggatacccatgcattcgtgttttcccgaaaaggtctgatat

SEQ ID NO: 59011 - DNA, 303 bp, Zea mays
  Clone ID: LIB3069-049-Q1-K1-B5
ccgggccgacccacgcgttcgagacaccggagttcggagcgctgttttggttttacggcgtccacatcgtccggagcccccttgtcctcacatggctgccaccgatgtgagcttcgtttatttaccgtgcgtttagagcaagcaatggagcaggaacctctgggcctgggtaatcaagccagagatccgttgtgtcgcagcggcagcggcagcggcagaacaggttcactaaccaacggaaaaatactgtcaaagctccacatgagaaccgcctttattcttcaatgtattcatgcttattcc

SEQ ID NO: 59012 - DNA, 268 bp, Zea mays
  Clone ID: LIB3069-049-Q1-K1-B7
cccacgcgtccgcgccaatgatatctgaagttgcactccttttctgaagcagaaatagagggggcgtgcaacatttcacttgtgctgctgcatcattgggtcatgggttttacaggtataggtcaactaggctcaaagatacacaggttatgcgagatcaagatctactgtaccatgaattaagatttaagagagagacgttgtgcgcctcttgttacgacacttgatgaacagcatagggaatgataccatcatagttttagtagtc

SEQ ID NO: 59013 - DNA, 365 bp, Zea mays
  Clone ID: LIB3069-048-Q1-K1-G11
aattccgtcgacccaccgtcgctacctcgcgacctactctgacttcactcttatctccaccgatccatgagctataaactctaactccgccggccactccttccccaacacccaacacatctcaacctctgctatgcgcaatgcatacatccagaccgaatcacgccgtcccttgccaaaaatctcccaatgtgatgaccacgatcccgcttgcccaaaccgatttactttcatattccacaaacccagacatgaccaaaactgctgcaactgccaatacacaggatcatctttcaagcaccccacaactgataagctagactcttatcctgcataaccctgctccaagaaatcccttcgctgtc

SEQ ID NO: 59014 - DNA, 317 bp, Zea mays
  unsure at all n locations
  Clone ID: LIB3069-048-Q1-K1-G12
ntcgccacgcgntcccagaaaactcccaaggtgtgtcttccattgaagtgaatggttcttcaaaagcgtttaccaatggtgagcaggtggatcccaagactgaaactagcacatccaccagtaacgtgcacaatgaatctcaaggggctgatagcagttctggatcaaataactcaattggtaacggccctgaacaaaccggtaaaactgaaaggcagtgataccactatctagacacgaacattgttttagtataaaagagttgattcctggagattgaagaggctagtactgaaccaagaaaaactgttcacatt

SEQ ID NO: 59015 - DNA, 412 bp, Zea mays
  Clone ID: LIB3069-048-Q1-K1-G2
cgcaggacgccgtgatcgcgttcaagacggttctctggttctggatgaacaacgtgcaccgtgtgatgccgcaaggcttcggcgccaccatcagggccatcaacggcgccctcgagtgcaacgggaacaaccccgcccagatgaacgcgcgcgtcggctactacaagcagtactgccagcagctccgcgtcgacccagggcccaacctcacttgctaggccagcagctcctgctagctcgtccacaataaatgctcggcgtcgcaccctcgcgaaaccaagagtttactgactagtacgagctaactagcatgcagtaataataatcatcgtaataataataataaaacgacggggctgagccactttgttcgacctgtatgaataatgaaacaactgtatgttccctcggt

SEQ ID NO: 59016 - DNA, 443 bp, Zea mays
  Clone ID: LIB3069-048-Q1-K1-G3
ctctgcggcgcaacggccacaccttccccggtcccgcctccgtctctgtccagcgggcctgcagtctgctcgccgaccgcccgcctgtccctccctcctcgccgccatgaacaacctgctcacggattcctttgagctccctcagcgggactcctcaagagacgcagatattgaaatgggaatgcatcatgctgatgcttcagacaacttgaaagatttcttgaagaaggtcgatgcaattgagagtataattgcaaagctgacaaatctattgaataagctccagactgcaaatgacgaatccaaagcagttacaaaagcaagttccatgaaagcaattaagcagcggatggagaaagatattgatgaagtggggaaaattgctcgtcaggcaaagacaaaagttgatgaactggaaagagataacctatcgaataagcaaa

SEQ ID NO: 59017 - DNA, 105 bp, Zea mays
  Clone ID: LIB3069-048-Q1-K1-G4
ctcagcgtgcaacgacactagcatcatggttttcttattatccggtgttcagcgtcctggcgaaagggagccatactcagatgaagggattgcttccatgacgac

SEQ ID NO: 59018 - DNA, 435 bp, Zea mays
  Clone ID: LIB3069-048-Q1-K1-G5
tctatctcgaaccttggttcgccgcacggcatcagaagcacggccgtgttctcatcccgtccagacgtttccgcctcccgagccacgtccgccgttagccgcggccgacacagctcctcctcctcctcgcagctcttctccagctctcggaggcccgaggtttcatcgacccgcgctccttcatcctcgacacctcactccggcggcttttttccgcagtgctgcacatcgcgagccgcgcggcacagccgcacttgttgtccttcgtgcgtggggtgcggttcgacgcgggcggcgggatggcggcgagcgcgcgggacagcaccgatgcagcggagcgagttgtggatgaccacgacggctgggcgtcggacgccgagatggacgtggagatggatgtggtggaaggcgatgccgaccggagggacggcggcg

SEQ ID NO: 59019 - DNA, 340 bp, Zea mays
  Clone ID: LIB3069-048-Q1-K1-G6
cgtccgctggagatgatggagaaagctatagcagctgttaagaagaatccactgcccaagtatgagaagtccttaattcttctaggactaatgaagtatgaagaagctctggatgagttggagcggctaaaggagattgcacctcatgagagtagtatgtatgcactgatgggaaagatttacaagcaactcaatattcttgacaaagctgttttctgcttcggcattgccctggatttgaaaccacctgctgctgatcttgctataattaagtccgcaatggagaaagtacatcttcctgatgaactgatggaggatgacctataagttcactcaagca

SEQ ID NO: 59020 - DNA, 429 bp, Zea mays
  Clone ID: LIB3069-048-Q1-K1-G7
acaagccaaagttgcaaagatggcttgatgagtttggggagtactatagcagagttgtggtagggctttctttggttgttgcacttgtgggaccattactttttaagtggcctttttttggtaactcaggggttcaatttaccgtggattatgacttatggtggctgcatctccctgtgcattggctgtagctccattggcatatgcaactgcaatcagttctcttgctagtaagggaattttgttgaaaggtggccatgtcttggatgctctttcgtcttgtcagtctattgcttttgataagacaggcacactaacaactgggaagcttatgtgcaaagcaattgagcctatccatggacatttgggtgtgaaaagtggtcgtagtaatccttcttgctgcactccaaactgtgaaagtgaagcatt

SEQ ID NO: 59021 - DNA, 311 bp, Zea mays
  Clone ID: LIB3069-048-Q1-K1-G8
ggcctcctgctggaattgacattcttgtagtattgtcttgacttatctgcagcaagagagctcgaagctgcaccatgcccaaaaagtgaaaatgttctgtattgaactaaactattgcacaataatggctatactcgcgggctttctgggtggagtcctatgggttcatgtcgattgagtatccagactgaagcaccccatatgttaccttctatcttgaaagaccgtgcaagccagacacatattagtggtcattatattcttgccacgaaccgtacagatgttcggatgggtccttacaggtcataact

SEQ ID NO: 59022 - DNA, 169 bp, Zea mays
  Clone ID: LIB3069-048-Q1-K1-G9
ctcaagcctacacacatgcattatctctatttttaccatatcaatggactaattaacattcacgaccatcttaaacttacccgagccctacaaaaccagcctaatccaacttacttatgtactataccatctttactacttatactacaaccagctgtcttaccaacac

SEQ ID NO: 59023 - DNA, 310 bp, Zea mays
  Clone ID: LIB3069-048-Q1-K1-H1
cccacgcgtccgcccacgcgtccgcccacgcgttcgggaagggttgtgtcctagccagccggcgaagatgagctgctgatggtaatgatgatgataagaggccactgctaccctactacgtaccctcctctttgtgtgctgccatccgtccccgttagacgatcgaggagagaataacgcagagctctctgctcccggcctgtcttctgccgtcccggccgtttaatttactagtgtgttcgtcctatatgtttagcagcagcaggtgtattgtgcgggtatgtaatggtattgcaactatattgggtgt

SEQ ID NO: 59024 - DNA, 312 bp, Zea mays
  Clone ID: LIB3069-048-Q1-K1-H10
tcgcgagacgcgtccgcgatccatctcactctccgctggtcgctcactcttgcagctccactctgtactcactcttacgctcttattagctctaggctctagctagccgcgccactccttcgtgtagccatcagccttctcatcgccaccaatggccactgccgaggtccagaccccgaccgtcgtggcggccgaggaagcgcccgtggtggagaccccgccgtcggccgtcgtgcccgaggagtctgcccccgccgaggccgatgccgaggccgaagctgctgctcctgctgatcccgaggagcttcccgc

SEQ ID NO: 59025 - DNA, 325 bp, Zea mays
  Clone ID: LIB3069-048-Q1-K1-H11
aacccaacacatcgcgtctgcgttctcccactttacgccggcgagtgttcgttgatggctcggtgcagcttagagaatagatgcagatagcagggatgagcgacgagcgggtgaaggcggatgcgctgcagatcctgggcctattccaagtgctacaccgcctcggcgtcttcgacctcgactataccctgtggcccttctactgcgagtgccggtccaagacggattcgccgagccttttcaggcacgccaggggcatcatgtacgccctcaaggagaacgggatcgacatggcgattgcttctggatgccccaccccggacat

SEQ ID NO: 59026 - DNA, 189 bp, Zea mays
  Clone ID: LIB3069-048-Q1-K1-H12
acatcctgggcctattccaagtgctccaccgcctcgtcgtcttcgacctcaactataccctctggcccttctactgccagtgccggtccaagacggatactccgagccttttcaggcacaccacgggcatcatgtacgccctcaacgagataccgatcgacatcgcgattgcttctcgcttccccaccc

SEQ ID NO: 59027 - DNA, 308 bp, Zea mays
  Clone ID: LIB3069-048-Q1-K1-H2
cccacgcgtccgccaacgggctcaacatccttgacatcatcagcgagcacctcggggccgaagctgcgctgccgtacctgagccccgagctccgaggggagaagctgctcgtcggcgccaacttcgcgtcggccggcgtcgggatcctcaacgacacaggaatacaatttgtgaacatcatcaggatcggcgaccagctgcagtacttgcgggagtaccagcggaagctgcgagccctcgtcggcgagccgcatgcgacgcagctcgtgaaccaggccctcgtgctcatcacgctaggcggcaacgac

SEQ ID NO: 59028 - DNA, 397 bp, Zea mays
  Clone ID: LIB3069-048-Q1-K1-H3
ttcccggtcgagcacgcgtccgcccacgcgtccgccacgcgttcgaccacgcttacgtacgatccttcttcactgctgcaggggaggagggctctctcgttacgcccgaccatgcacgggtggttgtacttgaatcacccgaggcagcatcagaagaagcagaaactcgagaagtttgtctttgatcaattacgaacaggcttgcatctgggcgtgggctctatttgcagcgtgtgctactacataatctactggtacattcatatcatatgacatttactattttttgcaccttgagacattgcttagtacttctgtgttgccttgtgaaaagagagtggtaaggcttggatccgctgatgctcttgtttaaaaaaaaaacacttccagactaaag

SEQ ID NO: 59029 - DNA, 346 bp, Zea mays
  Clone ID: LIB3069-048-Q1-K1-H4
cgcgttcgcccacgcgttctcccactcttgcttttcaaccttcttcactgctacacgggacgagcgcaatttcgatgcgccctaggaggcactggtgcctgtactagaatcacccgaagcatcatcataagaagcagaaactcgataagtttgtctatgatcaattacgaactggcttgcatctgggcttgccctctttttacagtgtgagctactacataatctactgttacattcatatcatatcacatttcctattttttgccacttgagacattgcttaatacttttgtgttgccttgtgaaaagagaatggtaaggttttgatctgctgatactcttgttt

SEQ ID NO: 59030 - DNA, 274 bp, Zea mays
  unsure at all n locations
  Clone ID: LIB3069-048-Q1-K1-G10
gctcactctccgctggtcgctcactcttgcattttcacccttcactcagtcttagtctcttatganctctatgctctagctagccgcgccactccttcgtgtagccatcagccttctcatcgccaccaatggccactgccgaggtccagaccccgaccgtcgtggcggccgaggaagcgcccgtggtggagaccccgccgccggccgtcgtgcccgaagagtctgcccccgccgaggccgaggccgatgccgaggctgctgctcctgctgatcc

SEQ ID NO: 59031 - DNA, 239 bp, Zea mays
  unsure at all n locations
  Clone ID: LIB3069-048-Q1-K1-H6
gggtccggcccacgcgtctcgcacacaggatgaacgggtgtgnggcatgtgtgttgttatttctgccgtgtgtgtatgtatacagggtgcggctgtatgggtagatcaggctatatatataacagactgtgtgctggtctattattgccctcatttcaaatacttatttttttcgccggtattaataatattattacatggagtatggcattagtataaaaaaactatgataacaaaaa

SEQ ID NO: 59032 - DNA, 155 bp, Zea mays
  Clone ID: LIB3069-048-Q1-K1-H7
gcccacgctcgcccacgctcgccacgctttcgcgacctggctcaggtagagtggagcacgttcacagatccagcattatgataaactgccattgcaattaaccttgaaaccaactagatcttaaagacttctaaaataccatgaacatattatca

SEQ ID NO: 59033 - DNA, 297 bp, Zea mays
  Clone ID: LIB3069-048-Q1-K1-H9
cccacgcgtccgctaacgcttgaattcacacttacactgtatactacttcacaacctcatcccgctcgagaattttcatgagacagcgaggagaatctatcctatatacaccttgactaacagcaagagctataaactgtcaataacagctctacagttcaaaagctctatcaactacctgatcgactactaattaccattgatacacttatattcaagtccactgaagaccttttacaaccctacatcattactattatatgctattgcaatccatgaaactccacacacttcaat

SEQ ID NO: 59034 - DNA, 378 bp, Zea mays
  Clone ID: LIB3069-048-Q1-K1-E4
cgtccgccctgacaagatccactttgttcccatctctgggttttaaggtgacaacatgattgagaggggcccgaccttgactggtacaagggccgaaccctacttgaggctttggacttgatcaatgagccgaagaggccttcagacaagcccctgcgtctccccctacaggatgtgtacaagattggtggtattggaactgttcctgttgaacgtgttgagactggtatcatcaagcctggtatggttgttacctttggtcctagtggccttactactgaggtgaagtctgttgaaatgcaccatgaggctctccaggaggcccttcctggtgacaatgttggcttcaatgttaagaatgttgctgtgaaagatctg

SEQ ID NO: 59035 - DNA, 383 bp, Zea mays
  Clone ID: LIB3069-048-Q1-K1-E5
aaatggctggaagcaagcccctttatgtagtttttgcgcagcgtaaagaagacagaacggcaaggctacatgcacagttttcacaaatgcgtcctgttgcaatggcgccttcaatacgtcctcgcatgcccatgtttgcacctggtgtccctggagttcgtcagcatctggtctatggtcagccaccaccagccttcatcaaccctcaggctggatttgcttttcagcaacctctgatgcctggtatgaagcctggtggtccaatgccgaactttatgatgcctatggctcagcaacgacagcaaccacagcgtcctgcttgtaaacgtgctggtggaatgcagcaacccatgccaatgggtggtcaacaacaagtggtccct

SEQ ID NO: 59036 - DNA, 340 bp, Zea mays
  Clone ID: LIB3069-048-Q1-K1-E8
cggacgcgtgggttttagggagagaaagcgttgaaacgccgagagaggcgtgcgagcgggaggagggagatggagcggtcggcgccggtgaggagctcccacacctccacggccgacctactcgcgtggccgcagccccagggccccgccccagcaacgccgtcgccgccgcgccggcccggtcagccgtcggaggctatcaggaaggtggtgttcgggggtcaggtcaccgaggaggaggccgacagcctcaccaagaggaagccgtgctccgcgcccaagtggaaggagatgactgggagcggcattttcgctgccgggagcaatggaaacgctgggg

SEQ ID NO: 59037 - DNA, 321 bp, Zea mays
  Clone ID: LIB3069-048-Q1-K1-E9
accacgcgtacgaccactcctgctcccactgtgtgctcagaagctatgccacctgttgacacacgaccacataacaaagcacttgcgcaatcaccataccaaccgtccctgcaaacatctctccgtttcatcgcaatatcccagaaccaacttcagctttattaccggcctgtcacactttatggaatttcacaatcccataaatctgatcttgtttgccgtaacgatcgataaccttctttgctcaaaatgtaccgattgcatcgaacgaatggccaatagcctcacctggctactaatcatttctctgaacttcacatt

SEQ ID NO: 59038 - DNA, 426 bp, Zea mays
  Clone ID: LIB3069-048-Q1-K1-F11
cccacgcgtccgcccacgcgttcggcgctttcgtcgttgcacgcagggctgcgacgcgtcaggtctgctcaacgcgaccggcggcatcgaggcggagaaggacgcggcgcccaacctgacgctgcgcggattcggcttcatcgaccgcatcaaggcgctgctcgagaaggagtgccccggcgtggtgtcctgcgccgacatcgtcgcgctcgccgcccgcgactgcgtcggcgtcatcggcggcccgtactggagcgtgccgacggggaggcgcgacggcaccgtgtccatcaagcaggaggcgctggaccagatccccgcgcccaccatgaacttcacccaactcctgcagtccttgcagaacaagagcctcaacctcggcgacctcgtctggctctcgagggctcacacgatcgggatcttcca

SEQ ID NO: 59039 - DNA, 316 bp, Zea mays
  Clone ID: LIB3069-048-Q1-K1-F12
gcgtccgcccacgcgtccggatacgcactcacctgcgtttctgctgcattctccactgctatctcgcaggcttgctctactggatttatgggatctcataacttgccctcccccggatccgccattccctcgtgccctctctccgtaccctcaaccttatggctcctttcttgcttgcctcaacaatcgccaaataacaggactagctggagccgctgaggatctttacgagcgtaagctatgacggccggttccctgcgggcaaaagaacagaaaaggaacctgtcttgatgtccacgacgtcgctaggctcgac

SEQ ID NO: 59040 - DNA, 265 bp, Zea mays
  Clone ID: LIB3069-048-Q1-K1-F2
cccacgcgtccgcccacgcttccgcaaggttaaacatttatgattgtatgcaatgctccaatcggtgtggaaaaaaaaaaaaaaagaaagaaaaaaaaaaaaaaaaaaaaaaaaaaaaaaaaaaaaaaaaaaaaaaaaaaaaaaaaaaaaaaaaaaaaaaaaaaaaaaaaaaaaaggccgcccattttaaagaacccaagcttactaacccaatcatgcaaccatataattattctataatgtcaccaaaatccaattcactgcc

SEQ ID NO: 59041 - DNA, 447 bp, Zea mays
  unsure at all n locations
  Clone ID: LIB3069-048-Q1-K1-F3
atcgcctcctgcgcagcgcttcagtcaccgcttgcgcagcccccgccaacgccgaacgcgccagcggcgaactcgccgccccaggcgcctgcagccggaaacccgccgccggcgccccaggcgccgccggcaggcaacccgccacctgcgcccaccgccactccacctccggccccgaccactccgcccccggccccgaccacacctnccccggctcccacaacgtccgccccggcgccgacaactccgccaccgtctcccccggcaagcccgccgcccgctcccgccaccccgccaccgtctccacccatggcgccacctnccgccacgccccctccacccgccaccccgccgccaccggccgcgcccacgccggccccgagcgtggccccgactccccctgccgtggcgacaccggctgcgtcccccaagagcccgaagacgccc

SEQ ID NO: 59042 - DNA, 163 bp, Zea mays
  Clone ID: LIB3069-048-Q1-K1-F4
caccggaaacccgccgccggcgccccaggcgccgccggcaggcaacccgccacctgcgcccaccgccactccacctccggccccgaccactccgaccccggccccgaccacacctacctcggctcccacaacgccgtccccggcgccgacaactacgtcaccg

SEQ ID NO: 59043 - DNA, 441 bp, Zea mays
  Clone ID: LIB3069-048-Q1-K1-F5
cccacgcgtccgggaaaacctctcttcactatttctttccctggttgagaacaacgatgggaggacaaagttcttagaccatgacgcttggattcaattggatggaattctaccatctatgaaaaagttccgcaagctagcagagttgcttgatatgtcattgaagtccatcacatcatgttgggaaagtggagacctaattagatgtggtttcacatcatctgaggtgcaaaatttcatcaaagcaatattcgctgactcgcctcttaggaaggagtgcctaagatggatcgttaggactccagcttagaatacagaaacagcatatttctgtctgtgggtcaatgattttttttttcatattcttttgtccaccataccatatagtgaagtattaattggtatgagctcagtttgcactggagacagacttgcaatctg

SEQ ID NO: 59044 - DNA, 348 bp, Zea mays
  Clone ID: LIB3069-048-Q1-K1-F6
cggacgcgtgggcaagatcaggaggccagtttaacacctgacccgagtagtaggacaggtaggccagatcaagaaaagcggggaggagcagcttccagatgcacctgagcggcgggggccggatgttgccgccgaaacagctgctgaccatcgtcatcatcatcttctccacgctctccttcatcaagctccttctcctcaccagctcgtcgtcctcgtcagcgggcttcacctaccgcagcagcccggcgtgggacgcatacggcggcggtaacgggacggctaggagcgcgctcgccttcaaggagctcgctctgctccggtccgtcatcgccgcgcgggcgccgt

SEQ ID NO: 59045 - DNA, 434 bp, Zea mays
  Clone ID: LIB3069-048-Q1-K1-F7
gacgaagcttcaccccctgtcacctgaagttatctcacgccaagcaacaatcaatatgggtaccgttggccatgtggctcatggagagtccactgttgttaaagctatatctggtgttcagactgttcggttcaagaatgagctggaacgtaacattactataaagctgggttacgctaatgcaaaaatctacaaatgtgacgatgacagatgtccgcgaccaatgtgctacaaggcctatggaagcggaaaagaagatagccctctatgtgatgtgcccggatttgaaaacactagaatgaaactactgagacatgtttcttttgttgattgcccgggacacgacattctcatggctacaatgcttaatggagctgctatcatggatggagctcttcttttgatcgcagcatatgaaagttgtccacagcccc

SEQ ID NO: 59046 - DNA, 289 bp, Zea mays
  Clone ID: LIB3069-048-Q1-K1-F8
ctctgcgcaatctccccgcctcgctcccgccttcacccaatggcgtctctccctaacggtggcggcgccgccgcctctggctcatgcggcgcgcgccctgtggacaaggaggtggacttcgacaactacttctgcacgtacgcctacctttaccaccagaaggagatgctctgcgaccgcgtccgcatggacgcgtaccactccgccgtcttccgcaacgcgccccacttacagggcaaagtggtccttgacgtgagcaccgggagcggcatacttgctatctggagcg

SEQ ID NO: 59047 - DNA, 318 bp, Zea mays
  unsure at all n locations
  Clone ID: LIB3069-048-Q1-K1-E12
cccacgcgttcganaaagaacaacaacatgtgtaggtactgctgtggttatagtcatgctnaggacgacattcctcatggtgccaataatgctgctggtgtggaagagccactggatcctcgtggtgaccttcatcgtgctgtcgctgatggtggaggttccctacttcgtggcctgcatactgaagatcgaccagggcggctgggtgccgctggtggtggcgacggccttcttcgtcatcatgtacgtgtggcatttctgcacggtgaagcggtacgagttcgagatgcacagcaaggtgtccatggcgtggatcct

SEQ ID NO: 59048 - DNA, 217 bp, Zea mays
  Clone ID: LIB3069-048-Q1-K1-F9
cacacgcttacgctagctcaatccagactatataccatacacctgcttcatccctactccgtggtgtactcactataaccggagcctgacatagtgatcgaaccatcttagtcacgctatttatttaacagctgatacaaattgatgtagcaacaaagtttttcaaaactgctattcatatttttatgtgattgaataattttacacaaatacacgt

SEQ ID NO: 59049 - DNA, 438 bp, Zea mays
  Clone ID: LIB3069-048-Q1-K1-G1
cccacgcgtccgcggacgcgtgggcggacgcttgggctcgggcccttcgagtgctacccggacggcaaggctgcggcgcacgtcggcgtgtacgagagcagcgtggaggagctgcacgtgccgtacattgcccccgtggagtgcggcggtcgggcggacgtcatgtgggtggcactccgcgacgccggcgggctcggcctgtacgcgtcggctcacggcggctccccgccgatgcagatgagcgcgagctactacggcgccgcggagctggacagggcaacgcacgtccacaggctggtgaagggggacgacatcgaggtgcatcttgaccacaggcacatggggctgggcggcgacgacagctggtcgccgtgcgtgcacgagcagtacctgctgcccgcgacgcggtacgccttctccctgcggctctgccccctg

SEQ ID NO: 59050 - DNA, 429 bp, Zea mays
  unsure at all n locations
  Clone ID: LIB3069-025-Q1-K1-G7
gggtttttgattttagccgccgccgctgctcatctcacatccctcgagaagacgcctgcgtgctcgccgatcgatacgatggccgtcttctccgacctccacaccgccgacggcctcaagtccctcgaggctcacctcgccggcaaaacctatgtgtctggtgactccattactaaggatgacattaaggtcttcgccgcggtgccgtcgaagcctggcgctgagtttcctaatgccgcccgctggtacgagaccgtctctgcggctgtagcctcaagattccctggtaaggctgttggtgtaaatctgcctgcgggatcagctcctgcggcagctgctcctgcggatgaggctgangatgatgatgaccttgatctttntggtgatgaaactgaagaggacaagaaagcagctgatgagcgtgccggc

SEQ ID NO: 59051 - DNA, 455 bp, Zea mays
  Clone ID: LIB3069-025-Q1-K1-G9
cccacgcgtccgcccacgcgtccggtttagtgaagaactgctttaggagaaacttgccccgctttgtccccttattagctaatcttattcgctgcgagcataactctggagaagttcaagttgcactgtatgatatcttccaatcatcaataggccccataatatcagcatagcgtatattgtttcctcgccagttgtacaattttgtcagattgtggtataagaaaagggtacagctttacagtactgtaaatgattcatggttgaggcatttctggtgttgaagctacatggaacatcgacccagatgtctaaacaaggtttttgctgcgcacatttgccattcttttttctaacattcactgggtaatcattgacacgttaaagaggatggacattggaataagtccctaattcctgttttggtgtcatttcccccctttcatcttggctct

SEQ ID NO: 59052 - DNA, 412 bp, Zea mays
  Clone ID: LIB3069-025-Q1-K1-H12
gagtttcttggagtctatattgtgccatatttatttatttttctttcaatatcttatggtgttatggattttcatccttttgctagaggtattgtttttgtattaactattaaagcaaacacatgtattgtctcactgaggacgcttatttatgataatatcttattgttaaaatgaggtcaggactaacatgctcatgcttgtcttagatggtaaggaagtcagtagaactcgaagacaacatttcttttgatagcatatgatattatcagattatttttattgagaatgcctggattttttgggggatctgatatatgatgcactttctcaggcactgcggtttatacagaattgttttttagactatgtgctttatgctcccaccccctctcttttccatacaaaatgc

SEQ ID NO: 59053 - DNA, 286 bp, Zea mays
  unsure at all n locations
  Clone ID: LIB3069-025-Q1-K1-H3
cccacgcgtccgcctggagcgagtgcagggtcgcggcctcgtgaccaaggcgtgggtggagcaggaggccctgctgaagcacccggccatggggctgtttctaagccacagcgggtggaactcggtgaccgaggcggctgccgccagcgtgccgctgctggcgtggccccgcggcggcgaccaccgcgtgaacgccatggtaacggtgagcggtggggttggggtgtggatggagcactggagctgggacggngaggactggctggtgaccggggtggagatcgcg

SEQ ID NO: 59054 - DNA, 369 bp, Zea mays
  Clone ID: LIB3069-025-Q1-K1-H4
cttgcggacgccgtgcggttcctaatggtttgttggatgattgggaggagaatggagctgttattactgcaaacagaacgaaaggtgacgacctagtaatcacccatcttggtgactgtctctggaaagaaaaaaatgagattgcagctgctcattcgtgctatttagttgctgaactaaatattgattcatactcggaaagcgcaaggttgtgcctcattggtgcagatcacttgaagtgtcctcgaacatttgccagccctgaagccattcagaggacagaggtttatgaatacgcgaaggtgcttggtaattctcagtatatcctactaccctttcagccatataagctgatatatgcatacatgc

SEQ ID NO: 59055 - DNA, 381 bp, Zea mays
  Clone ID: LIB3069-025-Q1-K1-H6
acccacgcgtccggctgcagcaagagtatttccttcctgatggccttctatattcacccacaccagggtatgatcaaccattcagctcatttgacagagcactgacacagccaaataatgctcctgggttgtttggtcaagggagtctaccactggcttctggaatgcatcatggaccgatgtatggtcctggatcctacaagggacgccagtatggtagcaaatttggtggcactactccaagttggagttctgctggccgcagatttggtactttcgacttgagtggcaatcaacaaagggggagcatggtatttggtagtcataatggctctctggagtttatgaatgagcaaaaccgtgggccacgtgctacaaaac

SEQ ID NO: 59056 - DNA, 439 bp, Zea mays
  Clone ID: LIB3069-025-Q1-K1-H8
ccacgcgtccgcttgcggacgccgtgcgtcctcaagcggttcggcgcgctccggttcgccaaccgcgccggcccgctctacggccacctctccagcaccgactccacggccacatcgatgaggcttacctgggtgagcggcgacgggaggccgcagcaggttcagtacggaggaggcaagtccggtacttctcaagtggcaacgttcacgcggaatgatatgtgcagtagccccttgttaccaagccctgccaaggatttcgggtggcatgaccctggctacatccacacggccgtcatgaccgggctccagccttctcaatcctacacctaccgttacggaagtgattccgagggttggagtgacacatacacattcagaatgccaccagctgcaggctccgacgagacatcatttgtgatctacggtgatatgggga

SEQ ID NO: 59057 - DNA, 445 bp, Zea mays
  Clone ID: LIB3069-025-Q1-K1-H9
ctcacgcgtgcgggctaggcgcatggctgttgaggtgctggaagtaccgagaagcaatgggacagtacagcaaggttctggagctgtccaaggagacaggtgaagattccggttgcaccgaggcctacggtgccatagcggactgctacaccgagctgggcgacctgaatcgagcggtgaacgtgtatgacaagtacatatcgaggctgcatcccggcgagtaaggtagatttgtttacagacgagacagcgagtgccttactttccgtacgttgagacttgcgttatgaccgtcttgctaaactcgctgtacgacttggatcgttacgagaacgattccaatattcgtatatacacaactactgatttaatgccaccagctgcaggctccgacgagacatcatttgtgatctacggtgatatggggaaagctccgctggaccca

SEQ ID NO: 59058 - DNA, 194 bp, Zea mays
  Clone ID: LIB3069-026-Q1-K1-A1
tttgctgattagtgctggtcagggcacgcagtttgccgcttaactacagccaatgatggagccacgggcctacgtcccgtcttatgaaggttcgtcgcgacccttagtatttcgcccctatacgaggaggagaatactcagaaactaaaaggactcttgagcgcaatcaaagggcatcccgagaaatagaaacg

SEQ ID NO: 59059 - DNA, 410 bp, Zea mays
  unsure at all n locations
  Clone ID: LIB3069-026-Q1-K1-A10
gaagatttggtgttttggacctgagaccactggcccgaacatggttgtagatatgtgcaagggagtgcagtatctcaatgaaatcaaggattctgttgtggctggtttccagtgggcatcaaaggagggtgcactggctgaggagaacatgcgtggaatttgctttgaggtctgtgatgtcgttcttcatgctgatgctatccacaggggtggtggtcaggtcattcccactgccaggagggtcatctatgcctctcagctcacggccaagccaaggctgctggagccagtctacctggtggagatccaggccccagaaaatgcacttggtggtatctacggtgttctgaaccagaagagaggtcatgtctttgaggagatgcanaggccgggtaccccgctctacaaca

SEQ ID NO: 59060 - DNA, 387 bp, Zea mays
  Clone ID: LIB3069-026-Q1-K1-A11
gacctacccgtcctcaagagcttccgttttctacctcagaccattttcccgaacatgggggtagatatctacaagtgagttctaaatctcaatggagccaacgattctgttgtggctgatttccaccgggcatcaaaggatggtgcactggctgacgagaacatgcgtggaattcgctttgaggtctgagatgtcgatcttcatgctgatgctatccacaggggtggtggtcaagtcattcccactgccaagacggtcatctatgcctttcatctcacggtcaatccaatgctgctgtatccagtctacctggtgtagatccatgccccagaaaatgcacttggtggtatctactgtgttctgaaccacaagaaaggccatgtcttt

SEQ ID NO: 59061 - DNA, 453 bp, Zea mays
  Clone ID: LIB3069-026-Q1-K1-A12
gcagcatgaagagggagatcagcgagacctacgacaccctccgcttcggcctcaatgccggcgtcaaggccgacctcgcgccgccgcacccgctccagtccagcatccaatcggaggccaagttctgggcggacaagaagaagtttgggacagaggccatctacggatccgccttgaacatccgcaaggatctcgatgcccaaatcctctcaaggttccaaaggccccctggtgctttgccatcatctctgcttggatatgaggcactgacaggttccctagatgattttggttttgaagattatcttaacatgcctcaagattctgaaggtttccgtcaacctgacatgcaccacggaatggaggttcgccttggtttgtccaagggacctatctgccctagcttcagttgaggcagtgaatgtagttctgcggttctgccgcacgttgatg

SEQ ID NO: 59062 - DNA, 463 bp, Zea mays
  Clone ID: LIB3069-026-Q1-K1-A2
gacctttgggctgctttatgtgcttgtttatgtgcttgtttatgtgcttgagatagcctaaaccttacatccctacgttacgggatcaggacttgacgaatcccataagaacgtcagggagaatcgcggcggaaagcacagcgtcttatcgaacgtcgcacgcgtagaggtcgcttaagtcactaataaccgtatatgggacactaacaagtaacatactccggacttcgtccgtttggacgacgactcgccgagttttaagatcgcagtagagatagacggaatgagtaggccgacgtcagagctcgtagacccctcatccggccttaaacgcgtagaagtccacatacctcacttcatgtccgggggaacgacgacatagcctaggagagttctggcacttgtaaggggataaccggagtacggaaatgacatagttacgtaccgttccataaccacgaca

SEQ ID NO: 59063 - DNA, 425 bp, Zea mays
  Clone ID: LIB3069-025-Q1-K1-G6
ggaggtcattctggatttctggtttcctacagaaggattaaacagctaggttagtggaaagggatgaagaaagatatccatgcctatgtccagacatgcaatatctgccaacaggccaaaccggacaggaccagctatcccgggctgctcgcgcctctacctgttcccccgcatgcatggcattctatatcaatggacttcattgaagggttaccgaagtccggaacaatggattgcattctggtggtggtagatcgattctcaaaatatggtcatttcttggcgcttgcccaccctttttctgcagcaaaggtagcaaaacttttcttggataatatctataagcttcatggtatgccggacaatatagtatctgatcgggatagagtgttcacaagtctgttctggcagcaattattcactct

SEQ ID NO: 59064 - DNA, 215 bp, Zea mays
  Clone ID: LIB3069-025-Q1-K1-F1
cttcatcgaccccgtggacgagtacctgattcagtaccttatggactacgaggacaagaggttcgagaacgtgtccaaggagggactgaagctgggcaaggactcgaagctcaaggagctcaaggagtcgttcaaggatctgtctgactggtggaagaaggccctggagagctagaacttagactctgtgaatatcatcaaccggctgcatgaca

SEQ ID NO: 59065 - DNA, 434 bp, Zea mays
  Clone ID: LIB3069-025-Q1-K1-F10
ctcgacttcgaacgccaagtggagagccgtcgcttgtccggcacacctccgcgagaagtggatgcacggctgcgcgtcgctcgacgggaaggtcgttgtggtggcggaccgtggcggcttgtcctacgatccttcggcgccacctgcggaggcgtgggcaccggtgtcgccggtgcttgacatgggatggaagggccgagctgcagtggttgagggaatcctctactcttacgattacctgggacaggtcaaggggtatgatccggacactgattcttggagcacagtggaggggttggagagggagctacccaagttcttgtgcggcgccacgcttgccgatgttggaggattgctctacttggtttgggaaggaaagtggaaagggaaattgaaaggtaagatggacgttaggagcatggtaatgattgaat

SEQ ID NO: 59066 - DNA, 409 bp, Zea mays
  Clone ID: LIB3069-025-Q1-K1-F11
gcggtccgcaaggcacttacccagaaggcatatcccatgcagcttgtgttattgagcagtagcatgcgatctattgcgagtgcgagttatgtagacaagagattagtggacatgccatatgcagacgcttactatgatttatacactagttgtcaaactagtagtcaatctgtcattgcaaggagccttctcatgagaaggaccatgcaaagtggcctccacaacgggttttagaacagtacgtactccaaagggaagtccgctggcaacactcttagaaaatctatgatagtatctagtatactgttcaggtagctgatctgctacaccaactacttcatcctaatgctaaatatcataaccattaacgcaacgaagacactcatggccatatgttttgccatgaact

SEQ ID NO: 59067 - DNA, 174 bp, Zea mays
  Clone ID: LIB3069-025-Q1-K1-F12
cccacgcgtccgcccacgcgtccgaaaaaaaaaataaaaaaaaaaaaaaaaaaaaaaaaaagaaagaaaaaaaaaaaaaaaaaaaaaggaaaaaaaaaaaaaaaaaaaaaaaaaaaaaaaaaaaaaaaaaaaaaaaaaaaaaaaaaaaaaaaaaaaaaaaaaaaacaacagcac

SEQ ID NO: 59068 - DNA, 353 bp, Zea mays
  Clone ID: LIB3069-025-Q1-K1-F2
attattttgaagctctaccccgcagtatataaaatttttcagtttcagcatctactacagacacagggagtcttggaggtgatggaagtgagaagtccaagcctaacttagtgctaagtaatattgatttgagagagatgcctaataagaagctatctgcttctgcaccaccatttaatccatctccaccatctgtacttagcccactttctggcaatgttggtctcccggcaccaggtgccattccaggagtagcaccttggcctgtgaatgtatccctgcatactgggcattcaactatggtgccaaagggtccttctttgtgcacttccccttatcatttatacccttct

SEQ ID NO: 59069 - DNA, 423 bp, Zea mays
  Clone ID: LIB3069-025-Q1-K1-F5
cccacgcgtccggccctccatgtcctggccacacagtcgttcgtcgcgccgatcgcccaggaagatctgcgatgcgctcgtcgttgccgagatcgcgattcgtttatgagcttcgaggaatcgatgatcaagcatggcgacaaagtgatcgaactcttcgagttctacgagatcgaagaccctgagcatctgtttggtgaaggtgccttcggtgcaatctatgcttaggtaaagaagaatgcgtcgaggcggatctccaggagttccaagacttcgacgagttcgaggattaggctagcgacctcccccagtcagctgcctgtggtgggtttatttacgttggctacgtttctattctgtgtactttgattatattatgtaaatgactctagtctttaatattattactcattctatattgtt

SEQ ID NO: 59070 - DNA, 434 bp, Zea mays
  Clone ID: LIB3069-025-Q1-K1-F7
cctgtcccctcgttctcctccgcctcctcctcccacctccccacacgggcacacctgccgtccccgtcgccgcggacccactcccatggcaaagctcccgcgtctaccctgctcgtttgccgttctcgcgctcatgtgcatcatcccgctcacagcgccgcggcctgcactgtcctcgcgcgcggccccaagggacggtgtctccttcgccggcgcaggcaacacgatacatcaacttcttaaagatcacggccttcccggaggactgctcccgcgcggcgtggagtcgtacaccctggacgagtcgaccggcctgctggaggcgcggctgtcggcgccgtgctacgccacgtacgacaacggcgaactggcctacttcgacaacgtggtgcgcggcaacctcagcaagggcgcgctccgaggcgtggagggcc

SEQ ID NO: 59071 - DNA, 425 bp, Zea mays
  Clone ID: LIB3069-025-Q1-K1-F8
actgactccacccacccgcccgctgccttttccggatctcgtcggactcggatgcgccggaccaccccgcgccgccgccgcgcagcagcagcagagatgagccagcagctccctgcgaacctagtggagatcatggagcagagaatgaagttgatcgagcagaggagcgcgtacctccaagagcaaatcaaccagacagccagccgcctcgccggaagagtactcgagggctaacaaggagttccgcaagctggagagcaccatggagttgatcaaagacctgagatcgaaacaggaggaaatcgagggtctcaaatctttggtagcaaatgatcatgaagagaaagacatgcgtgagatggcagaagaggagcttcttgtggctgtcgaggaagagaaacgattgcagcatgaactgtttagat

SEQ ID NO: 59072 - DNA, 446 bp, Zea mays
  Clone ID: LIB3069-025-Q1-K1-G1
cggacgcgtgggcggacgcgtgggcccgagcagatttttcagacattgctatagctgtccgagagggtgctgatgcagttatgctttcaggagaaactgcacatgggaaatttcccttgaaagctgttaaggtcatgcacactgttgccctgagaaccgaggcaactattcctggtggggaaacacctgcagaccttggtcaggctttcaagaaccacatgagcgaaatgttcgcataccatgcgacaatgatgtcaaatacccttcgaacatcaatagtggttttcactaggacgggatttatggctatactgcttagtcactaccgtccatctggcactatttttgccttcacagacgaggagagagttaggcaacgattggctttgtaccaaggtgtatgtccggttcaaatggaattttctgatgatgctgaaaagacattt

SEQ ID NO: 59073 - DNA, 349 bp, Zea mays
  Clone ID: LIB3069-025-Q1-K1-G11
aaacgaaagagcccgtgtgaaccggagattgatttattagaggaaaagggagacataaaggggaggccattatcaagaaaccatgagttctaggttcgcaatccctaatcctgatctcacttaagcgctcgtgagctctctccagtggctaaagattgcagatttgagttatagtccaagaaacgggtggtggtccgccatggaggtgaggtccgagcaagggctgatggcggtgagggatctattcggtatgccaaagagcccgccggcgccggtttccgggccgccagcgtccgccgccatgcaaagcgtgcgcatggcgtacacctcggactgcaccgctttgttc

SEQ ID NO: 59074 - DNA, 365 bp, Zea mays
  Clone ID: LIB3069-025-Q1-K1-G12
cccgcgcgtccgcttactaggaatagcaattctgtggtctgagttccttaagtcgccgagcaacgtgcttcattgtgggcctagaagaaagagaatcaaccgtacacttgatgcccaggtgtagaatctcaacaaggtcgtcatgtggggccacatcccacagcccttctataaagaattcacgagctcgacccttttgtaaaagcatgcaagcccaggcaactatgttgaatccattcccgtaaggagagaaagaaggatccagtgcctttttgtctgaaatgagttcaagaagtacaactccataactatacacatacgccttatcataaacgcggcatgtcatcgcatactctggagctaca

SEQ ID NO: 59075 - DNA, 451 bp, Zea mays
  Clone ID: LIB3069-025-Q1-K1-G2
ctaggcgtccggggatggctattggaagtggtttgctggctacctgtcctctggtggtgctgctggtgctgcctgtttgttttttgtgtactccctggactacgcgagaacaaggttggctaatgacgcgaaggctgccaagggaggaggtgaaaggcagttcaatgggcttgtcgatgtctaccgcaagacactcaagtctgatggtattgctgggctttaccgtggatttaacatctcctgtgttggaatcattgtttatcgtggtctgtactttgggctctatgattccatcaagccagttgtccttactggcaacctccaggacaatttctttgccagtttcgctctgggttggctgatcactaatggtgctggtcttgcatcttaccccatcgataccgtccgcaaaaagatgatgatgacatctggtgaagctgtcaagtacaaa

SEQ ID NO: 59076 - DNA, 442 bp, Zea mays
  Clone ID: LIB3069-025-Q1-K1-G3
cccacgcgtccggatgcgcgcctctctccctcccatacaaccaggccacaagcgcccgagcggctgaaaccctagctcgccgtcgtgctcggctcgccaccccgcgccagctcctttcaggccctaaccgttcgccgtcgcgcattcgagcactcgcggaagcgcacctagtgccatggcgaagaagcggaagcgcaccgacgcccccgcagaggcgaccggcgcagagaagcctgacgactctgcgccggcgcgcccggagcgcacgctcttcggcttcaaggacccggtccccgacgccgagcccgccttcgcgggcgccgaggccgcggtggcgccgttccggaacagggagaaggtactcatcacctgctcccgccgaatcacgtataggtgagtgctccctggtttttccgcttgcagtcttgtgagatgggtgatt

SEQ ID NO: 59077 - DNA, 255 bp, Zea mays
  Clone ID: LIB3069-025-Q1-K1-G5
tgctgtccaaaatgacattggagatgtggttattccatgttttattggtaacattgccagtcttatttgataataatgtcgtttgcaggttgatctgttcttctacagagacccagatgaagcaaaggagcatgatgaggaagctgctgcggcccctgagtttgctgcagtcactgattaccaaggagctgatcagtggggtggtgaccagtggaccttatatgtgtctttaccatattttgctcctactggtgc

SEQ ID NO: 59078 - DNA, 431 bp, Zea mays
  Clone ID: LIB3069-025-Q1-K1-E8
cggacgcgtgggcttcccagaaaattactttaacagcccgccatcagtcagatgtacctgtgaaatgtggcatccaaatgtttattcagatgggctggtgtgtatctctattcttcatccacctggtgaagatccaagtggttatgagctcgcaagtgagcgttggacacctgtgcatacagttgaaagcatagttctgagcattatatcaatgctctctagtccaaatgacgagtctgcagcaaacattgaggcagctaaggaatggagggataagagggaggatttcaagaaaagggtcaggcgcatcgtgctgaaatcacaggaaatgttatgaagaaaatggaattctggggaagtcaaccgtgccatgtcaggctactagattttgctttcaacctcaaaatgctcatctgacatcttgtgtattt

SEQ ID NO: 59079 - DNA, 305 bp, Zea mays
  unsure at all n locations
  Clone ID: LIB3069-025-Q1-K1-D2
gcgcccacgcgttcgcccacgcgtacgtttgcttctagcgccagaacccgggaaacaggggcgggttgttctaangttgggctagacacctcttattaatcgctgactggttatgggacatgtctctgtgtgatgctttctgtggtattattgctgcaatagccgtgtaatccatcgcttctgcaatgaagcgctcggaagcatgctacgtatgttgtgtctgtgggtgattgtatttctggtagtaacagtgattgttcctgaattttggataatacaagctcattcgcaggagtttctgttgt

SEQ ID NO: 59080 - DNA, 212 bp, Zea mays
  Clone ID: LIB3069-025-Q1-K1-D3
attcccggtcgaccacgcgtcgccacgcgtcgccacctccgaaaaatatattatcactaaacaaaaaaaaaaagggggtttaatttaaggtgacgataaatctcatcttcaaactgtaatatactatagtgtacctaatttaattactagtcatcgtttacaacacgactatcgaaaaactttggaatacccaattaatatttctaagcata

SEQ ID NO: 59081 - DNA, 299 bp, Zea mays
  Clone ID: LIB3069-025-Q1-K1-D4
ccaggcgtacgggcaggcgtgcagacaagccttcgcacactcgcgttctatgaccgccacatgagcatcggctcaggcgagggacatcagtgccacatcaacatctcgttcaacgcgggaaacctgtaccaagtcacgtacacttgcaatgcgcggaagtactccgtcttcacttgctacccacaagaaaggcccggactacttgttggatcatacgcacatgacacaccctgaaacgatcaccaatcacactagcttgacatacactgtcctgacaactagatctatggcattggttg

SEQ ID NO: 59082 - DNA, 75 bp, Zea mays
  Clone ID: LIB3069-025-Q1-K1-D5
cccacgcgtccgcccacgcgtccgtgaaagtgtaacacgctacattttgaacacagaaggttaccaacatggggt

SEQ ID NO: 59083 - DNA, 443 bp, Zea mays
  Clone ID: LIB3069-025-Q1-K1-D6
acgcgtgcgcccacgcgtccgcccacgcgtccgacggcttccacggccagaacccgccggcgcgcggcggcgtgcaccagcccaccttcaagatcttctgcaaggccgacgaggggtactgcctcaccgtccgcgacggcaacgtggtgctggcccccgccaacccgcgcgacgagcaccagcactggtacaaggacatgcgcttcagcacccaggtcaaggacgaggagggcaaccctgcgttcgccctggtcaacaaggccactgggctcgccatcaagcactccctcggccagtcccacccggtgaagctggtgccagtcaacccggagtaccaggacgagtcggtgctgtggacggagagcggcgacgtgggcaagggcttccgctgcatccgcatggtgaacaacatccgcctcaacttcgacgcctttcacggggga

SEQ ID NO: 59084 - DNA, 395 bp, Zea mays
  Clone ID: LIB3069-025-Q1-K1-D7
aaacagggctcgtggtttttcattggcccacttggcctctgatctgcccttggagcttggatctcttatcttagtttatttatattatggatggcatggcaacctggattcagagaaccagtaggtactgaaaaaataatccaaaatgatcgagtatccactgcccaggctcgttactgcaatactgccttcgtgaatcgtgcctctgcctcccaatctggcatggggcagtgggcctcagttcttccttcaccactagccccttttccctttcaagtcccttttgaaattttctctctctacaatttcttatacaaaagtgaatcgaattctgggatttttttaataaaaaaattccgggtacagaaagacagtgacggagatacgaaccaaac

SEQ ID NO: 59085 - DNA, 254 bp, Zea mays
  Clone ID: LIB3069-025-Q1-K1-D8
acccacgcgtgcgcgcgcaggcacagcactactcgaagcaagtactatagcagctgctgctcctgtacaccaagcgtacgtgcaaatacaaatacaatggccaccaaaagcatcgcctcgctgctcgccgtggccctgctgctgctgctctcctccccggccgccgtcgtcgtcgtccgcgcgcagcagcagcagcggggcaacccgtgcccgacgaacgcggtggcggacctcaaggtgtgcgccgacgtgct

SEQ ID NO: 59086 - DNA, 450 bp, Zea mays
  Clone ID: LIB3069-025-Q1-K1-D9
cccacgcgtccgctactggaagcgccgatctatcaggttctgatcgattcttctgccccgagtccgcagcggcaagcggagatgaactgcgagacctgtcagctgaaagaactggagctggaactgacggagatcagggatgttctgcgctgtattttgcacaccatattcttccatagaaccctcagcctggttcgccccaaagatgttgactgtgatttcctcgatattacttatgtacaatgtggtctaccggaactagaaaaggaagttgacgaatagatagaccagttcagtgcatgggtggagaaacacccaaaccgcagaagccagatctgcctctcctttttcgacgagaaacacagacaccctggatggtttgtcaacaaaacagagcgcatctattgggagcaatggctcatcaatttgcaagtcatgttccccaaaaga

SEQ ID NO: 59087 - DNA, 400 bp, Zea mays
  Clone ID: LIB3069-025-Q1-K1-E1
acctcgccggcggccaaaaatcgaagcaccgaaccagcggctgcggcagcggcggcggcgcggcaagggttgaccatggcggagctaaagcggttgtcggagagccgtgacctgacgcggattgagcgcatcggtgcgcactcccacatccgggggctagggttggactcgtccatggaggcgcgcgatacctcggagggcatggtcgggcagctccacgcgcgccgcgcctcggggctcatactccagctcatccgccagggcaagattgccggccgcgctgtgctccttgcgggccagcccggcaccggcaagaccgcgctcgccatgggtatcgccaagtcgcttggtgcggagacacccttcgccttcgtcgctgcctcggagctcttctcgctcg

SEQ ID NO: 59088 - DNA, 267 bp, Zea mays
  Clone ID: LIB3069-025-Q1-K1-E10
gacccactcgtccggtgcggttcctccacatatcgtatcggagtgaattccatcacacagagatcaataactcgggaagaccaacttagcctatggtagagcttgcttataaaccaaactacataaatatcatgacgatcattccaacttacgacccattgcccaatgaattacatagtaccttagcctgtactacataaacgacatcaagcttactactaccattaagctgcatgccttataaaaacaggcacactaggtctgtca

SEQ ID NO: 59089 - DNA, 363 bp, Zea mays
  Clone ID: LIB3069-025-Q1-K1-E11
cggggacctcgtgatcgccctctcggacattctttagtccatccaggtgatgaacgtacggtgaggtagaagagccttaccatgccgcacggtcccgtatcggaaggaaggaacacgcgcgttatcggcaccttggaaggacggttccttccttccctgcgcctaaatcgctgccctttgatttcgctgtatcagatgctgctatgctatgctaggctctagtctggcccagggaactgtggcaataatctgtggctttcaagctggtgttagaactcttgtactgcttgtaagcttatgtgggttttatcgtgcaagtaggtggtttgatgttttagtgtggtataaaagcgatttcaagct

SEQ ID NO: 59090 - DNA, 421 bp, Zea mays
  unsure at all n locations
  Clone ID: LIB3069-025-Q1-K1-E12
cccacgcgtccgcccacgcgtccgcaaagttttctctcccctagccgccgccgccgctcggctccctgagaggtgccgggaccgaggatttggccgagttctaggtagagaatcggttttacttgtctcagcccggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttctatgatgtatgaagctcccctgggctacagcattgaggacgttcgnacctgccgaggcgtgaagaagttccagtctgctgcttactccaactgcgcgaagagccatcctgatatcccttttg

SEQ ID NO: 59091 - DNA, 390 bp, Zea mays
  unsure at all n locations
  Clone ID: LIB3069-025-Q1-K1-E2
cccacgcgtccggttcgcttcttgtggcatcttgctttccttcgagtgccatggccgatgcggcggaggagaacgttgtctcgccgccaccgacccctgcggccccagccgtgggcgcctcagacccgcccctgcagcctgctgctgacagcgcctcaacggagaaggtgtctgctccggcgccggaggtaaggtcccggggattcaggcttcttggagaggacacttccgtgcacaaatcccttgggggcggtaaaactgctgacgttctgttatggaaagacaagaaaacttctgctgttggtataggcggcgcaactgtcatctgggttctgttcgaagtgcttgattaccacctnctgaccctgatatcccatgtactgattggtg

SEQ ID NO: 59092 - DNA, 460 bp, Zea mays
  Clone ID: LIB3069-025-Q1-K1-E3
gaccaacccttccggaaaaaccttattggtccagtttttccggttgatcttctttaaggttaaccttttaaccggagtatgtaaatattcctttgccaataaattacatgcttaaatcgtggctgctaggcgaatggtcctactttggtcatcaaatgcaggaattccactactatatgtgccacttgaagttgttatgttcaaataatatggtgaaaacgagcgtctattgggatctattttttatcttgcaaatgatcttcctgaaagaggtaatatattcttagatgaggtatatatcgtaatacttatagcataaacactcaagccactacaagtaagctcctgctctttgcttgtttccagattgatatgtcaagatacgcttgtttcatttgagctcactgttatctgaaaatatatagactgccttcgtccccttcatcactgctgatgaccc

SEQ ID NO: 59093 - DNA, 421 bp, Zea mays
  Clone ID: LIB3069-025-Q1-K1-E4
gcaagacaagaagcagccgtaagcagcagatagcatggcgagatcagggcgggaagcggggcccggagaggaggaacggaagctggtgctgggcaagtacgagctgggccgcctgctggggcagggcaccttcgccaaggtttactacgcgagggacctgagcgccggcgccggcacgggccacagctgcagcgtagccatcaaggtgatcgacaaggcgcggctgcggcgtacggaggggatggtggagcagctgcgccgggagatctccatcatgcggatggtgcggcaccccaacgtggtgggcatccgggaggtgctctgcagccgctcccgcgtcttcgtcgtcatggagtacgcgcgcggcggggagctcttcgccaaggtggcccggggcccgctcgacgaggaccacgcgcgc

SEQ ID NO: 59094 - DNA, 444 bp, Zea mays
  Clone ID: LIB3069-025-Q1-K1-E5
attaatcttctgaaaactggtgatcaagaagcatatatgaggatggttgaagagagcaagaatgaacgcttgaaaatgctccttgataaaacaaatgagcttcttgaaggaattggaaaagctgtacagcgacaaaaagatgctgaacatgttagtaagccagaaggagggagtgaagtgccaaaagggtcagaatctgaggattgttctcaaatttcgggcatcaagagtgaatcagctgaggagtctacttcagatgacgatggagacctccctggccctgcagatgaaagtaaattcaatgcaggacgtagacttgatgttactgttcattctattgaagaaaaagtaacagaacaaccatctgctctcgaaagtggtgaattgagaccatatcaactagaaagtctccaatggatgctttctctatttaacaacaatttg

SEQ ID NO: 59095 - DNA, 436 bp, Zea mays
  Clone ID: LIB3069-025-Q1-K1-E6
cccacgcgtccgcaaaagggcaacaacttatatatagtcgggaaattgcatattttgtaagcattgatttatcaggcaactacttaacaggtgaaattcctttgggtatcacatcccttgatgccttaatgaatttgaatttgtcatcaaaccaactgggtggaaaaattcccaacaagattggtgccatgatgtcgctggcatccctggacctctccatcaacaagctttctggtgaaatcccatggagcttatcaaacctgacatctttaaactacatgaacttgtcctacaacaatctgtcaagaaagatacccttaggccgtcaactggataccttaaacgtggacaacccgtcactttgtggaccttctcttcaaaattattggtcaagaaatggtagcttcatgcctgggtatcacagaagcaataagca

SEQ ID NO: 59096 - DNA, 117 bp, Zea mays
  Clone ID: LIB3069-025-Q1-K1-E7
gagctgcattactgtcataaaaacaaaatttttaaaaaaaaaaaaaaaaaaaaaaaaagaaggcataaataaatcatactacaatctaatcaataaaaatatactttttaaatcaca

SEQ ID NO: 59097 - DNA, 311 bp, Zea mays
  Clone ID: LIB3069-048-Q1-K1-C12
cccacgcgttcgcctactcctgctcctgcttctatcacagctagcgcctgctccccttcgccgatgatcatgtcttgcagcagcggcaagtgcgactgcggctccagctgctcctgcggcagctcatgcaactgcatgtcccctaacgtggagaccgccgacgtcagcagcatcaagaccatggtcctcgctgcgccgaccaccaaggccagcgccggcggcttcgaagcgggcaccgagggctgcggctgcgactgcaacacctgcaagtgcggcaccaactgcagctgctcctgctgcagctgcaactg

SEQ ID NO: 59098 - DNA, 172 bp, Zea mays
  Clone ID: LIB3069-048-Q1-K1-C2
gacgacctgacgacacaagttcagaacaaggttatcctcatgagcagaatcgacgacgccgtctgcagggtccttcgtgtcaagttcaccatgggcctgttcgagaacccttaccccgactctagcctcgccggcgagctctggaaacaagaacaccgggaactggcgcgcg

SEQ ID NO: 59099 - DNA, 286 bp, Zea mays
  Clone ID: LIB3069-048-Q1-K1-C3
ccagcgtccggtgcgagctgtgagatgtatcgtttgaggacggacattaataaggggagaggagatgaggagcctcaaggaagaggagcggaagaggggcggggacaggaatcccagagccgcacaaggcaaggcctaacctctcactcgcaacggcacacagcgcaggtctggaagttgccatgtcgaacccttactaatccccacagcttacaattttctatggtggatcactatgtgtgtatgactcggtgccaccagaaaaggctcatgcaatcatgcttat

SEQ ID NO: 59100 - DNA, 320 bp, Zea mays
  Clone ID: LIB3069-048-Q1-K1-C4
catgaatacccatgagccgcagcaaagtcaaggcctcagcctctcactcgccaactgcagcgacagcggcaggtctggaatgttgccgatgtctaacccttcagctaatcccacacagcttacaattttctatggtggatcactatgtgtgtatgactctgtgccaccagaaaaggctcatgcaatcatgcttataactgcggctgcagcaactgctgcaaccaccaaaagcagtgctgccactgcttttaatcctccaatgagcacttctgtagcatcttgacaagctcaagttgttgctgaccctatctcaataaaca

SEQ ID NO: 59101 - DNA, 98 bp, Zea mays
  Clone ID: LIB3069-048-Q1-K1-C5
tcgggcttcttcttaaatagagctgagaagagtcatttatttcagcagcaaggaatttccacgagtagtggaaaaggtaccttcacaacaaaacccat

SEQ ID NO: 59102 - DNA, 233 bp, Zea mays
  Clone ID: LIB3069-048-Q1-K1-C6
ttctgagctatccaaaccactcacagattgattttcacctaacgttgatgactctctacgtctggcgtcactgcatattctggctcctatccaacacattgacacacacgatctaacttttcatccagtgaagacgcacatagatccatcatcatactatagatcagacagctgacaacacgctcgatactcctactgcatcaacgaactcccactattatccttcatccata

SEQ ID NO: 59103 - DNA, 361 bp, Zea mays
  Clone ID: LIB3069-048-Q1-K1-C7
gccacgcgtccgattaagaatttcatattagttctaaacacattggaagtcacaaaggaggatgaggtctaagcctataaggtgttcaaggaccctgagtccctgacaatcgacaaatttccttgagtgcgtgcactgatgatagagatattgtattgatgtggttgacgcatgagatgactaagcaggtatatctaacgttaactacatatcctaatgttagactacccgtctagggcttggggtgttccccctgtaattaccaactcaccctctgtattgggcctggcccatttaccaagtctattaataccactcctagccctgattaaggttatggttctcattccaacatggtatc

SEQ ID NO: 59104 - DNA, 424 bp, Zea mays
  Clone ID: LIB3069-048-Q1-K1-C8
accggcacagtactcgtcctccttgcagagcttgcaccaacacgccaccttaccttgctttggtcgcactcgcacacagttgcgagcgcattgcttgcattgcgcagccgcaggccgcagcacgaagctagccagtaagcggtagatggcgagcagcgcggggaaccgcttcctgaggcagctgagcgcgagcaacggcgacgaagcggtctgcagcggcctgcagatggaccagcacgagtacggcggcgccggcgtggagaggatgggatcccggcggtggtcgaagaagcgggccgacgccgtcgacgccgctaggggctacggcgccggcaacgggaatggcgtgaagcaaccggcctatgccgcggggaagcgggtgatggtggtagtggacgagagctctggagccaaccacgccatg

SEQ ID NO: 59105 - DNA, 373 bp, Zea mays
  Clone ID: LIB3069-048-Q1-K1-C9
cagactctaacgcagtcactcatactgacttttatgcgactaggcttaaatatgacctaccgtcatttttaagtcacgcatattcgaccacaacacatccaaatacaatggactaaccacaaagaaacacacaatcacaacatctttaccatttttctggcttactgcaagcaaatactatacccagttacttgatgtgctcaaatcttacccctattcacgagttttacttataccagatccttcatacacattcatgctacaaaatataacccatctgttgcacctaataatctgccaccaatcttcatgcaggagacttcataacatgtaagctatcccaatactcatactacgcatcatgttcccaata

SEQ ID NO: 59106 - DNA, 401 bp, Zea mays
  unsure at all n locations
  Clone ID: LIB3069-048-Q1-K1-D10
cccacgcgttcgatcccgtccgccgccccttttcaaccacgaaccacgcaagcgaacccggcggccggcgtgcagcggcgatggcggagatcccggtgatcgacctgcgcctcgccggctcgtcgcccgacgagtcggcgcggctgcgcgacgcgtgcgagcgcctgggctgctttcgggtgaccggccacggcgcgcccgcggggctcctggccgacatgaaggccgtcgtgcgcgcgctcttcgaccttcccgacgacgccaagcgccgcaacgccgacgtcatccccggcagcggctacgtcgcgccctgccccgtcaacccgctctacgaggccttcgggctcctcgacgccgncgcgcccgccgacgtcgacgccttctgcgcgcgccttgacgcg

SEQ ID NO: 59107 - DNA, 394 bp, Zea mays
  Clone ID: LIB3069-048-Q1-K1-D11
cccacgcgtccgcagctctcggcttctgtctctcatcggcacacccgagctcgcgccctccggccacgtcgaggtccgagtcctgctttgatggcgaccgacgtgactgagactcccgcgccgttggtggatgcggccccagaggcgcccgccgacgccccggcggcgcctgctgccgacgcgaagccggccaaggccaagaaggccaccgcgccgaagaagcgcgccagcccgacccacccgccgtacgccgagatggtctcggaggcgatcacgtcgctcaaggagaggacggggtccagcagctacgcgattgccaagttcgtggaggacaagcacaaggccaagctcccgcccaacttccgcaagcttctgaacgttcagctcaagaagc

SEQ ID NO: 59108 - DNA, 350 bp, Zea mays
  Clone ID: LIB3069-048-Q1-K1-D5
gggggccatgcgggtattactattctgccactcttctcacaggccactcctgcaagcagttcggtgtcccaagaagacattgaggctctcaccaagaggacacaagatggtgggacagaggttgttgaagcaaaggctggaaagggctctgcaacattgtccatggcatatgctggtgctgtttttgcagatgcatgcttgaagggtctgaatggaattccggacattgtagagtgctcttttgtgcaatcaactgtgacagagttgccgttctttgcctccaaggttcggctcggcaagaatggagtggaagaagtgcttggtctgggtgagctcaacgacttcgagaa

SEQ ID NO: 59109 - DNA, 316 bp, Zea mays
  Clone ID: LIB3069-048-Q1-K1-D6
gtggtctatgcaattcagttgacatcaatgtatttcagataattctatggttggttttatggtggaaaccagttcgagttatggtcattttgccaaagatgttctttgcaggtgtatcactatttgctgcccttgggtttgttctgtatggaggaaggttatttctgatgttgcagcgttttcctgtagattcgaaaggaaggagaaagaaattgcaggaggttggctatgtgactaccatctgtttttcttgtttcttgatcagatgcgtcatgatgtgcctcaattcatttgataaagaagcagatcttgatgt

SEQ ID NO: 59110 - DNA, 396 bp, Zea mays
  Clone ID: LIB3069-048-Q1-K1-D8
gaggctgttaaagaagtgcttggatctttagtaaaggctgcgaagcaagcgcgacttgagaaggttgagataccagtcaaaatcaagctgataccagagccatggacccccgagtcgggactcgtcactgctgccctcaaactcaagagggaggtgatcaggaagacgtacgagaacgatctggctgagttgtacgcatgatggttctactctttttgatacgtttagtgtggaaaatgtgtagagtgtcaatgtcacgctgagatctatggtaatttgataccgattatcgttctgggattattattattattttgttcaggtagaagagatatataaaccttgaaattttgagttatatggcttctcttgatgccgaaaaactatattgcgatg

SEQ ID NO: 59111 - DNA, 396 bp, Zea mays
  Clone ID: LIB3069-048-Q1-K1-D9
tcaggtctcatgtgccacatactgacccattttctattcattcgcaatcgaaccataccagcagccattctgacccacctactgcgccggaatcctgagaccacttgcaccatgcacacagcatatcccaagaaactaccatcaccactatcgagcagcctatagctattgatcaagttgaacctgtcaacctcaatgtacatgaacttgtggtcgatgatcatcaacctggctatgctccaaggcgtgaatctgctacgctggataaacctgcatgtacttccaaaacggatgattcaaatgagattcgtgaagatagcatatcactggaaaatcagttagaaatttgcaatgcaactactatgtctgatgagtgttcctccacaaatgcaaatg

SEQ ID NO: 59112 - DNA, 271 bp, Zea mays
  Clone ID: LIB3069-048-Q1-K1-E1
cccactcgtccgcccacgcttccgcccacgttttcgtttactcttaggctgactcattttctagtgcagttcaccacccttcccaattccccatcttctccacgatccaacacaaccccaccttcacatcaagcaatacaccgtcgtgtacccaatccagccacacaagtccacactctacacagtccctcgatcccctccccctcttccttctcccaattctcctcgatctatccttctgctgtcctcgcatctatagcctttcaaaacc

SEQ ID NO: 59113 - DNA, 348 bp, Zea mays
  unsure at all n locations
  Clone ID: LIB3069-048-Q1-K1-E10
cccacgcgtncgcccacgcgttcgcggacgtttgggcagttttttggactctacacaaaactggtatcttcaactaattatgtgacacgaagacaatcagtgaagtttctttcagagtttctgttggaggccccaaatgctcaaataatgaagcgttacattttggaagttcattacttaaacattatgatgggcctgctaaaagattcaagcaaaaatatcaggatatgtgccttccacatttttaaggtatttgttgccaatccaaacaagcctcgtgagattattcaggttttggttgagaatcacagagaagtgttgaagctacttcacaatcttcccacaagc

SEQ ID NO: 59114 - DNA, 334 bp, Zea mays
  Clone ID: LIB3069-048-Q1-K1-E11
aaaaaaaatactaccactctttctaaacttttttatcaaaaatataaactttaaacaaaactagtgatctttaaataattatatgacacaaaaaacaatcaaaaaaaaaaaaaggccgaccttcctaaagaatccaaatttacttacacattcatccaactcaataactattttatattacccccaaatattaattcacttgccaaatttttaaaacatcaatatttgaaaaaccctgttttaccccaataaaatatcctttgacaaaatccccttttctccagatatcatataagcaaaaagccccaatcacatagacctttcaaaaattttc

SEQ ID NO: 59115 - DNA, 308 bp, Zea mays
  unsure at all n locations
  Clone ID: LIB3069-048-Q1-K1-C11
cggacgcgtgggcaatgttcttttgcatgtgggtagtggctntgtcaacctcgacgaattgcaggtggtgcacacaaacttttgccagaaggcactagactagctgtcactcttcgtggtgatgaatcatacgagcagctagatattcttaaggatgttgatgatataacaatgttgttacataatggtccatatgttgaggagaagacaggcagggtgcatgctgctaggaggttatttgagtacttacaggccaatggcttgaacttccctgtaattcatcacataaatttccctgaaaccattga

SEQ ID NO: 59116 - DNA, 372 bp, Zea mays
  Clone ID: LIB3069-048-Q1-K1-A2
aattcccggtcgagcacgcgtccggggaaagagcttacgctgctggggttatgggttagcccgttcgtgctccgggcgcgcatcgcggtcagcctcaaaggcctcacctacgcttactccgaggagaacctcgacgacaagagcgagcttctcctcagctccaaccccgtgctcaagaaggtgcccgtgctcatccaccacggcaagcccgtctgcgagtcccagatcatcgtgcagtacgtcgacgaggctttccccgccgccgcacctaatttccttccatccgacccctacgaccgcgccattgctcgcttctgggcctcctacgtcgacgacaagttctacagcgcgtggatacccgtgttcaagggc

SEQ ID NO: 59117 - DNA, 421 bp, Zea mays
  unsure at all n locations
  Clone ID: LIB3069-048-Q1-K1-A3
acctacgcgtgacgccgtacgctaaggctgtccacgggatctggtgttggcactgatccagatgctgcttgggcccgagcctgcggtgctgcagatgctgctgcccctgctgcagaggagaagaaggaagagcccaaggaggagtctgatgacgacatgggcttcagcctgttcgactgagagtctgagaccctcgctacccagccattagcaaattcgcttatgctgtccaagacttatcttacgttatgtctgtaggcttttgttattacaagtactcaagttttgagtttttgagatgtggctatgacaatgtgatgaagaatcctaaaccatcgtattagagtgaaacttggttctatataaagttccaaggttcttgaacctcaaaaaaaaaatanaaaaatattaaacttaaaag

SEQ ID NO: 59118 - DNA, 249 bp, Zea mays
  Clone ID: LIB3069-048-Q1-K1-A4
gatcgtgctaattctacttctacttcggaatttccgtcggtcccggtgcctcggattgtcaacgaccggatgaagtcgctgcagcaggatctgtggttcatcgtgcgatggcggcggagcctaccgtgcggggctacggtccagacgacgccgtcgacgtcgtccgtggggctgtctcagacgctatctgcggtgccctgagcgatcgtgcccatgacgacccggacttaggcgccgtatgtgcgcctg

SEQ ID NO: 59119 - DNA, 301 bp, Zea mays
  Clone ID: LIB3069-048-Q1-K1-A6
gcataaggaaccaccatgggcagcacataagcattcccattttacttttaggactgaaagtcaggtagatgtgttctagttgaagggggggggggtgttctggaacttgggtaaatgggggaattctgaatacagtgcaaatagaagtctgctccctttggatattgatcatgcatgaagcaaaatgttatatctgaaaagcgcgtaccttgtaccatagtatctagtcttaggtgctccttgcattaatatatagtacctgaatatggcccaaattatgtatctggataacacatgtagc

SEQ ID NO: 59120 - DNA, 264 bp, Zea mays
  Clone ID: LIB3069-048-Q1-K1-A8
gaggagagaccgtgcactacacacctcacgcctgaaggccagatctaagccttctcgtcgtcgggcaatgacaacgatgaacatgtaagaaccaaacaaatcagagcacgaccatcggtctctaatcaaaacgcgcagcacgcacgtagcagagcgcgcatggggcttctggaccagctgtgggacgacacggtggccgggccgtgtccggactccggcctcagcaagctccgcaagcacgcgtacttctccccctcgtcggcc

SEQ ID NO: 59121 - DNA, 319 bp, Zea mays
  Clone ID: LIB3069-048-Q1-K1-A9
cttcttcatgtttcaaatgggacttcatacttttatgtttttccatcaagctatgggatgggctttcttgttctttatacttgtgtgcttctttcaactgctccaaatatttaaatagcttacatgtgctcttgttacattcagattgttaaggagaaccaaatgcttcacaaaggctctgttgagattgaagatgattttgctactcttgctgataagagtatttttcctggggattttctctgggtcagagactctgaaatatatgagaaccgtgacattgcagatgagatttcagaacaaaaggatgatatgctac

SEQ ID NO: 59122 - DNA, 285 bp, Zea mays
  Clone ID: LIB3069-048-Q1-K1-B1
gcggctcgatccatctcactctccgctggtcgcttactcttgcagctccacccttcactcagtctgagtctgttattagctctaggctctagctagccgcgccactccttcgtgtagccatcagccttctcatcgccaccaatggccactgccgaggtccagaccccgaccgtcgtggcggccgaggaagcgcccgtggtggagaccccgccgtcagccgtcgtgcccgatgagtctgcccccgccgaggcccaggccgaagcccaagctgctgctcctgctgat

SEQ ID NO: 59123 - DNA, 261 bp, Zea mays
  Clone ID: LIB3069-048-Q1-K1-B10
accacgcgtccacccactcgtccacccacgcttacgaaaaaaaaaaacacaaaaacacaaaaagaaaacattaaaaaaaccacaaagcccacacaaaaaaaacaaaaaaaaacaaacaaccaaaaccaaacaaacaccaaacaacaaacaaaaattaacttcacaaccacacaactaacaacctcttcaccatccaaaacctcacaaacctttacaaacacaaaccccaacccatccccaaacaccccccagtcaccaaaa

SEQ ID NO: 59124 - DNA, 395 bp, Zea mays
  Clone ID: LIB3069-048-Q1-K1-B11
cacttgtgttgcctgttcatctatcaaagctttacctgctttggtacggttatgatcgcagggatggtgtccattcactctgtgcagctatatggtcaaaacataggagatggttgatgatgtcaatgatgtgtctcaatccaatagcttgttcgtttatggatttgcaattccctaatgggcaactaacatatgttgctggtgaggggatatcagccagtggttttcttccgttatttggtgggttgcttcaagctcaaggaaaatatcctggagaaacaagagtgagcttttcttgcaagaataagcgtggcacaaggtttactcctatgtttcaatggcctgacaagtctgtttcggtaggagttactcaagccttggcatggaaaagatct

SEQ ID NO: 59125 - DNA, 329 bp, Zea mays
  Clone ID: LIB3069-048-Q1-K1-B12
ccacgcgtacaccgtatatacttcaacttgtcgtcccaaaagcactaccgtcgcgagttctacacgccgtcagctggaccccgaccctcctgcatcgctggaggacttaaacgagggcggattggccgcgttgggcgccgcggcgtcccgacgatcatgggtacaggagacggaagacgggtcgacagcaccggcaagccacgatcacgagcgcacttttgagacgagaactggcgatcggcggacttcttcgatgcacatatatagcgtaggcatttccatttgcgaacttttgctgatttctactactggctatacactagcaacca

SEQ ID NO: 59126 - DNA, 406 bp, Zea mays
  Clone ID: LIB3069-048-Q1-K1-B3
actaactgcttcgaagaataaccctgttagttttccatcaaagcctgttggaccacctccaggatttgatcatgtaaccccaaagcgtcaagatgattctattccggttgaaaaactgcagaacccacaggtcgatgattacagctggctagatagctatcagcaatcgattgatcatgttcacagcttaagaactatttatcctggtgtcagtgatactagcactgcatttgccactccattctctttccctgggaggatacacacacaagggaccaatgaaaagacttggcaagatttccacctttttgagccttcaaaacagaacatgttccaaacttaccaccaaagaaatcttcaaagtggtcaaaaggatgaacaagaaccagcaaattctatctggtct

SEQ ID NO: 59127 - DNA, 434 bp, Zea mays
  Clone ID: LIB3069-048-Q1-K1-B4
actacgcgttcggttctagatcgctagcggttttccttcttaatctgttaatgcacttccatagctcagttatctcaccttgtagcttataaatcatgttattcaggttgtgatactgcataacccacaagtcgatgattacagctggctagatagctatcaacaatcgattgatcatgttcacagcttaagaactatttatcctggtgtcagtgatactagcactgcatttgccactccattctctttccctgggaagatacacacacaagggaccaatgaaaagacttggcaagatttccacctttttgagccttcaaaacagaacatgttccaaacttaccacctaagaaatctgcaaagtggtcaaatggattaacaagatccagcaaattctatctggtctagcagttaccatgtgtgatttggtaact

SEQ ID NO: 59128 - DNA, 334 bp, Zea mays
  Clone ID: LIB3069-048-Q1-K1-B5
cccacgcgtccggacagataaaaaggttttatctacccgggcaaacaaggaggaaaacgactgggaatgaaattacactaggtgatccaaatcaggtggcagtcctgttttctgaatggtgtcagatgcgtaatcatgtaagtgctagtgatgcggcatacactcgttttgtcacacaattgcagcaagatggtctgctgaagggggatgatatctgtgaacgcttcttccggattctcacggaacttgctgatacacactctctagtctgcgagcaaatcgttgctcctggtggatcatctcagcaatcaccacagcaacctcacatttcata

SEQ ID NO: 59129 - DNA, 58 bp, Zea mays
  Clone ID: LIB3069-048-Q1-K1-B6
cccacgcgtgcgaaaagataaaaaagtcttattcttcccgatcaaaccatgcataaac

SEQ ID NO: 59130 - DNA, 426 bp, Zea mays
  Clone ID: LIB3069-048-Q1-K1-B7
gacacacgcgctagctagcttaccttgccattacctcttcgcctagctagcctgccaggcgcggcacgtgccaccggcatctctgctctgctctcgcaagcacacgcccggccgactgccacagttgccatggcgaccatagccacgatggcgctgctgaagcccgccgtcaaggccgcggcgcggccagcgccgtccaccagcagcggaaacctctcgctgcccgtcccggagcatgccgccaaaaatgctgctgtgtccgcctgcgcgtcatccacactggccggcgccttcttcactgcgctagcgtcgtcgaccgacactgcgctggcggacgtccctgcagccgacgccttaggcgacagccgtggtcagctgctgctcatcgtggaggctcccgtcatccagtgcgttatgtacaacatt

SEQ ID NO: 59131 - DNA, 402 bp, Zea mays
  Clone ID: LIB3069-048-Q1-K1-B8
cgacggcggcgcgctcccgctgtccaagccctacgtcgcgtccctcgccgtgatcgggtgcaagtcgaacgacgccatcaggctgcgcggcaactacttcggcccgccgtgcgtgacggtgacgccgctccaggtgctgcagggctacgtgaaggacacgagcttcgtcgccggctgcaactcggccgcctgcaacgtcacgacgatccccgaggcggtccaggcggcgagctcggcggactccgtcgtcttgttcatggggctggaccaggaccaggacagggaggaaggtgaccggctggacctgacgctcccgggacagcagcagacccttatcgagagcgtcgcgaacgcggcgaaaaaaccggtgatcctggtgctgctctgcggtgggcccgtgga

SEQ ID NO: 59132 - DNA, 415 bp, Zea mays
  Clone ID: LIB3069-048-Q1-K1-C1
cgtagacgtgccaaatataaaggtcgctgatccgcagtccaaacgcaagagcggtggctacagcttagatgagtgggacgaggagtacgaccgagggaagacgaagaaggtgcggagatcaaagcaagactttggcgggccaaacccgttccaggaggaggcggactacgtatcgcagcggaggacgaagcagaaatcctaccgaggcaagtcttggaacaagcgggcctaacacggtagtagagggggagttgagagaatacgcgagagagaatccctggacgcacatgctgtttgttgttacgttttagcacccattggtgaaggagatttacgtttaaaaaccatatccgtcgtcggtacggtagtccccattagttgtcgacgatatgacgttttgtgcagttttcgtaga

SEQ ID NO: 59133 - DNA, 325 bp, Zea mays
  unsure at all n locations
  Clone ID: LIB3069-048-Q1-K1-A12
gatggcttctatctccncttcggttcgggttctggttcgtgaggatcttccggggttcggtttgttgggtgagcggatcgagatggcggcgtcggatgttgagtaccgctgcttcgacggcggcctcgcctgtgccacggacgaccactccctgcacaacgccttcagcacctacggcgaggtcctcgagtccaagatcatcctcgatcgggagacgcagaggtcccgcggcttcggcttcgtcaccttctccaccgaagaggcgatgccgaacgccatcgagggcatgaacggctaggagctggacggtcgcaacatcaccgtc

SEQ ID NO: 59134 - DNA, 426 bp, Zea mays
  unsure at all n locations
  Clone ID: LIB3069-048-Q1-K1-C10
atggctccctccagaattcatgtaacatgtgtgttagttcatgggccttcaccaacaggaaggatccaccaaggagtttgttcaacatggatgaagaatacaattcctctggaatatagcgaagaatgcagctgggctcccatctttgtgaggcagtcaaatttcaagttacctgctgatccgtccactcctattatcatgattggtcctgggacagggctggctccttttagaggcttcttgcaggaaaggttagcattgaaacaatctggggcagaattgggcacttcaatccttttctttggatgcaggaaccgtaatatggactacatatatgaagatgagttgcaaactttccttgaggagggggcgctttctgagctaattgntgcattctctcgggaagggccaacgaaagaatatgtg

SEQ ID NO: 59135 - DNA, 396 bp, Zea mays
  Clone ID: LIB3069-047-Q1-K1-G8
gtcccacaccgtcgaggagttcctgcaggctgccttcggctacgccggcctcagctggaaggatcacgtggtcattgacaagaagtacttccggcctgcagaagtcgacagcctcaagggggacgccaccaaggcgaggaaggtgctcaagtggaagcccaaggttgggttccaggagctcgtggagatgatggtcgatcacgacattgagctcgccaagaaggagaaggtcctggtggatgctgggtaccgtgatcccaagcaacagccatagaaacatcacagttgcttcttgctcttgtggggctcggattcaaattgttcccctcatacatggtggttctcaggggtagaggttgaccgaagttactatcgatatttatcctggtaagaaat

SEQ ID NO: 59136 - DNA, 440 bp, Zea mays
  Clone ID: LIB3069-047-Q1-K1-G9
ggcatcgaaacatggtatataaataaaggacttgacgatttgtaacgcagtagctggtgcgtgcgtggtgtggtggtaagaaattcttctgctgtctgtgttcttgtaacctcctcattctcgcccaccctgatggtacatgtaccgtgtacgtagtctgccgtcgggcgctgatcatgctcgacaagtctagtgtctgcattatactcgtcatacccatcaatacaaaagttagtctaatggtgaacacaaagctggagagtaccatggtgagcacaagccaaaagcacaaagaggggttcctagacaaagtcaaggacaagaatcatggtgagcgctgtaccggatccagccttacgaacaataacggcaacaagaataatgagcattggcatgaccatagtcatgacaactggaccagcatttacaacgattaaact

SEQ ID NO: 59137 - DNA, 446 bp, Zea mays
  Clone ID: LIB3069-047-Q1-K1-H1
cccacgcgtccgctcgtcgggctcgggcgttccggaagaaacaagcctggaaaatatagggtatataaacaactggaccaaacccaagtccagacccgcagcgcccgccggaggcggagggaaccgagccggcgaccggcagaccgcagagaagaggcctggagccgaccgcagagaagaggccaggagccgaccgcaggcagccgccaccgcaccagaacccgaggtctcgaggcaatcgagcgcacgcgggtcgggggctgcggccatgtcggtgagttgcgggctcgagtgggtggtgtgccttggctgcacgcggtgggcgtggaagcggctcacctacatcggcgcctacgacagcgagacgtggccgccggcgtacgccgacgagttcgagcccgtgccgcgcctctgacgcgccgtgctcgcgaactacgacgaggagc

SEQ ID NO: 59138 - DNA, 382 bp, Zea mays
  Clone ID: LIB3069-047-Q1-K1-H10
gaagttattgctctgcccataactggtggttacaccaagtatttggaatggatcaagaacagcacccgggacaagtgatctcttttttttttggagctcgacataatgcgatgatcgaagtgcccatggctccttacctcttccagtgtcttgcacacaagggagtatcctctcttgacctggacatctcaattacgttgctgtaccgaatccatatctaccatcttcaggtaacaagtgatttggtgtcccgtgtgggtaatccaaatgcatgcattgctctgagtattgacaggttggctagtgtaacgtgtaagtccaaaccatatcgtatccaaacatgcgtattgtaggtctttgatcgatatttgtgccgagttta

SEQ ID NO: 59139 - DNA, 256 bp, Zea mays
  Clone ID: LIB3069-047-Q1-K1-H11
cgactccacgcttgcgaaacacatacgtcctgactgctagacgacaggttcagcagatatctcacgtcgacctcgctaggccattggggtaacctccgtctatagtccgtgccaccatagacaccggcatcttatcacaatgcaagcccacgctcgctatcgactactgtatcatctctctatactgcgaccaatcatctgttcaattgactgtcactttcaaccatactattggtgcaacctctggtgatctcaa

SEQ ID NO: 59140 - DNA, 452 bp, Zea mays
  Clone ID: LIB3069-047-Q1-K1-H12
gcgcccacgcgtccgcccacgcgtccgcccacgcgtccggcgatgacgatgacggagaagatactggcgcgggcgtcggagcgcgcggcgctggagcccggggagaacgtgtgggtcgacgtcgacgtgctcatgacgcacgacgtctgcgggcccggcgccttcgacatcttcaagaaggagttcggggaggacgccagggtctgggaccgcgagaagctcgtcgtcatcccggaccactacatcttcaccagcgacgaccgcgccaaccgcaacgtcgacatcctcagggacttctgtgcggagcagaacatcaagtacttctatgacatcaaggacctcaccgatttcagggctaatccggactacaaaggcgtctgccacatcggacttgctcaggaaggccactgccgaccaggcgaggttctcttgggcactgattctcatacatg

SEQ ID NO: 59141 - DNA, 132 bp, Zea mays
  Clone ID: LIB3069-047-Q1-K1-H2
gcgctacactagaaagggaacatcggatgcttgaaaccatcacaactggctgcattaggaatgatgcatggacttggatactagggtctaactgacgactgagatcgtcagcctcaagggggacgccaggga

SEQ ID NO: 59142 - DNA, 241 bp, Zea mays
  Clone ID: LIB3069-047-Q1-K1-H3
cctccgctccctagcaaagttaaatcagagctgctgaccataacagcttccggcattatggcccatggatgtcctaggatacctgcgaataattcaccaacttgaatgaccaacagctacaagtgattaggccctaccctattaaatatacgaccttacgtactcactgatttgaaagaatcagatcttttatatggtcaacgctataccatcaactgtacgtagttgctcacccatgcct

SEQ ID NO: 59143 - DNA, 463 bp, Zea mays
  Clone ID: LIB3069-047-Q1-K1-H4
ggcttggaagacccacgcgtccggctacttttacacgtagatgctggaggaggatgtggaagttccagtctcatctgcaaatgaagctccaaacgatactatgaagatggacacagatgatgtgccaagtgatcctgctgctggatctgatgtgactatgcaggagcagcctcctgcagctggaaatggagcacaagataatgaggaaaagtctgtttcgatggaaactgatgcaaaggttgagccgtcaaaaaagaaagttaagaaaactactgttccggtccatgagttggtctatggggccttggctgcagctgacctgcagaaggctgtagagaaagagtatgagatggctcttcaagacagagtaatggaagaaacaaaggagaagaagaatgcttgtgaagcttatgtgtatgacatgcgtaacaagctatatgacaagtacagtgattttgtcaca

SEQ ID NO: 59144 - DNA, 443 bp, Zea mays
  Clone ID: LIB3069-047-Q1-K1-H5
cccctcgtccctttcctggaaacggatcttaggtcgccgtcgctgtcgagtactccacggcgccgagacgtttcgtcgtcgcctagacattccacgccaccaccgagtactccatcttccctctcaggtacgagttcccatctttcgagtactcgtcgccgccgctgttttgcccttttccacgccgtcgctgctgcagcagaaaggatgcaccgccagaaatggagtccccccagaactggatgaccaagctcttgattggccctcgccggaaatggagtccccccaggcgcaaccaaccttatccctctcaacgagatagttgtcgacatcaatggaacatttgtgccttcactgagtgctcccgcgccaaccaacacaggcttctccctcaccattgatgaggtagacaacacggtcacttggtgacaaaacgcagttta

SEQ ID NO: 59145 - DNA, 272 bp, Zea mays
  Clone ID: LIB3069-047-Q1-K1-H6
tgcatcgttcggtagacgttcacgttttcgacgctgtcgcttcctgatctggggccttactaatccgcggtgacttgcccaccggctcgctgtcctgctcctcgatttcacacctgattgctgacacagatctgggctagcctgcatcgctcgcaccgtcttgtgtgcaattctgcttgtcattggaaactatcccctgtctcaccgggtcaagggcaccggcagatacactactgatgtggccatgcctgacacctatacgtccatggctg

SEQ ID NO: 59146 - DNA, 347 bp, Zea mays
  Clone ID: LIB3069-047-Q1-K1-H7
cggacgcgtgggcgaagttcattctaaggttgctgacctcaccggagtcggagaactaaggctatgagtgacaaaatcttgcaggcaaaacgtggaccaacttaaatcagcagcagcgtcaggtggttaggcgctagcgaattaaattaaggccggccgaacctcactgtcttgaaagattcagatgttctaatgtgtaatgctttaccaccagtggttagtggttgctggttcatgcttcccacgttagagtcacgattttttttttttgaggctggagaaagatctgacgatacttcatgtgtgctttctttctgacgatggttccatacaagggcttaccaaag

SEQ ID NO: 59147 - DNA, 367 bp, Zea mays
  Clone ID: LIB3069-047-Q1-K1-H8
tcggggatgacttgcctcctgaagcacggcatttactcctcaaattggataagcaaactctgattgaacaagcacgcaagaatttctactgctcaaagtgcaatgggttgcttctggaaagttttgcatatattggtatatatgggaagtcattgcagcaagaagcttcatatatttgtcgactgatgacagctattgaatcaagagttacgcaaggagagcaagatggggctcatgacccatcaattcatccctggtgaggccttctatccacaaaagatggcttccttacacttcttgactgctttataaaagcataatcattatgtgtgcttcagaatgtatgagacaatgcacgggcaagaga

SEQ ID NO: 59148 - DNA, 324 bp, Zea mays
  Clone ID: LIB3069-047-Q1-K1-H9
gcgcctgtcctcgctcttggaccaaggccgtggctgcggcgtacggaggtttagcgctggcgggatccgtttcgtgacgctcgagggcgtctgcagtttggactcccgtctggagtcgctggtcacctgccgttgagccaacatgcacgtgacaaagagcggttcgcggcgcgttcgattggaggccgtatcgcgcgggagctttgcggctccgatggcattggactgggatatattcagcgtggcgccgttggaactcctgctggacgtgacgaacgaccgcggtgacacgatggactatcagtcgttctgcatcgaggagct

SEQ ID NO: 59149 - DNA, 470 bp, Zea mays
  Clone ID: LIB3069-048-Q1-K1-A1
gattcccggtcgagcacgcgtccgcggacgcttggccggacccttggccggactcttgggtccgattccaaacccaaatcaccgttccctccaaatcccattccctcggcccagaccagctcgcgaaatggacggcggcggcccgaaggcgaagaaggcggctgctgggcaaaagctaggcggcggcgggccgaaaaggaagccggtgtcgcggtcagttaaggccgggctccagttccccgtgggccgaatcggacggtacctgaagaaagggcggtccgcgcagcgcgtgggcacgggcgctcccgtgttcctggccgccgtcctcgagtacctcgccgttgaggtcctggagctggctggcaacgcggcgcgcgacaacaagaaaacccgtattatcccgcgccacctccttcttgccatccgcaacgacgaggagctcggcaagctgctgggtggggtcaccatcc

SEQ ID NO: 59150 - DNA, 263 bp, Zea mays
  unsure at all n locations
  Clone ID: LIB3069-048-Q1-K1-A11
cccacgcgtccggatcctgccaatatttttgttactccaactgtcnatacccccaaatcaccctatctcaaatgctatcttatacaagatactggggccctcctttcaactgctccaaacatcaacaaaaccttacatcttctcctactacaatcacatcattaactacacccacatccttaacaaatcctccgataacatcaaacatgactacgctactactaatcacaccattattattcctacaccatcttatataactc

SEQ ID NO: 59151 - DNA, 446 bp, Zea mays
  unsure at all n locations
  Clone ID: LIB3069-047-Q1-K1-G7
cccacgcgtccgctcgccgggctcgggcgttccggaagaaacaagcctggaaaatatatggtatataaacaactcgaccaaacccaagtccagacccgcagcgcccgccggaggcggagggaaccgagccggcgaccggcagaccgcagagaagaggcctggagccgaccgcagagaagaggccaggagccgaccgcaggcagccgccaccgcaccagaacccgaggtctcgaggcaatcgagcgcacgcgggtcgggggctgcggccatgtcggtgagttgcgggctcgagtgggtggtgtgccttggctgcacgcggtgggcgtggaagcggctcacctacatcggcgcctacgacagcgagacgtggccgccggcgtncgncgacgagttcgagcccgtcccgcgcctctgccgcgccgtgctcgcgaactacgacgaggagc

SEQ ID NO: 59152 - DNA, 432 bp, Zea mays
  unsure at all n locations
  Clone ID: LIB3069-025-Q1-K1-B8
gtctgccagatctaactccccccgactcactaatcccagagagcctccatggcgacgcacggtcactgcctcccactcctgctcgtgggcgncggcctcgccctcgccgncggccctgctcgcgcggcgctgggccggcggccccggcccgttgttggccggttggaaccggatccttgacgtgagcgactggcacatccaggagctaggcgggtgggcgctggggcaggcgaagcaccagaagctggccgccgacgggctgcggttccgccgcgtggtgcgcggcgagcagcaggtcgtgtccgggatgaactaccggctctacgtcgacgccgtcgaccccgccggccgcaccgtgccctacgtcgccgtcgtgtacgagcaggtctggacccgcacccgccagctcgccttcttcaacccggtgccccg

SEQ ID NO: 59153 - DNA, 435 bp, Zea mays
  Clone ID: LIB3069-025-Q1-K1-B9
catctgcaaggtacaattggcaaatgaagctgacgatcttgaggccgacggcgcgggccgcgagagcgtctgctccatctgcaaggtgcaattggcaaatgaaaaacagctgaccgatcactatggatcaaagcatccaaaggagaaacctccgagcacatcgagcaccgaataaccatggctggtcgtgacgcagaaatatagatcctgcttggctggtttgaggatctttaagtccgtctgatccatgccttggacctcaacgtcagttatatactctctagtgtgtgcatttcctcttgtttcaggtattgtgttgtcgtgctgccaatgtgtctccaaagtccaaactgtatgtggtcaccatggcattgggatgatgcgaaaaaattatgagcgtatctatgttccaatgtttgtgtggcttacaagatg

SEQ ID NO: 59154 - DNA, 428 bp, Zea mays
  unsure at all n locations
  Clone ID: LIB3069-025-Q1-K1-C1
ggttgctggtgcccgctggtgcggctgttcggccttagcgcggcggtgccgttcgggcgggacctcaccgtaccggaggcgctggcgaacacgcgcgaggacggcatgggcgcgctctaccgcgagggcacggcgtcgttgctcaactccatggtgaacaacaggttccccttcacgacgcatgaggtgaaggacgcattcggtgctgcgctcaactctggtgacgacggcgccgccgcggcacaggcgcgtctgttcaagaaagcaaatgaggggcacgtcatcaggcagaactagctaggcggcagtcgccgtgtgtatgtccgcaatgcaactatgtgcgcggcgagcatgcagggcttgcttaggatctgcacgtatgtgtttgatgatggggtgaagttatcatcacttatctcgatnaaaaa

SEQ ID NO: 59155 - DNA, 322 bp, Zea mays
  Clone ID: LIB3069-025-Q1-K1-C10
gtcagccgttcatccaaccgaaccgatatttgccttacatccacaccatgatccctattgtcaacgttactacgcatctcaagccggtcacatccagcttcagcccagaagaccactgtcttccaacatataccgaatacatacacctccatatacagtggtgataactacaactttaccatatacagcacatacacagtgataccaatgacacatctacattacataaacaaccaaatcatccatcttcttacattatacaattcaacttacctcataatagccaccaaaattagttactaaaactactgcaacatgctta

SEQ ID NO: 59156 - DNA, 429 bp, Zea mays
  Clone ID: LIB3069-025-Q1-K1-C11
cccacgcgtccgcccacgcgtccggcttcatgggcaacggcagcagctacgccaagaacagcaacaacaacgccggcatgctggcgttcgacaagatggggagctacggcaacaacggcggcggtaataccaacaacaacagcaacggcgtggaggtgaagagctacttcaacaagtccgccgggagggcggcgagcaacaacaacaacaacagcagccacgccggcggcggcaacaagaagggcggcgccggggagtacggcaggaagaagcacgccaagagcgagggcgcggcggcggcggcggccacggacaagcagcggttcaagacgctgccggcgtcggaggcgctgccgcggggccaggccatcggcgggtacatcttcgtctgcaacaacgacaccatggacgagaacctcaggagggagc

SEQ ID NO: 59157 - DNA, 175 bp, Zea mays
  Clone ID: LIB3069-025-Q1-K1-C12
aaatttaaacttcagtaccacatctatattaaataccatcaacaacacatacaactatgaaaaaaacagctacttatacaattgcatcaacaaacaaacaagcaccaactactacaacaacaatacatcatatgatgaaccaaataattcctcaacttccaataaccaatccaat

SEQ ID NO: 59158 - DNA, 448 bp, Zea mays
  Clone ID: LIB3069-025-Q1-K1-C3
ctcgtagagagaaggaaaaatatccccaattcctttctcccgatctcgatggcgaacccgcgcgtcttcttcgacatgaccgtcggcggcgccccggcgggccggatcgtgatggagctgtacgccaacgaggtgcccaagaccgcggagaacttccgcgcgctgtgcacgggctagaagggcgtgggcaagtccgggaagccgctccactacaagggctccaccttccaccgcgtcatccccgagttcatgtgccatggcggcgacttcacccgcggcaacggcaccggcggcgagtccatctacggcgagaagttccccgacgagaagttcgtgcgcaagcacaccggccccggtgtgctctccatggccaacgtcgggcccaacaccaacggcttccagttcttcatctgcaccgtcgcgaccccttggctcgacggcaagcacg

SEQ ID NO: 59159 - DNA, 383 bp, Zea mays
  Clone ID: LIB3069-025-Q1-K1-C4
cccacgcgtccggcatcagtgcgtcacattcaccgggaatggcaacgctcaaggtcccagccactgttcctcccgtcgccgatgactgcgaccagctgcgcaaagcattccaagggtggggcacgaacgaggcgctcatcatctccatcctcggccaccgcgacgccgcgcagcgccgcgccatccgccgcgcttacgccgaggcctacggcgaggagctcctccgctccatcacggacgagatctccggcgacttcgagagggccgtgatcctgtggacgctggacccagcggagcgcgacgcggtgctggccaacgaggcggcgcggaagtggaagcccgggaaccgtgtgctcgtcgagatcgcctgcacgcgcaccttc

SEQ ID NO: 59160 - DNA, 443 bp, Zea mays
  Clone ID: LIB3069-025-Q1-K1-C5
cccgtgaactgggaagaaaccttcaactctttcgaagaaaacctcaatccactgacggttgtgcacaactggctgggccccggagtctgcccaaaggttgtggccaagggtttcagatgcataatgagcaaccaaggcgtctggtacctggaccacctcgacgtcccctgggaggacgtctacagcggcgagccgctcgccgggatcagcgacagagagcagcagaagctggtgctcggcggggaggtctgcatgtggggcgagacggccgacacgtccgacgtcctgcagacaatctggccccgagccgtcgcagcggcagagcgtctgtggagccagctggaggccatatccgcccaggacgtcgagacgaccgtgctgtcacggctacaccgcttcaggtgcctgctgaaccaccgtggggtcgccgcggctcctgtcac

SEQ ID NO: 59161 - DNA, 349 bp, Zea mays
  Clone ID: LIB3069-025-Q1-K1-C6
cccacgcgtccgggaaaagaagaagaagattatcaaggaggtttctcatgagtggcaattggtaaacaagcagaagccaatctggatgaggaagcctgaggagattaccaaagaagagtatgctgctttctacaagagcttgaccaacgactgggaggagcatcttgccgtgaagcacttctctgttgaaggccagcttgagttcaaggctgtactctttgtgccaaagcgggcccccttcgacctctttgacaccaggaagaagcagaacaacatcaagctctatgtgcgacgtgtcttcatcatggacaactgtgaggagctgatcccagagtggctgagctttgtc

SEQ ID NO: 59162 - DNA, 73 bp, Zea mays
  Clone ID: LIB3069-025-Q1-K1-C7
cggaccgacccactcgtccgcccgcgcactcggaaaaaacctacaactattatcaagaaaacctcaaaccact

SEQ ID NO: 59163 - DNA, 430 bp, Zea mays
  Clone ID: LIB3069-025-Q1-K1-C8
cagcggttcacccagcgcgccgctctcgtgtgacaattgggcgtcccgcgtccgccgtcgccctgcccagcccttcgccggtcctttcccaggccttcgacgcgtccttcgccgtcgaagagtccccagcagcaccatgcccttttctcggcccgccgttggtttcttagttagactggttggggtccggccaagctgctgtcctccttcccgtgcatttgcagctgtcagagctcaaaagattaagcttcccaagaaaaaaaggcgattagatgaagtgtgcttagaaaggtttcaacaatacagtagaacatacatccagtcatggattcttcaaggcaaagtcatcgtggatggaagagttgtgaataaagctggaacacaagtatctgacaagtctgtcatcgaaatcaaggctgaaatcccaaaa

SEQ ID NO: 59164 - DNA, 460 bp, Zea mays
  Clone ID: LIB3069-025-Q1-K1-C9
cccacgcgtccgcccacgcgtccggataaatctacccaaatctacagtctgtaccttagggttagctctgccgtgcctgtcgaaaatggcaaattccttctatccgcaaaaaggaactgccgtgcaacatatacagaatatataatatcaataaattctggtgatacatctaggtgtacaagtaacaacacatacattgggaaattaaggtcaaatttccttggcacaaaatttgtaatatacgatactcatccgccatacaatggaactagtcaaacagtggcagggaaaacaagtcagagattctactccaagaagggatcaaccaaggtttcttgcaggtggtacagtattgcacaaatctcatacgagctgaatgtcttgggaactcgaggcccaaggcggatgaactgtgtaatgcactccatcccagcttcatgccttgaggcttgtggcaatg

SEQ ID NO: 59165 - DNA, 450 bp, Zea mays
  Clone ID: LIB3069-025-Q1-K1-D1
gcagagaatccccaagcaaacaaacagggttgagggagaggagaggagaggagaggagaggttgggtctgggacaccatggctccgatgaagctgtacggggcggtgatgtcgtggaacgtgacgaggtgcgcaacggcgctggaggaggctggctccgactacgagatcgtgcccatcaacttcgccaccgccgagcacaagagccccgagcacctcgtccgcaacccgtttggtcaggttccagctctgcaggatggtgacttgtacctcttcgaatcacgagcaatctgcaagtacgctgctcgcaaaaacaagccagagctgttgagggaaggaaacctcgaggaggcagcaatggtggatgtttggatcgaggtggaagctaaccagttcaccgctgcactgaatcccatcctcttccaggtcctcatcagtcctatgcttgggg

SEQ ID NO: 59166 - DNA, 476 bp, Zea mays
  Clone ID: LIB3069-025-Q1-K1-D10
ccggagccgccgcctgctcgctcgcctcctctccggcagcgagctctatctcccgcgacgagcagcagctgccaccgacgcacgcagaccggggaataaatattggtattggtagtgtgatatctataagaagtcaagatggtgaagttcacagctgaagagctccgtgccatcatggacaaaaagaacaacattcgtaacatgtctgtcattgctcatgtggaccatggcaagtctacgcttacagattcccttgtggcagctgctgggattattgcccaggaagttgctggtgatgttcgcatgactgatactcgtgcagatgaagcagagcgtggcattacaatcaaatctactggtatatctctttactatgagatgactgacgagtcactgaagaactacaagggtgagagagatggtaaccaatacttgatcaaccttattgactcgcctggacacgttgatttttcttc

SEQ ID NO: 59167 - DNA, 344 bp, Zea mays
  Clone ID: LIB3069-025-Q1-K1-B7
cccacgcgtccgcgacaaggaccgtaaggttctcctcgaccgcaaggcccgggggcgcgccgccgacaaggctaagggcaagtttactgccgatgacgtcgctgccgccgccgctggtggcgccgccaccggcgcctctctccaggagatcgactagactcttcacggtcatctgatggttgtcgtaccgccttttcctcatctctttagtttttgctaccaattgttatgtgatagaggtcttatgttatttgaaaactgctctgtgcctggatgagagttttggaacataatgtgaacctgtgtgtctgtgacctgagctttgaagatctcattatgtggtt

SEQ ID NO: 59168 - DNA, 414 bp, Zea mays
  Clone ID: LIB3069-025-Q1-K1-A10
cccacgcgttcgtccacgcgtccgcttgatattgtcaatgtatgaggatggcggtacatggatgggtttagtgctccgtttgcagctattatggctattggtatgtggactgtaccatcttcaccaagatggctacttctcagggcagttcaaggaaaggcttctttggaggataatagatagaatgcaattcaagcccttacaacattgatgggccgcacagcaagtgaaaaggctttggcagatgatgttgacgatacaattgtctctattaacgctgcctacgcaggacacgaagctgaaggaaacgtatatgatgtattcgaaggagctagcttgaaggccttcactattggctgaggtctggttatgcttcagcagataacaggtcaaccgagtgttctatattatgct

SEQ ID NO: 59169 - DNA, 427 bp, Zea mays
  Clone ID: LIB3069-025-Q1-K1-A11
ctccagagctcatatttggggcaaccgagtacacttcatcaattgatatttggtcagctggatgtggttcttgctgagctgcttcttggccagcctctctttcctggcgaaagtgctgtggatcaacttgttgagataataaaggttcttggtactccaacacgtgaggaaatccgttgtatgaatccaaactacactgagttcagatttcctcagatcaaagctcacccatggcacaagattttccacaagcggatgcctccagaagctatagatctcgcttcacgtttgctccagtattcaccaaatctaagatgcactgctcttgaagcgtgtgcacatccattctttgatgagttgcgagagccacatgcgcggttgccaaatggacggccatttccttcactgttcaactttaaacaggaac

SEQ ID NO: 59170 - DNA, 136 bp, Zea mays
  Clone ID: LIB3069-025-Q1-K1-A12
cccacgcgtccgagcatatcgagaagaatttagattaaacaaaaatgcctgaaaatatgcgtaaggtaatgatgctcgtttttatggaacacatatgatgtcctttgtttaagtcgtttccagtaaatatattatg

SEQ ID NO: 59171 - DNA, 450 bp, Zea mays
  unsure at all n locations
  Clone ID: LIB3069-025-Q1-K1-A3
aattcccggcggaagattggaagctcgactctccgatcccctctcgttcctccctgtctccctcgtcgcctcatcaattggggatccaatctttgctgctgccactcggcgatccgatcgttctcgatcaaggtcggtggccatggctcgctgccgccatcacctnctcctccttcccgtcttacttgccttggctgctgctgctgcgcggcaggcgcagagtcatggggaagcctccgccgtcttcatcgatgcctcgtcgcaccgctaccttctggaccagcaagccgaccaccaggacgcttcaatgtcgttaaatgaagtttctgcggttgtttctgtcttgcttggttttgcaccgtcaacatccctaccagctatttcttcttcgaagttgaacaaagttctttttcctaatccatttgatagaccgcgtgctgtttttctcgt

SEQ ID NO: 59172 - DNA, 417 bp, Zea mays
  Clone ID: LIB3069-025-Q1-K1-A5
cgggcgaagattggaagctcgacactctgtgtgacctgtatgagaccctgtcaatcacccagagtgtcatctttgtgaacacacgccgcaaggtggactggctcacggacaagatgaggagccgggaccacaccgtgtcagctacacacggtgatatggaccagaacaccagggacatcatcatgagggagttcaggtccgggtcctctcgtgtgctcatcaccaccgacctgctcgcccgtggtatcgacgtccagcaggtctcacttgtcatcaactacgacctgccgacccagccagagaactacctgcaccgcatcggccgtagtggtcggtttggaaggaaaggtgttgccatcaacttcgtcacccgcgacgacgagcggatgctgtttgacatccagaggttctacaacg

SEQ ID NO: 59173 - DNA, 436 bp, Zea mays
  Clone ID: LIB3069-025-Q1-K1-A6
aaacaaatctagggttccaagcgagcgaataccttcgcctgccgatctccccgcgtcttctcgggctaagacgattcgaggcacgagcgaagatgccgcagcggcattcgaaaaacaacaacgacctcgccttcttcacgtacgaggagaagcgtaagctcgggtacggcacgcagcgggagcgcctgggaaaggactccatcaagcccttcgacgcctgctgcctctgcctcaagccgctcatcggcccgctctgctgccccaagggccacacattctgtaaggagtgcatcctcgagtgcctcctctcccagaagaaggacatcaagcgcaagctagcagcacatgaggcccagaaaaagcaagagaaagaagaggaggaagagaagctaattctgcagaaggctaaggagttggatgcctttgatcagcagaa

SEQ ID NO: 59174 - DNA, 448 bp, Zea mays
  unsure at all n locations
  Clone ID: LIB3069-025-Q1-K1-A7
acgcgtgcggtggtccgcgagggcgtcaagtacggcgcttgcatcggccccggtgtctacgacgtccactcccccaggatcccgtcggctgaggagatcgccgaccgcatcgacaagatgctggcggtgctggacaccaacatcctctgggtgaaccccgactgcggcctcaagacccgcaagtacacggaggtcaagcccgccctgaccaacatggtctccgccgctaagctcatccgcacccagctcgccagcgccaagtgagcaccttttttttgcctttttcgtttccgaggagggcgtcgtcgatgccaatttgtttccaataaacagggctgtgcccgccgttctgttgtactccgtctgtggttaggttagtagttttcttgatctcgcccccacgcggtacctgttttactactctctgnttggtggtttctggagcaag

SEQ ID NO: 59175 - DNA, 361 bp, Zea mays
  Clone ID: LIB3069-025-Q1-K1-A8
ctagatcgcgagggccgcccttttttttttttttttttaatcaggactccctgcaagaagaatgagttcagtcatttttgtcattctctgtctctctccactgagattcaacacgttatcagacactttgctctccaacgaaggccatcatcgtgaagtgcactgcacacaccagtatgctacacggccggcggtgtggtaactgctatcatcatccatgacaagatgaacaagcaagatcacgattagcgtttgcagaccgcgacgagaggcagcacgccagcgtcgccaggccggactcgctcctgcgcgacactcagtgagtaacctattacgaacctaaagcaatatcgtctctcct

SEQ ID NO: 59176 - DNA, 446 bp, Zea mays
  Clone ID: LIB3069-025-Q1-K1-A9
atttgccagagcagacttcgatcttcttaatctacctgacagtttcttaccatcatttgagtttattgatggacatgttaagcctgttctagggagaaagattaactggatgaagacagggatcgttgagagtgatctggttctaacagttagtccacattatgttaaggaactcacttatggcccagataaaggtgttgagttggatggtgtccttcgcacaaagcctcttgaaattggaattgtaaatggcatggatgtttatgaatgggatccttcaacagataagtacaccagcgtgaaatatgatgcaacaacggtaactgaagcaaaggctctcaataaagagaggttgcaagctgaagttggattgcctgtggactcgagcatccctgttatagtttttgtcgggcgtcttgaagaacagaaagggtctgacatactca

SEQ ID NO: 59177 - DNA, 271 bp, Zea mays
  Clone ID: LIB3069-025-Q1-K1-B10
atctgcaacgggcaaaatataaaccactaacacatcaccgattaccattcatcacacatttcacaacacaaacctcccaacacatccaacacctaataatcatgtctcgtcatgacccacacctatcaatacttcctacacattttccgaatcttcaaatccttttgaatcatccttataacctaaacctccattacctactacacagtatctccatatactcctgacccacatattccgacttcctcctaccaatttttctccaaaaccc

SEQ ID NO: 59178 - DNA, 470 bp, Zea mays
  unsure at all n locations
  Clone ID: LIB3069-025-Q1-K1-B11
ctcgttctttcccgggggaggggaggactgtgagatgcctggccagccatggacccgcccgacccgaaccccaacgatgccccgtcgctcccagccgaatccgcggccagactcgccgccctctccctttgtggcaccagggaccttcccccggacttccacaccgccgagatcctcgacgacgacgagggctacctcacctccgcgtccagaggcgggagcagcacctccgcgtggaaggaggcgcccgagggactccacgacgatgacaaggatggggacgatgtctcccagcccagccccagaagcagcggatacgctggcgagcgcggaagcagccttgatgacgacgccgaccccgaccccgaccccgaccaggattgggcgcgcggcaagaagcatccncacgaggacgatgcttcctcttcgtggaggaagaggaaaaaacatttcttcattctgagcaattc

SEQ ID NO: 59179 - DNA, 165 bp, Zea mays
  Clone ID: LIB3069-025-Q1-K1-B12
gctgagtattagcgcatactgctagactgccactgtcgtctgtgctatgcatgcttttgagctcgagtgatgtttgaggaaccagtgatcgtgttgatggtgctgaacattggaacctgcagtacagtgtagcatgatgcttgcttgctgggccacggcccgttc

SEQ ID NO: 59180 - DNA, 438 bp, Zea mays
  Clone ID: LIB3069-025-Q1-K1-B2
gcaagatgttcggcttcgggcaccacggccaccacggccagaacccgccggcgcacggcggcgtgcaccagcccaccttcaagatcttctgcaaggccgacgaggggtactgcctcaccgtccgcgacggcaacgtggtgctggcccccgccaacccgcgcgacgagcaccagcactggtacaaggacatgcgcttcagcacccaggtcaaggacgaggagggcaaccctgcgttcgccctggtcaacaaggccactgggctcgccatcaagcactccctcggccagtcccacccggtgaagctggtgccgttcaacccggagtaccaggacgagtcggtgctgtggacggagagcggcgacgtgggcaagggctttcgctgcatccgcatggtgaacaacattcggcttaacttcgacgccttccacggcgacaagg

SEQ ID NO: 59181 - DNA, 424 bp, Zea mays
  Clone ID: LIB3069-025-Q1-K1-B4
cgcgtacgtttagtattttttttttttttttttttttttttttttttttttttttttttttttttttgagcaattaacaactgaaaacgttattttatatgcaaagtagtagtaagacagttttgcatcacttatgagtacaaagacataagacatcgttatctatttttcagcaaataaaacactggcaaacaacgaaaatttttatcatatcggactaataaacactactaagctgtaataacctgcgagtgtaataagaaccaaacaaagaaaaaaagaagatccagccctaattagcactaactacttagctagcggtagccattaggcgattatcaagcgcattcatttcatgccatatcggggtcatggatcacggtctccgggcttgggccctgacaaacaccgggagagggcccca

SEQ ID NO: 59182 - DNA, 464 bp, Zea mays
  Clone ID: LIB3069-025-Q1-K1-B5
ccgcccttttttggtttgtttttttttttttttttttaacatgtttgttctagtagctttttgagactgagcgcatattactcggcgaacttcaagcttaccaccaaaaccagtaagcctcctcgaactaacataagagattacacatccatacttcccaaggctacccgccactaagagatccagatttcaaaacattacatttgaacgagactttggatgaatcacattagcttgcaaaatacgataaccagtaaatggagaacattacatttgaaccagactttggatgaatcacatcccacatggctttcaaaataactctgtttcgaccagatcagttgctccaacaaatatggtgatagccgaacaatcaagtgccaatatcatcttcgaagcatcggaccaggcttgaagtaccctacaaagttggggatgtgactgctccattgtttcatgtgaac

SEQ ID NO: 59183 - DNA, 496 bp, Zea mays
  Clone ID: LIB3069-024-Q1-K1-H9
ggacctttgggctgatttatgtgcttgtttatgtgcttgggatcatttggcgcaagcgagtggggcgtagactgcgtttgacttggctgaatttggtaagtttgttatccctaagactcttgtcctcatcgacaaaattactgagaaggggaagtcggccactgatgctaagcaccctcctcctcatgcgtatctggagatttgtgatactcgtggagagatccttcgtttagtgattggtgatcctgcgtcgctttattagtagatgtcgttaggtcctatcttgttgggtcttcatatgactcatacgaagaccgctggggatgataatgaggagtcgagtcgtactctgcctgggcctagtactggtcctgctgtgcttagtcgaatgtgcttgagttcgggtatgagaggtagttagtttacggacgcaaaccatgcggagtatatctcgcacttcacgatccctaagcactcaggcttacgcaagtccccc

SEQ ID NO: 59184 - DNA, 356 bp, Zea mays
  Clone ID: LIB3069-024-Q1-K1-G6
cccacgcgtccgcccacgcgtactgtcattccgccctgatcacatcaacatacaggttcgggaccaatctgatgaagtgctggctcgtggtttcaatgatcagatttatgacatcttccagcttctgccatctaatattcacgatgcagtctcctctgctaccatgccacctgaggccattgagattacccgcaagtacatgaacaaaccagtcagactatcttgtgaagagagattagctcacccttgagggcatcaatcatatctatgagaatgtgcacaatgaatacttgaagctggacacactgtgtgacctgtatgagaccctgaccattatccatagtgtatatttgtca

SEQ ID NO: 59185 - DNA, 215 bp, Zea mays
  Clone ID: LIB3069-024-Q1-K1-G7
cggacgcgtgcgcggacgcgtgggaaaaataaaaaaaaaaaaaaaaaaaaaaaaaaaaaaaagaaaaaaaaaaaaaaaaaaaaaaaaaaaaaaaaaaaagaaaaaaaaaaaaaaaaaaaaaaaaaaaataacaacaaaaaaaaaaaaactaagaaaaatataaatacaaagacacataaagcccctcagaataccacacaatttattaacaaacc

SEQ ID NO: 59186 - DNA, 442 bp, Zea mays
  unsure at all n locations
  Clone ID: LIB3069-024-Q1-K1-G8
acgcgtacagagggcgcgggcgccctcccaaggtcgccatgacctccgccaaggcctcccccgccgaggcggccaagaaggcggctgctcctgccaagaagggaaaggcagcggcggctcctaagaaggtggcaaccccgaagaaggctgctgctgctgccgccccggccaggaagggcgtggccaggaaggccaagaagtagtctgcctgccttgtcgctggcgagatccccccctcaattccgcctatagattcccctctttcatggattttgatccaatcgtaatattgtcagtagctctagattcgtcggtagctccagcatgagtgtcggtggtagttctgtgcctgtaaaaacttgggatagttgatcgcgtgtgatcagccgtcatgctcctncagtctctatgaacaagctaagctataatagtattttgctat

SEQ ID NO: 59187 - DNA, 470 bp, Zea mays
  Clone ID: LIB3069-024-Q1-K1-G9
ggacctttgggctgatttatgtgcttgtttatgtgcttgtttatgtgcttgtcagtcaaagtaataaggtagtagtataagtaagaatggatattcttctttcctgttcgcgactacgctgctccgtcgtggtggtaagcgtgggcgtggtcttagtcgtcttcgtggtagtggacgtaatggtcgtggcacgcatttcgatgcggagattgttgttattagtagtgctaagattatggcttctgttgtgttgattattaaggttagtgttggtggtcctgaggtggttattgagggtggtggtcgtgatcgtaatattcgtaagcgtggtattagtcgtggtcgtcttcgtcgtagtcgtaatcgagttggtttggtctggtgacggtgtatgagagctgagaggatgatgatgaggaggtgcacaacaaacacaacagtggtgcttagcaaacaagacttcgctaatc

SEQ ID NO: 59188 - DNA, 274 bp, Zea mays
  Clone ID: LIB3069-024-Q1-K1-H1
cagacgcgtagcttctagcgccatcacccgaggaataagaccacaccatgctgcgttacgcgggcaggatgctttcggcttccgtcttctgacggcgcactcaggcagccgctaagggacctcttgacggagatcgcgccccttatcgggacgacgattgtgctttacaccgtaaaccaacactgcttttcatactctacatccagtatgcaactgccaggaggtcctctttaactgagacacttgtcccaggaaaccaagaagctgggctatc

SEQ ID NO: 59189 - DNA, 435 bp, Zea mays
  unsure at all n locations
  Clone ID: LIB3069-024-Q1-K1-H10
tttgggctgatttatgtgcttgtttatgtgcttggttgcataataccagcgcactcctcgtagtacatacctgcataggggtggtgttatccgaaaaactactcgttctctacttatcggaatagacgatggtcacactacgtagaataaacctgaaggtggccgagtacgttagaaacacgcgtctgtccggactggaaggttaactaaccacgtcgagaagagtcggtaaaccccacccgttaaacagcgacacgtacacatcgagcaacacactccgcttcgcactcntacgcaggaagatctccacaagactaagactcttataggactcgaacggtagaacgctattcctcataactcgtagttctaggatcatccgaggcgtcctaatcttcgcgatcggaggcagcggagtcgccttcgcaaattacg

SEQ ID NO: 59190 - DNA, 483 bp, Zea mays
  unsure at all n locations
  Clone ID: LIB3069-024-Q1-K1-H11
gaactttgggctggtttatgtgcttgtttatgtgcttgtttatgtgcttgtttatgtgcttgggcgttccgattaatccaggaacccggcgcctcgctctcgtcgatacgctaaattccttagtacgcctgcccggggcgtgtacaaagatacgaatcgcgaggaacgacataagcatagcatggaaacctgatagcactcgtccgcggcctaagttgggccgaataccgaagacagtagagcccgggtacgtaccagacgcactgcggcatcggagaaacacctggcgcagtcgccggccctcgcccttgccctccttagtagccattcgcgcctatcattctaaccgcgcttttctacgagctacgattgcaccctagagcccacgccggttaccttcgtatctcaggcagttgtaatcggtattacncgcgagagccaaatcacggccgccggccgtaccactctcgcggttcgcgacac

SEQ ID NO: 59191 - DNA, 486 bp, Zea mays
  Clone ID: LIB3069-024-Q1-K1-H12
gaactttgggctgatttatgtgcttgtttatgtgcttgtttatgtgcttgcttatctgcttgtttatgtgcttgattatgtgcatgggtgatttactgatcacggaaggaaggtgtgagttggaggtggatggtggaaaggttgggggttcattgatgctggagttggtgtattcgtagggttagttgttgtatgagcatgggcatggtatgccttagggtttctgatacttctttgctgggcctttgtagatcgttttgctcattgggtctggtggtggtggtggtggtggtggtcactataattagaagtagctgcatgtgttcgtggagatgcatcatgtttaggggcattaggttgcattaggtcacggcttcgccgtcgaaggaagattcgcgagaacgacgtgctctttacgccgcggttctggtccaagtcggcgctcgcctacaatcgggccccctccggtcgttaccttacggccta

SEQ ID NO: 59192 - DNA, 448 bp, Zea mays
  Clone ID: LIB3069-024-Q1-K1-H2
ttccaggtttcgtccgcttacagagggagggagagagagagagagttagattggagccacacgatgctgagatggaggtacgggagcatatcattatggctctgacgacggagcaccgcgacggacactatcgtacctcttgactgaaatcgcaacccttatcgagacaaagactgtgctcgacaccgtaaagccatgccgttattcatacactatatctagtttgcatctggcatgaggtcctctttaattgaaacacttgatccatgtatccataaatctgggctatcttagctagtatctaatgaaaatgatatgaagaatcctgacatattcacagcccatgattagtacaatcatctatcaaatcttacttctgataccgtcttgcatgcattggctaaagatgatcttaaagacgaaaggatcatacattcattaattactg

SEQ ID NO: 59193 - DNA, 431 bp, Zea mays
  Clone ID: LIB3069-024-Q1-K1-H3
gccctactgccaccgcgccgaacgccatggtcgagccggcagagcaccgtccagcggaggaggaggaggccgcggcggccggcgaggatgaggacaccggcgcccaggtcgcgcccatcgtgaagctggaggaggtcgccgttaccaccggagaggaggacgaggacgcgctcctggacatgaaggcgaagctctaccggttcgacaaggaggggaaccagtggaaagagcgcggcacatgcactgtgaagctgctcaagcacaaagacaccgtcaaggtccgtctcgtcatgcgtcaggcgaagacgcttaagatctgcgccaaccatctcgtggtggcgacgactaagatgcaagagcacgcggggagcgacaagtcgtgcgtgtggcacgcgcttgacttcggcgacggcgagcttcaagaggagatg

SEQ ID NO: 59194 - DNA, 220 bp, Zea mays
  Clone ID: LIB3069-024-Q1-K1-H4
ccaagcggacgctgtcggtgtgcgccgtctgctcgtcctaggaacgaccgacgagcggtgctgcgcaggcagaagccatttgcacgcgtccccctttcagctttgttgcgcccagtccgagggttttgtctttgtttctgtcgtccgaatggagcgagtggtgatggtgaagtgtgtcagaaatagatcggagaaaaatgaaatagaaagcagcaacagc

SEQ ID NO: 59195 - DNA, 486 bp, Zea mays
  unsure at all n locations
  Clone ID: LIB3069-024-Q1-K1-H5
cggacgcgtgggcagatcccaatgcaggagctatagttccagcgaataagtctaagaggtcggcagagcaggggcaacgcacaatcaggcgcccgttctctgttgctgaagtagaagcacttgtgctcgcagtcgaaaagcttggaaccggaaggtggcgagatgttaaacttcgcgcgtttgacaatgcgaagcaccgtacctatgttgatcttaaggacaaatggaagacgctggtgcacaccgcgagcatctcgccgcagcagcggcgtggcgagccggtgcctcaggagctgctcgaccgggtcctggcggtccatgcctactggtcccagcagcaagccaagctccagcctaagacgcccccgctgctggctgaagctcgcttgctcacctaataaattcgatgatcctggctgatggcctnctncgaggccgatgcagcccttgtataaagtcagtaagtcaatcagtccctttacagga

SEQ ID NO: 59196 - DNA, 426 bp, Zea mays
  Clone ID: LIB3069-024-Q1-K1-H6
tagccacgcgtccgcgcaagctcgccatgaaatggctccccgacatgaaccccaacaacatgaaggagggcgaggacaagttcaagcagatctcggaggcgtacgaggtgctgagcgacccgcagaagcgcgcggtgtacgaccagtacggcgaggagggtctcaaggggcacgtgccgccgacgggcgccggcggggcggtccccggcagcgcaaccttcttgtccaccggcggcgacgggccgacggtgttccggttcaaccgcgtgcaacgcggaggacatcttcgccgagttcttcggtggctacagcctcttcggcggtatgggcggcgatggcatgggcggcaaccgcatgggcggtgggatgcctggcatgcggagctgctggacgaggttctgctggtccatcttaggtgacgatata

SEQ ID NO: 59197 - DNA, 453 bp, Zea mays
  Clone ID: LIB3069-024-Q1-K1-H7
ccaaaccggcaaaccctaatgacctaatccccatcccctagccggtagccgccgagcaaacgggctcatccgatcggtcatccactcatcctcatcccctgcccattcgatccgatcggtcatctcatcctcatcccctacccgatcagatcccctgctcatccgccgagcaccaccaggcagcaggctccagtcgtcgagcaccagcaggagcacggcgcgctgcccagtaggagcacggccaggaggacgacgcctgcatcctgcctcttctcctctgctactggagcctctactgctaggagcacggttaggaggacgacgcctgcatccagcaggagcaccagcaggaggaggacgcccatgctgctgccgttgagcgatgatctgatgcgcccccatcatggctcttctgcttcctcgcgggctcgccttgatctactgctgctggtg

SEQ ID NO: 59198 - DNA, 472 bp, Zea mays
  Clone ID: LIB3069-024-Q1-K1-G5
cccacgcgtccggctgcgtagacagtcccttcgccctgataacatcaagatgtttgttcttgacgaagctgatgaaatgctttctcgtggtttcaaggatcagatttatgacatcttccagcttctgccatccaagattcacgttggagtcttctctgctaccatgccacctgaggcccttgagattacccgcaagttcatgaacaaaccagtgagaattcttgtgaagagagatgagctgacccttgagggtatcaagcagttctatgtgaatgtggacaaggaagactggaagctggacacactgtgtgacctgtatgagaccctggccattacccagagtgtcatctttgtcaacacccgccgcaaggtggactggctcactgacaagatgaggagcagggaccacaccgtttctgccactcatggtgacatggaccagaacactagagacatcatcatgagggagttc

SEQ ID NO: 59199 - DNA, 442 bp, Zea mays
  Clone ID: LIB3069-047-Q1-K1-F3
gctgtggaagatgcctttgaactgcttcatgagatcaactaacgtgtccggactgggctatgggttggcgattgtttcatctacaataattcttcatggcgtcttaattactgtgtaggacgagaggtcacaactttgtttcacttggatcggccaatgtatttattaggatatcttgcaaaccaaagccgtgtctatcttattgataagcaatttaatgttgtggggtatactttactccttagtttgatcgaatctaaaacacttgtcatgcgtgcggatttctatcgcgcgaatgatgttatatcatctataccaaaggaacaatatgacagtgtggcgcgtttcttggaatcacagtgaatgttggacgaagccctcgagatagcaactgacactcattacaagattgacctggctgtgcaacttggtcgacttgaaa

SEQ ID NO: 59200 - DNA, 457 bp, Zea mays
  Clone ID: LIB3069-047-Q1-K1-F4
aggactcctgggcagctcaaggctgtgctggcctcattaacccttgctccccaggacgtgatgaatgctctcctggaggctctctttggtggtgtgggtaagggattcaccaaagaggttgtgaagaacaagaagtaccttgcagttgctgtgccagatgatggtgcccagacccttctggttcacgccattgatgcttttggtgggaagtgcaaccctgatgcgctgaaagaggttcccgttgtcctcaaagccctctacgatggagatatcctggacgaggaaaccattgtggactggtacaatgatgctgtcgcagctgggaaggactcccaggttgtcaagaatgccaagccgttcgtcgagtggctccagagtgccgagtctgatgaagatggtgacgacgagtgaagaagccacgctgctctactgctaatggccaaactcgataatatta

SEQ ID NO: 59201 - DNA, 432 bp, Zea mays
  unsure at all n locations
  Clone ID: LIB3069-047-Q1-K1-F5
ctctcctcctcgcgaagtatcggcggcggctagcgcggcaggctagagcctcgttgctgaggaggggagatggcgggtatgggcgatatgccgatgaggcctgcgcggccgggcccgccgatgcagcaccgtggtccgcccccgatggcgcgcctccgccccgaaccaatcgaccgcgagaagacctgtcctctgctgctcagggttttcacaagggttgctggtcaccaccaaaatgaagagtttgcagtgagagggaaggaaccaaaggatgaagttcagatttacacatggaaggatgcgaccctacgcgagctcactgatcttgtgaaagaggttgctcttgcagcaagaaaaaagaatgcaaggctntcttttgcatttgtatacccagacaagaatggtcgatttggtgtcagacaggtgggttcg

SEQ ID NO: 59202 - DNA, 385 bp, Zea mays
  unsure at all n locations
  Clone ID: LIB3069-047-Q1-K1-F6
cgtggttctggtggttcacgtgaatacaactgaagaggacctccaccaggaacaggccgttgttttaactgtggagttgatggtcactgggcaagagactgtcaggctggtgactggaagaacaaatgctaccgttgtggcgaaaggggccatatagaaagaaattgccagaacagtccaaggaacctcaggcgtgagagaagctattcacggtctccatccccacgccgaggacggggccgcagccggagctacagcagaagccggagctatagccgatccagatccacgactggatctactaggggtggacgccgagaccgtgatgagaggagatcaatgagtcttagctacagcaggagcgcaagccctangcgttctgtgt

SEQ ID NO: 59203 - DNA, 446 bp, Zea mays
  Clone ID: LIB3069-047-Q1-K1-F7
atgctgtcgacggatatgcatagaagagatcagatatgcatagaagggagtaaaactaagatttgggtaaaaatcccctctcccgtattgtatttcaatttatacgtatatatttacggtgattgttttagcatattctagtatctgttttttcttatacttaaagaattgaattgtgtgatgatagatattttcatctggacacagagtaaagaattctcgactctcttgacttgacgaggctatataactagagaccattagaggagaactgaagactgagagcattctctgcttataatctttattcctctatattctaaattgcttttttcaatccccttgcacctggattcaattcgaatcccacaccatgtggtgttcttcctctatcgaataaacgttgtttcgcttgtctaatcatcagttcgatagggcattgaaag

SEQ ID NO: 59204 - DNA, 103 bp, Zea mays
  Clone ID: LIB3069-047-Q1-K1-F8
caagactgtaatgtctattgctacctaatgtttctcactttgtcattttggacacatgttcgacctattcaattttaatgagatgcctgatgaggctacttgc

SEQ ID NO: 59205 - DNA, 421 bp, Zea mays
  Clone ID: LIB3069-047-Q1-K1-F9
gcgcggacgcgtgggtgctccattctcagccgccgccaatcccttcccgtgctccgcaaccgctgagtgagaggaagagatggccggcaagggcgatggcccggctatcggcatcgatctcggcacgacgtactcttgcgtcggcgcgtggcagcacgaccgcgtcgagatcattgccaacgaccagggtaaccgcaccacgccctcgtacgtcgccttcaccgactccgagcgcctcatcggagatgccgccaagaaccaggtcgccatgaaccccatcaacaccgtctttgatgccaagcgtctcatctgcaggaggttcagagatgcgtatgtccagagtgatatcaagctgtggcccttcaaggacatctctgggcctggtgagaagccaatgattgttgtccagcacaagggtgag

SEQ ID NO: 59206 - DNA, 329 bp, Zea mays
  Clone ID: LIB3069-047-Q1-K1-G1
atgctgtcgacggatatgcatctatagagatcagatatgcatagaagggagtaaaactaggatctgggtaaaaatcccctctgccgtattgtatttcaatttatacgtatatatttacggagattgctttagcatattctagtatctgttttttcttatacttaaagaattgaattgtgtgatgattgatatcttcatctggacacagactaaagaattctcgactctgctgacttgaccaggctatataactagagaccattagaggagaactgacgactgagagcattctctgctcataatctggattcctatatattctaaattgc

SEQ ID NO: 59207 - DNA, 428 bp, Zea mays
  unsure at all n locations
  Clone ID: LIB3069-047-Q1-K1-G10
gcgcgctctcaagcttcaaaatcccactagcgaatggaaaacgggagaagctaggaagcagcagccgcggcgtttcttccttgagcgttcgccttcggctgctcaacgcgtgcttggtttcaggagagccttggtggcatctctgtttcatggccgagatctgctgtgaggcggcggcggcggcgtcggaccagaagggggagtgcgccggcagccgcgcggcgcggcggcggaggatggagattcggcggctcacggtggtggccgaagaggcgtccgccaagaggcggatgctggaggcggatgangaagacgcggttggggggcgagcgccgaggtacggcgtgacgtcggtctgcgggcggctgagagacatggaggacgcggtgaccgtccgttcggagttcatcaacggccaccacttcttc

SEQ ID NO: 59208 - DNA, 422 bp, Zea mays
  Clone ID: LIB3069-047-Q1-K1-G11
gcgcccacgcgtccgcggctggagatgacatttagggcgggctctatgtggttcctaagatggtgtcgcagggggtgcctctggcgaatctccacttacgatccacgagacctggggtggatgagatcccgttaccactgcttgttaagttctcgatgagctgtaggatctttcgagacaacgcgctttaccagacaggactgttccttttccaattggctcaaattgcgttcaacaatcgaaactcagtctccaacggtgccagaatggaacgtgctctcaagttaatttggagtacactcacttgatgtacttcatgcaccaccgataattcccaagtcactcaacagagcctacatgacctttctatgctttcgctctaatgaccactcactttgggttgttttgctgtgaaagaaaca

SEQ ID NO: 59209 - DNA, 96 bp, Zea mays
  Clone ID: LIB3069-047-Q1-K1-G12
gcgagggacttgcgctagctgtacaggtacgttttagcagacttcagaaacaagccgctgtcggcaaacggggagctcacttcagacgatccaaat

SEQ ID NO: 59210 - DNA, 458 bp, Zea mays
  Clone ID: LIB3069-047-Q1-K1-G2
ggccggagcagccgcagtcccggcgatccctccgactgtcgccctcatacttactcgtgactgccttgggttctctttccaacaatcgagatgagccgtggcggtagcgccggtggtggtcaaagttctctgggttacctctttggaagcggtgagccccccaaaccagcagtggcaccagctgtaagtgctccacctgctgctgcaggtgctccacctgctgagaaaccacctgctgcaaagcctgatggcaccagtcagattgctgctggggttaccagccaaaccaataactaccacagggccgacggtcagaacaccggaaacttccttacggaccgtccttcgaccaaggtccacgctgctcctggcggtggctcttccctgggatacctgcttggtggcaactgatgccgctcaccaagctatcaccccacactgtcgccgcatgctttttc

SEQ ID NO: 59211 - DNA, 446 bp, Zea mays
  Clone ID: LIB3069-047-Q1-K1-G3
tccacgcgtacgctcgccgggctcgggcgttccggaagaaacaagcctggaaaatatatgtgatataaacaactggaccaaacccaagtccagacccgcagcgcccgccggaggcggagggaaccgagccggcgaccggcagaccgcagagaagaggcctggagccgaccgcagagaagaggccaggagccgaccgcaggcagccgtcaccgtaccagaacccgaggtctcgaggcaatcgagcgcacgcgggtcgggggctgcggccatgtcggtgagttgcgggctcgagtgggtggagtgccttggctgcacgcggtgggcgtggaagcggctcacctacatcggcgcctacgacagcgagacgtggccgtcggcgtgcgacgactagttcgagcccgttccgtgcctctgacgcgccgtgctcgcgaactacgacgaggagc

SEQ ID NO: 59212 - DNA, 424 bp, Zea mays
  Clone ID: LIB3069-047-Q1-K1-G4
cggaattcctcgggggtcattccacttccaccaatctgtctcccaatctgtcttgctgctccaattcgctctctttactcggccagcggaaggtgagaggagggcgagatgacggcggagaaggcggacgcggggctttccgacttcgacgcccacttggatcgcctcttcgcttgcacggacgccggctccgacggcaaggtgaagctgctgctcttcctggccgaccgcaagcctggctcctccctctcctggtgccccgactgcaacgtggcagagccggtgatctacgagcggctggaggcactggagggcaaggacgcggtgctcctgcgcgcctacgtcggggacaagcccacttggcgcgacccggcgcactcatggagggtggaccacaggttcgggctcaaaggcgtgccaacgc

SEQ ID NO: 59213 - DNA, 353 bp, Zea mays
  Clone ID: LIB3069-047-Q1-K1-G6
gcgtactgatatgtcaatatccaagagctctccttcctacttggccaagctgcaatgggaggaagaaaccagtactcagcatcaacggctctctgagcaaggatatcgttgagaatctgtagtaaacctggaaatacaaattatgctctggaataacatcaggtttctccaagacaacaactggtcttacgacaatgtcaaggtgtgaatacttaacctcttgctgctgctgcgttgcaaagggagctgaaacttcgatatcctttgacccttcaggcagaacaacctttacgataagcttttcaatgagaatctcctccaatggacaaccaaatgtgatattgagaaatctc

SEQ ID NO: 59214 - DNA, 362 bp, Zea mays
  Clone ID: LIB3069-047-Q1-K1-F2
acgactcgtcctggcactcgtcgtaaatttttaagctttatgtattgccatgtttttgagatgcaacgaagcataatgaggagtttatatgatctgaagtatctatgtttgttgatatatccatgtgaagagatcaaagttgtgtgattgctgagtccatctattgagcaaatgctgcattgtatctattcaaatcatacttctgaatattgattgttctgcatgtattgctatagcatgacaggatatgttagataggattgaacaaattgcattggtatttaatatgtcaccagaagcgaattgaggaggctgtgttatctgaactgtcacttgatgatacatcgttcatggacttcaaa

SEQ ID NO: 59215 - DNA, 421 bp, Zea mays
  Clone ID: LIB3069-047-Q1-K1-D7
cggacgcgtgggtctccctccgccactccttccatctgctcgctcccactccccgggtagctactaagcgtggcgtccgttaccgcccgcgccccggtcgcggcccttcgcccgtctgccgcatcgctcaagtcgtcatctgccttccttggccactctagccgcctcggtcgcaccgagtcacccacgaggcgcaacctcaaggcagaggccaagggcgagtggctccccggccttccctgcccctcctacctcgacggcatcctggcgtgtgacaatggcttggacctgttgctcctggcggaggacccatagaacctgctgcgtttcgtgcaggcggagctggcgaacggtcggaggtccatgcttggcgtgctcagtatgctcaatccggatgtgctgaccaaaggcggactgatca

SEQ ID NO: 59216 - DNA, 307 bp, Zea mays
  Clone ID: LIB3069-047-Q1-K1-D8
aaaaaaaaaaaaaaaaataaattaaaaaatttaaaaaaaaaaaaaaaaaaatgaaaaaaaaagaaaaaaaaaaaaaaagaaaataaaaaaaggaaagcagcaagcgataaattaaaggtgctgtgcgataacatacatcgcattacgaatctctgtgatccctatgatggacttgaacggtccggtaaagcacatttttggactcatctaccaggatacccgcgtaatgctcaacatctttgtgcagaacgtaattagctactctgtaacctataacgagcaaggccgtttgaagagcgtcaccgag

SEQ ID NO: 59217 - DNA, 447 bp, Zea mays
  Clone ID: LIB3069-047-Q1-K1-D9
acagaacgtgcaactgatgttgtcttctcttctgctgatgactgcttagcaacagcttcagctgatagaactgcaaaattatggaaaccagatgggtcacttttgatgtcttttgatggccaccttgatcgtcttgctcgccttgcttttcatccatctggaaagtaccttggtacagctagctttgacaagacttggagattgtgggacatcaatactgtcaaggaactgctactccaagaggggcacagcacaagtgtatatggagttagctttcaccctgatggttctttggcagcatcttgtggtcttgatgcatatgctcgagtatgggatctgagatctggaagattgttctttacactcaagggccatgtgaaacctgtcctaggagtcagcttctctactaatggttatctggttgcaactggaagtgaagacaatttc

SEQ ID NO: 59218 - DNA, 307 bp, Zea mays
  Clone ID: LIB3069-047-Q1-K1-E1
tgcactccttcatccgctggtgtatcggatgctggatcctcgttcaagttacaacagatggttcgaaatgtacagcatgggtttacacgctgttttaagtgaagactgtaccgatggacaatggcctttacttatacagcaaagctgctgaagaaacaaatgttagcatgcacaagcacaactaccagaattccagaaaccaagctaatgcctatgtcaaactacctaattgggaaaacctgtagcttttcggcacttaagcaaccaacgtacctctacccaattgaactgtcagcataccttaaat

SEQ ID NO: 59219 - DNA, 451 bp, Zea mays
  Clone ID: LIB3069-047-Q1-K1-E10
caggatggggttgaagcaacagtttaactccttgaaggaaactatcagacatctcagccttctaccagcaggtggtggtggaatcctggcacacgctgttgcacgtgttgcttcttcaatcaagattaaaggcgataactctggagatggcattgagtcccttataaacaaagtagaaagcatgattgtcaatggagacttgagtacagcggccgatgccttggagcaagggctacatggaactgaagcagaggagatagctaccgagtgggtgaagcaagccaggaaacgcgctcttgcagagcagacacttgctctccttcgcgcttgtgcttcttcgaccacgttctcgtgattttgacaaccatttacccttccttttcttcgaccgcatttgccggtactccttgcaaccgcatattttttccccagaccatgctgcatatgtgtg

SEQ ID NO: 59220 - DNA, 399 bp, Zea mays
  Clone ID: LIB3069-047-Q1-K1-E2
aggacatgtactatatcacctgaatgcgttcgaaccatctacacctgtgaaggagactgtcatactcattgaccgcatacgaaagaacacacgaaagtagcgcgaaggctctgtgctgaaaaaatgagccttcaaagatcaaaacgaaatctcttgttaacactctgcttagccttgaagattgcacgataagctgcttatggcacgcttgatgcctgctgttccactaagcactattttactttgacattcctaactcaagcactatcaacatgttgagaaggaggaacagtgtccatagaagtgctcaggtgatcaaatggatgctgagcagacggcaatgaaatacaatgagaacatatgaactgatggcatgtgcactccagaaggataatagag

SEQ ID NO: 59221 - DNA, 420 bp, Zea mays
  Clone ID: LIB3069-047-Q1-K1-E3
aggacgaggagggcaaccctgcgttcgccctggtcaacttggccactgggctcgccatcaagcactccctcggccagtcccacccggtgaagctggtgccgttcaacccggagtaccaggacgagtcggtgctgtggacggagagcggcgacttgggcaagggcttccgctgcatccgcatggtgaacaacatccgcctcaacttcgacgccttccacggcgacaagggccacggcggcgtgcacgacggcaccaccgtggtgctgtgggagtgggccaagggcgacaaccagagctggaagatcctgccctggggcgaccaggcctacgccgcgggaggcagcagcgccgccaacgcgccccgcttcggcggcggctgcgagcccaccgtacgcatctactgcaaggccgacgaggggt

SEQ ID NO: 59222 - DNA, 412 bp, Zea mays
  Clone ID: LIB3069-047-Q1-K1-E4
accacgcgtccgcccacgcgtccgcagctagctagcatacagacgaataatctcttcttcacctcactaacaccagctagcaactctttctctcctgcaataatggccgctcgctcctcctcctcccagccgcagctggtcgcggcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaggccacctgcaactgcctcaagagcatgacgggccggcttcgcggcggcgtcagcatggccaacg

SEQ ID NO: 59223 - DNA, 451 bp, Zea mays
  unsure at all n locations
  Clone ID: LIB3069-047-Q1-K1-E5
tgcaatccttcacccgctggtgtattgtatgctggagcctcttacaagttacaacagattgtttgaaatgtacagcatggttttacacgctgttttaagtgaagactgtacggatggacaatggcctttacttatacagcaaagctgctgaagaaacaaatgttagcatgcacaagcacaactaccagaattccagaaaccaagctaatgcctctgtcaagctacctaattgtgaaaacctgtagcttttcggcacttaagcaaccaaggtacctctccccagttgaactttcagcataccttagatcaaggaccggttgcctgtggggcttgagatcggtgtaccgctgaaacgaaggcagccgccaagtccggactccgtacaacgattcatctncataagcaaatagatgctgattgtctctgcagggtattattgcagacttcgaca

SEQ ID NO: 59224 - DNA, 379 bp, Zea mays
  Clone ID: LIB3069-047-Q1-K1-E6
cccacgcgtccgcccacgcgtgtctcgactcatgacgatagctccgtcgttgacctaactaacaccgcgtgacagctagctctctcgcgcaataatagccgagaagctgagtgcttgtgacagccgcagatggtcgcggcggcggcggacctggcagccgcgctgctgctgctggcggaggtggccgagacggcgtcagaggcggtgagctgcggcgaggtgacgtcgacagtggcgccgtgcctcgggtacgcgatgggcagcgcggcgtcgccctccgcggcgtgctgcagcggagtgcgctcgctcaacagccgcgcgtcgtcggcggcggacacggatgccacctgcaactgcctcaagagcatgacgggccagc

SEQ ID NO: 59225 - DNA, 99 bp, Zea mays
  Clone ID: LIB3069-047-Q1-K1-E7
ttactttacagatttatgccggatagtatattcacgacattcctctcaaccatgacgatgcacaagcaagcacacagttacaagcaagccttttttact

SEQ ID NO: 59226 - DNA, 378 bp, Zea mays
  Clone ID: LIB3069-047-Q1-K1-E8
ggccggagcagccgcagtcccggcgatccttccgccggacgccctcatactttctcgacactgccttcgtttctctttccaacaatcaagatgagccgtggcggtcgcgcgggtggtggacaaagttctctgggttacctctttggaagcggtgagccgcccaaaccagcagtggcaccagctgtaagtgctccacctgctgctgcaggtgctccacctgctgagaaaccacctgctgcaaagcctgatggcaccagtcagattgctgctggggttaccaggcaaaccaataactaccacagggccgacagttagaacacctgaaacttgcttacggaccgtccttagaccaaggtccacgctgcttctggcggtggc

SEQ ID NO: 59227 - DNA, 455 bp, Zea mays
  Clone ID: LIB3069-047-Q1-K1-E9
gcgcccagcatacggccacacttctccgacgtttttatccggttctcataagactgactaagggcactgctggggaaagactacggactggtacggttgtgagacgaccgaacggtcggtccatgtggagccataggcgcctaacagagggagcaaaacccttgagcatccatcacaagcatagtaacaagatggtcaagttcctgaagcctaacaaggcagctatcgtactgtacggccgctacgcccggcgcaaagcggttatcctaaggaccttccaccatggaaccagggagcgcccctacggacactgccttatcgccggaataaagaagtacccaagcaaggtcatcatgaaggactccgctaagaataccgccaagaaatctagggttaaggccttcgtgaagctcgtgaactaccagcacctcatgcccacgcgctacacgctcgac

SEQ ID NO: 59228 - DNA, 403 bp, Zea mays
  Clone ID: LIB3069-047-Q1-K1-F10
ggggaaagtttttagcgttagcaatactgatccacaggaagtagaaaaggcaaagaaagcactgaaggagcaagaacagtcggtgattgacgccatagcaaggcttgctgaggcatcagatggtgaaagtggtaaatactaatccatttgtttcttagccataggtttatggaaatttgcaagatgctgcagaaaacactcatttctgcttccagtctagtaggatggttgccccaaacaagggtcaaggggagtggttttcagatatgttgtacaatgcatgatgtatatattacgcaatgttgtagcacaatggacatttgccctcgtaattatagtcaaccttaaatgagatatgcacgcggtcatcttttgcatggccacaagtggcatgaagtaaaca

SEQ ID NO: 59229 - DNA, 448 bp, Zea mays
  Clone ID: LIB3069-047-Q1-K1-F11
cccacgcgtccgcggacgcgtgggatactttaggtcaaggaacatgaaaacccgtgttattggttgcccagagactatcgatggggatctgaaatgtaaggaggttccgacaagctttggatttgatacagcttgcaagatatactctgaaatgattggcaatgttatgactgatgcgagatccactggaaaatactaccactttgtgaggcttatgggtcgtgctgcttgtcacattacgctggaatgcgctttgcaaacacaccccaatgctgcactcattggggaagaggttgctgcatagaagcaaacccttaagaatgtcacaaactacattactgatatcatctgcaagcgtgcagatcttggttacaactatggggttatccttataccagaaggcctgattgatttcataccagaggttcaaaaactcatcgcggaattg

SEQ ID NO: 59230 - DNA, 435 bp, Zea mays
  Clone ID: LIB3069-047-Q1-K1-D6
ccggggtggagatcgcgaagaaagtaaattaggtcatgtccgacgaagcggtcagggcaaggacgacgaggaccgccgaggaagcggccaaggcagttgcagagggtggcaccagctaccggagcatggaggagtttatttccagcgtcaaagcaaccgtggcgtcttgattgcgtcgtggggctcctgatttgcacaagtttgcgtgattgcgtcccctactcctctaccctacctttcactgatggggagtccggaattgtgacgtagctagcgcgtggctggttgcagcgtcaaccaaaacagttttcacaaacgtcagttgctgggaggtcggtagcatgtactatcacgtacctacgccatcaagaatagtgcgtcatctggcatcttgtgatgtcatcttgtaatgaaataaaacacagttgcatttta

SEQ ID NO: 59231 - DNA, 451 bp, Zea mays
  unsure at all n locations
  Clone ID: LIB3069-047-Q1-K1-B8
cccacgcgtccgcaagtttttgaacggagatgttggacccaagaccattcatgttcctactggggagaagctttctgtttttgatgcggccatgagatacaaatctgagggccatgctactataatcctcgctggtgctgagtatggaagcggcagttctcgtgattgggctgctaagggtccgatgctcctgggagttaaagctgtaattgccaagagctttgagcgtatccacagaagcaacttggtggggatgggaatcattcctctgtgcttcaaagctggtgaggatgctgattcgcttggcctcactggacatgagcggtacagcatcgatctccctaccaacctcagtgagatccgtcccggccaggatgtgactgttactaccgacaatgggaaatctttcacttgcatcgntcgctatgacactgangtggagctggcgtac

SEQ ID NO: 59232 - DNA, 385 bp, Zea mays
  Clone ID: LIB3069-047-Q1-K1-B9
cgaagattttctccaattagctattggccagtagtgttcgttgtgcctttcgcttgagctctctggacagaacaataatgcaggaacagtaggacagcaagatcatatggatacaaattatcctggaaatcttgcagtagccactgtaaatgggaaggagtcctcaaataaggatgtgagagggtttcctaaccccaaaagcttagaaatctacctgctccatatgttccatgaaattcttaggaaactcagggagaaatctcgtcatgtggttcgctaccagagttctgctcaagctgcacctgacgattgtggcctgctaagccatttttgcatgacagtagctcacaggatattgtctaacaaagtacatttggagctggaa

SEQ ID NO: 59233 - DNA, 395 bp, Zea mays
  Clone ID: LIB3069-047-Q1-K1-C1
gggaaatcaactttttgttaacccaaaagtgggagaattcactgatgggatggacatctactgagggtccatatgctaatggcagagaagcaggacttacattcaacagtgcggagtcagcaaaagcatattgtgtaaaacatggatggaattatgtggtacggaaacggcatacaccttttatgaagcctaatgcctacgctgagaactctaagtggaaaggccctctgaaggcggatcaagcatgagctctaggcctccaccaacatgtgaccctgtcactggaatgatgcgattctcctcctgagctctatagtctagacctcttgttcgtgagccttttctttcaacagagtgcgtcgtgaaagtacgagctagaatacgcatctatcaaa

SEQ ID NO: 59234 - DNA, 444 bp, Zea mays
  Clone ID: LIB3069-047-Q1-K1-C10
ccaagccttccgctgacacataccaccgaattttcacacatttgaatctgagctcgatatgtctaaacagggtgatataaatgtaaatcctcgtgttcttcacactgcacaattttatcacatgagacaacccatgcataatatatgccctctctgcaaatacactctctctatggtccccactctccatatgtgaaacgcacatactagactctctctgtgaacacacaccatattttgctctttgacaccatttctaaagagtgctttgacaccacatgggtacacatatatggcgaactatatataacacactccaaaacagttcacccacaatctcacttatatgccagacaccttaaaacctatcccaaagacatatttgttttcaatatatatggcaccgctctctataatattacattctacaaaacacatgtatat

SEQ ID NO: 59235 - DNA, 238 bp, Zea mays
  Clone ID: LIB3069-047-Q1-K1-C11
cccacgcgtccgcccacgcgtccgcccacgcgtccggcagcagcaagtgcagcacaactgaagacggacagcatcctctgactgttggtcgtttggttgtaacagtgccagcaataagatctctctgcctccttttcttttcttttggtgtctcaggggggtgggcaatgttccttccttctcagatcgatcaccaacaaagtgtttagattctaatccaaaacagtagaatggtctt

SEQ ID NO: 59236 - DNA, 433 bp, Zea mays
  Clone ID: LIB3069-047-Q1-K1-C12
aaaagcgaggctgcgagagcggagagagagtgtgagggaggcgccgacgccgagtcctttcttcatcctgcatctgccgctgtttccgacaggatgtttctcacgaggacggagtacgaccgtggggtgaacaccttctctccggaggggcggctgttccacgtcgagtacgccatcgaggccatcaagttgggatccactgcgatcggtttgaatacaaaggatggtgttgtcctcgccgttgagaaacgtgtgacctcaccactgctggaaccaaacagagtggaaaaaataatggaaattgatgagcacatacgctgtgccatgagtggacttatcgctgatgctagaacactagtggaacatgctcgtgctgaaactcagaatcataggttctcatacggagagccaatgactgcataatcttcgacac

SEQ ID NO: 59237 - DNA, 449 bp, Zea mays
  Clone ID: LIB3069-047-Q1-K1-C3
aaaccacatgatcttgcatccctgaaggaaaagcttgtgcacgaggcaaaagagaatcttggcatggctatggtctacactcttgtttcatcagccaaagagtggctaagtgagatatatggtcagaatggtggtgatgaggaacctgaagaaactgaagcagaagaggaggttattataccacatggtgaagctgttactgtagagagctttctggcgtggagagaccgatttgaagctgagttggccttacagcgtgctaagtaaacttcctattttgtttacatattaagtttttctcgatgatcacatgggaatctcttgtttacttgtgatatcttcaatctaatggtgtttgcttcccatattatataagtacccaaatgtgtgtttagattatcttttgcattttgttgggcatgcagacttatgccaggatcagctcttac

SEQ ID NO: 59238 - DNA, 262 bp, Zea mays
  Clone ID: LIB3069-047-Q1-K1-C7
agagaaccgtggcatggcgatggtctacactagcgtttgatcagccaaagcgtggctaagtgagatatatggtcagaatggtggtgatgaggaaccatgggaaactgaagcagaagatgaggttattataccacatggcgaagctgctactggagagagctttctggcgtggagagaccgatttgaaactgagttggccttacagcgtgcttagtaaacattctatgttgtttacatattaagggtttctcgaagatcacat

SEQ ID NO: 59239 - DNA, 450 bp, Zea mays
  Clone ID: LIB3069-047-Q1-K1-C8
gacccttacgccttcgctcgcgccgccgtttccgccgccgctacgccccgcacctcgcttcatttcgtgtcgccaagatgacgaagcgcactaagaaggcaggaattgttggcaaatatggaaccaggtatggtgctagcttgcgtaagcaaatcaagaagatggaggtatctcagcattccaagtacttttgcgagttctgtgggaagtttgctgtgaagaggaaagcagttggaatttgggggtgcaaggactgtgggaaggtgaaggctggtggtgcttacaccatgaacactgctagtgcggtcaccgtcaggagcacgatccgccgcctgagggagcagactgaagcatgatatagctctttatattattggggtttcctgtagttgctcttgtcaagcatgttgtgggggccttatctagtggaaatgtggaatcactgtactg

SEQ ID NO: 59240 - DNA, 450 bp, Zea mays
  Clone ID: LIB3069-047-Q1-K1-D10
gcggaatgaatactgtaaaggaagaggcggattttactgctgactgcgaaatgactgaatcagctatttgggcctgaacgttctggatacctgatgcgctcacttacatgaatattgatgtgcaattcgtacgaaatggtggctttactaatgatcactgactatagtgcccgtactccggtggttaagagacgacttggaggcttgctgacatagctcatgacatcgttctgtttgagaccattgctcacaagtgcgttgaatctgcaaagggatacatccatggtgaacaatatacatcatactgcaaaacagttgaccaacaagcttacttttatgccaaaaactctaaaatcgatcctaaggacacatttgcgttcaatatatatggtaccggaccctctaatatttcatactactctagttgcaactggaagtgaagacaaaagc

SEQ ID NO: 59241 - DNA, 442 bp, Zea mays
  unsure at all n locations
  Clone ID: LIB3069-047-Q1-K1-D11
cccacgcgtccgcccacgcgtccgcggacgcgtgggcagcccgccgcgcagagcagcgcagcgcagcgcaggcgccctccaactccgggctccgcaaccgctgctccccctccctccctccctccagctcggcctgcctcagcccgcgccgcgcgatgtcagaggaggacgaggaccagccgccgcccaagcggccgtgcgcgtcgccgcccgcggaccaggtgctcgacaacgtgctcgagacggtgctccagttcctggacgccccgcgggaccggagcgccgtctcgctggtctgccgctcctggcaccgcgccgagtccgccacccgcgactccgtcgccgtccgcaacctcctggccgcctcggccacccgcgccgcgcgccgcttccccaacgcgcggagcctnctactcaagggcccgccgcgcttcgncgactt

SEQ ID NO: 59242 - DNA, 445 bp, Zea mays
  Clone ID: LIB3069-047-Q1-K1-D12
ctcaaagatgatgctggaggggtcaaatcgttggatccattcagtgcaccggcattcgggcttggttgttgctggtttggcagcagatggcagacaaattgtttcaagggccaaatcagaagctgccagttatgaaaaggtctatggagaacccattcctgtgaaggatttggcagatcgtgtagcaagttatgttcatctttgcacgctgtactggtggctcagaccttttggttgcggtgttattcttggaggttatgatagggatggaccacagctttacatgatagagccctcaggagtttcctataaatactttggtgctgcattggagaagggaaggcaggccgcatagactgagatagaaaagttgaaactttcggagcttacctgccgagaaggcattgttgaagttgcaaagataatttatggagtgcatgacgaa

SEQ ID NO: 59243 - DNA, 390 bp, Zea mays
  Clone ID: LIB3069-047-Q1-K1-D2
accacgcctccgctgaatctgtgcatgggactccttttgaaattgactgctctgaacgtgaattttctgagtatgatgagaagggagaatgcccccttgagctaggcaagctgcggtccacattcagagtcaagcatgagaggggtgggaagactagatttgtctagatcgagtgacttggaatctgacagatattggagtaggccttgtattaatggtagatatgggcttaaggccatgcttgaaccgatctcctgtctgtactatctgcagatgctgtggatgccacgaaccatgcgaagcttttggagatagcgtccacaggagcattaccctggaccggaactggtctttataacttactaccaatgcatgaacatggggttggct

SEQ ID NO: 59244 - DNA, 440 bp, Zea mays
  unsure at all n locations
  Clone ID: LIB3069-047-Q1-K1-D4
aacccgcacaacggcacgattctcctccttcgtccgcgtagctctcggtttcggcgatgtcggggcgcggcaagggcggcaaggggctgggcaagggcggcgccaagcgccaccgcaaggtgctgcgcgacaacatccagggcatcacgaagccggcgatccgtaggctggccaggaggggcggcgtcaagcgcatttctgggctcatctactaagagacccgcggagtgctcaagatcttcctcgagaacgtcatccgcgacgccgtcacctacaccgagcacgcccgccgcaagaccgtcaccgccatggatgtcgtatacgcgctcaagcgccagggccgcacgctctacggcttcggcggctaggccgnctgcccttctgatgctctgatgtgacggccgtggtcggttgaatgtctagttggccggtctactgta

SEQ ID NO: 59245 - DNA, 206 bp, Zea mays
  Clone ID: LIB3069-047-Q1-K1-D5
cggacgcgtgggattattatttattgttttttaatttattttttttatttagataactgggaacttaatgattaatattattattttttttttatgctctgtacaattctgatagtgataaggacaaaaagtgatgagatcttggttggcacaatgaacattggttctcgggaagagagagagagagagagatagacagagagaaa

SEQ ID NO: 59246 - DNA, 286 bp, Zea mays
  Clone ID: LIB3069-047-Q1-K1-B7
accacgcgttcgaacacgaacttattgggttttactggacgattggtcttgcagggaagggcgcaatgctaatggctgtgatacgagaccaaccttcaacagtgccgagtcagtcaatgcatctgctgaaaaacatggattggatactgacgtacagaaacagtatacacctgttatgaaacctaaagcctactctcacaacttcaagtgtaaaggccccatgtacgcggtatatgcatgagctcaaggacactaccagcatgtgaccctgacaccggaatgaagc

SEQ ID NO: 59247 - DNA, 405 bp, Zea mays
  Clone ID: LIB3069-024-Q1-K1-F1
ctcaactctcgcgtgtcgcgtccttaacccttcctcccctccgatgcgaccctccgtccgggcgaccgtcgacaccagcctcctacctcgcgcccaccgtcgggatccgtccctactcgtctgcgcccgcctcgggctagatttctgagaaaatggcgagaagtgccggaactaggaggcgtgtggctcgccagctcaagtccacacatcccattccttcataccgatggaagtcaaagcccatgaaaaagccgatgaaaaaatgcaaccgaaagcaagtgttgccaaccttgcaaaagatggactgggaagatgccaatcgctctgtgtgcatggaatacccacataatgctgtgctcatcccttggtcataccatgataaggggtgtcgtccatatatgtgtg

SEQ ID NO: 59248 - DNA, 184 bp, Zea mays
  Clone ID: LIB3069-024-Q1-K1-F10
cttatgtcgaacaatcattctttgcgtttagatggcatagatctttttcttaattctatcttatcctcgttgatgactctcttgaaagtactcttctttagtcacgatcatcatgtcgtcctagactgtctataggtgaggatttactaatattgtgattcactattctacacttttaagttcg

SEQ ID NO: 59249 - DNA, 334 bp, Zea mays
  Clone ID: LIB3069-024-Q1-K1-F11
ttggttggacctttgggctgattatgtgctgttatgtgctgttattgctgcctgacctgatcgtacgtattgtatggttctcgcgaccattctgatctgatcgtaccgattgtatgttggagtgtcaatttggcggctaagttgtttgggtccgtaagtgtcttcctatgagctgagttggatgtttgtgcatagtgggtgatggagggatagattgtgggtctgagcggagtttgtcctccatatcttctgccggaatgagctagctaagtgaagttcccctctagttcttcatgatgggatatgtcagtggtcgcctctctgccgtgtggtc

SEQ ID NO: 59250 - DNA, 216 bp, Zea mays
  Clone ID: LIB3069-024-Q1-K1-F12
tttgggctgatttatgtgcttgtaaataacgttaatctatggtcagcaactcctaggaaacgaccacttcagtcatatcgatcggagtagcgtcccgttatttgtgagcattgagtccaccgggctcgtagtcgtcgacacagacgaagacctcgtcgagaacgattatgcatgagattacgaataatttggtcaagggagttcagtgagtactga

SEQ ID NO: 59251 - DNA, 344 bp, Zea mays
  Clone ID: LIB3069-024-Q1-K1-F2
gatatcactaggagggagaccttcaaccatttcgctagatgcttagaagatgcaaggccgggtgcaggtgctaacatgactgcgacgctgattggaaacaagggagacctttctcatagacgggctgtcagctatgatgaatgtgaacaattatccaaagagcatgctctgctcttaatggaggcatttgccaaaactgcacaaaacattcaagaggcattcattaagaccgctggtacacatatacaaaaccattcaagatggcctatccgaagcatcaaatgactaccacggcatcaaaggactctacacaggtcccaacttatctggacgtggaactggct

SEQ ID NO: 59252 - DNA, 233 bp, Zea mays
  Clone ID: LIB3069-024-Q1-K1-F3
aataggactaggaagtagaacctacaaccatttcgtatgatgcgtagaaaatgcacggccgtgggcaggtgctaacatgactgagacgctgattggaaacaagtgatatctttctcatagacctgctgtcaattatgaggaaggtgaacaacaatgcaaagaccatgatcagctctgtatggccgcatttgctagctctgcacaacacattcaattggcatgtcattaatacc

SEQ ID NO: 59253 - DNA, 454 bp, Zea mays
  Clone ID: LIB3069-024-Q1-K1-F5
cggacgcgtgggcgagctagctccgtgaggcggtatggcaggaagcggcacactgctccgagcccactgtctgttgatcccaacatgctcagcgagggtggccaccaacacgccattgcgtacgtccagggcgacaagtactatggtgcaaaggccaccattaatgtgtgggagcccaagattcagcaggctaacgaatttagcctgtcccagctctggatcttgggggggtcatttggggaggatctcaacagcatagaggctggctggcaggttagccctgacctctatggagacaacaacaccaggctgttcacatattggactagtgatgcataccaagccacaggttgctacaacatgttgtgctctggtttcattcagataaacagcgaggttgccatgggggctagtatcttccccatctcgaactacgcgggctcccaatatgata

SEQ ID NO: 59254 - DNA, 459 bp, Zea mays
  Clone ID: LIB3069-024-Q1-K1-F6
agcgaagaagaaaggagggtgctctgccggcggcggagcggagatgtccgagaggaggcgcggcgcctgcaccgggacccgcaaggatgaggtggtgacccgcgagtacaccatcaacctccacaagcgcctgcacggatgcaccttcaagaagaaggcaccgaatgccatcaaggagatcaggaagttcgtccagaagaccatgggtaccaccgatgtccggatcgatgtgaagctcaacaagcacgtctggagcagcggtatccggagtgtgccgaggcgagtccgtgtcaggattgcccgcaagaggaacgacgaggaagacgccaaggatgggcagtactctctggtcacagtcgctgagatccctccggagggtctcaaaagtttgggaactaatgttgttgaagatgaggattaagtcgaagggttcaatcatctatcacttaaatgcattcc

SEQ ID NO: 59255 - DNA, 306 bp, Zea mays
  unsure at all n locations
  Clone ID: LIB3069-024-Q1-K1-F7
tgatgattgttctcaagttgaaccctagtgtaactgataaaactcgtgaaaccaagggtatgcaactctggaactcaaacgttctactcgaggattgatggttcacataaatgtgggaacacgtaggaaaaactatgcatcttcgatttaggttgcaaaagagggagcttgaactcattacctgagccatcacaactttcttctctgcaacttggttacaggttatgcccttgctaaagggataatgcaaagatccctacaacaccaattagaattggggaagacgaacctnctnctcagtctcct

SEQ ID NO: 59256 - DNA, 453 bp, Zea mays
  Clone ID: LIB3069-024-Q1-K1-F8
cgagagcgtgattgagtcggtggactcgttgaacccgttcatgcacgcccgtggggtcgcggtcatggtggacatctgctccacaactgctcgcctgggatccaagatgtgggcgcctcgcttcgactacatcctgacgcatcaggcctatgtggcggtggacaaggactccactatcaaccaggaccttatcagcaacttcttgtcggaccctgtccatggtgccattgatgtctgcgccaagctgaggcccaccgtcgacatctctgtgcctgccaacgccaactctgtgcgcctggagctcctacagtcttcctagatcgaagcagtgagctgagagtgagatggagagagaaagagaggatgtcgtgtcccgagttacaacacattgctgaatggtttgtgcaactggatgtaagtcaagtctgaactgtgaacctatgatcgcttcta

SEQ ID NO: 59257 - DNA, 289 bp, Zea mays
  Clone ID: LIB3069-024-Q1-K1-F9
gacctttgggctggtttatgtgcttgatctttcgtatggtattgagttcttccatctctccttttaaacttcctcttttcttggaaccgggttaacagtttgtcgtgtcgatagctgtgattctggctggggaagaagtcctgtctttgcgttgtatactgggagaggagtcttttgtcttagttctgatagatgtccttccgttgctggttctcatggcaggtggtcatcgtgctcgtgacgagtcgtcatgctcgtcttgagctggtagtgtaggatgaggagttta

SEQ ID NO: 59258 - DNA, 369 bp, Zea mays
  Clone ID: LIB3069-024-Q1-K1-G1
cccacgcgtacggcgcaccgcttacccagttgccctagctccacccaccttccgctgccttggggaactcaacccccgcccccgtcacggatcggcacggccgacggactcgccttccccgtcgcctcctttgcactcgcctgcgtctcctcacctccccaccccgggcaccgcatctgctgcgcgatcccgtcgtcgtcctcgcgccagaccgtcaaatcctcgccgctccgcacgactaccgtgctctccagagaacgacggcgcacgggccgtggcgcgttcgtagtgagcgctgtccaaggccaggacacgaccatccaagtcccagatgtgacaaagtcgacatggcaatcactcgtgatcgag

SEQ ID NO: 59259 - DNA, 409 bp, Zea mays
  Clone ID: LIB3069-024-Q1-K1-G11
ggacctttgggctgatttatgtgcttgagtctagctaaatagtatacgagcatctcggccaggattgataattgtccgtgacgtacgacggggatggctacagggtagttagaggctgctatttagtcgccgtcgtggaagtcgatggtcgagtcgtagtcgttagcgtctgtgtcggcggacctcgacgtacattgctctaagactccgttggcgcatacgcgcggccttaataatacgacgcacgatagcgttgactcgatgatgttgtatactaaccggactggcgcttgcatgagtgattcgcataagcagtagacgttcgagtagtgttgctcctttacgattgactatgacactaacgcggattaaagagtcgtcacgatgaggatcctcacgaagtagaacg

SEQ ID NO: 59260 - DNA, 409 bp, Zea mays
  Clone ID: LIB3069-024-Q1-K1-G12
tttgggctgatttagtgcttgggatgtcgtacctacgtgatctgttgaggataggcctcataattgtccttttcgtactacctcgatggttaaggggtagttagacgctgttatttggtcgccttcgtggaggtctaaggccgagtcgaagtcgttagcgtctgtgtcggcggacctcgacttacatgggtctaagactccgctggcgcatacgcgcggccttaagaatacgctgcacgatagcgttaactcgatgatgttggatactaagcggtctggcgcttggttgagtgattcggataagcatagagcgttggagtagcgttgctcctttacgattgactatgacactaaggcggggaaagagtcgtctgaggaggatcctgcgaagtagaacgagggtcgggcg

SEQ ID NO: 59261 - DNA, 318 bp, Zea mays
  Clone ID: LIB3069-024-Q1-K1-G3
actacgattgtccgctgcatgaatccggctctgcgcgcccaattccctgcaaagccccagtgtctggcgatgatcttcttggaagatttcttcattctttactggcgcccaattctgctgggaggggggttcttgagagggagatccaccatttcgcttcggcttgagcagccggggagctgagcagcgcggcgcccatgtcggactccgagctgtcccagggcacgctagtgttcggcctccacctctgggagctcgtctgcatccgtgtcagcgccgcattcgtgctgctcctcgacctcctgtacctgctctgcc

SEQ ID NO: 59262 - DNA, 431 bp, Zea mays
  Clone ID: LIB3069-024-Q1-K1-G4
cagaccctgctccagtgctcttttcttctagccggcgccgcaaccgcttgctagcgctgtgcgcgctcatactcgcgtccgtggaaggtcgactcgacatggcctccgagacggagacgttcgccttccaggcggagatcaaccagctgctatcgctcatcatcaacaccttctactccaacaaggagatcttccttagggagctcatttcaaactcctccgatgccttggataagatcaggttcgagagtttgacggacaagagcaagctggatgcccagccggagctgttcatccacatcgtccctgacaaggccaacaatactctgacaatcattgacagtggcattggtatgaccaagtcagaccttgtgaacaaccttggtaccattgcacgatctggcacaaaagagttcatggaggcactggct

SEQ ID NO: 59263 - DNA, 347 bp, Zea mays
  Clone ID: LIB3069-024-Q1-K1-E9
tgcttgatcgaaggtcgcgtaggcgtacgtcccccagagcatataactagagtcgggtgatgcccacgactcgttgaacgatacttcaggcagtacatcactattggcgatacccatagaacttcgttagacagattcagaactctacattcggtaagggccgacgaaaaatcgacgttggaaatcggactctattagtggatattccgactaatttcgaaacatgagtacctcatgcataaggatctaacccgttacgatagctaatagtctcccgtgctactcatatatctaattcaactccaacatgcgcgacaccatgcgtgggtcgtctaggaaggataact

SEQ ID NO: 59264 - DNA, 196 bp, Zea mays
  Clone ID: LIB3069-024-Q1-K1-D3
cccacgcgtccgaaaagtaacaagagtagttcaaggctgaatgcacggaggacgaggccgggaaccggacgaccgcagtcactgtcccaaccgcattcaaacttgcaacaggtatgccaatctacaggttccatgcttccgaccccgatcatggaagagactgcctactttttattgatacctaaaatgaactcac

SEQ ID NO: 59265 - DNA, 422 bp, Zea mays
  unsure at all n locations
  Clone ID: LIB3069-024-Q1-K1-D4
nccacgcgtncgcccacgcgtccggggacctcaacgtcacctaccctntctgggtggaggagcccgggcggcccccgtgcggaccaccgaccttncagctcaagtgcgacagtagcggcgcgttcctgatcagatccgtctaccaggccttccaggtgctcggcatcttccccgagaacaactccttccacgtggtggaccacaacctnccgctcgccaccggctgcccagcgccaacggtgaacctctcgctcttatttcccgggaacattcgtattaagcagagccaacaaagagctgctctttcttgggaagtgcacngggtttcccgtcggcggagtctggcgggtttcgcagcctgccttgcgacaacagctnctttgtccggctcggcgacggccggaatttctccagccaaagca

SEQ ID NO: 59266 - DNA, 285 bp, Zea mays
  Clone ID: LIB3069-024-Q1-K1-D5
cagacgcgtggtcagacgcgtgggctaacttgtcacgagcgcaccgtcgcacgttggggatgtccccaccggcgacgggatcccgaccggagccctaattccaaggggtaaacgatgaggccgtacgcggtggggacgggctgcatgtgcgtgtggaggctgaaagcgggggccgtcgctggtgccgcaagcccggagttgatggtggtgccggcgtctggtccagctcgggtggacgaagccgggaagcacgcagtgatggcgcgtacaaggctttccgggcgc

SEQ ID NO: 59267 - DNA, 480 bp, Zea mays
  Clone ID: LIB3069-024-Q1-K1-D6
cccacgcgtgcgcccacgcgtgcgctcactcgtccggacacgcgtgcggccaaaatgcacaggttttcactgcattgaacaatgcaaagaaatctgctaggtcgaatggcactggatttgctgggcgtaagagtgttcgatcttcccagcattttgggtatagtaaggacaacttcaattgggtggatgatatggacatttcagacagtgagcactcggatgagttagagaatatgagtgatggatccgattcagactgggtacagtcgacgaggaaagccaaaaaacaccagagaagagtgtctagccattcaaatcctaacctggattgtcaaaatacacaaggcagtgcagaaccagagaagccctcagatgaaaagtgcattttgcccaaatacatttcatcagacggctgttcatgctcaaaatcctcctcatgcaagaccaacaaatgcgagtgcagagggtcaagtgcacaat

SEQ ID NO: 59268 - DNA, 429 bp, Zea mays
  Clone ID: LIB3069-024-Q1-K1-D7
cccacgcgtccgcccacgcgtccgcccactcgtccgcggacgcgtgggtggatctgagactggattatttagagggagtaaatgtataggttaatggtagctactactttgacttatcaatcgtcccgcacatgggtccgacttaagaacaccttgcttcaggcgctcaagatgctgacgcacggccgggacgattgataagtcaaattagttgattcacctggatctcagcctcagatatttagagggagtaaatgcataggtcaatggtagctactagttttttcggcttatatgttagtgtctagtgcctctattcgtaagcacgagtgagaggatgcaccagcgtatctgagaatggcttcacagttctaagagacgaactagtagcgataactgttgatatttacatgaagaacatgctcaaaa

SEQ ID NO: 59269 - DNA, 433 bp, Zea mays
  Clone ID: LIB3069-024-Q1-K1-D8
cggacgcgtggggcacttgcatcgctactgtataatccactacaatctgaagtccagcaatgtcttgctagacacgaatggtgagcccagggttggtgattatggtcttgtgaacctgctgccgatgctggatcgctatgtgctcagcagtaagatccagagcgtgctgggatacatggcacctgagttcacttgcacaacggtcaaggtcacggagaagtgcgacatatacagcttcggagtgctagtccttgagattttgtcaagcagaaggcccgtagaatatctggaagatagtgtggttgtgctttctgatcttgtcagtgatgcactcgatgatgacaggctggaggactgcatggatccacggctatcaggtgagttctcgatggtggaagccacactgatcatcaagctgggcctggtctgtgca

SEQ ID NO: 59270 - DNA, 308 bp, Zea mays
  Clone ID: LIB3069-024-Q1-K1-D9
ggacctttgggctgatttatgtgcttgacgacgaggcgccgaccgtcggacccggcctgcagggctacgtcgcgggagataccgtcggcgctaggcctaaggccgccaaggcgctcggcgcgctgtcgtccgtatctcctaaggagaagaaggagaagttaaggctccagactatccctggcagctaagaacggcgcaaatcgtttaaggtcacaccgctaaagccaaagcctcgtcagtaatagagtcgccaaactcgagtcgcattcccccgccaataccgccgtagcaccatagagcctcgccct

SEQ ID NO: 59271 - DNA, 440 bp, Zea mays
  unsure at all n locations
  Clone ID: LIB3069-024-Q1-K1-E1
gagggcccccgtggcgacctgaagccatggtaggtgaactggaaaaaaatgccatggcaccggcagcgtgtctgctgttcttgtgtacgctgcacagcacaaccagatgggaggctgatcgacgaggagggcgatgggtactcccatgccaatgatgtaaatgtaaagcgtcttccagcccagcaggcactgtgccttttcaggcgacgtgtctggttcgcttgtgtgacagtgtctgttctgaactttactttagcgttagcctattaacgatcggagatcatgtaatgtatggctgttgtatcatagtattaatagggtgtttagttcgagtaatgagttagtctatcattgtcttaaaagagacnctgagaaaagaagacaaagctgcaaacagcaattattctgttggtgcaacttaaaacaaaaaaaaggggggc

SEQ ID NO: 59272 - DNA, 492 bp, Zea mays
  Clone ID: LIB3069-024-Q1-K1-E10
tggctctggacctttgggctgatttatgtgcttgtttatgtgcttgtggatgtgcgggttggttattctcctcctttttgcgtagtctgagtcgacctggtgggtctcgttttaatacttatttattcctgcttaactttgacttaagattgcgttgcgacttggtagtagtccttgtgtggttacgggtatgggtgtggcggtggcggtggtgttggattgggttaagtaggggtgggttggtggctattcgcggaagaaggtatcgtcttatcctctttctcgtcctgctacgggtcctcctatgggtcctgtgttccttcttcgtcttcttcggaagcttgttgttgatatttcttagtattatttgatgtattgctttggggattgttctgttgatctttgtgcggttgctgatgtgtgtgttatttcgctcttgaatgtggaggttgctgacgtgtctcttgctggagttatggcggatccgggtga

SEQ ID NO: 59273 - DNA, 481 bp, Zea mays
  Clone ID: LIB3069-024-Q1-K1-E11
tggctctggacctttgggctgatttagtgcttgtttagtgcttgaaatttcagtgagtcgtccttcagcacacaaacgagtattatgtgcgcgcggcttcctcgaagccctggtggtggtgcatgcagtggtggctctaattttaggtgagtctggtcttggctatttgctgacttatgtaattacgctgaggaggaagattagggagtttaaggaggagaatgccatttccggatttatcgcttgcgaaggagagcccgctcccggcgccgtctatactcccgtacttcctaacgatattcctacctacgctatcgacccgctcgggagggaaatcccggcctggactatcggcggtacgaaggccaaggtcgactgcgtcgagctgctcatccacgtcgtcacgtccgtcgtctaagacgccgtatagtgccgtaaggagtctggcactattgtgtcgtataccaagtcctgcgtaatc

SEQ ID NO: 59274 - DNA, 420 bp, Zea mays
  Clone ID: LIB3069-024-Q1-K1-E2
cagacgcgtgggcaacgacctcgacgcctgtgcgtgtcgcatgggcggcaccacccagtaggcggggaacaaccagatggtcaacgccaccctgatgaacatcgacgacaaccgcaccaacgtgcagatgccgaggatgtacaacaaggacgacaacccccgcgtgcccatcatcgagaccggcaacgacttctccacgctgtacgcaccgctcatccgcgacggccgcatggagaagttctactgggcgcccacccgctaggaccgcatcggcgtctgcaagggcatattacgcaccgacggcgtctacgaggaacacgtcgtccagctggtctacacctttcctggccagtccatcgacttcttcggcgcgctgcgtgcccgggtctacgacgacgaagtccgacggtgggtgagcga

SEQ ID NO: 59275 - DNA, 382 bp, Zea mays
  Clone ID: LIB3069-024-Q1-K1-E3
cctaaacctttagcatgacctaactgtggcattgcttagtatggcaggtttcagacacagcgtatgggtcaaccaaactcacattggccaaatcagcaagatgtacaaattgtcttacaaccacaagatgaaacagactatcagacatgccaatcaggtcagactgcattgcatcaaaacactattaatactgatgagctttcacgcaaggctagtgagggtgggcatccagaccatcttaatgtccacgggaaacaacagcggagccctgcaagtgcacctactgaatcaactcatgaacttactgttgttgaaacaaacatagctgaacatgtagcttatgatgaacaacagaataccttattagaacaggattcaccat

SEQ ID NO: 59276 - DNA, 324 bp, Zea mays
  Clone ID: LIB3069-024-Q1-K1-E4
cctacaccttcaccatcacctaaccgtagtcttgctcagtctggcaagggccagacacaggggaaggatcaaccaaactcacagtgaccgtatcaagaacaagtacaacaacggttacaacgaccacatgctacagactatcatccatcacaagtaagacagactgcatcgcatcagaacactcttactactgatacagccgtcacccacggcaaatgatggaggccatccagaccatcttactgccgagacggatccgcgtctgacccctacaagtgcacctactgaatcaactcatgaacttactgcagtggaaacaaacat

SEQ ID NO: 59277 - DNA, 419 bp, Zea mays
  Clone ID: LIB3069-024-Q1-K1-E5
cccacgcgtccgcccacgcgtccgaatcactgtctggatgatgagtgaactacattgtacatgtttgagtttgttgagttatattgtccgtggacaagctgtatctggatgtggtcaaccggcttcaggggctcatgcggctggcctgtttttgctctgtgctggacgtctagtaagtctgcaactctacatcatatgttatgtagtgagtgatgttcagttcatgttctgaattcttaatgaaatgtgatctgaatgcctgacaattctagtattcataatttctatgatgctctgaaatctgaatgttcaatggtgttctgaaatctgaatcgtccactctccactgtccagttctagtattcatattcgttttgcttggtaatttggttactttgatattgccttctatatgctat

SEQ ID NO: 59278 - DNA, 489 bp, Zea mays
  Clone ID: LIB3069-024-Q1-K1-E6
actagtcctagatcgaagctgccggagattccactccccgcaccattccgagctttgtccggaccctactccgtggctgccagtcccgcgggagcgcagcgcgcgctgctctacggtcgccgcgcgccgttcgcgggagcgctcctgtttttcagcatcggcgccgacagcgctgcggtcgcgttcaggacagggtgcgccatctcacaccgacgtcccaccttactcggggcaagaggtctcagttccactagaatggactcagcttcgaccacagtgccatccattgtcgtgtatgtgacagttccaaatagggaagcagggaagaagctgtcacagagcatcatcagcgagaagcttgctgcttgtgtcaatatagtacctggcattgaatccgtgtactggtgggagggaaaggtacaatctgatgctgaagaattactcatcatcaagaccagggaatcactcttggatgccttgactggacat

SEQ ID NO: 59279 - DNA, 344 bp, Zea mays
  Clone ID: LIB3069-024-Q1-K1-E8
ggctgtcggcgtccttgtcctcgtccgccttcatcttcgtcgaggaggaggacggggagggctacgaggaggaggaggacctggcctcggacgcgggggcacgccgtggacgtgccgctgccgatgcgtcggctgctgactaacacggtgctgaacgtgtccgccgacgcggcgctggcgttcgtggagcagggcgtcggcggtagcggcggcggcggaaaggcgtgcggcatcaacggcttcaagggtgggctcggggacggcgacaggggcagcatcctgtccatcacggacgcccactaccggcagatgatcgaggcggacccgggcaactcgttgctcct

SEQ ID NO: 59280 - DNA, 354 bp, Zea mays
  Clone ID: LIB3069-024-Q1-K1-D2
cccacgcgtccggcgagtatgatgtggacattatcgatgagtgcacgggggacgaggccggggaccagacgacggcagtcactgacccaaccgcgttcaaccttggtgccgctatcctaagcgacaagttcctcgtgccgacgccgatgaaggaggagaccgcctacgtggagttcatccagaagaggaacgcccccgctgcagccgagccagagctgatgctaaacaaccgagtgtacacctgcaacaacgtccagtgcccgcgcagctgactacagctacggattactggaccgaaatgcccgcaacagccaccagtacacctgcaagcacaaggatccaacccctcagagc

SEQ ID NO: 59281 - DNA, 286 bp, Zea mays
  Clone ID: LIB3069-024-Q1-K1-C1
gacacacgcgtgcaaagactcatgagctgtttcgttgtacatgccacacgcactacacgcagggcagcgctattcatatatagagaggttagctatagctcgcacatatatgtaactaactaactaactggctcgctagcgtcgatccgtacagcacagccaaagcatctagaatcaatgcaaaggagaaccctgccagtgtgctagtactaccagcgcattttaccaaactgaccttcagaaacctgtacatccgccaggccgggccgtgcctcatggagctaac

SEQ ID NO: 59282 - DNA, 464 bp, Zea mays
  Clone ID: LIB3069-024-Q1-K1-C10
tttgggctgatttatgtgcttgttgagactgagcgtaagtagatccgcgccgacccataacccgtttggcggccgtcaacgacacgggacgaaatggccgttggcccggtcgtcaccaaggccgcgcaactcgacgggtaaccctagtacctcaacgtttcaacgacgaactcccggttacccgtcgcctcgttcaataaaaacaaacgtcgattgactcacaaaggcacaacgtaaaacaaagggtggttgactcataggacttaagtccatgcatgtacgtacgtgatgctacagtctcctcacagcgctattcaaacctaacctatcggttgctgccccataatactgagatcgggaaaatttcggtgccatttaatccaactgttccgtagcatacttttcccctgttagtcggtgcaacactcaagaggtttgaattgactgcttccatgaatagccgt

SEQ ID NO: 59283 - DNA, 343 bp, Zea mays
  Clone ID: LIB3069-024-Q1-K1-C11
tggctctggaactttgggctggtttatgtgcttggcgctctcgtagtttctactagtggcgttgtcttcgttggaggttgttattgtgaataagtctttgttgcggtctctttctgctggtagtgctgctgttctccttattggcattgtggttattagtaagaagtggaagtgggatggtagtagtggtgatgatgatgattgcggtgaggctgcggatgggactgagtctaaccctgatgttgtgttgtcgtttttcgagcggtaatgtcgttctgatactaagctggggtagacttatcatcataatatgaggatgaagaagtggatgcgtaaggatttt

SEQ ID NO: 59284 - DNA, 490 bp, Zea mays
  Clone ID: LIB3069-024-Q1-K1-C12
ggacctttgggctgcattagtgcttggttatgtgcttggcgtgacggccctactaaaattaggaaaccgtccgtgtcacattcgtcttggtctacatccgtgaagcccctactatcttccctatataagcaactagcgcggaacgcgccgacgacaccgtaatcggcccaatctgcgactaccacgaaaaacgtctttacgtaacgctaaccacgatcgggacttggcctcgtctctcgtagcacagcaaaaacaagcctaagcactccgacccaagaatgccgtgcggacaccccagctaagtagccgccaggcttacgaaacccttagtcgagctagaaaaggatagcgaacaccgcatattcgagaaagtcaaacccataaagtaaccagagaggtcccacctaaacgcccgggtatcaaaacccgctgagtttttggtagatcctacattactccactaaaccccaagcaatgagtagttcttcgg

SEQ ID NO: 59285 - DNA, 421 bp, Zea mays
  Clone ID: LIB3069-024-Q1-K1-C3
cgcgcgtcggtctgggagaacttcaagaactaacccgctgtttgacatctcgaccgaccacgcgaccgacatactacgaagacatgcagcgctccgtgttctgcctctgcccgttgggctgggcaccgtggagtcccaggctggtggaggccgtggtcttcggctgcatcccggtgatcatcgcagacgacatcgtccttcccttcgcggacgccatcccgtgggaggagatcggcgtctttgtacccgatgaggatgtcccgcggctggacagcatcctgacgtccattcccacggacgtcgtgctgaggaagcaacggctcctcgcgaacccgtctatgaagcatgccatgctgttcccacagcctgctcaagcatgagacgcgttccaccagattctgaacggactctcgcgcaagct

SEQ ID NO: 59286 - DNA, 423 bp, Zea mays
  Clone ID: LIB3069-024-Q1-K1-C4
ctctaaacgacaagtttgaagtattctatattgactatggcaaccaagaggtggttccctacagtcgtctacgacccgtggacccatctgtttcctcttctcctgctcttgctcagttatgcagccttgctttcataaaagtgcccagtcttgaggatgactttggtcaggaagcagcagagtatctaagtgaatgtttgctcagtagctcaaagcaatatcgggcaatgattgaagaacgtgatgcttctgggggaaaatcaaagggacaaggaaccggaaatgttctcattgttactcttgttgatgcggagacagaaagtagcataaatgctaccatgcttgaggaaggccttgctcggcttgaaagaagcaagagatgggacactagggagaggaagacggctctccagaacctggaac

SEQ ID NO: 59287 - DNA, 438 bp, Zea mays
  Clone ID: LIB3069-024-Q1-K1-C5
cccgacgccttgctccggcgtcaagggccacaagaccccgccgcagttcccgcggacgccgcggccgtcgttcttgcagtcgccgtcgacgctgttcgcgttccggaaggacgggcagcagaccagccgcgtggagcgcgagcgcgggtccttcctcccgtacctgcgcttctaccgccgaccctacgacgagatttcctaccgcgccatgatgcgcccgccgctcggcggcctgatacccatcgtcgagaagttcaagcacaagccggtgcagcagacgctgcgtcggcacgctgggctccaccagcatcagcagcaccaccattaccaacagcagcagaggatctgagtctcgtctctcggtcggtactgcatggcgacccgagaattttctccatatacagcataaaggcgatgctatattatgctaagttaatc

SEQ ID NO: 59288 - DNA, 428 bp, Zea mays
  Clone ID: LIB3069-024-Q1-K1-C6
accgaccccttgctccgtcgtcaagggcctcaagaccccgccgcagttcccgcggacgccggggccgtcgttcttgcagtcgccgtccacgctgttcgcgttccggaaggacgggcagcagaccagccgcgtggagcgcgagcgcgggtccttcctcccgtacctgcgcttctaccgccgaccctacgacgagatttcctaccgcgccatgatgcgcccgccgctcggcggcctgatacccatcgtcgagaagttcaagcacaagccggtgcagcagacgctgcgtcggcacgctgggctccaccagcatcagcagcaccaccattaccaacagcagctgaggatctgagtctcgtctctcggtcggtactgcatggcgacccgagaattttctccatatacagcataaaggcgatgctatattatgc

SEQ ID NO: 59289 - DNA, 416 bp, Zea mays
  Clone ID: LIB3069-024-Q1-K1-C7
cggacgcgtgggctggcgaggcaaaagcattgcgaccacagacagcgcgcgcttcagggccttttttttttttgagataacaaggaggagaggaggagatggcggtcacgatcacgtgggtgaaggcgaggcagatcttcgacagccgcggcaaccccaccgtcgaggtggacgtgggccttagcgacggcagctacgcgaggggggccgtacccagcggcgcatccactggaatatatgaggccttggagttgagggatggaggatctgattatcttggcaagggtgttcttaaggctgtcagcaatgtaaataacattattggaccagcaattgttggaaaggaccccactgagcatggtgagattgacaacttcatggtccaacagcttgatggaaacctcaatgagtggggc

SEQ ID NO: 59290 - DNA, 462 bp, Zea mays
  Clone ID: LIB3069-024-Q1-K1-C8
aagagaaaggctgatgagagtctacagagtcttcatactgtattgtatgggagaaaatcaggtaaccattttttgaagagaaacatatctcaattttccgggtttgtttggacagacaatcaagaaaagcacaggaccaaaataaaggaaaagcttgagaaatttaacaaggagaagttgctagatttttgtgaaattctggacgttattgtaaaagtaactactaagaaggaagaagtttctgccaagctcttggaatttttagagtctccttgtgttaccagggatgttattctcactgataaaaagaaggggaagaaacgcggaaggaaatctaaagtaagtcgtgaggtaacttctgaaggtgcttctgcagagaagaaaaggaaaagagttcagaaacaagcagctgaaaattgtaaagaagaatgatgatggggatgatgctgatcttgctggttc

SEQ ID NO: 59291 - DNA, 430 bp, Zea mays
  unsure at all n locations
  Clone ID: LIB3069-024-Q1-K1-C9
tggttggacctttgggctgatttagcgcttggattttatcgagtaggccgagaccgataatcctacggcttaatagtccgacggaatgcttagagagcggggtcggcgtaaatagaagtccggagtaaacgttacttccgtggccctatccgtcgcgcgtaaagtcggagtcacggcgaagaagaccttctcccattagtatactgtanactccgtcgggaataaaatctcggcgtctttcgcattcgttcccaacgcgaccaacggagggctatacgtcggaaataagtccgttacgtaggagcctacgacttcnttaatcggcgttcntctgcctaaggaggttacgaagacgggagccgaagcgcattataattcgaagagtacaactaagaagaagcatggctaggacgtgataaacgccggggac

SEQ ID NO: 59292 - DNA, 384 bp, Zea mays
  Clone ID: LIB3069-024-Q1-K1-D1
atcacacgtacgatgctgaacttgaggcgtttgctttactagagactccaactgaaccacggcatagggttgatcgtgataggcttactagatatccgcctactaatgcatctaagcatactatggctcatatacaggcccagctctacagcacaatcacatgcattagatggtggcaaagaccatgatcctcatgcaacctcatatgctgtcacgaacactcacagcaacatggatcctgttgtacagataagtatctctcagttacatgacatcactgcgctaaaggccaatcaaggatacaggaaaagacatgtgtcacatgagaaaatttctgatgagacagcaattgcttgaataaccactggaaatattaagaaaaat

SEQ ID NO: 59293 - DNA, 423 bp, Zea mays
  Clone ID: LIB3069-024-Q1-K1-D10
tggcttgggacctttgggctgatttatgtgcttgtggatgtgcgggtggctgtgcgggtcagcctcagactgtgagtggttgtttccaccggcggggcccccccctacgcccccccggcccctcctcggcgccctatgccctctaactcgtcaacgaaacggaagtattcgatgctagactacattcggcggtaatcacttaccaaatcgaatcccatcgcaatcgtatcgcctaactaatcgcagtggtcaaccagtcagtccgtcattcgttggggtcacggtaaacgtacaaatcgatacaagctattaggagcaagcgcaatctctgagcttcgtctccgccatcgcccgggcatcgatcgcgctatcttatcatcacccaagaactacagtagcaagcccatcagcgctctcgtcgct

SEQ ID NO: 59294 - DNA, 445 bp, Zea mays
  Clone ID: LIB3069-024-Q1-K1-D11
ggacctttgggctgatttagtgcttggaagccgcggatataatcgcggacaagtacgacgaactgaaggagtaagaggaaggcgccctggtcgagtaagacgagaagtaaggagaggaagtagaagaaaaaggaaaagaaacggacgttgacgagaagtaagaagaggaagtagaagaaaaaggcctcgtcgacgagaaagacgaagacgaaggcgattagaagacggaagagaacaaggaggagatcttgaagaacaagaaagtaaggagcgttagggacagaagttagggaaacgacaacaaatacgacggactaaaactcagggaagttaaaagcccgtcgaatattttaagtttacacggcattgactgcttctaatgcgagaggaaaacagcggaaaagccggccgaagcgaccgagaaagagttaaataggaaccctgc

SEQ ID NO: 59295 - DNA, 453 bp, Zea mays
  Clone ID: LIB3069-024-Q1-K1-D12
tggctctggacctttgggctggtttatgtgcttgtttatgtgcttgtttatgtgcttgtggatctgcgggttggcgttgaaggtttcggatagacggtttgcactccggatgagagtgtagtagtcgttagtcttgaaactggcggttggactgtttacctctcagagttgcggagttgtgttggtgcgacgagaagaacagccggggtcgagaacgagatgacagttgagccgacgaagactcgtattctgaagtctaagtcttccgtgcttgtactagtcctttcgcttccggcgccgtatcaggtcgggaaaccccgactgcgagaccccccccacttctacttttgatcgtcgctgcgttccttctccgtttttccgacgccgcaaattaaatcaacgcgtgtcggcgcccggcggcctgacgtaaccccggcccgagcgatacgtcag

SEQ ID NO: 59296 - DNA, 459 bp, Zea mays
  unsure at all n locations
  Clone ID: LIB3069-024-Q1-K1-B9
ggacctttgggctggtttatgtgcttgtttatgtgcttgtttatgtgcttgcttatgtgcttgcttatgtgcttgtttatgtggttgggtctccacttacgggtcgaatagatatcatcatctgaccgtaactaaccattgaaaaaacgaatccgaggagaaaacgccgtcgaatccgtataaaaagaaacggatagacgggtcaaccccgaagaggcccgatatctacctaaaaattaatgagtagatcgcttaagaaacgtcaaattcagttactaagcataataaggtggcgtaagaggaagatgaatcgttattcgagaaatccgtgacagtaaacgcaggctggtaagacgtaaaaaagtacccggaagagtacgcgcttaacccgacgctactaaatacagcctagatttcaggaattacgtctgatatggccgcaccncagctctcatcaac

SEQ ID NO: 59297 - DNA, 439 bp, Zea mays
  Clone ID: LIB3069-047-Q1-K1-A3
accacgcgtgcgcgaaggccgcggcccactcgccagctttgaggcccgcatgcaggggatcaccagcgaaatctggaacgcgcaccaactgttcgtcgttgtgttcgacaccgacaggctcaagggctccacgctcgtaaccaatggcgtgataacgggcgggtctgacgagtgggcgatctacggcggtaccggggtgtttgccatggcgaggggcgtcatacggagaaggtatctcgtcgacagggcccgtgggaacactgatgagctcaacatggatgtcttctgtcggccgtttggctcacagtcacagctgcaagataagatgcaagtgcaagggcatgggcagggctctagcgtcaccaagattggactatggtgtggaccgggagggtcggcacaggacatcacggcagagcggtcaccgtagcatgttcac

SEQ ID NO: 59298 - DNA, 252 bp, Zea mays
  Clone ID: LIB3069-047-Q1-K1-A4
aggacgcgtgggcaacggggagatgcatcttcaaacaatggttgggctgtacaaacatgattcatctcggtcagctcgacgcccagggcctgatattggcactcctgctcaattcattcaccaaactgttggcatatcattgaatttgcttataaacgtggggaaacataacttgcctgggaagtggtggctgtcagcctgcgatcgtgaactgtaacttatcgaaaatgcaacggagtttgggactctact

SEQ ID NO: 59299 - DNA, 254 bp, Zea mays
  Clone ID: LIB3069-047-Q1-K1-A6
cgcagcatcaggccagtgtgctgcccttattccgtgatctgccgagagttgctcctgctatcgcgttatgtgtgtctgttctgaagtattgcgcggtttacaacacctgatgttgtaagagttgctaattaccctgcattgctaccggcttattgagaataattattgcttgttacgttgttgcttcaaaactgcgatcgtgaactgtaacttatcgaaaatgccgcgcagtttagaagattcacgcttacgta

SEQ ID NO: 59300 - DNA, 451 bp, Zea mays
  Clone ID: LIB3069-047-Q1-K1-A7
gctcattttgttagccatgttgctcaacattgcaacatcagtggtggtggtcgtggtcgtacttatgacgatgtgcatggcttggaggatgcatctatgagagtttctgatacagtcttgggaggtgcctatagtagccgtggtggtcatggtggtcgacgtgcacgtggtcatcatccagccccccttcaacaatgccatatcgtgcacctcgcacaattggagatcgtggtgctgctgtctagtctgtggacgacgacactgagggtgatgaattcaatgaccaagatgctttggggcatgctgaatggaggaagttaaaatatggaccaccagaaaaccttgataagcttgagataatgtttgagcatatagctatgaatggatcaacttcctgcacaccaggacaaaatattgatatagaaggacctgatgttgaaggagtagaagc

SEQ ID NO: 59301 - DNA, 447 bp, Zea mays
  Clone ID: LIB3069-047-Q1-K1-A8
atcatcaagcataccctggagatcattcatttgctcaccgatgccaaccccatccaggtcgtcgtcgacgcgatcatcaacagtggaccccgtgaggatgccacccgtattggttccgctggtgttgtgaggaggcaggccgtggatatctcacccctgaggagggtgaaccaggccatctacctgctcaccactggtgccagggagagtgctttccggaacatcaaaaccattgccgagtgccttgcagatgagctgatcaacgctgccaagggctcatccaacagttacgccatcaagaagaaggacgagattgagcgtgttgccaaggccaaccgttgaactgagcttgtatcctggtgcactctgcgctggaaacttttatgtcgctggcagtcgtatcggttcttggtttaccaatgtttagagttttttgagacctatatg

SEQ ID NO: 59302 - DNA, 438 bp, Zea mays
  Clone ID: LIB3069-047-Q1-K1-A9
cggacgcgtggggtgaagaggcttctcctgattctcatgaaacgttcaagcatgatagttccttctgtatccagatgcatagtgttgaggaaacacagagtttttctgtgtctatggagacaaaggctgatatcaaaagtgattttgttttctttcagtttgctgtccattattccaatatatatcaaacagaaatcactcgggtgatcactatgaggctgcagactgatgatggtttgtctgcatatctggcaagtgtgcaggaggatgttgcggcagttatcattggtaaaagaactgtattgcgtgccaggactgcctctgatgctattgatatgaggctctcaattgatgaaagagtaaaggacatagctctcaaatttggtagtcaggctcccaaatcaaagctttaccgcttcccaaaagaactagcatcac

SEQ ID NO: 59303 - DNA, 309 bp, Zea mays
  Clone ID: LIB3069-047-Q1-K1-B1
agaccgatgactgtcacactagatgattacatgaatcttgtcacatctaaactgaactgaattgatgacgacatggcccgaatggtcgcttctggaatcattggtaactggcacaacatttttgaataagctgattcacagaattccatgctgacactatttaagtcaagcgtatcggcaaacctacagcgcagaatcacaccgcgtagaatggaatgacgacgaatagggactaacgaatagaattgtctaagcacgtatgcttaaaaggatacaactgaatggatctgagcgcttcaattgattgat

SEQ ID NO: 59304 - DNA, 452 bp, Zea mays
  Clone ID: LIB3069-047-Q1-K1-B10
cgctcctcgcgccgacgtcgcgtctgctcctgtacaggtaaggagaggaagagggcgaaatggtgaagcgcaacatcgtcatgcccaacgggcacttcaagaagcactggcagaactatgtcaagacatggctcaaccagcccgcccgcaagcagaggcgccgcatcgctcgtcaaaagaaggctgtgaagatattcccccgcccgactgctggtcctctacgcccgattgttcaatgccagactttaaagtacaacatgaagtcaagggctgggagaggctttacccttgaggagctgaaagctggtggcatgcccaagaagcttgatccaaccattggtatatctgatgatcaccgtcgtaagaacaaatcccttgagggactgcatgccaatgtgcagaggcttaagacatacaatgccaagctggttatctttccaaagcgtgcgcgc

SEQ ID NO: 59305 - DNA, 346 bp, Zea mays
  Clone ID: LIB3069-047-Q1-K1-B11
gcgcggacgcgtgggctcactcccactttactcttatccactgcggactggacgcgtgcgagaggcttgaccgagcagcagcagcagcagcagcgatggcgcctctgaagctgtacgggatgccgctgtgccccaacgtggtgcgcgtggccaccgtgctcaacgagaagggcctcgacttcgagatcgtccccgttgacctcaccaccggcgcccacaagcagtccgacttgctgaccctcaaccctttcggacagatacccgctctcgtccacggagacgaactcctcttctagtgccgtgcgatcaaccggtacatctccagcaagcacgcgtctgagggcac

SEQ ID NO: 59306 - DNA, 408 bp, Zea mays
  Clone ID: LIB3069-047-Q1-K1-B12
cagcgggactgtcgttgggatcaagtgcaatgatggcattgttctgggtgtcgagaagctggtaacctcgaagatgatgctggaggggtcaaatcggaggatccattcagtgcaccggcattcgggcttggttgttgctggtttggcagcagatggcagacaaattgtttcaagggccaaatcagaagctgccagttatgaaaaggtctatggagaacccattcctgtgaaggatttggcagatcgcgtagcaagttatgttcatctttgcacgctgtactggcggcttacaccttttggttgctgcgttattcttggaggttatgatatggatggaccacagctttacatgatagagtcctcaagagcttcctataaatacttaggtgctgcatttgggaaaggaat

SEQ ID NO: 59307 - DNA, 408 bp, Zea mays
  Clone ID: LIB3069-047-Q1-K1-B2
agaccgatgatggtcacctagagatgcaatcatatgtttgctcataaactcaaatcattggcagacgacatggactgcttgatcgactgtggattcattgttgagggggacaacattgtaggcgatggcgtatgacggaattccatgcggataccattaaagtcaagacgttcggcaagcgtacggcgcagaatcgcactgcggacaatggaatgacgacgaatagggactaacgaatggaatggtctaagcacgtgtgctgaaaaggatactgctggacggatctgtaagcatcgattgattgatgatatgcataacttgaaatggatgaccaaggcataggcgaactaagtttgtggcaaagcacatgctgctgcatgaatctacagtaaccgaagcagacgaatc

SEQ ID NO: 59308 - DNA, 377 bp, Zea mays
  Clone ID: LIB3069-047-Q1-K1-B3
ctggacgtccggcagtttcaagtttgaactgcccaccatttcttgctgttgaggcctgcagggagcgcttgggtgtccatccttgtgacaagaggaggagcatcacagagtaccgtgctctcttccctgccattgatttttcgctgatagagagtgacgaagatgttctctgggtaccagatgtcagagaaacctttgagtcactcgcagaaaggggtatgaagttcattgactggctatggacaagagaagagagagagatagccatcgtcacccatagcggtttattaagccataccttgcgcatgtacagcaaaaagtgccatccaacaagtacacaagaagtgagcaagtactttgcaaactgcgagctccgg

SEQ ID NO: 59309 - DNA, 435 bp, Zea mays
  Clone ID: LIB3069-047-Q1-K1-B4
cggacgcgtggggcttcgtacaagctctctgacgccgtcaagaaggcatcccccaagaccaaggctaagccggcaaaggccgtcgctgccaagaccaccgtccccaagccggccaaggccgtcgtcgtcaagtcaaagaatgcagcggctgccaagccaaagaaggccgctgctgctgggaccaagcgcaaagtgcccgagaagaaggtcgtggcgaagccgaagaagtcccccgccgtcaaggccaaggccaagccgaagaccgtgaagtcccctgcctccaagaaggcacggaaagcctccgcatgagatgggttgctctaggtctaagctctgattgtggttggtgtcagctaggtactgtacaaactaagtgtgtgcccaaagtgtctcatgcagcgtgttatgtgcttagcaagttctatctatcagagt

SEQ ID NO: 59310 - DNA, 394 bp, Zea mays
  Clone ID: LIB3069-047-Q1-K1-B5
cccacgcgtccgattttctttgaatgcgttcaacgggaccattgctattgcttgcaaggcctttttccttgccagtcaatataattgtgaatttgaggctctgagcatgtgctagaatgggcatccataatagtaaatataagaaacagtttttagtactaatttattcagtattatccaaagaagaatttagtggaactgttttgagtgtgttgtatagttatgctaattctctcatctatttgcggctcactacaacgatgtttacagtacttcatttctgaacttggttttcaatggaattgcctagcatctgcattgtaatttttcatgctccggtcatctcagattgtgaatacttatgttttctgtaataatcatgggtcattttgac

SEQ ID NO: 59311 - DNA, 378 bp, Zea mays
  Clone ID: LIB3069-047-Q1-K1-A2
aatcctactgtcccgctaggattacgtgcttaccctattccaaaacctcacagcggagaagagcgcaagatgttcgtgtgtgggcaccacggacaccacggccagaacccgacggcgcacgggggcgtgcaccaaaccaccttgaagatcttctgcaaggccgacaaggggtactgcctcacaggacgctactgcaacgtggtgctggcccccgccaacccgcgcgacgagcaccagcactggtacaaggacatgcgcttcagcacccatgtcaaggacgaggagggcaaccctgcgttcgacctggtcaacaaggccactgggctcgtcatcaagcactccctcggtcagtcccacctcgtgaagctggtgccgttc

SEQ ID NO: 59312 - DNA, 178 bp, Zea mays
  Clone ID: LIB3069-046-Q1-K1-F12
cccacgcgtccggagcattccatcaattttcaatttcgtcccccaaaaaaagcggacgttaaattttaattggggaagctaatacaaataaccaatacaacaacaaatactataatcaactcatgtgacatctaaaatactatcttcttcccataatttttttttatcaaactttata

SEQ ID NO: 59313 - DNA, 381 bp, Zea mays
  Clone ID: LIB3069-046-Q1-K1-F3
cggacgcgtggggtaatttcaggccgcttgtcctttcttgcgttttccttccttgcctggtcgttccgaaaccccgcaccttccccatttcatttcccccgcagagtagtagttttttactggaatttgtaccggaaccagggcttaatggatgctgtttgcttgttagttcagcttcaccaatttctcaacagtgtgtttgttcttctccaggacagtagaaaggaaaggagaaaagcttgttgtgtctgtgtgtgagctgcagaccccgagaggatggatcagtatgaggtgctggagcagattgggaaaggagcatttggttctgcactcttggtgaggcacaaggccgagaagaagaagtatgtgctcaagaagata

SEQ ID NO: 59314 - DNA, 280 bp, Zea mays
  Clone ID: LIB3069-046-Q1-K1-F4
ggaattccgggcgaccagcgttcgccagcgttcgccagcgttcgttggtcctgtgaggaccctccatcatattaagagaagaccagcagcatctatcattgtctgctcaacccgggagtggcactttagcttcataccagcacctgtggtagctgctccagctgcagtctctgccaaagaggacttctttcctgttttggaagccccccagaccagcaagcgcaccaagtcaaaagcatctgatatctgtgcccagaccgagaacaactctgttatagta

SEQ ID NO: 59315 - DNA, 321 bp, Zea mays
  unsure at all n locations
  Clone ID: LIB3069-046-Q1-K1-F5
gcggggctcgggtgcncccttcgctgcccttccccctccgcgtccccggctccccggtggccgccgctccaccgctgcccacggcgcggcccgcccgggcctncccgctccctcctgccgcccgcgcggcgtttcaagcccctagacatgaagaagggacatagtaggaactcaccgaagaccttcagctcatctggacactcgggggttaaactaaacaacgaaggtctcgtcaacgacaggctcctaataaattgtggagaggatcaagattgtgtgctcggtggcatagttgccctgggaaagtttgatgctctccac

SEQ ID NO: 59316 - DNA, 375 bp, Zea mays
  unsure at all n locations
  Clone ID: LIB3069-046-Q1-K1-F6
tcgcccacgcgttcgnttngaccgtgttatggagaagagaatcccggaggtcgtcgcggacgcggtggcctttcgcgaagagctccgccgccacttcgagcgcctgccgctgagctacgccgtcgatgtgaacgtcgacaaggcggaggacgtgctgctgcaccggaggattctcaacgagtgcgctcaccctgaaaatcgccccatcttccatgtgggctttctgaactgcattccgccctcggtggatccacagtataacactcaattcatctctacgagcgaaaacagtaattgtgggggttctcaggattccactttgagaaaatttgagccatgcgaagggatcgaggacctcagtttaactggacaaaa

SEQ ID NO: 59317 - DNA, 368 bp, Zea mays
  Clone ID: LIB3069-046-Q1-K1-G1
atctcctcggccgacacgtgctgaggccactgacgttgcaaatgccgttcttgatggaactgactgtgtcatgctcagcggagagagtgccgctggagcctaccccgaggtggctgtgaagatcatggctcgtatttgcatcgaggcagaatcttccctggaccacgaggcagttttcaaggccatgatcaggtccgcgcctcttccaatgagccctctggagtcccttgcatcatctgctgtgaggactggcaacaaggccaaggctgcactgattgtcgtcctgactcgcggtggcaccacggccaaactggtcgccaagtaccgccccagggtccccatcctctccgttgtcgtacccgtgctta

SEQ ID NO: 59318 - DNA, 356 bp, Zea mays
  Clone ID: LIB3069-046-Q1-K1-G10
atcacgagtctctcagcgagtgctggagagcccactatgtccgccgccggcggcgacgtgccggagactgtggaggtgacgctgcgcgccgtcggcccgtcccgtccaaccaccctccgcctccctccgcttctctcggtcgccgagctgcgcggctgcatcgcgcgcgaacgccgtctagcaggcacggaagaagttcgactccgcttgatcctgcgggggaagacgctcccgcaccaagacgacagccatgtcactctccgcgatggggatactcttatagtcgccgtggcacctaagcctcctgttaatcatcttcttgatgatgacgttgaggacgaagaagaggatgaact

SEQ ID NO: 59319 - DNA, 346 bp, Zea mays
  Clone ID: LIB3069-046-Q1-K1-G11
acgcgtccggtttattctgagaacaacccttatgtgtgtcaccctaatccaatgcaagaaggacaggagctcttccgcaagggcctgttaagtgaacctgttcttgctttagaggctgaagttttgaagaatcctgataatgcttaaggttggaggttgttaggcataacacatgcagaaaatgatgatgaccaacaggccattgcatcaatgatgcttgcgttggaagctaatccgacaaaccttgaagatcttcttgctcttggtgttagtcacacaaatgaattgtagcacggagaagcattaaggtatctttataggttgcttcagaatcatccaaaatatg

SEQ ID NO: 59320 - DNA, 379 bp, Zea mays
  unsure at all n locations
  Clone ID: LIB3069-046-Q1-K1-G12
gcgagcgagaaacgaacttgagcgatagatagaatctcacaccgcaaccgagaaacaagcgaactcgacaaaaagattcagggaggctcttgctacatggccattgcggcgcggctgctgcgagcaaccgaggtgagatatcgattactatctgcttcccatggtttcggccagcgagctgcatacacagatggtgggatagtcgatgttggccaaccaacaccccagtctcatccagagttattagctgatggagagatcacaccaggcatcacaaacgaggaatacatctctagaagaaaaaaacttttagaggtgctaccagagaagagcttggccattattgcttctgctgatcagcanatgatgactgatgtag

SEQ ID NO: 59321 - DNA, 294 bp, Zea mays
  Clone ID: LIB3069-046-Q1-K1-G5
cgcatggtcagcactgcctttgcacggatttggatccgagtctagcggcatggcggatctcgccggcgagcctgtggcgaggaccaacagcgatggcggcggcggcggcagcaaggactcgggcagcttcgagtgcaacatctgcctggacctggcgcaggaccccgtggtcaccctatgcggccacctcttctgctggccctgcctctacgagtggctccacgttcacgcgcactctcaggagtgtcccgtctgcaaagccgtcgtcgaggaggggaaactcgtccccctcta

SEQ ID NO: 59322 - DNA, 372 bp, Zea mays
  Clone ID: LIB3069-046-Q1-K1-G7
cagcgtcgagagctggccaagatgaaagacctaagggggtctcaaaggtgaagactgcctagaccattggctagctcttttgttgaggactcgctttctccacaaagcttctcgcagctcaggagttgcggcttcccaggcttccagctcctaaaatgtacttattcacgtaccaagggatttgatctgccgtaagtattatgcgagatttgttccaccatttacgatcaactgtatagttctaaagatcccctcaaccaacatgctgcggatttgaagggcaatcatcaggaacatgtccgcatgaaacgtatgcaagagtgagatgccaaatcagatgatgacgtttcaaaaggtgaaagacatttttgt

SEQ ID NO: 59323 - DNA, 342 bp, Zea mays
  Clone ID: LIB3069-046-Q1-K1-G8
tctacacataccggatcataaaatctaccgttttattgatgatccagagcttcagctgtcgacaataagtgatggtgatcatcttgcagtttataagctcccaaagttggaaaagagggtgaattacattcagtttgtgcatcgtcatgaagatctggaccatggaaacaataacagcttgacatcttggaaaccgtaccgtgttcctcttcttgcacaaatttcttgcaatgaaattgtcacgggttttgatatccatgagttggtccataaaatgcttgtgcccgtgctaaagaattcggactctctgcatttggctggtcaaagttctgttttcacaag

SEQ ID NO: 59324 - DNA, 385 bp, Zea mays
  Clone ID: LIB3069-046-Q1-K1-H1
cccacgcgtccgatgttttcgctcttcttactggatatcatgatccacctgctggtgttcagattcgtgagggtctgcactacaatccctacttccctggtggtgccatagccatgccgaagatgcttaatgatggagctgttgagtatgaagatggtacacctgcaactgaagcccagatgggtaaggatgtcgtatcattcctttcgtgggcagctgagcctgagatggaagagagaaagctgatgggagtgaaatggatctttctactatcactagcgcttctccaagctgcctactaccgccgcatgaggtggtcagtcttgaagtcccgaaagctggtcctggatgtcgtcaactaaggactatcattacccttttttta

SEQ ID NO: 59325 - DNA, 379 bp, Zea mays
  Clone ID: LIB3069-046-Q1-K1-H12
cgaagacgaggaccgcagcctggacctactggcccggttcctgcactccgtatgtaagaaggcctcacgccgcgcgcgccgcgctgccaggtccgtgctgccgccttccgtccccgccgagctggtgaagttttcggtcaatggcgtgcttgtcctgacgttcttatggatcctgaagggtcttctcgaggtggtctgcacatttggaagcatggtgtttgcaagcatccttcttgttcgtggtatatggtctggggtgacatacatcagagaaaaccgttacagctatattcaccggatcgacaacgatgagaaccgatggagcagagtccagactggctgttaatattttgctttccttatctatgaacagacacac

SEQ ID NO: 59326 - DNA, 191 bp, Zea mays
  Clone ID: LIB3069-046-Q1-K1-H6
gggtgaggaaagtcagggactacttcagctatgtgacgtacgctacactgcatgagtgagctgtgtcggcatgagtaggagacaagtgcctcgatagtattttggctaattgttccagtactgtattcatgatgtgcacactgctctgtactactggtgtgcatgtgattgttgtacattatttgctcttc

SEQ ID NO: 59327 - DNA, 72 bp, Zea mays
  unsure at all n locations
  Clone ID: LIB3069-046-Q1-K1-H9
aaaaaaaaaaaaaaattaaattttaattttctaaaaaaaaaaaaaaaannggggggaatgtaaaaaataaaa

SEQ ID NO: 59328 - DNA, 222 bp, Zea mays
  Clone ID: LIB3069-047-Q1-K1-A10
gcgcccacgcgtccgaagaataagataagaccattttaagaggaaacaaacaaaaataagaaatagctaatgaggtcaaaggcgtaggtgctgaatagacattgatgatcttgcgtgcgtttagacacaaaggctgatatctacagtcgtttgaattgatttcattttgcttgagcctcattttaatacatttgaaatggcgatgctctaggatgaactcta

SEQ ID NO: 59329 - DNA, 372 bp, Zea mays
  unsure at all n locations
  Clone ID: LIB3069-046-Q1-K1-F11
ggagagagatctcgatccgcacaccttatgcctctcttcctctcgccccaaggacaacgaaaacatcaaacgagagaacgaaaggaaacagagcaagagcatcgctctcgaagcaaaacgcgcaccacgccgtcgccggccggccacttcgcacgtacgtaagacgcgcacgcaccggtgcatatatggggctcctgaaccagctgtgggacgacacggtggccgggccgcgcccggactccggcctcggcaagctccgcaagtacgcctccttctccccctcgtcgtcgtcntccgcggcggtggcggctgcngctgctgctggctccgcgccgcctccgggcgccgtgacgcggagcttgaccatgctgc

SEQ ID NO: 59330 - DNA, 337 bp, Zea mays
  Clone ID: LIB3069-047-Q1-K1-A11
cgacccacgcgtgagccaagccttccgcccacgcgtccgcccacgcttacgaccatatgggatggccatatggcctcccagtgagactgctcaatcgagcgatgcgctcaagacattctgagatacatgggatacctcaaggctgtctggcacgtcagcactctctattgcgcagttacaaagatgcaggttccaaactcagatggcgctatcacttgccgaccagctgcaaggctgctaccaacttaatggcacgtcagatgccgctaaagtggaatatgctggccaatggtcgcgtctcatctacatagcactagccagaaagccttattgattc

SEQ ID NO: 59331 - DNA, 448 bp, Zea mays
  unsure at all n locations
  Clone ID: LIB3069-047-Q1-K1-A12
caagaccgcggagaacttccgcgcgctgtgcacgggcgagaagggcgtgggcaagtccgggaagccgctgcactacaagggctccaccttccaccgcgtcatccccgagttcatgtgccagggcggcgacttcacccgcggcaacggcaccggcggcgagtccatctacggcgagaagttccccgacgagaagttcgtgcgcaagcacaccgcccccggtgtgctctccatggccaacgccgggcccaacaccaacggctcccagttcttcatctgcaccgtcgcgaccccttggctcgacggcaagcacgtcgtcttcggccaggtcgtcgagggcatggacgtcgtcaaggccatcgagaaggtgggcacccgcaacggctccacctncaaggtggtcaaggtcgctgactgcggacagctctcctagatctctctgatctggtct

SEQ ID NO: 59332 - DNA, 395 bp, Zea mays
  Clone ID: LIB3069-046-Q1-K1-D10
cacaaacgccggcgcaaactctcgccctttcccgacagatcttcaattccccggtctcgccaccgatcgaccttcacgccagtctccgtctcttccgaaagcgtcgcgcgcggttgtttgagaggagaggaggaagatgagggagtgcatctccgtccacatcgggcaggccggcatccaagtcggcaacgcgtgctgggaactttactgcctcgagcacggcatccagcctgatggccaagtgcctggagataagaccgcgggacatcacgatgatgccttcagcaccttcttcagccagactggtgcttggaagcacgtttcccgtgcaatcttcgttgatctagaacccactgtgatcgatgaggtgcgcactggcacgtaccggcagcttt

SEQ ID NO: 59333 - DNA, 399 bp, Zea mays
  unsure at all n locations
  Clone ID: LIB3069-046-Q1-K1-D12
cccacgcgtccgcccacgcgttcgcccacgcgtncgcccacgcgtccgaagggtatcaagtttgcccacgggaactaggcaccttgcccggcttctaacaattgatgccccttgcatttttgtttgactgcctatttttcctgccccccgtatggttggggcaatgaggcgtagtggtcgataataaaacccagcggaacaaagaaaacgtgtaccagaaactgtttgcaaacaccggtgcctttttttgtgttgaaccaccattagttgagccgtgaaggaatggtgaacaagctttccacttgctcatttccgagcgcttctctttgattgtatccatggtttggactcatgactgtacgtcttggcagttggcttggcacccaggaatctaatcac

SEQ ID NO: 59334 - DNA, 406 bp, Zea mays
  Clone ID: LIB3069-046-Q1-K1-D2
aatgtctgctgctggtaggactgttgagactgtgctgtacttggctggtttgggcaatgtcaaaacaaaggtgtgattcttgagtcccagctatcactatcagtcctttttcaaaattgtgatttcctttctattttttcttctgcagattatcggatcaaggaacccacttaatgtgattaaagctctcttcatagctttgaatgctgtatgtgcccatttcttgctcaaaatctgcccaattcaatctcctcatccttgatatttatttgtttatagatcatcttctctaatttatcaatcattttgcttccagattgaaactcctaaggatgtccaacagaagtttgggcgtactgtcgtcgagtcatatttattgtgatcatcatggttgtttggaggacac

SEQ ID NO: 59335 - DNA, 370 bp, Zea mays
  Clone ID: LIB3069-046-Q1-K1-D3
cgaggtaggggaggttcggctgtgaacaagttccgcatgtcactgggtctacgcggggcggccacggtgaactgcgcggacaacacgggcgccaagaacctctacatcatctccgtcaagggcatcaagggccgcctcaaccgcctaccgtccgcctgtgtcggcgacatggtcatggccaccgtaaagaagggaaagcccgacctcaggaagaaagtgatgcccgccgtcatcgtccgccagcgcaagccgtggcgtctcaaggacggtgtctacatgtacttcgaagataatgctggagtgattgtgaatcccaagggtgagatgaaaggttctgcaatcactggacctatcggcaaggagtgtgctg

SEQ ID NO: 59336 - DNA, 223 bp, Zea mays
  Clone ID: LIB3069-046-Q1-K1-D6
gttcgaccccaccgccgacttccacacctactccatcctctggaaccccaagcacgtcatcttcatggtggacgacatgcccatcaaggacttccgcaacctggagagcaagggggtggcgttccccaagagccagccgatgcggctctactccagcctgtggaacgcggacgactgggcgacgcatggcgggcgcgtcaagacggactggtcccacgccccc

SEQ ID NO: 59337 - DNA, 252 bp, Zea mays
  Clone ID: LIB3069-046-Q1-K1-D8
agtgatgatgataattcaacccagcccgatgaatattcaaaaatcgaagagaatggcgatgaggaagaacatatcagtgcttctgaatcaatagacacagataagaatgcagacaaagaattgcttgtggctgctagacccaaaaccaaggtcaagaaactttgcaaaagaatacttcgtcaggccccatctcagtcaatgaaattgaaagatcttaaggtcgccgttgaggaacactcaaatgttgtattt

SEQ ID NO: 59338 - DNA, 406 bp, Zea mays
  unsure at all n locations
  Clone ID: LIB3069-046-Q1-K1-E1
cccacgcgtccgcggacgcgttggcggtgctcatcctgtgccacttcaacagcgattggaggctaagctcgcagggggagctctggagttggacgctgttctttgctggtgtcacggctgttggatttggttcttcctattatcatctcaacccgaatgacgccaccctagtttgggacagactgccaatgacgattgctttcacttctgtcatggctatattcattattgaaagggttgatgatagagcaggggcaaaatcccttgcaccacttgtgattgcgggtgccttgagcatcatgtattggagacactntgatgatcttcgcccgtacgcagtagttcagtttgttccatgcattgctttacctgtgatggctatagtaatttcaccgatgtatacaca

SEQ ID NO: 59339 - DNA, 417 bp, Zea mays
  Clone ID: LIB3069-046-Q1-K1-E10
cggacgcgtgggcgccgccgtcaccgtcgtcgctcgcgctctccgcccggaggggagcgagagtaggggcgtgtcggcggtgaaagcgactgcgtcagccatggcggacgaggagcattcggagaggagagaggaggcctccgagcttgcccccttcgacccgaccaagaagaagaaaaagaagaaggttgtcatccaagaaccttctgatgaagtggacaagcttgcagagaagacagaaacactggcagtcgcagaacccgctgaacttaacttcactggaatgaagaagaaaaagaagaagccggtggatcttgattcaactcttgatgagcttggagatggggaggacactcaagatgatcaagctgtagaggaacaaggggaaggcattgtgctgggaagtgtccctacata

SEQ ID NO: 59340 - DNA, 228 bp, Zea mays
  unsure at all n locations
  Clone ID: LIB3069-046-Q1-K1-E11
tttttttttttttttttttnntnnganttnttntttttgtttttgtaaaattttaaatggtttaaagaaaaaaaaattttaaatttttttttttttttnnngaaaaaaaagnnnaaaaaaaaaaaaaatttttttaaaaatttttcccttgtaggaggttgaaattaaaaaaaaagcatggtggaaaaaaaaaaaaaaaaattttaaaaatgaccccctctttctttt

SEQ ID NO: 59341 - DNA, 381 bp, Zea mays
  unsure at all n locations
  Clone ID: LIB3069-046-Q1-K1-E2
ctcgaatggtcgaacagtagtttgctcgctattatccatggcgacttctacggctgctgccactgcactgctccgccccaggccggcagttccagccaagaggaggtgcctccatgcggttgctgggtggacgacgatgaggaggaggggagctgcangggtcgtgcgagctttcttcaaccctctcggggatgagcgcatcctccgagaagccatcaaggagccagtagcattcatgggtggtgtgtttgctggcctcttgaggcttgacctgaatgaagatcctctcaaggaatggataagtcggacagtggaggcttctggaatagctgaggaaaacagctctgaagaatcaagtgaggcagatcaaaatgatgcacc

SEQ ID NO: 59342 - DNA, 447 bp, Zea mays
  unsure at all n locations
  Clone ID: LIB3069-046-Q1-K1-E3
ctcaaatnttcaaactctagttttctcttatataacccacgccaacanaaacggggctcggttaatttactagtgtgccccgacaccnacaaaaccacccaatattaacttccttcattcttattctatttttactaccataattactatttaacctgttattttcttcctaactttctttaacacttttattgattatctctttctcttataaaccaatctattttccattttcaatcattaatatttatttttttttatttattaaatttttatatttttttttattaattttattttatttaatattttttttttcccttttttatttattttatttaatttaaatttttttttattttattttattcttttttttattataatattttaattttattcttttattatattttttttctatttatataattttttttctttttt

SEQ ID NO: 59343 - DNA, 353 bp, Zea mays
  Clone ID: LIB3069-046-Q1-K1-E4
gacgaagcgaaagacaaagcttttgagttggagttgagctggatctgtgatgaatcggagcgtcagcatcagaagggtccaaatgaactgttggagcaagccaaagctgctgctcaagcagctcttgaggagatggatgctgactaagaaacaagacgatttgcccagacttggtgtttttggtgctgttgaaatctccgatccctttggggtgacccactggacatggccaatttgtcacaatttattattttgacccatgtcatgtgaaactcctttcgttgaagtctggtatctagattgacttgtatcagagctgtggtttacgcaaactggattctggagtactggac

SEQ ID NO: 59344 - DNA, 354 bp, Zea mays
  Clone ID: LIB3069-046-Q1-K1-E5
gacagatatttctaatagccttttggttactacactcctgattcttatcaagggtgcacggctctcaagctgatctttatcatgtgatgatatatatgttcctgatcctgctgagactgagaaaatcaactgtttggggccaaaagaacttcaatatgtgttacttctggcttgatcgctgtcaggatgctcttcccaaaaccttttatctgaaaaacttcataggagagattcaggtcacacttatcgttctaggacatctgaaatggatccagattctgacctgattcgccgagcacgtatgatgatttcaattcagcgagttttgtgcatcaatgatacatccattgagtt

SEQ ID NO: 59345 - DNA, 358 bp, Zea mays
  unsure at all n locations
  Clone ID: LIB3069-046-Q1-K1-E6
cccacgcgtncgggccattgctcttcttgatcccctcacgctgcgagtgcaccacctggaggagaaaaaatacagggtttataatttcaaagcagctctcaccagcaagcagctcgtggagtacattgtgcttgacattgaaacagaatcgcctgaaatttgcatcgatgggtctcggtaccagttggcttatgcgcaggttgcccggatgtcagatttcgggaagaatgacgccatctttactgtgaggacgcatcttgggcatctgctgaatcctggcgatcacgcccttgggtatgatctgtatggtgccaacctgaatgatgatgacatggacatggctatgacccggtacagc

SEQ ID NO: 59346 - DNA, 392 bp, Zea mays
  unsure at all n locations
  Clone ID: LIB3069-046-Q1-K1-F1
ggattccggtcctattgtgttggccttcgggatcggttccaacaccagccgccgtcatgtcnaagcgaggtaggggaggttcggctgggaacaagttccgcatgtcactgggtctaccggtggcggccacggtgaactgcgcggacaacacgggcgccaagaacctctacatcatctccgtcaagggcatcaagggccgcctcaaccgcctcccgtccgcctgtgtcggcgacatggtcatggccaccgtaaagaagggaaagcccgacctcaggaagaaagtgatgcccgccgtcatcgtccgccagcgcaagccgtggcgtcgcaaggacggtgtctacatgtacttcgaagataatgctggagtgattgtgaatcccaagggtgagatg

SEQ ID NO: 59347 - DNA, 382 bp, Zea mays
  Clone ID: LIB3069-046-Q1-K1-F10
gccaaatttacagcagagagctataaaagctctagctaaccttgcaatagctgggccggatacgattgccaaggagggtggtgtttttgagttgtctaaagtgttgttgcaatctgacccgcctttgccgcatgttgtgtgggaatctgcagcatctgtattgtctagcattctacagtacagtactgagtttttccttgaggtacctgttgcagtactagtgcaattgctcaggtcaggaactgaaagcactgttgtcggtgctttgaatgcccttcttgtattggagagtgatgactcaacaagtgcagaagcaatggctgaaagtggtgctgtggaagcattgcttgatctcctgaggagtcatcagtgtgaagaaact

SEQ ID NO: 59348 - DNA, 397 bp, Zea mays
  Clone ID: LIB3069-046-Q1-K1-D1
gctggacgatctcaaacatcacagctggtaacaaggagcagattcaggctgtgatcaatgcaaatataattgcacctctggtgcaactcctgcaaactgctgaatttgacatcaagaaagaagcagcctgggcaatttcaaatgccacttctggtggcacacatgatcagatcaagtaccttgttgcccagggttgcattaagccactctgtgatctgcttgtttgcccggatcccagaatcgtaacagtttgcttggagggtctcgagaacatcctgaaggttggcgaggcagagaaaaaccttggtgcaagtgatgtcaatgtctatgcacagatgattgatgatgctgagggcctggacaagattgagaacctgcagagccatgacaacaccga

SEQ ID NO: 59349 - DNA, 486 bp, Zea mays
  unsure at all n locations
  Clone ID: LIB3069-027-Q1-K1-F3
tttgggctgatttatgtgcttggccggacttcggtctagaaggaatgtcagtcacacgtccaatatacgtaagctgaatgcggggcctggggagtcgggtagaaggaaaagaggtcttcagtcaaagccgctctgtttcgttcgtagggtgtgtgtaatggtcccgattcaatggttcttgcccgtcggaactggaacagccgagaataaagcggtgaatgggcgtgcaatgtgcgggaactcgttgaatagcctgggttaaacttcgaagaaagtctaaaagtgtcgcccgacgagttcgtgcagcaccaggcagccggctaggcaaaggtcgattaagttaacgacgtccagtcggctcccctggacgactagttatatcgggatcgagatatggtttggatctttatggngggtagtagcggggaactccggataacgggtgaaagtttgacttagtaacactgtgcgagcgaagaagggtac

SEQ ID NO: 59350 - DNA, 477 bp, Zea mays
  Clone ID: LIB3069-027-Q1-K1-F4
ctttgggctgatttatgtgcttgtatagatataagctgctgcaggtagtgagtcctctcttctctttatgtactgtgttaagggagagagagagactgttgtcttttcctctggtgctggcggcgtgggcgtttctttcttctgagtgagactcgctcggctatagactcactcgataaaacggcgaagactcgtcgtactggcgtcggtcacgctggcggtttaattacggttgctaccgtttctaagcgtttagataccgaagctgctgctgccgatactcttaagttttgtaccgaggttcggaatagcgatatttcgttaactcatgagttcggctctgacgacgccgcgaagtagcgtaggggtaggaattctcctcctagtatcgacgccgagaagtatgctgtcgaggtcgataccactcccgctctggcgaatatttttattaagatttgcgggtccggagtcggtaag

SEQ ID NO: 59351 - DNA, 484 bp, Zea mays
  Clone ID: LIB3069-027-Q1-K1-F6
aacctttgggctgatttatgtgcttgtgcgccttctcgccccgttagggttaattccgttaatgggctgagccgaattaatgttagcatgagagaagaggggccggggaggcagatgagcggtgcagggaatctggctgcggggtggcagagcgagtgagcgagagagaggtagggtcgctatgagtgcgggtaggtgactgtgggagtgacgatgatggtggttggtacgttggggccgttggcgggtctggttgttgtggtcggggcctttgtggtgtttgaggcggtggctagggatgtggcgactggtcggccttgtggtgagcctgtagttgtctcagaggacttaagtccatgcatgtgcgtacgtgatgctacagtctcctcacagcgctattcaaacctaacctatcggttgctgccccataatgctgcgatcgggaaaatttcggtgccatttaatccaactgttccgtagtata

SEQ ID NO: 59352 - DNA, 416 bp, Zea mays
  Clone ID: LIB3069-027-Q1-K1-F7
ctttgggctgatttatgtgcttggaaagacccacctacgctgggccctgcccccacaactaatctagtccgcgctcgtactcggggcagttcgagtcctcgaccagccaccaacccaccctagcttgccggactccgtgcttcggcacagctcgcgaaaggccctgatggagacctacccggacccacccaacagctcggacgacaaaaaaaatacaagataaaaaaaaaagggtggttgtctcagaggacttaagtccatgcatgtgcgtacgtgatgctacagtctcctcacagcgctattcaaacctaacctatcggttgctgccccataatgctgcgatcgggaaaatttcggtgccatttaatccaactgttccgtagtatactttttccctgttagtcgggtgcacagtg

SEQ ID NO: 59353 - DNA, 365 bp, Zea mays
  Clone ID: LIB3069-027-Q1-K1-F8
atttatgtgcttggaaagacccacctacgctcggccctgcctctaccactaatctaatccgcgctcgtactcagcgcacctcaaatccgcgagggggcaccaaaccaccctaactttcccgactccctgcttcggcacaactcgccaaaagccattattgagatctacccggacccactcaacaacttcgacgactaaaaaaaaacctattaaaaacaaaagggttgctttctcaaaagaattaaatccatgcatctccgtaccttattctacagtctcctcacagcgctattcatacctaacctatcggtatgtcccccataatcctccgatcgcgaaaatttcgcttccatttaatccaactc

SEQ ID NO: 59354 - DNA, 274 bp, Zea mays
  Clone ID: LIB3069-027-Q1-K1-F9
cccacgcgtccggtacaagtgagccaagtttcgtgccctgcagcgcgaggttagctgctggaagggagcgtagaaaggcgagattagctgtgggattgtgttgggcttgtcgtgttttcttttgcgttctttcctagtcattgctgttgcgcttttgtatttgtcggacccgtaactaccagggctctgctattagcggcacggagcctgtaattgtattgtatgataatgtgatcgagggtgctacttcccctcggcattcctagtgttggtt

SEQ ID NO: 59355 - DNA, 449 bp, Zea mays
  Clone ID: LIB3069-027-Q1-K1-G1
tttgggctgatttatgtgcttgtaatagtaatggtagtacccgttccgatacctccaaggaatagcggagcttcgtcccaatcgctctaaaggcctcttcgctaactcgtctatcgtctatggatttaaatttcgacgacttctccgctttcgagaccgtctatacgcataagattgatagggttaagcacgagcttattgtatgtcttcggatatagaagcacgttacgggtcagaagtaaggtcaaaagtcggttaaatcggcgaacgcgttggattttaaactgccactattcaaacaattagctaagctgtaagcacgaacggatccccgaggattaccgcgtttcgccgaatctacgcaccattccgcgaaaaaaaaaaaaaaaaaaaacacaaaaaaaaaaaaagggtggttgtctcagaggacttaagtccatgcatgtgcg

SEQ ID NO: 59356 - DNA, 297 bp, Zea mays
  unsure at all n locations
  Clone ID: LIB3069-027-Q1-K1-G10
ccaccgcgggatcctcctcgacaccgcacgttactactaccccgtccgtgacatcctccggaccatccgcgccatggcctccaacaagctcaatgtattccactggcacatcaccgactcccagtccttccccatcgtcctcccctcggtccccaatctcgccaacttcggctcctactnccccgtcatgcgctacaccgaccaggacgtccgccgcatcgtccgatacgccggggcctttggcatcgcgttaatccttgaatcgacatgcccgggcacacggggtcctgggccggc

SEQ ID NO: 59357 - DNA, 388 bp, Zea mays
  unsure at all n locations
  Clone ID: LIB3069-027-Q1-K1-G11
cccacgcgtccggcgccgcgcgagcacgttttgcgccggtgcggcaggcgaaatccgagagcactccggccccgctacgccgcaccgcccatggccgcagctagccgcagatagagagaggcgcaggcgagggcgtgcagatccagatccggtgggcgggaaggacttgatcgcccccaccaccatggccggcgcggtgtcggcgctcttcctgctggacatgaagggccgcgttctcgtctggcgcgactaccgcggcgatgtctccgcgctccaggccgagcgcttcttcaccaagctcctcgacaaggagggcgattcggaagtgcactcgcctgtggtctacgacgacgctggcgtcacttacatgttcatncagcacaacaat

SEQ ID NO: 59358 - DNA, 218 bp, Zea mays
  Clone ID: LIB3069-027-Q1-K1-G12
agcatacagacgaataatctctacttcactttactaacaccagctagcaactctttctcggctgcaggaatggccgctcgctcctactcctaccagccgcagctggtcgcagccgctgaggtactggcagcggagctgatgctgctggcggcggcggccgagacagcgtccgagctgtgagctgcagacaggtgacgtcgtcagaggcgccgagcctc

SEQ ID NO: 59359 - DNA, 483 bp, Zea mays
  Clone ID: LIB3069-027-Q1-K1-G2
ctttgggctgatttatgtgcttgtttatgtgcttgtttatgtgcttgtttatccccctgtggatgtgcgggcacatcgtcctgggcgcgcgcggcccgcgggcggctcgctcgccccttaccctcactctacgagtattaattagataattcacgagaatcctagacactgtcacgactggtgggttaatttgcataatacagggactccgaataatcctacggagacacctcgtattgtagctttcttccttaagaataatccttgagttagggctttagcagagtaaggcccatagtaactgtgcgtgttagtaaggggccctacgagctcaaatacggacaaattcgccggggatcctgaaccgagcaggaagttagcactacgggacgaattctggctagtagtcgacactagggatccggagggcggctcagggggctcatcggatgagaaagaaggtaggacagtttacgtgccttt

SEQ ID NO: 59360 - DNA, 412 bp, Zea mays
  unsure at all n locations
  Clone ID: LIB3069-027-Q1-K1-G3
ctttgggctgatttatgtgcttgattattgtcgtactggctctgattttcgaactctgttgttatccgtcctcccgacccgaccgtgcctggcctgcctggcgttttctttgcttcggactcgccgtgtgagagtgtggtagtgtgtgagacctgtttttcctctcctcttcaggaagtaggaagtaagttgattgtctgtcgagtgttgntgttgacggttgctgtggcgttgacgaagtctcggagggcggagatttgtggtaaggttgttgttgtggcgtttgatgatttttcgtgtgcttcggcgatggcgattgcgtctgggagtgttggtttgccgtgtcctactgcttctgagggtgatatggctgttgtgtctacttgtggtgtgtcgtgtcgtcatgtttgtg

SEQ ID NO: 59361 - DNA, 471 bp, Zea mays
  Clone ID: LIB3069-027-Q1-K1-G5
tggctcggaacctttgggctgatttatgtgcttgtttatgtgcttggactcatagtcggttagccgcgggctaacggcgatctttaagtagcatgaaaactcccggccatagaaatttcgctaagggtaacgtagagaatcgctttttagttcgtagcgaaggctatatgctgggtcgacttttagtcactcgccaaggtgttggccggaagactcgattcattcttaaagcccctgggaagcgcgggtttcctattcgtcagagcgattggaagaccccgcttcgtattcgccaagatgtaatagagaaccgagtacttattccttacggcgctatagagagccgacttctaggtgaaggcgctatagaaggaaacgggactcgtcgcccgttcgttataagtcttatacttcttcgccccgtagaaatttaaggatccgttcgccttcaaatagtgggagttcactaat

SEQ ID NO: 59362 - DNA, 436 bp, Zea mays
  Clone ID: LIB3069-027-Q1-K1-G6
aaccattgggctgatttatgtgcttgtatgtatgcctgctcaaagtccgactaccccgaggatcagatgtagaggttagctgagggggaatccacacccgaggggactgctacgcttactaacgaagcctaccgcgataaaccctataaagcgccgacgctcgactatccctcgcatctactgcgtccttccgcgatccctacgcacggacgtattcataataccgagaggactacgaacgtatacgtttcgagggatctgcgtacagcgcgtcatacgcttaataatatgctaacggatactaatttagagaatttcactacggacgaatcatgtatctacgtctctgtcgataagaacgatcagctagctactgactctccaacctcgtcgacttagatcgactcatcgattcatggacctacatcgtacgatt

SEQ ID NO: 59363 - DNA, 499 bp, Zea mays
  Clone ID: LIB3069-027-Q1-K1-G8
gaactttggtctgatttatgtgcttgtccagctatcggctcgactcggttcagtcccgctcgagaggctccaatcgaagatacgggccgagccccgcttctcaggcggacgtcgtcgactaaagtcgtcctatctacaaaatcagtttcatcattagaagtaataccgatacccgtagatcgactagacgaactaaaaccatcttcactaacgctagtacttaaaggagctatcctactatcggctcgattatcccctagcgttattcgccttagttgccttcctcccagccgtctagtcaccttcctgaaggtacaagaacatctaagcgtaccttagatagcgcaagtaaccagtctaagaccgtctctaatacacggacaccccgaccctataacctcccctaaacgcttaatactcgcaggtactcgtcccgtcactctaaccaaagttccacccggtagcacacaattagcatctctactccttcgatgagtca

SEQ ID NO: 59364 - DNA, 422 bp, Zea mays
  unsure at all n locations
  Clone ID: LIB3069-027-Q1-K1-F2
ctttgggctgatttatgtgcttggccgccaattacgcaaggggagatatcgctcaggtttctaatatatgggtgattccaagtgacgacccccgantgctaaagcgctgcttccgtaggctttgggcgtctcctgaccgcgcatggcgaggtcgacgagtcgggttttccttcggcgtacaaggctaagttcgagtctagacggaataatcatcttcggaatatacaggttaattccacgccttcggagcttttggcgggtgctcgtcctcttcatataaatatgagtcctgattcgtcgtaatctcatgataagactattgtcgatcatgtccataagccttcgtctaatcggcctaagaggcctttgtagcataggctttatgatcctcatactgttggtcaaagtcatcttgggtatca

SEQ ID NO: 59365 - DNA, 381 bp, Zea mays
  Clone ID: LIB3069-027-Q1-K1-D4
tggctccgaacctttgggctgatttatgtgcttgtttaggtgcctagaatgctgacgagactactcgtcgttataccggcgattgggtctccaggggggatttcacgaaggttactgataaggagacgggttagaagtatgctttcgctaatactaccggaattaggacccgtgatcgtgatcggtctcatgttgactttgacggtaccatcgcacctaggatggaatctaatgtgcagatagatattcgggcgcacgcgggagcgcacatcgaactcggtgtctccgtcgccgagtttgagtacgtaactacggacatctgtcggactatatacccacatccagtacgactgtacgtccgtccatccggccaaaaagggt

SEQ ID NO: 59366 - DNA, 478 bp, Zea mays
  unsure at all n locations
  Clone ID: LIB3069-027-Q1-K1-D5
tggctcggaacctttgggctgatttatgtgcttgtttatgtgcttgggaggttgtggtggtggcctgggggttgtagggtgctgggatttaggtggggccgtgcttttgtggtcgttgtggtggagtagtctgttgttggccggttattgcggtctgccgtagctgtcggggaggtttcttgtggtcgggtgttgtgttgtgttgatatgcctgagaagtccaacaagacaggactgggtatgcatagtaatgcgcattgggtgagggatattgctctcggttggactgctgtctccaaaaaggcttgtcctgacaattctgagttagaaagtgctaagcccacggtttgggaaacatcgacttcaaggagatctgattattttaatactactaaaccagagggtccggctattcntaggacgctacgtaattccccattccgtcctgagcatacggagtacgactccgtcggctccg

SEQ ID NO: 59367 - DNA, 259 bp, Zea mays
  Clone ID: LIB3069-027-Q1-K1-D6
ttgggctgatttatgtgcttgtttatgtgcttggcctcagactgtgagtgcctgtctcagaggacttaagtccatgcatgtgggtacgtgatgctacagtctcctcacagcgctattcaaacctaacctatcggttgctgccccataatgctgcgatcgggaaaatttcggtgccatttaatccaactgttccgtaatatactttttccctgttagtcggtgcaacagtgaataggtttgcattgactggttcccttaa

SEQ ID NO: 59368 - DNA, 438 bp, Zea mays
  Clone ID: LIB3069-027-Q1-K1-D7
tggctcggaacctttgggctgatttagtgcttgtttgcgcctattaaggctgattagtctaccctgggtatcaatgggtatatttctattgggggggctgctagtgttatttctgcgttgggttgtgtgtgtttgggtgtatttgttggtggtctgctttgtgtgttgtgtactgttgagcgttccgctggggatgagattggtgctactgcacctattgcttgtaatgattaagccgacccgtcgaagtttgacgttatggcgactccgtgtaacgttaaaactgatacgcctaaaggactaacgaggtccgtagcggataaacgggggtggaccgaggtcatagagttagttagtcccatagcgaaggaagataataatccgctttccgcagagcacgaaccggccaatgcggtcgaacaattgctgaagtgccct

SEQ ID NO: 59369 - DNA, 468 bp, Zea mays
  Clone ID: LIB3069-027-Q1-K1-D8
tggctcggaacctttgggctgatttatgtgcttgcgagaaagcatactcctccaaaaaaaaaccccaaaaaaaaaaaaaaaaaaaaaaaaaagaggagaaaccaaaaaagggtggttggctcaaaggacttaagtccatgcatatgcgtacgtgatcctacattctcctcacatcgctattcaaacttaacctatcgtttgattccccataatgctccgatcgggaaaatttcggtgccatttaatccaactgttccctagaatacttttccccttatagtcggtgcaacaatgaaaaggttattattgactgtttcctttaatagccgtgtatttccaacggtaaacgggatatgtttcgcattggtgtaccaagtgtgtgagccgcggcggccatgtgtaatgcgattgacatatccgttagagtttcagtgtttgtcttccctgtccctcctttccttccctctg

SEQ ID NO: 59370 - DNA, 341 bp, Zea mays
  Clone ID: LIB3069-027-Q1-K1-D9
gccaggcgtctggcctagttgctcaaacatttcaacgccgccaagaagcacatcacgacgggtcttacgccagcttcgaaataccatgcctgatgacgtttctacacaccttagaaaactggtgtttcatttggaacccaacatcttgtagctgtactccctcgagatggtattgagcatactgtccagataccgcggctacaaacgcattggtgcaagttatgatgctctagcaatgcatgcaatgaatatagtgatgggaagcactgtcccaaaagctgaatttgttgaccttgaacccactgtcatcgatgaggtgagaactggcacctaccgccagc

SEQ ID NO: 59371 - DNA, 437 bp, Zea mays
  Clone ID: LIB3069-027-Q1-K1-E1
ggtccgaacctttgggctgatttatgtgcttggtacgttatttctgcggtttaccttgctgactgctgtcgccgacgtccgcgcccttccgcggcacagaattccgtccccggcatggggtcgtaacgcggacctgactaaaaaaaaaaaaaaagggtggttgtctcagaggacttaagtccatgcatgtgcgtacgtgatgctacagtctcctcacagcgctattcaaacctaacctatcggttgctgccccataatgctgcgatcgggaaaatttcggtgccatttaatccaactgttccgtagtatacattttccctgttagtcggtgcaacagtgaagaggtttgtattgactgtttcccttaatagccgtgtagttcgaacggtgaacgggatgtgtttcgcagtggtgtaccaagtgtggtgggcgcggcg

SEQ ID NO: 59372 - DNA, 429 bp, Zea mays
  unsure at all n locations
  Clone ID: LIB3069-027-Q1-K1-E10
gccgacccacccgtgcggattgtagccggcgccgctgctcatctcatatccctctagaagacgcctgctcctcgccggtcgataggatggccgtcttctgcgacctccacaccgccgacggcctcaagtccctcgaggctcacctcgccggcaaaacctatgtgtctggtgactccattactaaggatgacattaaggtcttcgccgcggtgccgtcgaagcctggcgctgagtttcctaatgccgcccgctggtacgagaccgtctctgcggctgtagcctcaagattccctggtaaggctgttggtgtaaatctgcctgcgggatcagctcctgcggcagctgctcctgcggatgangctgangatgatgatgaccttgatcttttttgtgatgaaactgatgaggacaagaggcagctgatgagcg

SEQ ID NO: 59373 - DNA, 411 bp, Zea mays
  Clone ID: LIB3069-027-Q1-K1-E12
cccacgcgtccgctctactaatccagcccatttcgaactctctctagacgcttcctcggtgtctctgggcaccgctgccccgtaccgtactcctcttcgcgccgtagaaatggcgctgccgaatcagcagggcgtggattaccccagcttcaagctcgtcatcgttggcgacggtggaactggtaaaaccacatttgtgaaaaggcatcttactggcgagtttgagaagaaatatgagcccaccattggtgttgaagttcaccctctggattttagcactaactgtggcaaaattcgcttttattgctgggacactgctgggcaagaaaagttcggtggccttagggatggctactacattcatggtcagtgtgccatcattatgtttgatgtcacttctaggctgacata

SEQ ID NO: 59374 - DNA, 463 bp, Zea mays
  Clone ID: LIB3069-027-Q1-K1-E2
tgtatgtgcttgagtctgcgtccgtaagccctcaagatcctaccgtcccccgatagggtagggcgaaagcgtcgaaactccctcttacttgaagtcagccgtaattgtaggagacggaaaaaacgaccccggcgacaaaaaactccaagaaggataacgaaccctcgaagggaaaacgcgagaatctagacaccgtctccgcgaagtctaccgaagagtgcgagtcaatgaagaagtaaacagagaaaccgaaaaattaaaaggagatatccgagctttcgcgctgactatcataggtagaaaggaaataaggttgtcatgttagcaccttagatgttttcctcagttaagaagatacgttagtgataagctaagaactccagtacacgcgtccgctaacaccttgccggcgcttgccatagtccgttgggatcctcgaagttcgagacacgaacacgccatc

SEQ ID NO: 59375 - DNA, 101 bp, Zea mays
  Clone ID: LIB3069-027-Q1-K1-E3
tcctacggtggcgcggacttgaagtcatccgacggtggatgagactcatattacgtacacggtgacgaatcagactacgaccgatcatgaaaccgcgacgg

SEQ ID NO: 59376 - DNA, 336 bp, Zea mays
  Clone ID: LIB3069-027-Q1-K1-E4
tttgggctgatttatgtgcttgcccggcctagaggataaaatactaacaaaccactacacggtaatacgcgcaccaaaccgaggttagaaatcgtaaagtctagactactccacccgtaacgcctaatttacatacacaccaatacgcaagtaacccataaggtacttagaatcatcataaagaagtacccaagtagtggcttaataaatcgtttaagtacctaagagctactataattgtgagtaaattccttacaccactagtcaacagcactactaaacgtattagcgtcctaagagttattccagcaataacatacgagatactaagctcat

SEQ ID NO: 59377 - DNA, 384 bp, Zea mays
  Clone ID: LIB3069-027-Q1-K1-E5
tggctcggaacctttgggctgatttatgtgcttgggtaaaaaaaaaaaaaaaaaaaaaaaaaaacaaaaaaaaaaaaaaaaaaaaaaaaaaaaagagaaaaaaaaaaaaaaaaaaaaaaaaaaaaaaaaaaaaggggtggttgccccaaaggacttaagcccatgcatttgcgtacgtaatgctacagtcccctcacagggctattcaaacctaacctatcggttgctgccccataatgctgcgatcggaaaaatttcggtgccatttaatccaactgttccgtagaatacttttccccttttagtcggtgcaacattaaaaaggtttgaattgactgttccctttaatagccgtttagttcgaacggtaaacgggattttttt

SEQ ID NO: 59378 - DNA, 223 bp, Zea mays
  Clone ID: LIB3069-027-Q1-K1-E6
tggctccgaacctttgggctgatttatgtgcttgtatctcttgtcggctatctatctccgtcaccttatttccaatctaactccagctctccaggagtctcaagtctcaatcagttgtgttatcttcctgcgcagttactagttcctctactgttattaacggttatcgttgaagcttagattttgattgctgcggtagttgatgaaatgtttagcgcggaga

SEQ ID NO: 59379 - DNA, 358 bp, Zea mays
  Clone ID: LIB3069-027-Q1-K1-E7
tggttctgctcctaaggcgtgatcgtttccgctgcaccctgcacccatccttaccgccctgggggaggctcctgatctcggggtcgaatgtcagtgtgcagtccgtcgatgataaatctgttctaatccctggcgggccctggaatctcaaccatagtccatataaccgttccggtcaaatcgtccggtcggtatcacccccagctactcgactactcactgcgcgctccgggccaacccggtatgcggaaagtgaccggcctagtgagcccacttcccaagagtaactaagtctaaacgaccagtcctcttctaagactcaaaactacgctcccattcccctcccctcctctacaat

SEQ ID NO: 59380 - DNA, 430 bp, Zea mays
  Clone ID: LIB3069-027-Q1-K1-E8
tttggtctgatttatgtgcttgtctgttgatcccgttgcttatctttttgccctacttgtgttgcctgttgggataggagggagagcacagtattaggacgttggtgatgttgatgactactggtgtttcttcggggtcgggtatttagacgcatctaaatgtctcttgtaagtcttttcatacgtgttacttacgggagtacccgccggggacgggctctggcgtagcgcccgcgaattagtcggcaaaggccgacgagaagtctaaggaggattctgataagacgtccgagtgtgttaggtcagttaatgagtagtgtcataccggggaatcgtagcgattacgaagtgtacgtcggaaattctacccttcggtacctacgccactccgtacaaccacttcatcgtaccttttaagtgcgcatctagt

SEQ ID NO: 59381 - DNA, 111 bp, Zea mays
  unsure at all n locations
  Clone ID: LIB3069-027-Q1-K1-E9
cccacgcgtccgcccacgcgtccgggtctttccagtcaatgtcaatggtgtcagagctctgggcctttgtngtttttgtcttgccggtcggtgttttcacatctttcttct

SEQ ID NO: 59382 - DNA, 116 bp, Zea mays
  Clone ID: LIB3069-027-Q1-K1-F11
aaaaaaaaaaaaaaaaaataaaaaaaaaatttttaaaaataaaaaaaaaaaaaaaaaaacaagaaaaattgaaaaattttaaaaggacaataaacaaaaaaactcaataacaaaaa

SEQ ID NO: 59383 - DNA, 443 bp, Zea mays
  unsure at all n locations
  Clone ID: LIB3069-027-Q1-K1-D3
gaactttgggctgatttatgtgcttgtttatgtgcttgggagttttgagaatttaccatcaccctcctttttgctgctatcttctcgtgtctctctgctatcttatcttagttttcctctcagactctctcttttttcttctatatgtatctatctctgctatcgaggtcagtcatcagtcgacatcggaagctcggaatatgtatcgctatccgtctgccctaaggattcgtttcgcgttaaccaagcagcatgttgctgcatggctagtctcgagtcagtctcctgcgtctgtgacggtgctggagcgggaaacggttacgggggcggagtctggtacgggaacgggtggtatgcattattataatgttcntagtactattattgtgttgacgacgacgagtagttacttttatagttatagttgtggtgttgttagtcat

SEQ ID NO: 59384 - DNA, 228 bp, Zea mays
  unsure at all n locations
  Clone ID: LIB3069-027-Q1-K1-B4
gggcggccgagaggcataccccngatgagaagaatgttaagacctctgaaggcgatactcgtaagttagggtggtatggccgtaagaggtgtggtggtcgtggcggtggtaattaccattagctgctgggtctgatgacgattccttagtagaatagttcgagtcatgtgattacgttggagctgttgcctaaggatctgatcattgtatactagcctgcgttgagtt

SEQ ID NO: 59385 - DNA, 433 bp, Zea mays
  Clone ID: LIB3069-027-Q1-K1-B5
tggcctggaacctttgggctgatttatgtgcttgtggatgtgcgggtggatgtgcgggtggacgtgcgggtctgtgtgagatcggatctagacggacggttcgcaccccagccgcagaagggggtaaacccgtattgcagcattacggtacggtcacacgtggaatcgccgaccgacgagctgccgcatggcccgctgatccgacgacacgccgacgcgggagttttcgaacgaggtggcaccaacggaaacacaggacggtaacgataactaaaaaaaaaaaaaaaaaagggtggttgtctcagaggacttaagtccatgcatgtgcgtacgtgatgctacagtctcctcacagcgctattcaaacctaacctatcggttgctgccccataatgctgcgatcgggaaaatttcggtgccatttaatccaact

SEQ ID NO: 59386 - DNA, 209 bp, Zea mays
  Clone ID: LIB3069-027-Q1-K1-B6
gatttatgtgcttgtcggattgtcgggcggacgagaggcataacgatgatgagaagaatgttaagacctctgaagcggatactggtaagttagggtggtatggccttaagaggtgtggtggtagtggtggtggtaattactattagctgttgcgtctgatgacgattcttgagtagaatagttggagtcatgtgattacgttggagctg

SEQ ID NO: 59387 - DNA, 100 bp, Zea mays
  Clone ID: LIB3069-027-Q1-K1-B7
ctttcttctcattttctgcttcaaaaaaaaaaaaaaaaacaaaaaaaaacaacacaaaaaaaaaaaaaaaaaaaaaaaaaaacagtaacccccaaaacaa

SEQ ID NO: 59388 - DNA, 212 bp, Zea mays
  Clone ID: LIB3069-027-Q1-K1-B8
ttgggttgatttatgtgcttggattgattgctgttatcagcgtcgcgtctccacgtggacgggagtgttacggagaggctggggcgtcctgagaaggtatatagtaataccggtatgaggattaaggaagacgatgagtggactaccgttaattcctgggtctaatgacaattgcgtaggagtatagctcgaatcgtgttattaccttcgag

SEQ ID NO: 59389 - DNA, 442 bp, Zea mays
  Clone ID: LIB3069-027-Q1-K1-B9
atttgatcttattggaagagacaagagcatgattcactggagggtgctaaaaattgatcgggtggagtgcactgagctgggtgtcgatgaggatccaactatttacacggaaagtgaatgtcaagaactgctttggcggatccatgaggggaacaggttgactggtggactgaaatttgtcacaaaatgttacggaatagttggttttgtaaagtttcttggtccttattacatggttataataaccagtagaaggaaaatcggcacaatatgcggccatgaaatttattccgtcggcaagagtgaaatgattgcaatttcaagtgttacagtctggcccaacgtggcttattctatggacgagaacagatataagcgccttctttgctcagttgacctttcgaaggatttcttcttcagctactcttacaacatcatgcgc

SEQ ID NO: 59390 - DNA, 324 bp, Zea mays
  Clone ID: LIB3069-027-Q1-K1-C10
cctagatctacacatattctcgagagccactttcgccaaggtccccataagccataagtgggcctgcgggttctacaaaacgcgaataaccaaaatcacctgctcaacggacgcatcatcggcaagacagcaggtttctgtaccaatctgagccttcgtgtctatctgattgcaggaataaatcgtattgcggttaacatgaactccacatgtatctagcgttgataccatgccaagaggtggtgtgcaccgaacatgagctccacatctatgcgtcactctgcatggaagtctgagcccttgactcactttagccacaaacag

SEQ ID NO: 59391 - DNA, 436 bp, Zea mays
  Clone ID: LIB3069-027-Q1-K1-C11
cccacgcgtccgtgctggtggacgtggactttgccaccacgtgcctggccttcgcgcccggccggagcgccgccatcatcgggaacacgcagcagcagacgttcagcgtcgtctacgacgtcaagaacagcaagatcgggttcgccgccgccggctgcagctgagaagcgacacctacatacacgcgcatgcacagaccgactcggcaactaaaactaaaacgagcagcgcatgcatgcatctaccgtccggtttcgtctgaaaccatcattaatttcgatcgtccactccacgcacagcaagttctttacggaccttgccgcatatgatatgtacatggtgacaagataaggtacaggagaattgatgaaagaagcgttgccggccagtcgtcgttgacaagaacaacacataaataaaacattattacggagta

SEQ ID NO: 59392 - DNA, 435 bp, Zea mays
  Clone ID: LIB3069-027-Q1-K1-C12
cccacgcgtccgcggacgcgtgggtgcctattcattggcatcgatggattgtcttcattgcgttgccttcataagttgaccttgcttgacctgtcttatacatttttgatcaacttgaagcctatttttgacagttgtccacagttgaaggtgttaaaactttcagcttgcaagtacctcagtgactcatcattggatgccctttacagagagggtgctcttccattgcttgttgagctagatctgtcctactcacccatcgaacagaatgcaatagaaggtcttcttgcttgttgtagtaatttggttaatgtgaacttcaacggatgtacaaattttcaagaattggtgtgcgaatcttgggatagcggttctgtggatatgccagttgactcttgacacctagttcaccaatcaagaatgaggagatcagtg

SEQ ID NO: 59393 - DNA, 310 bp, Zea mays
  Clone ID: LIB3069-027-Q1-K1-C2
gcgtcacgtccacagctggtcgccagtgttacggcgaggctggtgcgtcctgagaaggtgtatatgaataagggtgtgcggattaaggaggaggatgagtggtcggcggtgcatgcctgggtgtatggagaggggcgtcggtgtctgtcgcttaacgtggtggggtcgtcgtgtcgtggtaagagtcgtaggtcgtgtcggacgaatcattcgtgtatggattccaagtgtggtaatcctattgatgatgaggatgagtctactacctgctcgtatagctcctcgcgtaataagcgagcgagtgcgccgt

SEQ ID NO: 59394 - DNA, 348 bp, Zea mays
  Clone ID: LIB3069-027-Q1-K1-C3
tttgggctgatttatgtgcttgaggcgagtcttttcatcactattgctcatgccgccatgagcttcgcaatttcagaccgtagggtttctacgcttctctgtttctggaagaactggcgaaaattatgaacggcaggcgttgcgatggagaacgtagtggcgttcgcgtgaatggtggttttcgaaattgtcgcctatctggactagtacgcggagagcggcgtgacggcggaagatctcgtggtgcttatggcggtcttagagctaatcctcgatgtaaactaagtcactgaggatgtagctttagaagatggggcggattaagacatagcgataaacgccgacgct

SEQ ID NO: 59395 - DNA, 141 bp, Zea mays
  Clone ID: LIB3069-027-Q1-K1-C4
tttatgtgcctgttcctcgcccttggtcaaagatctcaggaactctaggggtacgcatattgtggagactcctacgtattgtccttcatcgctcagtgtgacttagatcccaaacttacaaaaagttgaccggcctcacat

SEQ ID NO: 59396 - DNA, 459 bp, Zea mays
  Clone ID: LIB3069-027-Q1-K1-C5
tggcccggacctttgggctgatttatgtgcttggaggaattccgtcaagtcgaacgacgagtctcacgaggcgtattagactacgatctgtagggcctaagaagcctctggcgccggcgaaaaatcagattaggccagcgagacgctaagcaggccgatcctggacatcagaactcacgtagaaaaggtgaaagactctaactgttaggtaccgacctgcaaacacgtttttgccgtcaccgcgaccgggacagcggcgacgtctcctcgggcgaagaataagacacggcgatcggcgttactccgtgaccctatagccactacgtcggaattagtcgagccgctccgctcctttctgcgtaattacacgcccgactgcggctttaaaaagaaaagaaaagacggtctgacggcccactttgtactcgttgacctaagtgatcatcccagtcactaaaa

SEQ ID NO: 59397 - DNA, 478 bp, Zea mays
  unsure at all n locations
  Clone ID: LIB3069-027-Q1-K1-C7
tggcccggaacctttggtctgatttatgtgcttgtttatgtgcttgtttatgtgcttgtttatctccttgaccttaggccgaccccgatttagggaggcgctccgactgagtcccgacatgcccacgtctaaaacccggagaccactataaggagatatttctactgcctagcccacttttatgatcactaacacccttttaacccacacccaacccgaggtgcctctagcccgcctaggcccccaacaatagcttcgacgaaatcgtgcaccccaggacgacgccggatagagagaacgcaattaacatagccgcgacgacctaattcctatccacacttcacctaccctaactagggttagagttagcctctccggacgtaatcgtaaccgtcctcgataagacttccccaccggatctccaccgcatcggcgctacaccttacggngcaattaccgtgtagcggtgaaacgtcgg

SEQ ID NO: 59398 - DNA, 247 bp, Zea mays
  Clone ID: LIB3069-027-Q1-K1-C8
tgcttgagcgggtacagcgaccaataaagatatcgccaagaatacgctttcgtgtaagtctcgggagcgaggtctgcgttcattgccgataggatccgttaagttacgtctagccttccgagaaatacactccccattaaagtagcggaacggtccaatagtacgtctcggataacgccacccgaatccgtcttgaatacgtccacgcccaaaggcccatccacaattctcgcagcgagctctcgtc

SEQ ID NO: 59399 - DNA, 379 bp, Zea mays
  Clone ID: LIB3069-027-Q1-K1-D10
cggacgcgtgggcggacgcgtgggcagctgtctggacagcaaccagctggctgaagtggaggagttcgaagacaagatgaaggagcttgaggggatctgcaaccccatcatcgcgaagatgtaccagggcgagggcgcgggcatgggcgctgctgctggcatggatgaggatgccccgtctggtgggagcggtgctggtcccaagatcgaggaggtggattaaattggttagtgttcgaggtttggtttggtgaggtgtcaagtgcctgaactctgaaggttgtttgtgagataagtgatcttacgaagtggtcgcaatagctgcggcctgtgttgaacttctcagaaataaataagttttcgttccttaaaaaaaaaa

SEQ ID NO: 59400 - DNA, 396 bp, Zea mays
  unsure at all n locations
  Clone ID: LIB3069-027-Q1-K1-D11
cccacgcgtccgcccacgcgtccggtcacttgctgcctccgcttcccaggacagcttaacgctgacctgcgcaagcttgcagtcaacctgatcccgttccctcggctccacttcttcatggtcggctttgcgccactcacctcgcgtggctcgcagcagtaccgtgcactcactgtccctgagctaacccagcagatgtgggatgccaagaacatgatgtgtgctgctgacccacgccatggtcgttatctcacagcctctgccatgttccgtggcaagatgagcactaaggaggttgatgaacaaatgattaatgtccagaacaagaactcgtnctactttgtggagtggatccccaacaacgtcaagtccagtgtttgtgatatccctccgcgt

SEQ ID NO: 59401 - DNA, 465 bp, Zea mays
  Clone ID: LIB3069-027-Q1-K1-D12
ctcatgttcgattcaatttccgcgcttcatttaaaggataaagcacttacagatcaaaacggtgtccggcaaaagttcatggaggcagagaaggagaaaaacaaggctttaatgaacgcgcagctccgggagcagcaaaatggagcatcaacaagctccccatcactttcaccaccaatagttccagattccatgccaactctaaatatagggccatgtcaacatagaggggcagcagaatctgagtctgaaccgtctcctgctcctgcacaagcaaacaggggcaacctgccaccatggatgctccgcactgtcaagtaacaggtgaggtctttccagtgtagttttgcagctgatctcgacagcaacacacctgtcaccgaaatgcttctgtgaccttagatatcaaccgatgcacgatccatcttgatcctgtgatcgaataccggcgtaagtactactaat

SEQ ID NO: 59402 - DNA, 377 bp, Zea mays
  unsure at all n locations
  Clone ID: LIB3069-027-Q1-K1-B3
gatttatgtgcttgagtcggtccacccgtcctagccgaagacgccgagtaaatttactttaccccaatcgacgagatcagcttcacacggctaagcgaggagtaagcagatggcctccgcttcgtactggaaagttgggagtaattcgccttccctaaggcggccacatctggattacggtacgacgcgttaaacagtacttcaagactaaggttcntcctaaatcatctatagcttacgtaaggactagactcacacgccggaaacgcggacgcaccggactccctcaaggagtagccggatctgaggccaaaattcgaagaataaggagtggaggacggtccacccgttctagcggaacacgccgagtaaatata

SEQ ID NO: 59403 - DNA, 386 bp, Zea mays
  Clone ID: LIB3069-050-Q1-K1-D9
aaaaaacaaaaaaaaacttcaaaaaaaattataaaaaaaaaaataaacaaaaaaaacaaaggggacattttacataaaaagcgggtaccaccaaaactataaacaaaacacttgaatattgaaaggctaccacgtttctcgaggtccggatcatggtcaaaaaccatgatcctaaccgttcattctcatgaaggtctaattgcaattctagcgcagtcacttttcacagggatgattgctaaaactctccatgacacctatttcaatgtcttgaaatagcattcacttctattatgatgcacctatgtagataaggtcccagcgcatgtgacttttcaactgctgactcatataattgggaatagtacccccccttatggttgcct

SEQ ID NO: 59404 - DNA, 442 bp, Zea mays
  Clone ID: LIB3069-050-Q1-K1-E1
atcatatcagaaaaggggaagctgatgttattctttgtggttgttctgatgcaccaatcatgcctattggggtgggaggttttgtggcctgcagagctctttcacagagaaacagtgatccagcaaaagcttctcgaccttgggatgtggatcgtgatggatttgttatgggagaagggtctggtgtgcttgttttggaagaacttgagcatgcaaagcaaagaggtgcagaaatatatgctgaatttctaggaggaagtttcacatgcgatgcataccatatgacagaacctcatcctgaagggaaaggggttattctttgtattgaaaacgcattatcagattcaggagtaacaaaggaggacattaactatataaatgcccatgcaacatctacacagatgggtgatttgaaagaatttgaagctctcaaccggtgttt

SEQ ID NO: 59405 - DNA, 130 bp, Zea mays
  Clone ID: LIB3069-050-Q1-K1-E10
cggacgcgtgggcaaaatgctccttgagtaaaacaacatactgcaagtcaatgaagtcgaatttattaacatggacaccgacacaaaacatcctgatcctcatcacaactaccttctgactagcttatta

SEQ ID NO: 59406 - DNA, 415 bp, Zea mays
  Clone ID: LIB3069-050-Q1-K1-E11
gcactccattacaatggcgtgatcgatgctttcaggaagactgttcgtcatgaaggaggtggtgctctgtacaagggtcttgtgccgaactcagtcaaggtggtgccctcaattgccattgcatttgtgacttacgaggttgtgaaggatgtgctaggagtagagatgaggatatcagactgaggatggtcgttttcaactgctatttttgtaggctttgggaagttgtgtttttttgtaggcagggcgggtagaaggatatgaccgcggctccattcagcatcagcccatgttggatatatcatatatcctgccactggctttaggtcctagaattgtttgctgggtcgtgcaaaagtaataaagtcgctgtaaagcttattaagcatttgctaacttatcaaagaaatctatt

SEQ ID NO: 59407 - DNA, 365 bp, Zea mays
  Clone ID: LIB3069-050-Q1-K1-E2
ctacgcggacgcgtggtcagagccacgttagccgatttctcctattctcctctcgtgtctggccgaacaggcagagcgaccagtctccagagcgctccccatggcgtcaggagctgcggcggcccctgtcgttcagactgtggtgctgaaggttgccatccactggcatggctgcaagaagaaggtccggaaggtgctcaagggcatcgaaggcgtgcaggacgtgacggtggacgcctcgcagcacaaggtgactgtgacgggcaccgtggacgccgacacgctcatcaagaggctgtacaagtccggcaagaagggagtgccctggcagtgtcacccgtccgccaagaacagcgagcccgcgc

SEQ ID NO: 59408 - DNA, 362 bp, Zea mays
  Clone ID: LIB3069-050-Q1-K1-E3
cgacccactcgtgcgcccacgcgttcgcccacgcgtccgaccacgctcccggaagtataataactatgactttcgggggtgcccgggtgtctactgctggggtcaaccatgcctgacaattggacaatcagacatccatcgatctaacaccgtgaagatatactgacccaagagggaatacatttactacccacggtccaagtaccatgacattcactgtacatactttgggacaacgttccctcatctgttactgatgacttactatcacctaaagccacagaagctttccaatcactatgttccctcgagtttttcgctttaagctgcacacaccatgaacctcaagtatttgtccttta

SEQ ID NO: 59409 - DNA, 420 bp, Zea mays
  Clone ID: LIB3069-050-Q1-K1-E4
ctacggcaatcttatgctgggtgaccgggagaattactacggcattgggaaacacacatattgtgcctatgccattgatacacttggcagaacccaaccttatgtccagtccaaacgagataatcccgaactttttcacttgaactacactttagtatggcaatcaaacatcccttggagcatctacgagaatctttataaattgcactatctaaattaccatttaaagagtcatttacattaacaccgtgttctatatcttgtccatgtgcatcattatttctatgtaatgtatgtactacaacgagccattcacgtgcagaactctttggctaacgatactccgtctctacatgactagtctattcacattactatttaaataacttgtttgaagctatttttataccaacatctata

SEQ ID NO: 59410 - DNA, 250 bp, Zea mays
  Clone ID: LIB3069-050-Q1-K1-E5
cccgcgctaaataagaactgttttaaaatgttattgaccattcattactccaaggttcacagtggatatactatcggactatggattgcaaccataattgataaaaggtcatacatcgcaaaaatgacataaataatactctgacatatatgagcatacaactagatccatacaactattcaataattaaataggctgaacacatttacgtagatagattactacattacagtgtcttactgattctatc

SEQ ID NO: 59411 - DNA, 338 bp, Zea mays
  Clone ID: LIB3069-050-Q1-K1-E6
gtaggaagggtgttgccatcttttttgagatttgcgacgacgaacgtatgctggttgacatgcataagttctacaacgtgttgattgaggagctgcctgccaatgttgctgaccttctgtgatcaatttcaagaaaaaacataacaaaaaagggtggtgaggaacctggtaaggcttggttttgtcgaaataccgtgggagagggggtgattaggacggtggggtttctatgttgaagtcgtggacatggacaatttgtgattttttctcctttatgccatgttttggaatatttgtagctgcctatgcctcgttgtaatgtgctgctgtggtggttc

SEQ ID NO: 59412 - DNA, 462 bp, Zea mays
  Clone ID: LIB3069-050-Q1-K1-E7
gtgcgccctcgcgaggtcgaacccccaaggtgaggcgacgaaaccctcgccagtccccaacgggaacctcagtcaggcggcgtgagggagggagagttcgaggaccgaggcggcgtcgggcgagatgaagcttaacgtcaagaccctcaagggcaccaacttcgagatcgaggcgagccccgatgcgtcggttgctgacgtgaagaggatcattgagaccactcagggtcagagtacctaccgggcggaccagcaaatgcttatataccaagggaaaattctcaaggatgagaccactttggaaagcaacggagttgctgagaacagcttccttgttataatgttgtccaaggctaaagcatcgtcgagtggagcttctaccactactgctgcaaaagctcctgcaactttggcccaacctgctgcccctgtgccccctgctgcatcagttgcaagaacacc

SEQ ID NO: 59413 - DNA, 456 bp, Zea mays
  Clone ID: LIB3069-050-Q1-K1-E8
gtgatcccctccagcacccgcttgtggagttctactggggcaatgtcaatcccatcggtgtgaggagctgttacgatgagggcaagcgtacagccgaaacgttgaccatggattaccaccgtggtgccaaccttgaggttaggatcgcacgtatcttcaacacatatggccctcgcatgtgcattgacgatggccgtgttgtcagtaacttcgttgctcaggcactgaggaaggagcccttgacggtttatggtgatggaaagcaaaccaggagtttccaatatgtttctgatctggtcgagggtctgatgaagctgatggaaggcgagcatgtaggaccatttaacctgtgcaaccccggcgagttcaccatgctggagcttgccaaggttgtccaggacaccatcgaccccaacgcacggatcgagttccgtcagaacacccaggacgacccac

SEQ ID NO: 59414 - DNA, 433 bp, Zea mays
  unsure at all n locations
  Clone ID: LIB3069-050-Q1-K1-E9
gctcgctcccaactcccaagccaagccggttcccaaatcggcacagcgcacccactccggtcagtcccttcgttcacccggatccatccagccagccagccagccatgggcggcaaggactgcggcaaccacggcgaggacgacctgcggcggtcgtgccggcgcctgctagcgatcctcctagtcctggccctgatcgtgggcgtgatcgcgctgatcatctacctggtggtccgccccacgcacccgcgcttctacctgcaggacgcgtcgctgcagcagctagacctctccaacgccaccaccaccaccaccacctccgcgtcctcgtccctcctctccacgacgctgcaggtgacgctggcctcgcgcaacccgaacgagcgcgtgnnggtgtactacgaccggctggacgtgtacgcgtcgtacaagt

SEQ ID NO: 59415 - DNA, 140 bp, Zea mays
  Clone ID: LIB3069-050-Q1-K1-F1
tcgcggacgcgtgggcggacgcttggcaaaaattcttaaacatttatgaaaaatataaaactaaaggaaaatggggccaaattcaaaaggccatagacaacaacaaataaaaaaaaacatataaaacaaactaaaagggg

SEQ ID NO: 59416 - DNA, 321 bp, Zea mays
  Clone ID: LIB3069-050-Q1-K1-F2
acgcgaccccttggctcgacggcaagcacgtagtcttcggccatgtcgtcgagggcatggacgtggtcaagggcatcgagaaggtgggcacccgcaacggctccacctacaaggtggtcaaggtcgctgactgcggacagctcttctagatctctctgatctggcctgttcggtcgacctacctccgtcatcgctgactccccctgcgtccgttactttggatctgaataagatggtggtgatctgaatggtggtcttagtacatcatgtatcgctcgcagtttaatatagcggtttatgtgtggatctgtgaaccccatg

SEQ ID NO: 59417 - DNA, 464 bp, Zea mays
  Clone ID: LIB3069-050-Q1-K1-F4
cgaaccacgcctacggaaaactgcatccaggagaagaactcgagttttactcgctctgatagccaaagatcaccagcggcatagggatctaaaacctgggattcatgatcaccctcttcgacattctcatcccttgatggcaacaggtcaacacaacaagacctatcatccactgacccaatgctatttccagagagaccggttaagagctcgcccaaactcaacagttcttttgacagggacaatggactcgactaccctgatgatgtgcttaccaagtccatgaacatgcccatagttcaatccagcctgccaactcttggcattagaaatcttgtgaatgattcaatctacaaagatagccatgaattgtcagtcataattaacactgaacaagaagttaaagattacccatccaactgtggagatcaacctatgcaaatgaatgggcctcaccacgacag

SEQ ID NO: 59418 - DNA, 284 bp, Zea mays
  Clone ID: LIB3069-050-Q1-K1-F5
tccatgcgtatggccacacgctttatcctctttaacaccagatcatatccacaggaacatcgggaatctcccaaagtgccatgatgcgttcatcgtcagtggcttacactgtgctcctatgctctgattcataacccaactccatgtgcttcatgctatagcagctgagctctggcatcttgattccgtgtacttacagtcttgaatagctctcggactatctaccatcctcatgcccccgttaaacgctgtctcgggcggtccttcgccttgcagcttgatca

SEQ ID NO: 59419 - DNA, 407 bp, Zea mays
  Clone ID: LIB3069-050-Q1-K1-F6
accatttccaattttgaagattttccttctataaggatatagattcttttatggcatcaggcttcaagctggttggctatgatccccaccagaagatagagatgaaaatggcagtgtaatggtggcttggctggagcccccatcctatggactcggtggatgtaatcagtaggactggtactacataaaaattaaccggacaccgcactagcttgtttttggtgatggtgctgaatgttcagtgggagacgttttctctgatttatcaattgcgatttgcgtattatggtcgcttaagtcaactctacaaaatcggctcccttttatctggagccagttgattactcgattgcgaatgtgatggatgatctaagcatactctgttgcaagggcctactgggtgtgtg

SEQ ID NO: 59420 - DNA, 455 bp, Zea mays
  Clone ID: LIB3069-050-Q1-K1-D8
cccacgcgttcgcggactcgtgtttcgcatttcagtttgaggcgcttggatcagctattggggtgcgttgctcagtgcttgttggaggagtggatcgggtgcagcaagtgttatccatcggaaaacgtccacatattgtagttggaactcctggccgtcttttggaccatttgacagagactaaaggttttagccttaagaaaatcaagtatttggtattggatgaagctgataaattacttaatgtggagtttgagaaatcccttgatgacattctaagcgagatgcctaaagacaggaggactttccttttttcagcgactatgaccaaaaaggtaaataaactgcaacgtgcttgtctcaggaatcctgctaaggttgaagtgtcctccaaatattctacagtagattcacttaaacaagagttctattttgttcctgcagatgacaaggat

SEQ ID NO: 59421 - DNA, 429 bp, Zea mays
  Clone ID: LIB3069-050-Q1-K1-C3
gcgatcttgttccctcattgtcatcttgaaagattcctcgtcttctgacactatcaaaggttataagctatgggactggaagagcagagagcaaccaagtatggaaaagcctgttattgtgtccaaagatgaaagaaaaatacttctttatgaccttaccccatgcacagaatattctttcagagttatatcattcacagatgatggggtacttggccattcagaatctagatgccgtactgaaagtaaggagatatttgtcatgcgtgcaccaaagaatgcagtgggaggaggggctacacatgcgcaaaaaaaagacaggaaccagtcttgtaagtcaactgggttcaagatccgagatatttggaagaacttttaggaagctttatatgcaaaaagctgttttgaacgattttctgaagatgtaca

SEQ ID NO: 59422 - DNA, 440 bp, Zea mays
  Clone ID: LIB3069-050-Q1-K1-C4
cgtcgacagtgcacaaggccacaaggattgacttgacctctttcgctttgagatggtgtaccgtggtagaggggaggatgctgggggctacgtgttggaggacgatgactagtatgaccaggatgcgcatgtggctcgccttgaggaagagaacctgaccctaaaggagaggctcttcttgatggagcaagaggttggtgacatgaggcgccgcctggaggctcttgaggcaaaattttcgctaggtggtggtgttggaggtggcgagaatgaagtggaagaagctcctgctcagaatgatgcagagaggatccatacttggccagagaatagcagcgaggatgatgtatagatggttgatgcgggaactgagaaaggcggatcacaaacttatggtgccatgacttcagagaaatcttgcggggatgataccaacaatt

SEQ ID NO: 59423 - DNA, 289 bp, Zea mays
  Clone ID: LIB3069-050-Q1-K1-C5
tcgcccacgcgttcggtcattagtttctttgatttggatcagaacattcaaggatgcatgttgagcgactataaagtggtcgatgagctacaatagtacatgaccagtgctttcgaacacatgaatgccatgttcaattctcaggactgcgaccttaggatgtgagcctgtaccttaggagctaacagggttgatcgtgccatccttttgataggctgggaagcatgatatcattgaccgagcattacagattctacaggtgcattcaataattcttgtgcaacaacgt

SEQ ID NO: 59424 - DNA, 455 bp, Zea mays
  Clone ID: LIB3069-050-Q1-K1-C6
ataaaatgaaatttgaatctactttaacaatttcttcgaacactgaaaaagaatttccatttgatccaaacaccaccttgtaacctgtctatactaaatgcaccaaagcaagagtggattgaacgttgatatgttacatatgtatcgtactcatctaacatcttaagtaaccagaggggaaaaagcaagttgatctactgagatatattgaaacagagaagcttatatatcacgatttagtgttattattcaagtattccatatacctttggcatataaaatgaaacttccagataattgatttgctgtaagaagagtgaaaaaaaagatacaggttaccattctgatgttatttcaagtaggttaagattataacctgaaaaacttggtgcaaggcttcgatttgcttgatagaccagtttgaaatgactccgtggtttgtgcataaaattaat

SEQ ID NO: 59425 - DNA, 449 bp, Zea mays
  Clone ID: LIB3069-050-Q1-K1-C7
tcgactgcgactgcctccaagggtttcaggtcttccactcgctgggaggaggtacaggttcagggatgggcaccctgctcatctccaagatcagggaggagtacccggaccggatgatgttgacattctctgtcttcccgtcgcccaaggtgtctgatactgttgtggagccctacaacgccacgctctccgttcaccagctcgttgagaacgcagacgagtgcatggtgctcgacaacgaggctctctatgacatctgcttccgcacgctcaagcttgccacaccaacctttggtgatctcaaccaccttatctctgcaaccatgagtggtgttacgtgctgccttcgcttccctggtcagctgaattctgacctccggaagcttgcagtgaacctgatccccttcccacgtctgcacttcttcatggttggatttgctccactgacc

SEQ ID NO: 59426 - DNA, 455 bp, Zea mays
  Clone ID: LIB3069-050-Q1-K1-C8
agttctagatcccgagtgctaacaatctggtttcagaatcagacacactcgattcgagcgggatctgtccatggcgtactcgtgcaaccacgtctgctatggagcacgccgaccaaccgccagatatgcttgatggaagcacgcctccggcctctccgagaagttcaccggacgctgcgacagcgtcgagcggcgcgtggaggtgcggtgcgactccctgcactcttcacagtgcggtgcgagaagatccaggagcaggtcgatgtcgctgcactctgcagtgacgaacatggcattgcgttggaggggaagcgcaccgacctcgagcaatggcggcccgatctcgtcaagcgggtcgaggaggtggcgtgtgtcaacaaactcctcgagcgggaacgtcgagcggaatccgtcgtcaagcccaccatcttcggcacttacacggcggcgcccct

SEQ ID NO: 59427 - DNA, 256 bp, Zea mays
  Clone ID: LIB3069-050-Q1-K1-C9
cggacgcgtgggctttggacatattccttttgaccttgccgtgaagtgctaaaaaggcaaggtcatggtgaatacagggagatcactgaaagggaccttcttggggagggtactggccatgaaaaagtcatttgccatttttaccacccgagattttcaccgttgaagaaccatggtaaccctttaaaaggcctttgcccaactttatggggacacaaaattttaaaagcttgactctaaaaatgctacatttttt

SEQ ID NO: 59428 - DNA, 431 bp, Zea mays
  Clone ID: LIB3069-050-Q1-K1-D1
cgaaccacgcctgcgcacgatgccgtgggcgccaacagcggctggctttatgacgttgaccggcgttcgaggactgggacactaagagcggcgctctgtgggactactgcatggacttctgcaagatccgagagatgcgcaagcagaacaagaaggagctcttccgcgccagcctctgaggctacgacgacctcttagaccacgcccacgtccactcccaaaatccgcaagccaacagcgcccagcccaagcttggacgaccctgccccgtcggcgaccggcgaccgctccacgcccgcgaccactccccaacgggagggaagaagttcctgagctacttgcagtgctgaatcaaggcctgaagaggagctgccgcaatgctaagcctgagtgcctgcgctttgtcgcagcagaacacttgtgagcaatta

SEQ ID NO: 59429 - DNA, 225 bp, Zea mays
  Clone ID: LIB3069-050-Q1-K1-D10
agcaaagcaatcagagccaagcacccaccttcctcctttctttccttcgactcatcacggcatgtcttgctgcggcggcaactgcgcgtgcacctccggctgcaactgcggcagcggatgcggcggctgcaagatgttccctgacgtggagaccgccggcgtcgccagcgtgaagcccacggtcctcgccgcccccgccaccaaggcgagcgccggcgggttcga

SEQ ID NO: 59430 - DNA, 265 bp, Zea mays
  Clone ID: LIB3069-050-Q1-K1-D11
cccacgcgtccgcccacgcgtccgcggactcttgggcggacgcgtggggtctctagtgggggtagtaggatttgcggtgcgtgtgttgtctagtgtgtgctggaatagctgtggctgtgttcccgtcgtgtctgtggcctgtgtaggctgtctgtagtatactgggttgttggatgtatgcgttctggccgcaagactgatgtcatgctgttgctgcttactacagtttgcagtctgaaataaaaacttgtttgatgagcactgt

SEQ ID NO: 59431 - DNA, 273 bp, Zea mays
  Clone ID: LIB3069-050-Q1-K1-D12
cccacgcgtccgggccagtcgacctctcttttcgcgaaaaatggcggcggcagcggagggtttggctgcctacagggcggtgctgcgggcggcgcggcggacgttcgcgggcgaccagctgatgctgaaggagtctgcggtggagatccggcgccgctttgaggaccaccgtggtctaaccccgggctccgacgatgcagcgcgtgccctcgccgacgcccgcgaggcggcgcacttcatcacccatatgatagtccaggccacacgcgcacc

SEQ ID NO: 59432 - DNA, 258 bp, Zea mays
  Clone ID: LIB3069-050-Q1-K1-D2
tcgcggacaaaaaaaaaaaaaaaaaaaaaaaaattataaaaaatttaaaaaaaaaaaaaaaaaaaagagaaaaagaaaaaaattaaaaagaaaaaaaaaaaaaaaaaaaaaaaaaaacataaaaaaaaaaaaataaaaaaaaaaaaaaaaaaaaaaaaaacaataaacataaataaaaaaaaaaaaaataaatatgggatatctatgaaatggctaatgtaaattacaaacataatccaaagacaattgtaatagaag

SEQ ID NO: 59433 - DNA, 433 bp, Zea mays
  Clone ID: LIB3069-050-Q1-K1-D3
tcgccacgcgtccgcgatctagctcgctgcgttagcctgtctcctggcgtgcgccgctctggtgccactgcgacggcaacagcacggcatggcgccggcataggtcgctaggaaaaacctgcttttgtgttcgggttcacgtcgtgtcctacgtggcgcggcgggccccgcctagtaaaggagcgtaggagcgtcgttttgtgttgtggtcgaataaataatgtgtctgtgtgccgatcccgtgtcgggttagtgggcccactgtcggtgctgatgtggcctgcctttacagcacatcggtggggctgggccgtaaagctcctgtgtcgtttaaatatatgtgtactctgtactgtaccaactagtatgtgtttcgagtgtgtagtaagcatatttgtgtcccatccatctttcgaaactttctttttttaat

SEQ ID NO: 59434 - DNA, 219 bp, Zea mays
  Clone ID: LIB3069-050-Q1-K1-D4
acgagcacttccatcctgctgatcggtaagtgcttctctaattcttagtatctacgaccttatctggactgtggccgtctcactggaggctaacgataacatggattcatgcaccgacgatggtaatctgggcgtaaccttttgctctgtacttcctatgatgatgtcttctactggagcctgctttgacagatctgggcttagccttaaaaacaataa

SEQ ID NO: 59435 - DNA, 317 bp, Zea mays
  Clone ID: LIB3069-050-Q1-K1-D5
cccacgcgtacgtgcattgctttctcaccgtgaacacttacagcgcgcgcttcaaggtctagtactgattgcatgctcaggacgacaggatcatacggcagactcaaccactcctgtgatgtagaggctaatctcaaacagcctggtgaaccagaccgatcagatgaacgtggcccttagggactgtccattcatcagggaggccaaacccaatggatcattcactgtactagatgaagtctcgtaggataggtcatggaggatctgactatgctgccaatggtgcttaaaatgctgtcagcacatgaaagcccatt

SEQ ID NO: 59436 - DNA, 452 bp, Zea mays
  Clone ID: LIB3069-050-Q1-K1-D6
gacaaccataaggttcgctgatttcaaacattagagatacagtgttccccttgtgataggaagcggtctccttgtcctgcagcagctaagtggtgtcaatggcattctattttatgctgcgagcatcttcaaagctgctggtattacaaacagtaatctagcaacatttggtttaggggctgttcaggtgattgctactggagtgacaacctggttgactgacaaagctggtcgaaggcttcttctcattatttccaccacaggaatggtcattactcttgttattgtttctgtgtcattttttgtgaaggacaacatagctgctggttcgcacttatactctgtaatgagtatgctttcactggctggacttgtggcatttgtgattgcattttctcttggcttgggagcgattccgtggatcattatgtctgagatcctttcctgtaaca

SEQ ID NO: 59437 - DNA, 380 bp, Zea mays
  Clone ID: LIB3069-050-Q1-K1-D7
actgtctctacctcttgctacttgtgccgtttcctcgtccgggctcctccgctcaagtccaggagtgcagtgcgctgtccaagcgccgccccaccaggtgctagcggtgccacctccacctccaaggtaaacccacacctactacctgtgtgcttcgtaaggcctatctacacctgcaggctgcagccaccagcacagggatatgtaccagcctgctcgtttcagctggaacagtattctccagttttggattggaacatgcagccacagccaaaagtagctgaagcgattggagttgtagcttttcggggataatcaaatgatatgagagtggatgttgcggatcatgtataagctttagactgccgactgattcactt

SEQ ID NO: 59438 - DNA, 342 bp, Zea mays
  Clone ID: LIB3069-050-Q1-K1-A10
cccggactggctggtgatggcatgctcggtgtccgatctccaggacaccttcacggggagcaatctgcgctgatatggtgagcgcttatataaggtggcctactacagtcatgtaaaggctacaggccctcaaggctaaagacgcccaaaagatatccgcgcacactgaagaggctgttggatcgctctagcatgagcccgatgcacacgtggatcatacgagcgacactacgacttcgactgccagaactgactctggccttacgatattgaagatctgatgcatgcatctacgactagagtgtagcctacaattgctttcaaagacatgtatcactgtct

SEQ ID NO: 59439 - DNA, 277 bp, Zea mays
  Clone ID: LIB3069-050-Q1-K1-A11
cacagactggctggagatggcatgctcgggttccgatctccaggacaactgcacggagagcgcacaccgctgatatggtggcgccttataaaaggtggcctactacactcatgtaaggctgacagccctcaaggcaggagccgcccaaagctaatccgggcacactgcagcggctgttgcatcgctctaccatgcgaccgatgcaaacctggatcatccgagcgacactacgacttcgactgccagatatgaccctgggcttaccatattgaatatc

SEQ ID NO: 59440 - DNA, 278 bp, Zea mays
  unsure at all n locations
  Clone ID: LIB3069-050-Q1-K1-A12
cccacgcgtccgagcgatcccactcccgttcagcagctgatcgctcactcttgcagctggatcattctttagctgctctagctctagcctctagccctagctagtagctagccactcggtcgtgtagtcatcagccttctgatcgtcacccatggccactgccgaggtccagaccccgaccgtcgtggcgaccgaggaagcgccggtggtggagaccccggcttccgccgncgtcgtgcccgaggaggcttgccccgtcgncgaggccaaggtggaag

SEQ ID NO: 59441 - DNA, 416 bp, Zea mays
  Clone ID: LIB3069-050-Q1-K1-A3
cgaaccacgcctgcgcagacgcgtgggttgatctgtagcatccttttgtcactgtttaattagatgatctgcagccgcgcaatcatgctgcacacaaggactgcagtaatgaaaatcatgcacatgatatgccaaatggcttgggtttgaatcattctttcaactggtcgaccatgaactccaatagatcatcaaaaatcaagcccttatgggaggggagctgtgacgatgttgacatgtgtgagtttgcagacaaggatgaatatgcaccagtaggatctagctataatcctatgtcagaaccatttgataactgggaaaacaagtttgacacaagcccagagcaaagttctcatgaaccaatggaaattggtgaattggtcatacatgcttaaagcaggataactgagaatgat

SEQ ID NO: 59442 - DNA, 453 bp, Zea mays
  Clone ID: LIB3069-050-Q1-K1-A7
gtttgagatataaaatctgctttggatggttgacacattcttagtcgtgattatatgacaggcaagttgtgggatctaatcatggattcaggcccagttgcaacttttcaggttcatgaatacttacgtcctaagctttgtgatttatacgagaacgattcaatttttgacaaatttgaatgctgtctcagcggtgatggactccatgttgcaactggttcttatagtaatttgtttcgtgtttttggttgttctcctgaaagcgtggaggcatcaacgttggaagccagcagaaatcccatgaggcgacaggttgttgatccagcaaggcctgcacggactctgaccggtgctgtgaggagaggtggagaaaacacaatcgttgacgccagcggaaactcttgcgatctttcaacaaagctgttccatcttgcgtggcacccaactgagaac

SEQ ID NO: 59443 - DNA, 459 bp, Zea mays
  Clone ID: LIB3069-050-Q1-K1-A8
cccacgcgtccgcggacgcgtgttcggacgctagggcagcgtccaacgccatgcatcccgaggtcgcaacgcaagcaaagaaagcccatgcaggcgtgtgcacggcgcggcggggcaaccaagggtgggtgaacccgcagagaggggcagctagcttccttccttcccaggcgcgcgggagaggttagccgccgtataagtagacagccagccagccatgtcgtcggtgtcgtcgtcgctgtccaacttcctgctctgctgcttctacccgtcatccgccggccaccaccgcggcggctcctactactacagcagccacccgacgagcgccagcaccctgcactaccacgagggcaccttcgacgggcgcagggccatgggccggagcagcaggccgctgtcgctgcagactgtggagctgaatgtgcgcatgtgctgctcgggctgctagcgcgtggt

SEQ ID NO: 59444 - DNA, 285 bp, Zea mays
  Clone ID: LIB3069-050-Q1-K1-B1
cgcgtcttccttaccctacgctactggtcctcctggccccacttccccgcaagagcggctgccgcagctgcgaggtccgtaccccacatcggcgagcggcggcggaaccgccggaggcaaaggcaagatgttcgggcgcgcgccgaaaaagagcgacatcaccaagtactacgagatcctcggggtgcccaagtcggcgtcccagaacgatctcaagaaggcctaccgcaaggctgctataaagaaccaccccgacaaggccggtgaccccgaaaagtttaagga

SEQ ID NO: 59445 - DNA, 284 bp, Zea mays
  Clone ID: LIB3069-050-Q1-K1-B10
gctgatgtcaaatgctttagactgtaatgtctctgatacgcacaccaactacatgagggagtccattaggagtgactgaggttacgaattgatcataaaggatatcggataactgggactccattaccgaaagcacatcaccgcgtacggtgactgcaacgagcgactgcttacatgccgccacgagactctcgacatcaacacctgaagtctagtgcgtctggaatcagctctacgtctggtctgtacgacgatgacaccgagaaggaaggctgatgctactt

SEQ ID NO: 59446 - DNA, 168 bp, Zea mays
  Clone ID: LIB3069-050-Q1-K1-B11
gctgatatcagatgctgcacactctgacttctctgacacgaacacctattacatgacggcgaacatcatccttggctgatgtcacgaattgatcataagacatttccaataactcggactccattacccaaagcacatcaccgtgatcgctgaatgcaccaagggaat

SEQ ID NO: 59447 - DNA, 335 bp, Zea mays
  Clone ID: LIB3069-050-Q1-K1-B12
cccgaatcggggcctccaccatctccaatttcaaccccaccccataccgtcgccgcctgcgctagggttttggagtgaggatcgccgatgtcgacggctcccaggcgccccttccgaggccgcggcgccccgccccctggcaccggctacgtccgccgcggacccgcccctgccccaggccccgccgacggcgccaagaccctgcgcaagcccgtcttcaccaccgtcgaccagctgcgcccccagacgcacggccacaccctcacgcgccgcgtcatcttcggccggaccgtccttgacaagcccttcacgcacatcggccggacccgcgtcgc

SEQ ID NO: 59448 - DNA, 424 bp, Zea mays
  Clone ID: LIB3069-050-Q1-K1-B2
tcggtcctgcgccgtcggccgctgacgaggactggaaccgtttgtcggtcttgaagtcctgcgcgatctccggcaccagccgctggaagggcagcttccggatgagcagctccgtgctcttctggtacttgcggatctcgcggagcgcgacggtgccggggcgaaacctgtgcggcttcttcacgccgccggtggccggggccgactttcgcgccgccttggtggacagctgcttccgcggcgccttgccgacggtcgacttcctcgccgtctgcttcgtgcgcgccatcggagagagctgcgtgaggcgtacctggggggtctcttcgaggacaccaacctctgcgccatccatgccaagagggtcaccatcatgcctaaggacattcagctcgcgcgccgcatcatgggcgagagggcctga

SEQ ID NO: 59449 - DNA, 417 bp, Zea mays
  Clone ID: LIB3069-050-Q1-K1-B3
gcgggatgttcgacctatattctgggccaacagttcaaagagttatcttaaaaggacattagggggggatcaggatccccatggacggtggggtgattctcggaacccatcatatggagcacttactgaccaccagttcacaagaccacgaggccgtggtaagaagctccaagaggaatgggctgttccactgaaatctgtggaggacattagtgagcgcttcacaaacttctgtcaagggaaactcacaagcagcccatggtcagaattggacggtcttcaaccagagacaaagattatcgatgaccagttggtgaatattaaccagaagggtgtccttacaattaacagccaacctgctgtaaatggagagaaatacgactcgcctactgatggttggggtggtcctggaggcta

SEQ ID NO: 59450 - DNA, 372 bp, Zea mays
  Clone ID: LIB3069-050-Q1-K1-B4
tcgacccacgcgtacgcggacgcgtgggcggactcttgggacgcgtttctaggaggtttcagtttgcacaaccctgcggatacctggtgcaaggatgcatataacctgcttcagaacttggacataaggtgacttctgcgcatggatattctattagatacaatcaacctttccaaaaaagtgttcagagcatgttaagagaatcaaccttacatccagaaaggctatgctgacaagaaatgttatgaaaagatcccaccgtctatcacggtgaacctttctgaaagctgatctgagacaaactcgatatgcgggcaacaaggaccggaggctctttcttccatgaccacgccatggtgtatgcgataaatg

SEQ ID NO: 59451 - DNA, 310 bp, Zea mays
  Clone ID: LIB3069-050-Q1-K1-B6
gccacgctcgccacgcgttgccaccttcgccaccgtcgccacgcgtcgtcgaccttcgtttgagcttgatgacacgtgcgattttgacaccatagacctcatatctacatattagaagccccgtcgacttacgggagcgtcccgatccggcgttgacacgtgtgatcgcaaccctaatcggatgtaatgcattgtagcagcgtggcctgagtcgtgaccgtgtcttttctcgcgcttccttcaacgcctctcgctaaagatccaccgatttttgctgggagtcgagagcgtgataccgggacgacgacca

SEQ ID NO: 59452 - DNA, 455 bp, Zea mays
  Clone ID: LIB3069-050-Q1-K1-B7
tctgatcgtgatcgcacgaagatcaaaaattcctaaacaggtgtgaaggatgaggtcactggcaggcgaaacatgcgcataaagtattgcattcttggactaacctcacaagcagcaagagagctatcattctctggcgatgatcgtggtactgtgaagactgtagtccaatacttcatggagacttatggatttagcattcagcacaccactttaccgtgcttgcaagtgggcaatcaacagagaccaaattatgtgcctatggaggtttgcacgatagctgaaggacagcgttactcaaagcgactcattgagaaacagatcaccgctctactgaaagtgacctgtcagcgacatcaagagcgtgagctggacattttacagactgtgcatcacaatgcgtactatgaggacccgtatgcacaggaattaggtctaagaattgatgatacgcc

SEQ ID NO: 59453 - DNA, 443 bp, Zea mays
  unsure at all n locations
  Clone ID: LIB3069-050-Q1-K1-B8
cccacgcgttcgccacgcgtttgtcgatttcgncgccagaccgctcccttccccgcggcgggcccaagccaggccaacagttttgaggtggtaatggcggaccagctaccaacccactgtccttcataagctaggtggccagttccacctgagctccagcttctctgaaggtgtacgggcccgtaacatctgcctttctttctcatcttatgaaaggagatttgccacgaggaactacatgacccatagcctttggggcccttcaatgtctgttagcggtggcatcaatgttccagtgatgccgactccgctttttgccaatgctccagccgagaaaggtggcaaaaacttcatgattgatttcatgatgggcggtgtttcagctgctgtttcgaagactgcagctgctcccattgaacgagtgaagctgcttattcagaatc

SEQ ID NO: 59454 - DNA, 258 bp, Zea mays
  Clone ID: LIB3069-050-Q1-K1-B9
gaagccgggctacaactacaagcagcacgttgcatacggggagaccgaaggtgcaggggacgggtacggcgccggcggcgtgaagaagcaagcaggctacagctacgcgcaagaggcgtccgaagagagctacggcggcgctcagtctcaccacggtggtgccggcgccgtcgcgcagacgtacgcctacgaccagcagcaggcctacaagcacaaggacccagcaagggcggtgtacggtgctcgctacggtggtgg

SEQ ID NO: 59455 - DNA, 374 bp, Zea mays
  Clone ID: LIB3069-050-Q1-K1-A1
tcgggggagcaacaagatctccattctcagcgcagtagtcggtctccctaaccagggcacccactgcgagacggggaacgttagagtgctcggtccggtcacgctgtccggcctcaacgaggggaagcgggacctcagcgaccagaagtggacctaccagatcggccttcacggcgagtcgctgggcgtgcagtccgtcgccggtagctcgtccgtcgagtggggcagcgcggcagggaagcaacccttgacatggtacaaggcctactttagcgcgccgtccggcgacgcgccggtggccctggacatgggcagcatgggcaagggccaggcgtgggtgaaccggcgtcacatcgggcggtactggtcgtaca

SEQ ID NO: 59456 - DNA, 345 bp, Zea mays
  unsure at all n locations
  Clone ID: LIB3069-027-Q1-K1-A1
tctagggttcattagatatggntggcgttattatccttaccgtcgaggatactaaacccttattggtcctgctttcgtgcctcgcccgttctaaggactcacacagtgtctcacgtcccgcgttgtccgcggtacttctattagaatcttgtctgtctaagacatcgtggcgtcttggtgttcgggattcgttaccggaggctactatcgtatgcgtcttcggatccgccgagtcctattctgagaaatcataggctggtgattgcgggtccgtcgtgtccctcgttcgcgttaactcggaggcttcgccttccgctaagattttcgagcgtatcgacctgggta

SEQ ID NO: 59457 - DNA, 439 bp, Zea mays
  Clone ID: LIB3069-027-Q1-K1-A10
cggcatgcaagctactgttggtgctttggtttcaaaagctctcacaacctctgcagtacccgattatcaggctgctggccaaagccctgtcttggctttagatgttttcctagttcaggcttcagcgaacaccatcctgtcgcatttccttggggtggcgagctccctggagctgctgcgctcggtgtcactgcctccagcagaagccgccgtcccggccccggcccctgcacgggcctgagccatggcccgttgggcaggtcaagaaaaaccttcaatccttggctttggctctagacagttgctatttcttgattgcatgtacaacttgcatcaagaatacatacacatcgatgccttccagttcacctggacgcaacatgttcgcgtaattcccgccgagtgtgagctcttgcatgagcactcgcgaaccacatgt

SEQ ID NO: 59458 - DNA, 353 bp, Zea mays
  Clone ID: LIB3069-027-Q1-K1-A11
ggagacgtcacgcctgcgcggctgcgctcaccatggacgaggatgagtttgggcgcgtgctcgacctcttgccggtcgtccgctcccgagactactgctgctccgatcctggaacatccaacagaggaaccagacagctatcacgagttcaggaggcaactaatggcgataataaggactcgtccggtgcacaagatatgtttatgcagaaattgaagatggctgcggagaataagattggagcgacaaaggcagagttcttctgcaagacattcgaagaagttcatgagaaacttgttcacagagagctgaatttggatgctgctaagaagttcctgagcgcatatgagagc

SEQ ID NO: 59459 - DNA, 382 bp, Zea mays
  Clone ID: LIB3069-027-Q1-K1-A12
cggacgcgtgggtgcagattgacccagcgatttacaagagtatctcatctggatttggtaggctgttaaaggagcaaggggccaggggtttcttcaggggatgggtgcctactttgcttggttacagtgctcagggggcttgcaagtttggcttctatgagttctttaagaagtattactcggacatcgcagggcctgagtatgcccaaaagtacaagactctaatctacctcgcaggatctgcatctgctgaggtaattgctgatgtggctctctgcccttttgaagctgtgaaggtacgtgtgcagacacaacctgtatttgctcgtggattgagtgatgggctccccaaaatttgtccgatctgaaggtggtcttgggc

SEQ ID NO: 59460 - DNA, 423 bp, Zea mays
  Clone ID: LIB3069-027-Q1-K1-A2
tttgggctgatttatgtgcttggtcttcaaccatcgtcataggcgcggtaaccccgtcgtaacttcagagtcggacgagaatgcgaacaagtagccttgtgcacccgaagtcgtcttatacgaactaagaggcgccttcgtcaagaggttagtattagaccatccctcgcgacgtcatatagtgaatgtccgagtccatcgcgtccctaagtgtcggattctacgccgtaagaagagtctaggtttcatagtcccttagttaggaggcggcccctaggacgcgcaaaccgagcgctactcctctttcctaggcttacgacccgcaagagagccggaccccggtacttagcccccctatagaatactatttacccgagtcggagaaacatgtttccgtgaaggggccctacgcgacgcgtcaaa

SEQ ID NO: 59461 - DNA, 427 bp, Zea mays
  Clone ID: LIB3069-027-Q1-K1-A3
aattggtctgatttatgtgcttggggaactttggtaggtaaagtgaaagtacccgcgtgagaggtgctgtgcgccttccgtcctgggtctatgcgttgcggtttccgtgtcccttttgcacatgattgcgtcgcctttgttttgagtgaattggtggtggtggaggtgacgtagtatgagttgcggtggttcgatgtcgagtttgctgttggtgtcggggtgggtttcgtctttattattgctgatgaggtacctacggagtggaatacgagtcctgctaaggtgtcctaggagtctaagaattcgtgtttgtagtctcatctggttcatgagcatcgtgagaagcttcattcctgtagtgaatagaagtaagcggcgtcggataatacgaaagaccatgtcggctaggtttcggctaatgtcgctg

SEQ ID NO: 59462 - DNA, 256 bp, Zea mays
  Clone ID: LIB3069-027-Q1-K1-A4
tggtcggaacattgggctgatttagtgcttgtctgccttctcgtctttccccgtaattcttcgctacacaggttatcgcgattcgtcctttcggtgtagccgtgtactcttacagttattctggaagtctgaggttgaggacttatacacacagtactcgctccccacatcaggccccagcccccgggagaactcatatggtgtacaagtcaggcagtccctcctaacaactccggcttagcttaataagtccttt

SEQ ID NO: 59463 - DNA, 315 bp, Zea mays
  unsure at all n locations
  Clone ID: LIB3069-027-Q1-K1-A5
tttgggctgatttatgtgcttgtttatgtgcttgaacgttcggttacatccacgcttttcgacatagccctagtcaacgatcggctagctacaatataggagggtaagtgaagtacgtcgaagtcggtatggtggacgatggagaatcctcgtgttggggctagtgtgctactcgtatgcgaacggagcaagtcggatggtgtcgtaagtagtactggggaagacgcgtgggctacggtatggaaaagtgcggatgagttcggggagttgntgggtgcggcttcaagtgtagttatactggcgcgggcgtttgcg

SEQ ID NO: 59464 - DNA, 476 bp, Zea mays
  Clone ID: LIB3069-027-Q1-K1-A6
tttgggctgatttatgtgcttgcgtggccctagccgtatgagacactaaccgcgaacttagcgccctccccgatatcttgagggttgacataatcgctctcacgaagtggagaagggcgaagtgagaatccgaagcaaacgggtagtactacaagaagtaggctttcgataccgaggaccccacacacgaaaaggttaaaataccgatactgctaagcaaggtaataatactcccggctaaggcggagaaaaaggctggagccctcctagccacaaaagccggagtcttagacaatcgggaggtagcctccggaggtaccaaaagtacgaggccactcggcgaagtttttgcagacatgaagggtcgcgaaaaagtcggcctctcttccttatttaaggaaagaagacccgtagcctcgacactaatcacgacgctaagttagataaatgacgaagccatatacgtcgtcgcggaa

SEQ ID NO: 59465 - DNA, 405 bp, Zea mays
  Clone ID: LIB3069-027-Q1-K1-A7
cttggctccgaacctttgggctgatttatgtgcttgtggatgtgcgggtcgcggatctggacgaccactaacgactgctgctcactgtacacgaatgggtgcacacgagacacccgcccgtgagagagcctagcccgttaccgacgctcgcagtccacgaagtttccagccagccgttatcgccgccttcggcatccgcacgaaccgggccacgaaaacgaagagccgcgccacgagccgcaccccgcgactaaaaaaaaaaaaaaaagaaaaaacacaaccaaacacaaaaaaaaaaaaaaagggtggttgtctcagaggacttaagtccatgcatgtgcgtacgtgatgctacagtctcctcacagcgctattcaaacctaacctatcggttgctgccccata

SEQ ID NO: 59466 - DNA, 449 bp, Zea mays
  Clone ID: LIB3069-027-Q1-K1-A8
tgcttaagtcttcactcatggttattaacagccttgatttgcaagtgttaatgttttacccgttatcatttcattgtgtattggtaaagtgtagtgttaggttgtagtccgtaagggtaggtggtggtgggtagggtaattgttatcgtagttgagacttggtggttagtggtaattggtggggggtaggtggctgggattcggcgctggctcatagttagatagtagtagtagtagtgcgatattatcattgcacggcttatcgtcttcccgtcggcgctgcttatcgtcttctcgtaatgctgcccgactcttcgcgtagctcgtatatgtgcgccgaaggagccgaccttcgcatagtatatgacagtataaattctcatcggcctaccttcggcatcattgcggcaactcgattcgtcacactgtcccgtccaccactcacacct

SEQ ID NO: 59467 - DNA, 449 bp, Zea mays
  Clone ID: LIB3069-027-Q1-K1-A9
cccacgcgtccgcccacgcgtccgggcactttacctcctcctcctcctcctcctagcacaggtagcgcctgctccccttcgcctgtgatcatgtcttgcagcagcggcaagtgcgactgcggctccagctgctcctgcggcagctcatgcaactgcatgtcccctaacgtggagaccgccgccgccagcagcatcaagaccatggtcctcgctgcgccgaccaccaaggccagcgccggcggcttcgaggcggccaccgagggcggcggctgcgactgcaacacctgcaagtgcggcaccagctgcggctgctcctgctgcagctgcaactgagcgccggccggcccggcgatggcgcgcacgagtcgacggaaggacgacgacgagtcgtataaatataatagcggcgtctaaataagatcctgtcaactgcacccgccatcatcgat

SEQ ID NO: 59468 - DNA, 325 bp, Zea mays
  Clone ID: LIB3069-027-Q1-K1-B1
tgcttgtttatgtgcttgtttatgtgcttggctgatcccaaaacttgtatggctgaggcggagggtaggattgcaaagtcgtagacccgggatatagtacggtaggagtggcctaggattactatgagtagtcatcattgaggagtctatgggacaaccaccgcccacgatactatggatacggagagtcctaataatgcgaagtagcggtccgacgagactgattgacatgttaatgatagtgcacgtaagtcctctgccggcaataaacgcgactcggttgagaatagggtcgctgatatcctagcagtataggtccatgtcg

SEQ ID NO: 59469 - DNA, 113 bp, Zea mays
  Clone ID: LIB3069-027-Q1-K1-B2
ggccttaagaagtgttgtagtagtagtggtagtaattaccattaggtggtgggtctgatgacgattcctgagtagaatagttggagtcatgtgattacgttggagctgttgca

SEQ ID NO: 59470 - DNA, 453 bp, Zea mays
  Clone ID: LIB3069-026-Q1-K1-H9
ctatttctcaaagaactttaatcacttggttgatcaactggcatacggcacacaactgtagtaaaaaatggagaaatgcttggtgtatcgcatctaagaaacagaagagttttgtccaatgggtttgtttcattagggaaggaggatcttcagctcatgtatagtgatggtgataaggcttttggtacatccactgatctctgcattgatgagagactaagaatcgcatctgatggcattatttttgtcaggtcaggttaaagttacttgcttcagatacttagtaattttgaaaggaacatcaagagccttatcttattctttctggcgggcattgatccagtacactgatgcggctactgcttcagctgctagagaatccttagatggaaggagcatcccaagttacttgcttccggagcatgtaacatcctgctgcctgcgaatttcttt

SEQ ID NO: 59471 - DNA, 445 bp, Zea mays
  Clone ID: LIB3069-026-Q1-K1-G4
ttgggctggattatgtgcttgtggatgtgcgggcgtgtgtctcgacttgccctgtatctgtcggtatgttgtagtgaagtgcggcgtcggatactgagggtatgatgagttttactctgcctgcgatggatgcgtctccttttcatgtttgtgataatgcttgtatgtattcggatgttattcatcttatttgtgagattaaggatgatactgtttcgtcgtgtgtctaggctgagtaggattcagttgaaggtgctgttggtgttgctttggctttgtttgatggtgttggtaaggattgtgctgctgatgtttcggctgttaatgcggaggttacgactgtggtggacaggaagataattctgtcgaagtagccgtagggttatactcggaggatcgggcctgagcgttaagaaactaagggggcggcgcctgatgatgcgtt

SEQ ID NO: 59472 - DNA, 474 bp, Zea mays
  unsure at all n locations
  Clone ID: LIB3069-026-Q1-K1-G5
ggtctggacctttgggctgcattatgtgcttgtttatgtgcttggtcctttagagatcttagctacggtgactctttagactctatgtacgaccttcggttacttcctcttcggttgttgttcctgttgttgttttagtcgtgtccgtggatggtgatgatgcggcggtttccattgaacttatgcctgagaaggaggctggaaaggattgtggtgtttctgctgagcctcatgtttttcggcgcggctatcgtaagaagtccgtcttcgagcacgaaagatccggcgtaagccccaagaaagtcaaactcgctccgaccgtcaaggtcgaccgcgacgagtataagagcccgcgtagtaagcacggagcccttgggcacttaataacttaacggcctttgaaaggacttccggagtttaaaaagcacgaaagataatgtatcgtagaagtttcngtcgaaccctctaacatcg

SEQ ID NO: 59473 - DNA, 403 bp, Zea mays
  unsure at all n locations
  Clone ID: LIB3069-026-Q1-K1-G6
tttgggctgctttatgtgcttgagagttcatagacgccggactctcctagacccttaagcactatggacgacggcactgaggccgccagtaaggagtagaatcttctctaccgagtctagaacgtgagaaaacttgaaaactggggacgttctcgcgacggtctccgtccttacgtaaacagacggcggaattcatggcagcattccgtagtcgtcggactcccccgatcgcggcgggaccatattttccgtagtatgccggcccaagaaattccatccgttcagaccgtggcggtcgggaaccataggcagtcngaacagggccacggcggacgtatcgctctgaagttggctacctccatacacggtccgttgcggcagagaaaccaggatcacgtctcgg

SEQ ID NO: 59474 - DNA, 487 bp, Zea mays
  unsure at all n locations
  Clone ID: LIB3069-026-Q1-K1-G7
tttgggctgatttatgtgcttgtccgtcaccaaaataatagacaacgttgtcccagactaaaaggcgtcaaatagagcgtggtccgtcccagccgctaccgtagtcgcgacgtcctcctcggtacccgccggtcctccgccacttactcccggctcggaaccttccgctctcgctccggccaccaccggacggacaccggccatcggaatgcccacttcgcgcggcgcaccctcctcctcgtataacgctgccctagacatccgtgccgtaacggaagagcgggccgtctacttgatagaatatatagtttcggatgaggccacttttcgtgcggagttcgttatggtgaatgaactttcgcatagaagtaggtaggcgatgcctgagtcggcgaatgcggcgaattaggcgactattaatgcgctgcataggaatccttttttgtagtcgatgttcncgcatcataattagctggngttatcgacg

SEQ ID NO: 59475 - DNA, 436 bp, Zea mays
  Clone ID: LIB3069-026-Q1-K1-G8
tttgggttgatttatgtgcttgtttatgtgcttgtcaacactaatcgctacgcgagcacacgttccgatacctctaaagagtagcggagtttcgtcccgataaccctcaaggcttcgtctcttactcgtctttcgtcgattgattttaatttggatgatttctccgctttggagaccgtttatacgcataagatggattggttgaagcatgagctgatggtttgtagtcggatgtagaagcatgtgacgggtcgatgaatgtcccttcgtctgctcgggtgttaccgcctttccggacccgccgccggctgcacgcactttcgacttactcaggactactgcaccgcaccgcagcgcacgcacgctgctggttcattactgccgttacttattacagcgaggcggccggatacgtcctgttcacacgtattcgcgt

SEQ ID NO: 59476 - DNA, 433 bp, Zea mays
  unsure at all n locations
  Clone ID: LIB3069-026-Q1-K1-G9
cacgcccctgtcactgaggtgcgccgtggttcttggcatccccacggcgatctaccgccgtggcggggctgcctcagccgctgagctggtcacggcgctgtctctcccctccactaagctgccgttccttcgccgnctgctgcggctcctcgccgcgtcgggcgtgttcaccgtcgacaagcagagcacggaggaggagcggtaccgcatcagccccgtgtcctacctcctggtggacggcatccctcacgaggaccacatgaaccacaccgctctggtgctcacctgcacctcgacgcgctacatcgaggcggggatagggctggcggagtggttcaagagggacgtggtcacgtcaccgttcgaggagctgcacggngcgactctgttccacgagagcatggggagcctcgacgcagatttccacgacatg

SEQ ID NO: 59477 - DNA, 433 bp, Zea mays
  Clone ID: LIB3069-026-Q1-K1-H1
cctttgggctgatttatgtgcttgtttattgcttgggcccttagaacacatggcccggctggtattacaagaccgtctgtcggaagtcacgcatctgccactatcctctagaaagacgtcggtctccactcgggtcttttcgcgcattaagcgaatctaacgaaacctccacgtcgtaatgaggtcactaagtatccgatcttataggaaagaagggacgaggtacatcctacgctctcttcgagaaccgtagaaatcatccgcggaccgcaccacctacacgatagggacccgatatcaaatccgtagagggtacttaagccggtcgtcgggaaggcatacaaattatcacggaagtaagtcgacttatgccccgcccggaataaaaacccgccagaggaatccaccgaagtcaagtccgacgagcctacta

SEQ ID NO: 59478 - DNA, 224 bp, Zea mays
  Clone ID: LIB3069-026-Q1-K1-H10
ccactcgtccgattgaaacgccatttttaaaaacaaaaataataaaaaaaaaaaaaagaaaaaataaaacgggccatatctaaataccatcctgacatactcctttcatgccatatcatatactcttctatcatgtctcctacatctaattgactgccccccgttctaccacttctttcctgcggcacccctgccttttcccaattcaatctcctttcctacca

SEQ ID NO: 59479 - DNA, 443 bp, Zea mays
  Clone ID: LIB3069-026-Q1-K1-H11
cccacgcgtccgcggacgcgtgggtccaatctgcccttgccgccgccgcccgatccaggtgtgtagactgctcactcctctccgctccggtccgaatggcccgcacgaagcagacggcgcgcaagtcgaccggcggcaaggcgccgcggaagcagctggccaccaaggcggcgcgcaagtcggccccggccacggggggcgtgaagaagccgcaccgcttccgccccggcaccgtcgcgctccgcgagatccgcaagtaccagaagagcacggagctgctcatccgcaagctccccttccagcgcctggttcgcgagatcgcgcaggacttcaagacggacctgcggttccagtcgtcggcggtggcggcgctgcaggaggccgcggaggcgtacctggtggggctcttcgaggacaccaacctctgcgccatccacgccaag

SEQ ID NO: 59480 - DNA, 453 bp, Zea mays
  Clone ID: LIB3069-026-Q1-K1-H12
ggcaaaactggtggcaggcactggtattacaaccgacgtgcagaccagctatgcagcgcggatcatggggctatctgttatccccttcatcatcgctcagttcccaaagatgttgaagacccaccacgggcagcgtctagctatgttgctggccctcattgtgtcattcttgctcgtgctttcctactgtctgtatcaggttttccagccttggattcagaggaggaagcttgcatacgcaaagcacaagcacgtaatctctgggatactgaggcacgcccagatgcagtcactcggccggctgctaaacgacgatggcacgcccaatgacgacgtcatcagaaagctgttccgcaagatcgacatggaccagagcgaatccctgtcccgtgctgagctgcacgccctcatcgtcggtatcaacttcgaggagggtgactttgacaggacgga

SEQ ID NO: 59481 - DNA, 246 bp, Zea mays
  Clone ID: LIB3069-026-Q1-K1-H2
ttatgtgcttggtacactgtagagacgcataaatgacttacccatacacacattccatagatatagtttaccagtaccgcctaaggaagtctcaatatagatgacgtcgtaaccaaaccaagtcattacgacggttacgaccataacatagaggccgaacttcgatagtagatcgccagggtacgaaccggacacaatcgatcgagaggggtacatcacgcggatacggattaaaccaaagtcgtc

SEQ ID NO: 59482 - DNA, 409 bp, Zea mays
  Clone ID: LIB3069-026-Q1-K1-H3
tttgggctcgtttatgtgcttgcttattgtcgtactggctctgattttcgacctttgctgttatccgtcctcccgacccgaccgtaccgggcctgcctggcgttttctttgcttcggactcgccgtgtgagagtgtggtagtgtgtgagacctgtttttcctctcctcttcaggaagtaggaagtaagttgattgtctgtcgagtgttgttgttgacggttgctgtggcgttgacgaagtctcggagggcggagatttgtggtaaggttgttgttgtggggtttgatgatttttcgtgtgcttcggcgatggcgattgcttctgggagtgttggtttgccgtgtcctactgcttctgagggtgatatggctgttgtgtctacttgtggtgtgtcgtgtcgtcatgtttg

SEQ ID NO: 59483 - DNA, 450 bp, Zea mays
  Clone ID: LIB3069-026-Q1-K1-H4
accgagacgaagaggatactaaacatcccccagctctaaggaaacggtaccgtccccatgcggcggcccatagccaacccgtaccgtattgagcggcggcagagattgcttaaactttctactaggagaacggcatttggtattacctgacctactcgtagcggatatcacgaggaggtcttcggagtacgtcggcgccttcgggtatacacacttatcactaccgtcgcgtcacgaggccacgttcttattataatatgccgagcaagagaccggtgagtatagggcgacacttccttacggagtatgtccgctagcaatctacgatacaaatcacggagataccatcgtctacattaagaacgtcgactacggaagggagtcacctataaacattccgcataatccagacgccaattagcataacgcgtctaaactcgtcactcccag

SEQ ID NO: 59484 - DNA, 378 bp, Zea mays
  unsure at all n locations
  Clone ID: LIB3069-026-Q1-K1-H6
tgcttgtttatgtgcttggtattctatggcctatccctctgcgttgctgcgggagcggcgcggctgcgcggtcaaattcgcctgtggtgtgttatccgttgcgtgatatggtcgtgtagtgacgcggtagatgtgtagtccgtcatcatctactgccgtggcggctgctgttgatgtttcttttgatcgggtggcggttgtggtggtggggtggcgtatgatgcttatgttagctaagatgcatgataagcgtactgtgtcgttgatgtanggtgttatgtcggtgcggattcatgatgtgtggaatgtgatgtcggatgtggtgcctatgggtcttcctactctgttgctgggtcgggcggttcggggtgcgaatgt

SEQ ID NO: 59485 - DNA, 459 bp, Zea mays
  Clone ID: LIB3069-026-Q1-K1-H8
ctttgggctgatttatgtgcttgtttatgtgcttgtagatacttacgcatagccttagcgtagcaaaagaacgaatgcggtaaacgtaaagaggacactggtatccccgcccccgcctacaacccgacgacggtccaggccgccgctggaactcactcttttcgcagccgcataacgttaaaacacagccggaagccccagtcggcatattaccagggcgtcgcaccaattccccccatctccgcgtagcaaagacctcccccgctaaaaaaaaaaaaaaagggtggttgtctcagaggacttaagtccatgcatgtgcgtacgtgatgctacagtctcctcacagcgctattcaaacctaacctatcggttgctgccccataatgctgcgatcgggaaaatttcggtgccatttaatccaactgttccgtagtatactttttccctgttagtcggtgc

SEQ ID NO: 59486 - DNA, 375 bp, Zea mays
  Clone ID: LIB3069-026-Q1-K1-G3
tgcttgttcgaaggaaaacggaccgccggattaggattggagtcatcacatcgtcgcttagacgagcgagagcgttcctacggacaagcctacacgttttcataaggaagtcgtattaagttctgtttcagaccacgtcgtcgtccgtagaggagaggcgtttatcattcctccggtaaacgcccaatttcctagcgcaaagtaacgccccgatatccagtagcgagtcggcaaccccgccctcccttccgttcaatcgtcatactttgtagtcgcgctcccagaaccggtctcggcatacaagacgcgagttacggccaccattagggtcagacccactcccgtctctcgccacctaagtcgactaagcacctt

SEQ ID NO: 59487 - DNA, 426 bp, Zea mays
  unsure at all n locations
  Clone ID: LIB3069-026-Q1-K1-F11
gcacaatttgccggacagcccattcgcattctctacgaaatctgctgcgcttttgcatgacagtttcactgccacggagaccgagaacaccgtcgcgtcccgtgttggcgtggatgccggtgtcgggagcaagatcgacggtgggagcaaccatctttcgccccccgcgttggaaatcccttcggccaacttctacttcttccccatgcacaaggtggcnctcgatcacggagccctgggggtggtaaggtcacccatggaggggagttatacccccccacctaatcatagaatactagaagccaagaaagcgatggtgggatatatagggaaaaaaggagtcgagtgtcagcatagtgttagctcccttctggtctagtaccttttttagaggatagttctactaaaccacangagaagaagatg

SEQ ID NO: 59488 - DNA, 454 bp, Zea mays
  unsure at all n locations
  Clone ID: LIB3069-026-Q1-K1-F12
agataaaccaccgtcagtccgattccagattcggatcaatatgacatgcgtgaaccaagaaactggattggttgaaccaagtctatttcctatgcttggcaagtgggaaagggaacatacaatggaggacatcctggccagcttaaaaagggagatgtcaactcctcagaaccgcaggctgtaccaacctcatgaaggtaacgaagatcaaagagtagagcagaaagggctgtcccttagatgtgtcgtcatgtaataatgtacatttgaattgagcagcgagatgccgagcttgagcgaaccctcttagggcatgtttaggaacaatccccttcaattcccttgctttcaaagaagccctgtaggaaccctnctgtagctcaccttaatcgcaataaagtgtcgatgactgttaaattgcctgcacggctgcacaccatgtaacagcaaccga

SEQ ID NO: 59489 - DNA, 441 bp, Zea mays
  unsure at all n locations
  Clone ID: LIB3069-026-Q1-K1-F2
gggctgatttatgtgcttgactgtcttagtgtttctgttgctggtagcccggtccctgcatctttgtcattgagtcaggaggtacgattcctgttggcttaatacgggcaagatatgcggcacgggagtcgggtgtaagtctaagatttatagaaggaattagaggcgggtcgataaagttcataagaagagttactctggtaatgagcggaagaaatttcccgtcgggctactctatgtaaagggaactgcttccgagaagactggtaccgaggtcaagtagttcaatctcgtcacttgcaagcgtgtctgcgcatagtcggcgaagaatgggaagaagaccgtcgttcccgcgttaaatgacggccgtccgaatcatactgaggagaatgacgacgcgtcgaccgtcggacctngctgcaagggttacgtcgcgggaga

SEQ ID NO: 59490 - DNA, 411 bp, Zea mays
  Clone ID: LIB3069-026-Q1-K1-F3
tttgggctcgtttatgtgcttgtggctgtgcgggtggatgtgcgggggtgactcgcctcagggtcagggagagcgatggaaagtgatgtggtgtgagtgaggagggttaaggtgaagaggggaagtattgtattaggatttccgcctgatgttgttgttctcgactcttgtgaggccgctaggacctaacacgctgattagtatacctgtcatccttcgtatgtcgccgggtaacgccagaataatgtaggttccttagatagtggcgaagagtttcctgctctcaagtcctcctagttaagccatgaaggccttaagttcgaagattcttaagaaatcggacgctcttgttacggtcgcacataaggcgaagtccgctgggttcgaaggcgaagagtatgagcccgacgt

SEQ ID NO: 59491 - DNA, 417 bp, Zea mays
  Clone ID: LIB3069-026-Q1-K1-F4
tttgggctgatttatgtgcttgtggatgtgcgggtggatgtgcgggtggatctgcgcgctattaatagtgttcctgagttactgcgtacgacggttaagcgtgatttttgttacggtaagcatacggtacgtcgttctacgcattgcggcgacgcggcctttaaggatgcgaatgtcgtcgcggttataactaagattaagtgtattacttagcctgcggatcggcgtttgatcggtcctaagcgtggaactaatcattagttctttagtgctgcttttggtggcgattcggttaaggcgtagtgcgttgcgcgtacgactcttaatcttattagcgccgcggaggctcctctttgtaccgattataagcctgattctacgcatgttaagtgtgttcctgcgtatcggcatgctggc

SEQ ID NO: 59492 - DNA, 463 bp, Zea mays
  Clone ID: LIB3069-026-Q1-K1-F5
ggacctttgggctgctttatgtgcttgtttatgtgcttgtttatgtgcttgctccgcgcgtagccatacccatagtcgcgaagaagatcgccctctggtcctcctcaccagcagccctaacgggtcacggcgccgcctcatttataccgggcggtacaatactaagagccgtcgtctccggccctactcaccccgccgtcctagaagtctccgaatccgccgaaaactcgggaaacactaacgatcctctcggaaagataaggtcaccttcagcgccgttcgctgtcgcatccgacgtcattcccactactcggacacccctacattctctcagaatcccggagaagtcgtagtcgtggagaagtacggtaaaatccgaaccacacagaaagcccataaacctctccgtcgcgctagcgtccactctaactgtccggacacgtcatgagtcacaccctaacgt

SEQ ID NO: 59493 - DNA, 406 bp, Zea mays
  Clone ID: LIB3069-026-Q1-K1-F6
ctggctctggacctttgggctgatttatgtgcttgtttatgtgcttgtttatgtgcttgcgtcactggcgtcgtaggacccggaaatgcgtcacccgaccagaagatgagtgcttcgataagcgggcattcacacttcgcacggattacccctccgcagtagcccgccctgtactcttacgcaccctctaacccggagatcggagagagaataatagagagaaatcgacgccgaggataattacagaagcaaccggccatgtccgagaggaggaacccggtaaatagggatcacaccccggagagcgaccccggcctccacccgaaacctccacgccgtgctaacatatcgacaacccttaacgctcggccgcgtcctcatgaagacttaaaaccttccggattaa

SEQ ID NO: 59494 - DNA, 433 bp, Zea mays
  Clone ID: LIB3069-026-Q1-K1-F7
ggctctggacctttgggctgatttagtgcttggtaaagcgacaatctcgcagtcgacttacccatagaggtacctcccctcagtatcccgtgggataccgaaccctagaagtagaaaggcggaatcacaggtgaaaaacacgaataaacaaagataagcctacgatctggaataaatatgctatgacgatcggccccaaccccgccaagagaacctgactacccgcccgatacggcctagcgaaacagaaattgctagccccagcagtacttaatcaaaggacgcccatacgagtcgccacctctaaactctatggctcgagtgggcccgtctgtttaccggtaatacccctaggcccagctaagcggtaacaagtcgcttcccggcgagtataggctcgcataggaccatccgcgcctgcgaccggcctcat

SEQ ID NO: 59495 - DNA, 446 bp, Zea mays
  unsure at all n locations
  Clone ID: LIB3069-026-Q1-K1-F8
gacctttgggctgatttatgtgcttgttggaacgatacttccttagaccctcctacctatcctcgggcgaggagaacggtctcagactgtaggaatcacaagtagtccgcggaaatcatagccgagacggtaaataaggccggagccgtcgacaccgccgggagggccgccgaggactcgaaagacgaaagcgagtttcatagaagaacggcgacggaaataactgagaaggcggcagttaatccgggcgtactagacaccgacgtctgctcggaggagtcgtccaccgacggcactccgcacgtcccttaagagtagatcagcgacgatgtanacgccacgtcaaacggccccggagtcgcggccaacgtatccggatagagagccaagtttcattccttctagacncgcggcatcactaagcggtgaccggaataatagagcgt

SEQ ID NO: 59496 - DNA, 424 bp, Zea mays
  unsure at all n locations
  Clone ID: LIB3069-026-Q1-K1-F9
catggatccccacttcccccaccccaaggtttcgaagcgtacgctacgcgcactgccctggggcgaccgccccgccgctggcgggtcggattgggtccgatccggatctggatcagcaccggcatcgccgcgacaaggatgtcgaccccgaggcagcggcatacctgcaccttcggcggaggcggaggagggaggcgcgccgcctccgggtcggccatgctgccccccgtggtggtcctcgtgttcctcttcgtggtcgcgccttcgctcttcttcgtcgtgcgcaatgacggtcgcgcccacgctcacgtncacgtagcctccgatcgcaagggtaagaatggcaatcaagaagcagcagcaatgaagaacctcaaatctaatttgcccaaggaggtgtttgatgctataactgctagtcaac

SEQ ID NO: 59497 - DNA, 411 bp, Zea mays
  Clone ID: LIB3069-026-Q1-K1-G1
tttgggctgatttatgtgcttgtttatgtgcttgtttatgtgcttgtttatgtgcttcgaaggtaattctatatagccttaggagtagaactccttcaatccttcgtctcttccactaacagagtctctgaatgacgaaaaattcttcgagctcagaaggtccgtcggcaccacttccaagaacctcccggatgtaaaggacctcgtgaaaaaggaatcatcgatctagtaacgggcaagtgcggatttactcactaaaccgaagaccaaggagctgccgtcggcgatatcaggactcctggcctacgacgtaaggtacattctcctataagctaccgtcaaggccgtcctaaccgagacattatgctgagaacggtaagactctaccgttaaaccatcggagaatacgat

SEQ ID NO: 59498 - DNA, 469 bp, Zea mays
  Clone ID: LIB3069-026-Q1-K1-G10
acccacgcgtccgagcggctcgtctacgactacctccccaactgcagcctctccgccatgctccacgggagccggggctcgggccggacgccgctggactgggaggcgcggatgcgggcggcgctgtccgccgcgcgcgggctggcgcacctgcacacggcgcacaacctggtgcacggcaacgtgaaggcgtcgaacgtgctgctccgcccggacgcggacgcggcggcgctctccgacttcgggctgcaccagctgttcgcggcgtcgacggcggcgcgggccggcgggtaccgcgccccggaggcggtggacgcgcggcggctgacgtacaagtcggacgtgtactccctgggcgtgctgctgctggagctcctgacgggcaagtccccctcgcacgcgtcgctggagggcgacggcacgctggacctgccccgctgggtgcagtccgtggtgcgggaggagtgga

SEQ ID NO: 59499 - DNA, 477 bp, Zea mays
  unsure at all n locations
  Clone ID: LIB3069-026-Q1-K1-G2
tttgggctgatttatgtgcttgggaggaagcgactctttcctggttcgttcccaggcacatatagggttggtagtgttgttttcgcgtcggtaccctctccaagccccaatatttagcacggaattacagtgttacggacggacggacggctctcctcctcctcttggcccgagccccctcggcgccgggcaggtacattcgctgctcgctagtgcagatacaaaacaaaaggctctcgggatgtctgtttacgcacgcacgcacacgacgcgaagcgacttaaggcggcctgtgcatcacggtaacaaatgcgcgggaaagtgacgcactgctgacgatcgctgttgttcgtacggacggtatgggaacccatctctcgggccaccacataacgtggtagtcggtcacgtcgacgtcgcgttaatcgttactacccatcttaaaaaaaacanaaataccgnggcacgcgcgcgaag

SEQ ID NO: 59500 - DNA, 432 bp, Zea mays
  unsure at all n locations
  Clone ID: LIB3069-026-Q1-K1-F10
cccacgcgtccgctcacgcgtccgcggactcgtgggcgtgccgtgcccgtgtgcatcggggaaaaaacagcagcaggggccgaatcggagctccgccgccggcagatctgcgccggccggtctgctccgcccagcggacatggaccgcgacggccgcccggggtggctaccgtcgctgggcttcgccttcctcagcttcaactgcgggatggccgtctaccgctcctgggacgacccctacgccgtcgccttcgtcctcgccgcgtaccgccgcctcgtcctcctcttccgctgcctccaccttctggagcgccgccgggaccagcgcctcaagctcgccgtctggggcctctccacgctcctcacactcatgttctcgtacaagatcgccgncgtgatngccgcctgggcccagctgctcgtctggggcat

SEQ ID NO: 59501 - DNA, 320 bp, Zea mays
  unsure at all n locations
  Clone ID: LIB3069-049-Q1-K1-G10
gcgacggaggaacgcctgggcggccgtnttgttgggctccaccgcggtctggttcggcggcgatcttgtgggatacagcttcctctacgtactcttgaaaactagcagagcaagcaagccagccactttacctagctagtgttccggctgattccactggcgacgattcgagtttgagaagcacgtgggggcggagtcgaagaaccagaacggtaacattctnctcaccaacgacaagttgctctacgacctgtttcacgagctcagaaattggcccccttgtgcggaggagtttcgggcgaacgccggggtactcatga

SEQ ID NO: 59502 - DNA, 306 bp, Zea mays
  Clone ID: LIB3069-049-Q1-K1-G11
gcctcacgcagacggacttgatcgcgctttttttcgcgcacacgatcggggtgacgcagtgggacaagttcgtgcggcggatctacacgttcaagcagcggctggcgtggaacccgccgatgaacctggacttactgcgctcgctgcggcgggtgtgccccctcagctacagccccacggcgttcgccatgctggacgtcaccacgcccagggtcttcgacaacgcctacttcaacaacctgcgctacaacaagggcctgctcgcctccgaccaggtgctcttcaccgaccgccgctcccgaccca

SEQ ID NO: 59503 - DNA, 408 bp, Zea mays
  Clone ID: LIB3069-049-Q1-K1-G12
aggaagaagaggaagcgtgctcaagcaccgtcgtgcgagcaccagcttctgctgggagcgcttgcgtgctgatgctgttctgtgatacggcgctatcctcgccgagcttattcctcgacttccaacctattcaccaccgctgtcagaacccttcttgtgacaaaaagttaagcgagcgtcttcttgaccttgcaagactttttgtccggagataatctcctacgaattaccctcttgcatcttgcgactacctctcctcgtctcgcgcctgtcgatccttccatccctctcgtccccgtctatccctcttgagcttggaacactctcgcagctagtagtagctatatattattggtttcctttcacctactttcgcatgaactactctgctatttgctggaataaagc

SEQ ID NO: 59504 - DNA, 358 bp, Zea mays
  Clone ID: LIB3069-049-Q1-K1-G3
cgacacctggtctgactcttcggattacctatacaattacacaaaaaacaaaactaaaaagggcacggggcaaataaaaaaaggaaccaggcaacaaaaccataaaggaaaccctttatgaagaccaaactaacaatcacctccatatcaagctctacaactaatatacgtataccaacatttaaacaaatggccctgctataacaaccaccttacttgcaaacccttgacgtaacctaaattacaccactagtcatgaaaagctcttctaaaccatgacctaaacctgaaaaggtcctactacacgtactttaccaacaggtgcgcactctaataaagcaactacaccaccccttac

SEQ ID NO: 59505 - DNA, 347 bp, Zea mays
  Clone ID: LIB3069-049-Q1-K1-G4
cggacgcgtgggcgcgaagtcaaatctcacttcaccagtggctgccttctccgctccgcgcggcgcctgccccaaagcttcagtggctgctgcgacccttctgttctccgctcttggtcttgggtgatcgccggcggtacttgtagcggggtatttatctgagggaagaagaaactatacaattcatcatgtcaggagggtcgtctgaatcttccccgttatctggacaaaatagccttagttctctatcaatttccaaggacaatgaactatcttcagagtctggctgcttgtccattggtgtactaagcgcttctggagaccttgcttagaagaaaactttccca

SEQ ID NO: 59506 - DNA, 447 bp, Zea mays
  Clone ID: LIB3069-049-Q1-K1-G5
cggacgcgtgggaaagggccggacccgaaattgcggtacatgtggagagtgggtgctcgccgtacaaacacccgttgtaaggagctaaactcagaacctgttattcctgagggattacctgagtgggaagagatgatggattcctggggttctaaaatgatttctgcaattgaggttgttgctgagatggctgcaataggctttggcctatcgaaggatgcatttacttctttgatgaaagagggaccacatctcctcgcaccaactggaagtgacctgcagcgtcatggttctgagggcaccgtttttgctggattccactatgatcttaatttcttgacgatacatggccgaagtagattcccaggccttaacatctggttaaggaatggtaaaaagatggaggtgaaagtccctgttggttgccttctaattcagtctggaaaa

SEQ ID NO: 59507 - DNA, 161 bp, Zea mays
  Clone ID: LIB3069-049-Q1-K1-G6
ggacgcgatgaaaatttcatctcaaatttgcgaacatgtccagagcgcggggctacgggtccaacacccgagtggatgagctaaactcagaacctgctattcctgaggtattacctgctccggaagagatcatggattactgtagatctaaaatgataaca

SEQ ID NO: 59508 - DNA, 240 bp, Zea mays
  Clone ID: LIB3069-049-Q1-K1-G8
gcggcaagccagctcgcgagctggcctgtggctttatccaacaacaatttcttatatagaatcagagttagcatataatagtagtactgagtcgataattaatttatgctatttgagattactatacaaaattgatatattatctatattatattagtgatatattaattctactaatttaaaatatttttaagagtttatattataatttagagagcagatgtacatttatgggtaggc

SEQ ID NO: 59509 - DNA, 225 bp, Zea mays
  Clone ID: LIB3069-049-Q1-K1-G9
gttgaggaacccgaagtgatcgcccaacctgtcaccttgcagcagttatgccctttctgtgggttcacggaatccgtgcctctgttgaaaaaactgtagcttatgtgtgtcttggcggattagctggttatcttgaactgacgttcatgtgacatggcaatggcacatgaacatacgtttcatgagtttgattgttaattggcgcttgcagcactttgatccctg

SEQ ID NO: 59510 - DNA, 443 bp, Zea mays
  unsure at all n locations
  Clone ID: LIB3069-049-Q1-K1-H10
cccacgcgtccgttttttttctttatgattccttcctaatatgtatgatgagttagttgttgtctcattctagttttgtcttaggcaaaaaaaaaaaaaatccatgatcttgttggcatgaagtgtttgaagttgtgactaaagctatgactagttggagtcttgagatgtttattttctatatgcccatacacttacatgactaggaagtttttttttctctagtatatttaattcttctgcactagggcaacaattatcatatattcggaattcatggttcctttgtattttagtttatgttgttgcacatcagttttctgttcatattaaattatgggttcacatatataagctgcatgtttggtcgaattgttaattttgcttgtcaaggaggatgcacacctagattagacaangtggttcttatgcatgtagtcagt

SEQ ID NO: 59511 - DNA, 453 bp, Zea mays
  Clone ID: LIB3069-049-Q1-K1-H12
gacttgccggaccgacgcgtccgaagcgcctgacactgtcactggagatattttctttgttctccagcagaaggagcatccgaaggtcaagagaaagggcgatgacctcttctacgagcacaccctgaccttgactgaatctctgtgtggcttccagtttgttgtgactcacttggataacaggcagctgctgatcaaatcaaatccgggcgaagttgtgaagcctgattctttcaaggcgatcaacgacgaaggcatgcccatgtaccagaggccgttcatgaagggcaagctgtacatccacttctcggtggagttcccggactcgctgagcccggagcagtgcaaggccctggaggctgtgctcccgcccaagccggtgtcgcagtacaccgacatggagctggacgagtgcgaggagacgatgccctatgacgtgaacatcgaagcgga

SEQ ID NO: 59512 - DNA, 366 bp, Zea mays
  Clone ID: LIB3069-049-Q1-K1-H2
ggtcgacccacccgtgcggagcgacaagaagaacattgccaccctcttttcagagtttgacaagattaacaaaaagcttggctttgggaaggaggatcttggcaagatcgaagaagagcttgaattggaaattgccaaaagtgagctgactgaacttaataaggaatgcgttgaagcaatggagactcaactcaagagggaggagtttcaagatgaggagatgcctgatgtcatgaaattggacatcataaacttactgtaggcctgatcgacgataaatctttaaggccaaagcacctatggctttgcgttcaagttgaacggtgcttcacacctatgaacgcctgttctttccttttttgaata

SEQ ID NO: 59513 - DNA, 425 bp, Zea mays
  unsure at all n locations
  Clone ID: LIB3069-049-Q1-K1-H3
cccacgcgtccggcaggaggcgctggaccagtatcccctcgcccaccatgaacttcacccaaggcctccggtccttccagaacaagagcctgaacctcgccgacctcgtctggctctcaggggctcacacgatcggcatctcccaatgcaactccttcagcgagcgcctgtacaacttcacggggcgcggcgggcccgacgacgcggacccgtcgctggacccgctgtacgccgcgaagttgcggctcaagtgcaagacgctgacggacaacacgacgatcgtggagatggaccccggcagcttccgcaccttcgacctgagctactaccgcggcgtgctcaagcggcggggcctgttccagtccgacgccgcgctcatcaccgacgccgncttcaaggccgacatcctcagcgtgatcaacgcg

SEQ ID NO: 59514 - DNA, 411 bp, Zea mays
  Clone ID: LIB3069-049-Q1-K1-H5
cggacgcgtgggctgagctgctcatccgcattctccccttccagcgcctcgtccgcgagatggcgcaggacttcaagactgatctgaggttccagtcctccgccgtcgcggcgctgcaggaggccgccgaggcgtacctggtgggtctcttcgaggacaccaacctttgcgccatccacgccaagcgcgtcactatcatgcccaaggacatccagctcgcgcggcgcatcaggggcgagagggcttgagcgcccgtcgtgctgctcgtcgttgtagtgttactagaagtagatggtggctttcgtttcgtggcttccttatcctgtaggagtaatgttctagatgtcttggcttcagtgcaatggactgtgtttgctcatttctgaaatttatcaatggacttgttcttgc

SEQ ID NO: 59515 - DNA, 380 bp, Zea mays
  Clone ID: LIB3069-049-Q1-K1-H8
cccacgcgtccggaatccttctttatggccttcatcaactgcaccatcgaggagagccttggtcggtaccgcggcgtcacagcggctgccaagaaacacgggctaagcatccgggggtacgtgtcatgtgtgattgcttgccccgttggaggcgcaaccgatccggcgaaggtggcgtacgtagctaaggagctgtataccatgggctgctcggagatctcgctcggcgacacgaccggtgtcgggacaccaggtagcgtggttgctatgcttcaagctgtcatgtcgtttgtcccggtggacaagattgccgttcatttccacgatacgtacgggcaggcccttgccaacattctcgtctcccttcaaatggggatcaa

SEQ ID NO: 59516 - DNA, 349 bp, Zea mays
  Clone ID: LIB3069-049-Q1-K1-H9
gacccacgcgtccgcagaaggagaacatcattaacgccgccttttctttcggcaacatcacgttgagcgtcacgaagagcatcccggagaccggggaggtcatcggcgtcttcgagagcgtgcagccgtccgacaccgacctcggggccaaggcgcccaaggatgtcaagatccagggggtctggtacgctcagctcgagtgattcgagtgtctaactgctaggtgtccgaccgtcgtcatggatcttgggaaggtgtatgtataccatggaaaactttggagagcagaggaggaatcgtgtatgtaatgtacttgttaatgcaaattcgggctgtcgcttttttactc

SEQ ID NO: 59517 - DNA, 289 bp, Zea mays
  Clone ID: LIB3069-049-Q1-K1-F9
cccacgcgtccggaacatcgtcttcatcgtcggcgcggacgacgtgcgcggccagatcccgtcggcggtgggcgggctgacggagctcatgtcgctgacgctgttccggctgccggggctgacgggcgccatcccgccctgcctcacggcgctgtcgaacctccagttcctcaccgtctcccacaccaacgtgtccggcgccatcccggagtcgctggcgcggctgcgcggcctcgactccgtggacctctccagcaaccggctgacgggcggcatcccggcggcgttc

SEQ ID NO: 59518 - DNA, 315 bp, Zea mays
  Clone ID: LIB3069-049-Q1-K1-E10
gccccatcccgccatccgcccgcgcggcgtgcgcagagccgagccgagctgccggaacgcaggcggcggcagcgggaggcctccgaaacgcagcggaacacctgaggaggcggcttcccgccgaatgctctaggaggaggcgcggcgccggcggagatggggtccaagtacacgcgcgggtgctgcggctggctgatcgtggcgctgattgcggcgctggtggccacggccgcgatgttcgccatcatgaagcgcaagcccggggcccgtcacatcaagcccgtgccggtgccggggccggcgggggccatcgac

SEQ ID NO: 59519 - DNA, 352 bp, Zea mays
  Clone ID: LIB3069-049-Q1-K1-E11
ctcttcttcacctcactaacaccagctagtaactctttctctcctgcaataatggccggtcgctcctcctcctcccagccgcagctggtcgcggcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaggccacctgcaactgcctcaagagcatgacgggccggctcggcggcggcgtcagca

SEQ ID NO: 59520 - DNA, 439 bp, Zea mays
  unsure at all n locations
  Clone ID: LIB3069-049-Q1-K1-E2
cccacgcgtccgatcatacctgatgaacttttggtcttattttcaaatggccaagactaccggttggcattaaaatggaacaagcatagtgtcagggcctaaggaggcccacggaggggctgcgacagcagcagccatgggccctccaagggggattagataaggatagttagagataagattagaagattagttgagattatttaggagattagttgagattatctaggaaggttatcagttagtagtttgttgagagtttttaggagagttttaaggagataaggatcagtagctagataggggcggccaatcggcctatttatgtaatcaatggatgagaaataaagcaagcaagaacggggaagaccaatggggcatctnctgagagaacgagcatattcatttatattgctctggaagtatttaactagtttac

SEQ ID NO: 59521 - DNA, 447 bp, Zea mays
  Clone ID: LIB3069-049-Q1-K1-E5
tcgcccacgcgtccgcctggcatccgtttagagtttgttccgtccaggcaaccaaaagggaagggggcccgtcgcgcagaggaagaggagagcagaggaggatggctcgtacgaagcagaccgcccgcaagtccacgggaggcaaggccccccgcaagcagctcgccaccaaggcggcgaggaagtcggcgccgacgaccggcggcgtgaagaagccccacaggtacaggcccggaaccgtggcgctgcgcgagatccgcaagtaccagaagagcacggagctgctgatccgcaagctgcccttccagcgcctggtgcgcgagatcgcgcaggacttcaagacagacctccgattccagagccacgccgtgctggcgctccatgaagccgccgaggcctacctcgtccggtctcttcgaggacaccaacctctgcgccatccacgct

SEQ ID NO: 59522 - DNA, 447 bp, Zea mays
  Clone ID: LIB3069-049-Q1-K1-E6
gaggaaatgaagaaaaacgctcaagctgctttagttactgctcattactacgaggatgagagtgctcctactggcacatgtgctgtatgtgttgttggtggtgaaaggtcattgattgcaaatctgtcagcggcaaactgttacaaatctgagcatctaaagagaccagagaactgggcactagttgaaaaggcaaaatacatctacattgctggatttttccttacagtgtcgcctgattctatccagctagtcgctgagcatgctgcagcaaataacaaggtgttcctgatgaacctctctgctcccttcatttgtgagttcttccgtgatgcccaagagaaagtcctcccgtatgctgactacatcttcggcaacgaaactgaggcaaagatctttgccaaagtcagaggatgggagactgagaatattgaggagattgctttg

SEQ ID NO: 59523 - DNA, 445 bp, Zea mays
  Clone ID: LIB3069-049-Q1-K1-E7
cccacgcgtccgcggacgcgtgggcaaattttgtaaaacggggttttacctagccctacttgtggtcaattctcgagcgtattagcagtagacagtagtagtagtctgggtcggaacccagtcaagctcagcgcctgggttgcgtttggactccagtgcagaattgcgtagaggatttagaggaagagcggagctgagctgagcgaggcaggagtaaaggacaacctgtatgtcactgttagtgggcccagtgccacgtgaaagtcaggcactgttggtgcccattgacggccggacttgccagcgacgcggatgggcgacgtgaacgtgtctggccgagcagtgcgctcgctccctccccccaatgggccatggcctcttccgcgaaagcgtgctcccctgtaagtatctgatttggatgctagccaaagctgctggatgatta

SEQ ID NO: 59524 - DNA, 256 bp, Zea mays
  Clone ID: LIB3069-049-Q1-K1-E8
ccggcgggaaattggaactgtggtaaaatgttagtgaggatttgttacacgagtcttcacatgatataagttctccgactatggattgcgacaataattcaaaaaaaaaaaaaaaaaaaaaaaaaaaaaaaaaaaaaaaaaaaaaaaaaaaaaaaatacaaacacaagcatacaacaaaataataataaataatagagtaacctaaattaaattaactggtccgcagattcacaactttcactactgggaaacccc

SEQ ID NO: 59525 - DNA, 331 bp, Zea mays
  Clone ID: LIB3069-049-Q1-K1-F10
cccacgcgtccggatcttcccagccatcttcacatccttgaagagcacggatgctagcgatggttccgagaacgcgctgatggatgagctgcaggcactgcatgagcatctgaaagctcatggcccctacatcaacggctagaacgcatcaccagctgatcttagcatggtgacaaagctcttcacacctccaggtcggactggagcatgacaaaggctggcagatgcccgaacatctaaccaacgtccacgcctacaccaaggctgctttcagccgtgaatctgttgtcaagactaatgcatacgatgagcacgtgattgcaggatgggc

SEQ ID NO: 59526 - DNA, 329 bp, Zea mays
  Clone ID: LIB3069-049-Q1-K1-F11
cccacgcgtccggaggatgcgagggagcttatcgcggcgccatggacgacgaggagcacgagggttacggccaggaaatgccggaggacggcgacatggacggcgctgacgttgatatggctgcctccggcgatgacgcggcgaagctgcaggagctcgacgagatgaagcgcacgctgaaggagatggacgaggaagccgccgtcctgcgcgatatgcaggccatggtcgccaaggagatgcaaggacgcgaccctagcgcatctacagctgacgcaaaagaacaggtggatgccccggctgtgcatgttggaaatgtggattatgct

SEQ ID NO: 59527 - DNA, 291 bp, Zea mays
  Clone ID: LIB3069-049-Q1-K1-F12
cccacgcgtccggcacggcaagagagagtgttttttcgttcgatctgctgccggagtgcgaagaggacgaggaagaggagcgccggaattgtaaagatgttcctggtggactggttctatggggtgctggcatcgcttgggctgtggcagaaggaggctaagatcctcttccttggcctctacaacgccggcaagaccacccttctccacatgctgaaggacgagcggctcgtacagcaccagtcgacgcaataccccacgtgagaagagttgagcatcgggaggatcaag

SEQ ID NO: 59528 - DNA, 383 bp, Zea mays
  Clone ID: LIB3069-049-Q1-K1-F2
cgccaagcggtgaagcatcatcggtcatggtggagacttagccagcgccagaggccatgctgcgcttgtccaatgccgcgctggtcctcgcctccctacgccggccacgcgcgccgacgccgacacaggatcgccgccggacctcctactctccctcctcggccgccgcagcggagctcgcgcggctccggtccgaggggctccttcgcagcgccgagatcgcagcggcgcggcgcgaggccgctgcccacgcgcgggtcgacggctccgagctgctcctcgtcctcgccgtggcgcccggcgtcctactgcttcttctcctcgggcttctctaagccagcggcggcctgggtagcgcggtggctggagtctggggcccgctt

SEQ ID NO: 59529 - DNA, 447 bp, Zea mays
  Clone ID: LIB3069-049-Q1-K1-F5
cccacgcgtccgcccacgcgtccgatccacatgaccaccagaccagagccacagcaccagcggcagccacccaaagcccaggaccgcctcaccgccaatggccgaccgcgtctaccccgccgcgaagccgaacccgcctccaggcgcggcgggcaacagcaacggcgcgcaggcgtcgtcgttccctgcgcccaagtcgcagatgtaccagcggcccatctaccgtccgcaggcccccgcgaagcggcagcgcgggcggtcgtgccggtgcagcttgtgctgctgcttctgctgggcgctggtggtggtgatcctgctggcgttcgtgggcgccgtgtgcggcggcgtcttctacctgctgtaccggccgcagcggccgtcgttcagcgtgtcgtcggtgcggctggcgtcgctgaacctgacgtcgtcggcgacggcgcccgtgct

SEQ ID NO: 59530 - DNA, 442 bp, Zea mays
  Clone ID: LIB3069-049-Q1-K1-F6
cccacgcgtccggatagattacttatacctttaaccttcagaatacaatcataggagcactggaaaattatcggaggacatgatatcatcacatgacatgaaacgactagaggcgtattcaaacaattcaaaccgattatccatgtgatgctggatctagtacccatgcttgcacatcagtattttttacacaggcttccaatgtgattacatggtgcatatacagttcgtatgttctgtctaagcctgcacgacaacgacataggcactgcgaatggagatctcgctatagaaagggcacatggtctatcaaacttcatacagacaatgaagaaactgcatggttaccttcataacattggaaggaaaaaaatcggaacaaccttacctcgactgaaatacattgaaatgccctcttttagcaaatcgatggatgaggacc

SEQ ID NO: 59531 - DNA, 448 bp, Zea mays
  Clone ID: LIB3069-049-Q1-K1-F7
atcttgtcctccaccaagaacgcccagctctttgacggccaagttcccgtgccggcgcagcgggtaccgtcgaatccggtgctgaattccgaggtctcaccggcgacagtgagccaaggtcctccagaccatcctcccggcgctcgtccgtcgccgcacagcggcgtggccaacggcaagcaaacgccacggaatcccgtcgctacctcgccgagccaggatgaccggtccggggcagggaaagagaaccagtcgtgcagcaacacgccgagcacgagcagccgccagtcgccgtcgcagcagaagacgcccaagtccagggcgacgccgccgcctgacaggcgcagggttactcctgctcagacaagccctgctattgcgcctgaccgtaaacggcctgccgacgctgctgctggcactggcagcaactctgacaaagtgacgacct

SEQ ID NO: 59532 - DNA, 451 bp, Zea mays
  Clone ID: LIB3069-049-Q1-K1-F8
gaacaaaccattgttggacgcgttcccctcctgcacgcaacctcatctcgtcctgcagatcctggatggccgtcctccttgataccttgcctcgcgagtgctctcggtgagctactttgttttgatttatcaggaaatccgtttgcttcatgttatgcaggctcagatctgattgctggattcggcatcttacgggcttgaatagagctaggactgggagaaaacaacaaacccgcgttggatcctgtatcggttagtccttgccttcaaggttcatgttgttttgttttggtggtcgagcatcgcatgttctgcttctggttccagatctggagaaatttctaagtcgtcgtcgtcgtcgtcgttcggttcggagcggatctgaggcgacgatggctggaagcggcgggatctcttggtctgcaatcctgcttcacctcgatggatgatg

SEQ ID NO: 59533 - DNA, 354 bp, Zea mays
  Clone ID: LIB3069-049-Q1-K1-E1
gtcgaccacccgtccggaccgagcgaattgaccacagcttctcaccttcgctattttcgatggcacccaaggcggacgggaagcgggctgctaataaggcggcagaggatgagcccgcgacagagaaggcggataatgctccggcggggaagaagcccaaggccgagaagcgcctcccggcgggcaagttctccggtaaggagggcggctagggcaagaaggggaaaaagaaagcgaagaagtccgtggagacctacaagatctacatctttaaggtgctgaagcacgtgcaccccgacatcggtatcttgttcaagggcatgttcatcatgaactccttcatcaacgacattt

SEQ ID NO: 59534 - DNA, 369 bp, Zea mays
  Clone ID: LIB3069-049-Q1-K1-C1
tgcttccatcgaatgacgctgactgactatctggacgggtgtgatcgaaatgcgcaaaactaaaatctgagcaccgctcactgttgaggctaaccaggacgtaaccagaatggagatctttatatcgcttgcgcgcttatcgtagccatactgtgactgctgtgcagcttcggagaacgctagcaacatgaacatgcctcttggcttggtgcaccaacctgtcattccatcaacacgcagcatccaatgagactagagaaaaccctgtaacattttaccaagtgctaatagcacgagctcatgtaacttctgcagcgactatcatccccaatattccagtgcattgcctgactttactgagacatctta

SEQ ID NO: 59535 - DNA, 385 bp, Zea mays
  Clone ID: LIB3069-049-Q1-K1-C10
atgcgcttcagcacccatgtcaaggacgatgatggcaaccctgcgttcgccctggtcagcaaggccactgggctcgccatcaagcactccctcggccagtcccacccggtgaagctggtgccgttcaacccggagtaccaggacgagtcggtgctgtggacggagagcggcgacgtgggcaagggcttccgctgcatccgcatggtgaacaacatccgcctcaacttcgacgccttccacggcgacaagggccacggcggcgtgcacgacggcaccaccgtggtgctgtgggagtgggccaagggcgacaaccagagctggaagatcctggcctggggcgacgaggcctacgccgcgggaggcatcagcggcgtcaacgcgcccc

SEQ ID NO: 59536 - DNA, 359 bp, Zea mays
  Clone ID: LIB3069-049-Q1-K1-C11
cccacgcgtccggctgaagatgtccaggctctcctgcgccatgaacctcacctccgacgggaccggcgcgcaccacggctggtactgcaactacctcgaggccacggtcacggggccccacctcgggtgcgcgcagcagctcttcaccgtcgagcagtggctcgccaccgacgcgtcgccctaccgcctgtacgcggtcgtcgacaagtgcaagacgaagcggcaggagccgcgacgctcgccggccggcgaggccgaggccaccgtgaccgtgctctaggtacgaccagtagtaaatcatcgacagaggctagctcctgcctctgctgtgtgtaattactgtatgtgagtgaccgatc

SEQ ID NO: 59537 - DNA, 397 bp, Zea mays
  Clone ID: LIB3069-049-Q1-K1-C12
cccacgcgtccgcccactcgtccgcccactcgttcggcttcgggctctacgtccccagggtgtgtgccacacccacactgagcgatatacgaaaaccgacggcgcctggcccctaggacctagtcacagacccttgatctttcttcgacgcgcccccgggcatggcgaaccgcagtgttgccatgggcttggccctcgcgttcgtggccatgaccgcgctctgttgcgcgccgggcgccgcggagttgccccggctggagcactcggccaggagcgaacgatcgctgaagctgctcgtcgtcggggacttgggacgcagggggactcacaaccagtccccgggtcgcgacccgatgggaagggtccgggagaagctcgatatcgactttggtatatc

SEQ ID NO: 59538 - DNA, 397 bp, Zea mays
  Clone ID: LIB3069-049-Q1-K1-C2
gttcgtgggcgagcacactacgcatgcgtttttgtttttcgacaaggcagaggacgcgagcggggtgggggtgtcgttccggggcacggagcccttcaacatgcgggactggtccacggacgtaaacctgtcgtggctgggcatgggcgagctgggccacgtccacgtcggcttcctcaaggcgctgggcctgcaggaggaggacggcaaggacgccacgcgggcgttccccaaggccgtccccaacgccgtcccgggcaagccgctggcctactacgcgctgcgcgaggaggtccagaagcagctgcagaagcacccgaacgccaacgtcgtggtcaccggccacagcctcggcgccgcgctggcgaccatcttcccggcgctgctggcgttccac

SEQ ID NO: 59539 - DNA, 356 bp, Zea mays
  Clone ID: LIB3069-049-Q1-K1-C3
cagaggacatcttggattttaacactgaatttactctttaatcacttatataattgatggcgggtaacggagtagttgaataggttagaccatgtatgattgatctattcacttcgatgacgatccttcacccaacttgtatggctacctacgcctgcttactgcttacacagggctagcgctcatgctggagctcactgagaccagggctggatgctttttcacaaatggatgggctgcggatgcctttcagttgtagcacaagtcttccacctgaactgacgattttctgacatgatacgcgtttgatctcagctgctgcttcatgcgagattactactatttatgtgtatctc

SEQ ID NO: 59540 - DNA, 239 bp, Zea mays
  Clone ID: LIB3069-049-Q1-K1-C6
gacagactggggaaaagatattgtctggactaatggatcagttacagaagatatgctaactgatttcaagatgcatgtgtcatggttggcggtcaatttactgcatacctaaacgggttgcattcaaaggttctgcacctctgaatctttcagatcgtcttcaccaggtgcttcggtgggctcttgggtctattgagatcttcttcagcaatcattgccctctttggtatgggtatggt

SEQ ID NO: 59541 - DNA, 434 bp, Zea mays
  Clone ID: LIB3069-049-Q1-K1-C7
cccacgcgtccggtgagtttccggcaagggttctaccaggaggcgatcatcttctgctccagcaagaacgcccagctccccgacggccaagttcccgtgccggcgcagctcgtaccgtcgaatccggtgctgaattccgaggtctcaccggcgacagtgagccaaggtcctccagaccatcctcccggcgctcgtccgtcgccgcacagcggcgtggccaacggcaagcaaacgccacggaatcccgtcgctacctcgccgagccaggatgaccggtccggggcagggaaagagaaccagtcgtgcagcaacacgccgagcacgagcagccgccagtcgccgtcgcagcagaagacgcccaagtccagggcgacgccgccgtctgacaggcgcagggttactcctgctcagacaagccctgctattgcgcctga

SEQ ID NO: 59542 - DNA, 448 bp, Zea mays
  Clone ID: LIB3069-049-Q1-K1-C8
cccacgcgtccgcaaaaccctagctcgcccttcccaattccccatttcggccacaccctcggggcctccacggatccacccctgcttcaggttacctgtgccagcgacgccggtagaagccatggacagctctctcgcgagcgcggcggcgatagccgatcagcgccagaagatcgagcagtaccgccacatcctcgcctccgtcctatcgtcttccccaccggacatctctcaggccaagcgcttcctcgaccacatggtttccgacgaagttccgctcgtggagtcccgtcaattgctccagacgttcgcgcaagacctagggaagctggagtcggacgcgcagaaggaggttgcccactacgcgctcacgcagatccagccgcgtgtggtctccttcgaggagcaggtggtagtgattagagagaagcttgcagaactatatgag

SEQ ID NO: 59543 - DNA, 398 bp, Zea mays
  unsure at all n locations
  Clone ID: LIB3069-049-Q1-K1-D1
gcgnccacgcgtccgcttgtctctgttgacactcttatctatgaccatctctgcgctgagccagtgagcgaggacgttcagagctgcgacattgtcgccttcaacaagatctaaatttccttgtgatggtggcaatggtggttggtgggcactgtaccagcctaatttataattttccatgagcatcttcaagagtttttctaaattatcatttggagtcatttacataaaaagcactttctatatctttttaatctcaacaacttttctatatcttgttggcaccatctttagctagcgagaaacctggatggctggaatagaagataactatatttagacaatacttttagtaattcttgtgtgatcggatgcataatggcttggtctggctgggt

SEQ ID NO: 59544 - DNA, 404 bp, Zea mays
  unsure at all n locations
  Clone ID: LIB3069-049-Q1-K1-D10
ccacgtttgcgaacagctctggagatgctgttatcgacacaagagatagaaaggcgtctagaagaggtttctttgcccttgatcattttgcacggtgaggctgatatggttactgacccggcggttagtaaggctctgtatgagaaagccaagagccaagacaagaagctgtgcctctacaaaggtgcgtatcacgctatcttggaaggtgaaccggaccagacaatattccaagttctcgatgatatcatatcctggctcgatcagcattccacaaaagaaggtatatcgttgtgaatcaggcagcgctgttcgccaggattgggtgaattcctttggcaatgctgtatcgcttncggttggggatcccggattcaacggtggggattccatttttgatatga

SEQ ID NO: 59545 - DNA, 395 bp, Zea mays
  unsure at all n locations
  Clone ID: LIB3069-049-Q1-K1-D12
gcagatccgtaactttggggatgctgtctctgtgtgcactcgctcgcccgagaagctggggcgcggatccttgacatgtatgaggcgcttgctgaggtgatccctgaactaaaggagctgttctttgggagttatggnggtgatgtcatccatgatctggagggggttcttgaaaggcttggtgacgcggtcaagggtacccttcttgagtttgggaaggtcctacaacaggagtcatcgcggcgacccatgatggctggtgagatccacccaatgacacgctatgtgatgaactatctcagattgttggtcgtttactgtgacacacttgacatacttttggatgacagtggtgctggagctgtagatcattaatatttacataatggcaccga

SEQ ID NO: 59546 - DNA, 443 bp, Zea mays
  Clone ID: LIB3069-049-Q1-K1-D7
gcagaggacactactcctcagaactctcccttccctcttgtaggggccaaaagggtcagagagctaggaagaagagaactagtgcccaagcctaacaagaaagcaagctcttctgcaactgttggcattcgccttaatttgtatccatcccaatggcaggcctatctctggaacacccctgggcattcactttcggcctcctaggcaacgttatctccttcatgaccttcctggccccgataccgacgttctaccgcatctacaagagcaagtcgacggagggcttccagtcggttccgtacgtggtggccctgttcagcgccatgctgtggatcttctacgcactgatcaagtccaacgagacgttcctcatcaccatcaacgcggccggctgcgtgatcgagaccgtctacgtggtcatgtacttcgtctacgcgaccaag

SEQ ID NO: 59547 - DNA, 450 bp, Zea mays
  Clone ID: LIB3069-049-Q1-K1-D8
cccacgcgtccgggcgaggcaaaagcattgttaccacagacagcgcgcgcttcaaggccttgtttttttgagataacaaggaggagaggaggagatggcggtcacgatcacgtgggtgaaggcgaggcagatcttcgacagccgcggcaaccccaccgtcgaggtggacgtgggccttagcgacggcagctacgcgaggggggccgtacccagcggcgcatccactggaatatatgaggccttggagttgagggatggaggatctgattatcttggcaagggtgttcttaaggctgtcagcaatgtaaataacattattggaccagcaattgttggaaaggaccccactgagcaggttgagattgacaacttcatggtccaacagcttgatggaacctccaatgagtggggctggtgcaaacagaagcttggagcaaatgccatccttgc

SEQ ID NO: 59548 - DNA, 448 bp, Zea mays
  Clone ID: LIB3069-049-Q1-K1-B8
cggagcctgggcggacgcttgggcagcagattatatcaattgccaaagcagccattacaatggtactcattttagggacttcatttcttgcagctgccaatccaattacaggatgctatgacgctcttaagtgatcatgaacttatacattgaaataatggtgggcctcgagaggccagaaggtggagaggagttcaacaagtactacatcctgtctgctctcctatccgtggattgcaggtgagtgcaaacaacttcctgctaaaagttagcaaggaatcggttgatacttattgatggtgcctgaaatatcctatagatgtctttagtagaggatccaaataatggtctgcaaggtttattgaatcggatcgcacaaaactccatctgcttcagaattgagctaagcgcatcctaacatcttgactcctatatcgatcaattattt

SEQ ID NO: 59549 - DNA, 468 bp, Zea mays
  Clone ID: LIB3069-026-Q1-K1-D4
tttgggctgctttatgtgcttgtctaaatacgactaatcagtcgaggctacccacaccccttaaccaaagaccctcgaggattagtccacgctgaggcgtataaaacgtaacggcagtcccacctagaaattatccatttcagaggaagtcgccgaagttctaaaaggcccttagaccacctttatgcgtccgcctaattgaaactcggagcctcggaagcgtattgaccgtaattaatctcatcgggaggggatctagcattataacgtagcttaaaggcctccgctagcgcgtaataccagcgatcaagtagtatggttccggcatctacccgcaaaaccgcaaggcatcgagacattactattcctgaaagactgaaaacaactcgactcccggtacttaactgcgtatgacgaggtacgttacttaccccagcggcccgtcgcctgctatcgagacgtcgccgc

SEQ ID NO: 59550 - DNA, 321 bp, Zea mays
  Clone ID: LIB3069-026-Q1-K1-D5
tgggctgtttagtgcttgggaaattatggtggtgccttcgtctcccatttggttgaaccgtcgttggctatttgagatccgtagacactgactcgaccgtggtacgacttgcctactcgtcgagattggtggggaagactgacggttaagcaccatgctttgtctgaggtctggaaaagtataggccgaacatgaggcatattggtctgcggctaactgggtttcaagcctataatcctgctgagccctgctatataaagccactcatagagacacgtcggatcgccccccctaaacgcgcggatacaatcgacaacgaac

SEQ ID NO: 59551 - DNA, 389 bp, Zea mays
  Clone ID: LIB3069-026-Q1-K1-D6
ggacctttgggctgctttatgtgcttgtttgagattactgatgagtactccctcgtactcgtaacggtcgttgtcattgcgcttgctttttgtactaagtcgggtctttaggggtcagaggctcttgtgtagggttctggtcgtacgggtacgcttgttcctcatggcttgtttaagtttgagttcgatacgactaagtctacttattatgttgctgttgttggggctatttcttccgatattcttgatacgcatggtttgtatattaatgagacttcgtcaggtaaggtgtcctaaggtggcgcaagggagaaggctgagtcggttattaagcccgttgctcttcctgttgatggtaagtgtgagacttgtggcgatttggtgcacgc

SEQ ID NO: 59552 - DNA, 489 bp, Zea mays
  Clone ID: LIB3069-026-Q1-K1-D7
ggctctggacctttgggctgatttatgtgcttggatccccgttctcggaacatccgcctttacaagtcacactcggttcgccatattagacaacgattcgtcgttccacatcctagcggccgacgacgtctataaagtaggatcagaaactcacgtcgtcgaccccgtaaacgatccaattactagtcacaatcatagtcccgacttaccagtggaacactcccctcctaccgacaatggcgttcctctcgccgacggcgcaccgatcgaccctttgaccatcttcctagaggtagccggccgtcccagcaattcgaatattagtaagaccgactacgtcaaattctcagccactctgtacaacggcgtcagcggcgatcatttagatcgtatcgattaagtccacgaaaaggtagccgttgacggcgtggacgctaccgatcgcttcgcctaagcgatcaaagacggtacatcgacacgtacgagtct

SEQ ID NO: 59553 - DNA, 456 bp, Zea mays
  Clone ID: LIB3069-026-Q1-K1-D8
ttggctctggacctttgggctgatttatgtgcttgagtaggctgagtactcctgatgttccagtccggaccgtttcgaatgattatcctactaagtgtgctctgcggcatgataatgagcggggtcatagtaattgtgctgctgattcgacttgttatacgcctaagatttagcaggtcagcagagagacagaccctcgttctttcactgcgggctgcttttaacggttcccggctgtagattactcccgtcgtccgctcacgtcgagaacaaacgcgaatggcgttttcggatgtcggacttacgtcggccccggatatgtcgctcccccgcgcccaatccactcgtcgttgcttcgcaatgaacctgtaagccccagcctccccgcgtcccgccaaagaacaaataacgaggccctagccccggcggttttaaaaaaaaaaaaaaagggtggtt

SEQ ID NO: 59554 - DNA, 438 bp, Zea mays
  unsure at all n locations
  Clone ID: LIB3069-026-Q1-K1-D9
gtgctgcctgtactatactaacttgcaagtgttacgtcggcgacggccaggcgcaccactcggcggcccggccagcccacccagagaccacctagccatggcgtccaggtgcttcttccccagggacgcgtccggcgccgacggccggcaccagcagtcgaagggcgcggcggaggccctcgagcagctgcgccacggcgggcgcctcctgtcccgggaggacgtgggcggcgcggtgcgcgtcaggatcgtcgtcagcaggcgcgagctcaagcagatggtcgcggcgctcggcgacgacgacggcgctggcgcggcggcggcggcggccaccagcgagcgccgtcaccggcagcgtggcgcgggcgcgggcgcgggagcggggccgggcgccgagcagaggctgcagtcgctgcngcggcgcagcgcgcggagggc

SEQ ID NO: 59555 - DNA, 376 bp, Zea mays
  unsure at all n locations
  Clone ID: LIB3069-026-Q1-K1-E1
tttgggctgatttatgtgcttgctaggaagccggcgtatattccttcggaccctagccctagaggtcatcgggagataatggaggagaattcggataggtctagggagtctcacctggaggccgaagataagaccgacgggaccgataggcaaaccgacccgttagactggctggttgactggccttagtacctaatttacaatgagtccggaatctccgcgttctaccgggatctccgcataacgctcgggcgcgcgacccacacacacacacaaagtcgcaatacgcaacatcggaggacataactcccaataaagaaggcggtggtcgccttacctaaaagatagnaccaagcttttggattacctagtacga

SEQ ID NO: 59556 - DNA, 458 bp, Zea mays
  unsure at all n locations
  Clone ID: LIB3069-026-Q1-K1-E10
aggcaccacaccttctcctcctcctcctcctagcacagctagcgcctgctccccttcgcctgtgatcatgtcttgcagcagcggcaagtgcgactgcggctccagctgctcctgcggcagctcatgcaactgcatgtcccctaacgtggagaccgncgncgncagcagcatcaagaccatggtcctcgctgcgccgaccaccaaggccagcgccggcggcttcgaggcggccaccgagggcggcggctgcgactgcaacacctgcaagtgcggcaccagctgcngctgctcctgctgcagctgcaactgagcgccggccggcccggcgatggcgcgcacgagtcgacggaaggacgacgacgagtcgtataaatataatagcggcgtctaaataagatcctgtcaactgcacccgccatcatcgatccatggtcgctcctggggttcatgttcatctg

SEQ ID NO: 59557 - DNA, 450 bp, Zea mays
  Clone ID: LIB3069-026-Q1-K1-E12
cttgctgagttgttgtggacaaaaagagctcgaaagtgggtagagaaaacggggggcaagccaaccacactcgcagccagcctgcccgctcgcccgcccgccattcttgccgattcgagtcgacgtcacgcctccggcgcccccttcggttgtcacctcgggggtcgcggattggtggaggggaggatttgagcggcgcggccatggatacaacatctagggccgccaagatcccgtcgctccaccagacggagatcaactgggataacctcgacaagaccaagctctacgtggtgggcgcaggcatgttcagcggggtcaccgtggcgctgtaccctgtctcggtggtcaagactcggatgcaggttgcctctggggacgccatggggaggaacgcgctggctaccttcaagaacatccttaaggtggacggcgtgccagggctgtacc

SEQ ID NO: 59558 - DNA, 393 bp, Zea mays
  Clone ID: LIB3069-026-Q1-K1-E2
ggacctttgggctggtttatgtgcttgtctagggagtttcctaagctcgaggttgccctttctgagaaggtctacgctcttacccttaggaggattgacggtaagtaggagaagttaatcgcttgtatagaactggacgatcaagggtcggtgtgttacggtgatacagcttccttcatagacgacccgaagtgccgccgtaagccctcgagatccgacacccagccggtcagacccgtaactaacgtcgaagaacaaacatcacccgtgataacggatcacccataacgctgcgacgtccctggcgtcaaccgtatccgtttccgttaaactaagtacgcgaatcaacggaacgtcctagccccgcgtagcccggcaaaaaaacagaacacc

SEQ ID NO: 59559 - DNA, 496 bp, Zea mays
  Clone ID: LIB3069-026-Q1-K1-E4
tttgggctgatttatgtgcttgtcgtagcgtcatcctctgcccatcgtcgtcccgagcaaaaccgttaaagaaacctccggacagaccggccgtacgggtaaagaacccaaaagctctagacttatcggaggaaggtcgtaaatcgggcctagccactagcgaaggatagcatgagaagacaaagaaacctactctgatcgtaagaagcgaaggcgttataacctcgcacggaggcggttgattatagtactctagaagagggcctccctccgaattcataaccacaatagacgccagcatgctaacgtaaacccggtaagaggaagctcccggattagccactcgcgccaaggagcccaggatagagagcgaagtcgcggaatccgtaaacgacatctatcacggcccagtcggcgttgcgactcttaacgactaagagaggcgcgagtgtaccctaaaggtctcctatctcggcaccacccggacaaaccgtct

SEQ ID NO: 59560 - DNA, 491 bp, Zea mays
  unsure at all n locations
  Clone ID: LIB3069-026-Q1-K1-E5
tggtctggacctttgggctgatttatgtgcttgtgcttgtaagcgttctgtttgtatcgatcactagcgcctgcccgcggagtattggaatcatgaaggctgcccataggtgtcatgttctttcccctccttctgctggtgctgatagtgacgagaacgagccagtcacttccgaacctacatactcctcggcggaaatcacggactgttatcctggtaacgcgcgtgagtccgacactacgccttactcggagaaagcgtatcctacgtcggaagagacggcgacgaacggccgtaccgcggagataagcaaatagaatactccggtattaacataatccacggagaaaatccttcgaaacagcgacacttacccgcgcagccccttacttatccggtataaccgttcgctcgttttcncttacaaaaccctttctcgcacgcgagagcgtaaaataactctcgcaattacggagcaccgaaccgattcg

SEQ ID NO: 59561 - DNA, 318 bp, Zea mays
  Clone ID: LIB3069-026-Q1-K1-E8
tggttgatttatgtgcttgtttatgtgcttgaaaaaaaaaaaacaaaacaaaaaaaaaaaaaaaaaaaaaaaaaaggagaagagaaaaaaaaaaaaaaaaaaaaagaaaaaaaaaaaaaaaaaagaaaagaagaataaagagaaaaaaaaaaaaaaggaagataaaatgagaaagataaagaaaattacaatagttgtaaaaaagagtaagaggtataaaatagcacggaggcgattcaatataaagggatataagtaggacaacactagaattgatgtcaacaatataagtcaggatgcttacgtaaatgtcgtaag

SEQ ID NO: 59562 - DNA, 450 bp, Zea mays
  Clone ID: LIB3069-026-Q1-K1-F1
gacctttgggctgatttagtgcttggaggccagtcacagtccgtatactcacccactcaatcaatcaatcggtcagtcagtctgacgtgtagagtaaagtgaaagtagtaagaagtaaagtaacggagaatttcgtgagcgcgtcagcctcattagtgtagcctattaaatctattcctggaaattcgcatacttgttgggttgggttgggtagtagggagacaattgaggagggtaggcgtgattcggataggagacatgcgagcaatccttttgctcatgatggttgtggttttgatgttagttccgcggtttgtgcgtaggggactattagtgaaactgggaatgtgtattaatcgcctgctgacgcgcctgatattgataggtctaagggtcttatgtctgctattaacggtgcgacaatggttgggctcgatgagcgggtgactc

SEQ ID NO: 59563 - DNA, 396 bp, Zea mays
  Clone ID: LIB3069-026-Q1-K1-D3
tgcttgtatatattcgccgcatcgcttaaaaaaaaccactccctataaaaaaaaaaaaaaaaaaaagagaaaggacaaaaagaaaaaaaaagaaaaaaaaaaaaaaaaaaaaaaaaaaaaacacacatgtacaaaaaaaaaaaaaaaaggggggttatcccaaaggatttaagcccagacatttgcgtccgtaatgatacagacccctcaccgggtttttaaaaccaaacctaacggttggggcccaaaaatctagcaatcggaaaaatttcggggccattaaatcaaacttttccgtacaaaaatttttcccagttagacggtgcaaaattaaaaaggtttgaataaacggttcccttaaaaaaccgtttaattcaaaaggtaaacggaattttt

SEQ ID NO: 59564 - DNA, 179 bp, Zea mays
  Clone ID: LIB3069-026-Q1-K1-B9
cccacgcgtccggttactccaacctatatgtttttgcatggataatgttttttggctgaggaattggctcgtcatatttatatatgcattttcactctcaaaaaaaaaaaaaaaaaaaaaaaaaaaaaaaaaaaaaaaaaaaaaaaaaaaaaaaaaaaaaaaaaaaaaaaaaaagggca

SEQ ID NO: 59565 - DNA, 331 bp, Zea mays
  Clone ID: LIB3069-026-Q1-K1-C10
cgagtgccttgcagatgagctgatcaacgttgccaagggctcatgcaacagttacgccatgaagaagaaggacgagattgagcgtgttgccaaggccaaccgttgaactgagcttgtatcctggtgcactctgcgctggaaacttttatgtcgctggcagtcgtatcggttcttgttttaccaatgtttagagttttttgagacctatatgcggttttggttttcagtgcacaattaaaattactgagtaatgtagttgattgggaacagaaatgtttggtgcctggtttaccgaactccaaaataaaaaatatacgtgcacagaatgcta

SEQ ID NO: 59566 - DNA, 416 bp, Zea mays
  unsure at all n locations
  Clone ID: LIB3069-026-Q1-K1-C11
gccctcagcaaccagcaccaggtccgtgtttagatcgagtccctctttgacgggaccgatttctcggagccgctgacccgtgccaggtttgaggagctgaacaacgacctcttccgcaagaccatgggccctgtcaagaaggccatggaggatgctggccttgagaagagccagatccacgagatcgtcctggttggtggaagcaccaggattcccaaggtccagcagctcctgcgggactacttcgacggcaaggagcccaacaagggtgtcaaccctgatgaggctgttgcctttggtgccgctgtgcagggaagcatcttgagcggcgagggtggtgacgagaccaaagatatcctnctncttgatgtggctcccctcaccctgggtatcgagaccgtcggtggagtcatgac

SEQ ID NO: 59567 - DNA, 442 bp, Zea mays
  unsure at all n locations
  Clone ID: LIB3069-026-Q1-K1-C12
gaggatcgccgatgtcgacggctcccaggtgccccttccgaggccgcggcgccccgcccgctggcaccggctacgtccgccgcggccccgcccctgccccaggccccgccgacggcgccaagaccctgcgcaagcccgtcttcaccaccgtcgaccagctgcgcccccagacgcacggccacaccctcaccgnccgcgtcatctccgcccgcaccgtcctcgacaagccctncacgcacatcggccgcacccgcgtcgcagagtgcctcgttggagacagcaccggcaccgtcctcgtcaccgcccgcaacgaacaggttgaccttctgaagccagatacaacagtgatcttccgcaacgctaagattgacatgttcaagggtaccatgaggctggtggtggacaagtgggggcggattgaggtgactcagcctgctgattt

SEQ ID NO: 59568 - DNA, 388 bp, Zea mays
  Clone ID: LIB3069-026-Q1-K1-C2
gacctttgggctgatttatgtgcttgtggatgtgcgggtgactttagggttgtctcggtggcggtggtgtgccgagacggtcgatatcgatagtgtggagattgagaaagagaagacggcagtggacgacgggggtaagtttgtagagtctctgaagagtgtgaggaagaagtcgtagaagtaggagtggtaggtggaatgcaaagtggtttgaaaagtggtggagaaggagtgatggtgtgttgatacagagtggtggaggtgcgagcgggaggatgtctccgttgttgtgttgctggacgaggtttgggttgagacggcggtggtgtggtgggagatgtggtgtgagtgggcgggttggtgggtggaggagtgtggggtgtgagtc

SEQ ID NO: 59569 - DNA, 386 bp, Zea mays
  Clone ID: LIB3069-026-Q1-K1-C3
gacctttgggctgcatttatgtgcttgattactctatctcttgtcggctgtctatctccgtcgtcttatttcctatctagctccagggctccaccagtctcaggtctcagtcagttgtgttatcttcctgcgcagttactagttcctctactgttattaacggttatcgttgaggcttagattttgattgctgcggtggttgaggaagtgtttgcggcggagattttgttgttggttgctgcgtttgaggagctcgtttttgttgaggttgaggttgaggttgaggtcgtcgtcttcgtcgactttgaggagtcctttgtggttgagtagtaggtagttgttgaggtggaggttgtggtcttcgtcggcgttgaggagtttgctgt

SEQ ID NO: 59570 - DNA, 406 bp, Zea mays
  Clone ID: LIB3069-026-Q1-K1-C4
tttgggcttgtttatgtgcttgtttatgtgcttgggagtttgttgtggttgacttcgctgttgaggtagaggtcgtcgtctttgaggagtctgttgtggatgagttggaggtcttcgtcttcgtcttcgtcggcttttaggagttggttgttgaggtggaggtcgtcgtcttcgaggagtttgagaaggttagtgagcgaggttgcgtgtatgtagtggtggtggttagggtttaggttttaggggactggtgcgtgtgtgcggtggagcagctcgctgtgtgtgcatacggtagcacgatatgggaccccgtcgcctagcatgtcatggtcatcggtgctctctcgcgcgcgcgcgtgcgcgcgctgcatgcagtttggcatgcagtcagtagcgatcgctgtgc

SEQ ID NO: 59571 - DNA, 446 bp, Zea mays
  Clone ID: LIB3069-026-Q1-K1-C5
ggacctttgggctgatttatgtgcttatttatgtgcttgtttatgtgcttggcgacctaaaccgagctttcgaataagaagcacggacgtaacgctttcccatcctcgacgaatctccctaatatttacgacgatatatagaagaccgccgagaagcaccttaatcttaatactgaaacctacatccctaactagagttagcacttctgtaccgccattgaggatcctccgttatcctttagtaaagggaaactcgggaaggacggtcggcacttcttcggctacggcgacgcgccctttctcccgaacaatagtggaaaatccgatactccaccggtctagggtaaggagcacgctcccgtcgtaaatctagataatccgggcgtcacagctgatactaagacttcaaattactcgactaacaattagaatgagcatcgtacgga

SEQ ID NO: 59572 - DNA, 421 bp, Zea mays
  unsure at all n locations
  Clone ID: LIB3069-026-Q1-K1-C6
gacctttgggctgtttagtgctgcccattctcctaatgaatagcacctacatccgaactcatcgtgcttatgttagagtcatataacgaaaatagggtgcataccagacgacgctagatcctactacttaaccccgtcggtatagcggtaggatagagcaatatgcgccgacccggtcaaagggcctctccccgaggagcccacgaagtgcggcggaaattccgttacgtccgtcgagtgtccttcgtatgaggcggtacccaagtctcggaaagtgttcaaacacggggtccgaggagggcacttagtgccgatcgatccggtgctgtggacaaacaactgaagtattagacgagccgctgtcccgcaatggaaacgatcngagcgacgttggatatcgcggtgcgcgagtccccacgcg

SEQ ID NO: 59573 - DNA, 482 bp, Zea mays
  unsure at all n locations
  Clone ID: LIB3069-026-Q1-K1-C7
ggacctttgggctgatttatgtgcttggcgatggcggagcatgcgaatgagcggtggccttacggcgtttgcttgtgcgtatattgcgtgctactcttatttagtatgatgagattgctattaatgatgagactgttgttgattctaaggagtatgctactaagtttgcgactttcgagaagcattctgatgagaagattactccgtattctaatttgcttgggtgtcctgctactggtgggttttatggtgatgttggttctattggttgtaagactactactgatatccatggtggtcgccgagtttatggtggcggtgttcctcatggtaaggattttattaaggcggattgtagtggtgttcatgcggttaggtaagttgntaagagtactgcggttagtggatctgtttgctgtcgttctgcgtaggcgctgcatgttactggtgcgttggagttttcgcttgcgcctgctgatctg

SEQ ID NO: 59574 - DNA, 396 bp, Zea mays
  Clone ID: LIB3069-026-Q1-K1-C8
gacctttgggtctgtttatgtgcttgtcagtagtcgaaaaggagttgtaggcacggtctcatatggagcacgtcacccccacggatctgaggaaccctctttgactgagtatcggtcataccgggaagtcaaggctaaacccttccggaatcaaacccactactcatgatatataggtcttgcataacggtgggagagcccgtatataggaatgcgtttttagttgctggccgctccttaggaaagccctattaagagccttaagtggtagtcattttgctgtctaggcgaatcatgagtcgaacgcgtcgggaatttgagggtttaggtggacgtagcgtgtcacgtaccttacttttgtactagtggcggagtttggtggtgcggcgttcgggt

SEQ ID NO: 59575 - DNA, 444 bp, Zea mays
  unsure at all n locations
  Clone ID: LIB3069-026-Q1-K1-C9
cgttcccggcctcaccccgagccagtcgtttcgctagggtttcgccgccgccgccatgccgcgccgcagctcaggaaggtctgccccacgcccagctccccgtgctgcttcactgaggaacccgccacagccagcacgccaggctcctcctccagctcctgttcgagatggtggtggctccatgtttggaggaattgggtccaccattgctcaaggtatggcgtttggcacgggtagtgccatggcacacagggctgttgactctgtattaggtccccggaccatccagcatgagactcttgccacagaagctcctgctgctgcccctgctgctccagcgatgaatgctgatgctngcagcttccattctaaggctttccaagattgtctcaacaactatggcagcgagatcagcaagtgccagttctacctagacatgctgaa

SEQ ID NO: 59576 - DNA, 268 bp, Zea mays
  Clone ID: LIB3069-026-Q1-K1-D1
cctttgggctgctttatgtgcttggagaagtgcaatataatgtagtgagtcgcacggtccaatttctatggttgctcgtagaacggggtgttactctgtgtcgtcttcgatttcgtcatcgtcggttctgatggtggttatgtgttcggtgcttgttgatcgtgtgggtgacaagcctttggtggggtgcgtgcatgtgctgcgtgaggattcgttgaatcgggtgtgcgctatcggtgcatgattgctaaatcttcgctgggtcctg

SEQ ID NO: 59577 - DNA, 419 bp, Zea mays
  Clone ID: LIB3069-026-Q1-K1-D11
gatccgagcagcatgagtggcaagcagcatttgtagccacagctcgctcgctcgctcactgaattgcagctagccgcggttgcggttggactggatcggcggcagggcagggcagggcgcgcggcggtggtgtggtggtagttgcagaagtgacggtcaagttttcctcgctccttgcttcggccgagcctccgcctgacgctactaccaacatctccacctgaatccatctctatctacctcgcacgaacgaacagagacaggggaggggaggaattgaagtgtaacccaaggaaaggaaccatgatggtgtggcaggcggaggaggaggattgatccatccgtctacccatcagacccatccatccatcggtggtggtggtggtggtggctgctgttactcgctatcaccatctgct

SEQ ID NO: 59578 - DNA, 364 bp, Zea mays
  Clone ID: LIB3069-026-Q1-K1-D12
aaagaaaaaaaaattttataaaaaaaaaaatttaaaaaaaaaaaaaaggagaaaccaatcaaaggaaaaacaaaataccaaaaacagaaaatcaacaacatacaacataatatccactcaacacactcacatcacaactgtacaaaaaatcacaacaaagggcactcccctaaacctccctccttccttccaactcccctccccatgaatcacctttttacatgatcccctaaatccaaatatctctccctctttctaacaaccctaacacgggaaaacccccgtatgcccacccttacacacccttgagacccactatcaatttccccctttcacgaggatacttacaccccccccctatctc

SEQ ID NO: 59579 - DNA, 315 bp, Zea mays
  Clone ID: LIB3069-026-Q1-K1-D2
tttgggctggtttatgtgcttgggaaatttcagttgttacactctatgactccactcctattaagttgagggaaggcgacgagtgacggcgtgtggtgcggcgcttgtcaacggtggtctggctgtgggtaagaagaatgggctggcccttcctatcactgatcgtattaagttagcggaggataagactacggacgctgttctgtctcagaagccttcgtaggagtgtactaaggctgttggtagtaacgtcggtaattctcgtgatcttgctattacgctctgtgagaagattaaggctattgcgattctcga

SEQ ID NO: 59580 - DNA, 391 bp, Zea mays
  Clone ID: LIB3069-026-Q1-K1-B8
gacctttgggctgatttagtgcttggtaaacaaagacaagaaagaaagacccggccgatcctccgagacgtatgtcaatagcgagggagacacattagccgtcgcgataggcgatacagcagtgtccgtcggctcgaaagatataaccatcggcgaaatatctcgcgatttagataagttcgcagcgtccgaatgcacggaacccttcgacttcgctaccaaggccgtcaccgaatttaagattaaagtcgacgttgataaaacggtcatcgggccaactaagtccgtctaagaagatttgctaccttatcctctcagagatgaggaaattaattagatcgccaccgaaggaacgggagaaccgtactccgacactaccgcagatagatca

SEQ ID NO: 59581 - DNA, 459 bp, Zea mays
  Clone ID: LIB3069-026-Q1-K1-A5
ctttgggctgatttatgtgctctgttatgtgcttgtttatgtgcttgcgctcccttaagattattcggccacgtccccgccgagcccgaagacttctgcgacgtcgaggaggtaaccgtcggatgggacggacataatcccgacggatattgctcaagagcggaggtcgtctacggcggcagaggcaacgtccttctgtacgactgcctaagcggtcccggcggtggcggcggagtatgctgcggcgcgctgagatatctagagcactgcgcctccgctatcggatcgttcctcctcgtactacggtaggacccaaaggactacacgtggaaggtcggcgacgcccggcctctcgaagcgcactgtgaaagtcgcggtattgcacgaaccgcggatcatataaaccacgacgacacgaaacacgtcgcaagcttacaacatacctttccgctctacgat

SEQ ID NO: 59582 - DNA, 447 bp, Zea mays
  Clone ID: LIB3069-026-Q1-K1-A6
tggctctggaactttgggctgatttatgtgcttgtggatgtgcgggcgggaatcgaggcaaaacaattttgtaattgtatttatatttcgtgtgcgtctctctcgttttacttgtgtgttttcttcttcttattgtttgctttgttgttgttgttgtttggttgctcggcggtgacggtgcattgggtggatgatgatcatgatcattctcctaaggcggcgtctactggtgatcttggtgctggtaagcttaattcgtctctgtgtcctatgtgtaatgagcctagttctgagcttaagcttattactggtgctgagcctgttatttgtagtacttatgctgaggataaagctgctaaggtttagactcgggatattgctggttaggaaagacattgtgtcactatgaagtgtgcatcattgtgagtggcaggggtgtcggctgcg

SEQ ID NO: 59583 - DNA, 414 bp, Zea mays
  Clone ID: LIB3069-026-Q1-K1-A7
tcctgtatgagtgtaatattacctatccattagcctgaagtggaggtgattggtaattcgtggtggagacgctaggtaggggtaagggtggtaaggggtctgggaagggtggtgtgaagtgctattggaaggcgtcgtgtgataatacttaggggactatgaagttggtgacttggaggtcggtgaggaggggcggtgcgaagtgtactcttgggtcgactcatgaggagatttgtggtgcgtctaagactccctctgagaacgctacttgtgatgtcgcgattcatatggagtatgtttgctgtaaaattgctattgtcacggatgctgcgcatgtttctaaatgttagggttgtatctctcacggtcctggtggtcaggccaggcgcgggcaaccgttcgcttaggcgctct

SEQ ID NO: 59584 - DNA, 393 bp, Zea mays
  Clone ID: LIB3069-026-Q1-K1-A8
ggctctggacctttgggctgatttatgtgcttggtccggcctacccgtctacggacctatgcatcttggttacttagccgttcgcgtcgcggttaccgaagtctcgaaatcccactgtgaaagggatacctttggttacgctaagtaaactgttttaaagccttaggatgggaccagggtgtcggtagatagcttgaccacaggggagacatgcggtccggggacgaccacgggcattgaacctataaataataagctattgatcgactcgccttttgttgaacggggggccggcgttactcctggtgaagagcgttaaaagtgtggtacgtcggcgaaggctgtcggtgatgttactacgacgctggtgatgtcgactacgatgtttggtga

SEQ ID NO: 59585 - DNA, 408 bp, Zea mays
  unsure at all n locations
  Clone ID: LIB3069-026-Q1-K1-A9
gtcagacacgcgtccgcccacgcgtccgcctacgcgtccgcggacgtttgggcgacatgaagctcagggacgacctggagaggctcaagaagatcaggaaccaccgtggtctgcgtcactactggggcctncgtgtccgtggccagcacaccaagaccactggcaagcgtggaaaaactgttggtgtcttcaagaagcgantagctacatatctatcgacaaatctcagatgtactagtgtttgttcttgttcaaactgtcttgatgaagggtttctgttgggacagtttcctgaaattatgttttgccctaggataatctngcagttatggaaaccttgtatattgtatcctgcaatttggtttttgcaacttataagagtaattntatttgatgagtcttatgctg

SEQ ID NO: 59586 - DNA, 382 bp, Zea mays
  Clone ID: LIB3069-026-Q1-K1-B1
tttatgtgcttgtctcctcctattctatcaatattagtcagcaatctccctctcttcgtaacaacggttgtctgtcttcttcttctttagttgtagtcggctgtggtggtggtggcttcggtagtggtgtcgtcgtcgtcggtggtgggggttgggatggtgctggtggtggcgagtcgtggtgaggcgatgctgctggcggtgttgcgttctgggcatgtgacgggtagtgtggtgctgtttcttgtggtgcgtcgtagtggggcgtgtctgtctaatagttgtgtgctgctggtggtggattggtaggttattcgtaatcgttctaagagtacgatgggttggtctggtggtggtgctagtacggttaatgttgataata

SEQ ID NO: 59587 - DNA, 153 bp, Zea mays
  Clone ID: LIB3069-026-Q1-K1-B10
cccgcgcgtccggttactccaacctatattttttcgcatgcataaggggctatggctgaagaatcgtttcaaaatatttatggccgcataatcactctcaaaaaacaaaaaaaccaacaaaaacaaaataaaccaataaaaaaaacttaaaaa

SEQ ID NO: 59588 - DNA, 437 bp, Zea mays
  Clone ID: LIB3069-026-Q1-K1-B11
cttcaaatgagttccacgcatcaagaagtctagattccaggaggcctaaaataggagaggagggcgcagcttgattcaatccatgtcaagtcagaggctgctgcgaggtttgcacatgcaagtagaatttagatggtcctgcttcgctttcatgtggatttatcttgcaaatggtatgtggatccgttccagaggcaatgagccttgcagccagtttgcagtataaaaaacccaattatgtccactgctggttcgacgcagcgtgtgccgaggatttctactgccaagcataagaaagtatttgaaatcaagaacttgcattcattcaatcataatgtgtttcctatcaagcataagtgtgtgtgttttgtttgatatctgctttaataggagaatggtcttggcaccccaaaaatgttcccattctactttcgggc

SEQ ID NO: 59589 - DNA, 444 bp, Zea mays
  Clone ID: LIB3069-026-Q1-K1-B12
cccacgcgtccgtaggaatctctgacaattatgctggggccgtggagtctgtccaaaagtgagatcttctgaaagatacaaaagtgtctctttctgcaaaccatctgcagaaactgtgtttatcttttcaactaaccacaccgcttgggcacacatttaaacctcaccaggtgttcttgaaattgaggcatgagagtaaggttgaacacttattcgtggtacctggctctgcaaggcagttcaaaattgttcttgacttcctaggtttggtggagaaattttactacctttctggaagatatgaccttgagcttaccgttggtgatgctgtaatggaaaattcatttctacgacctcttggccatttggagttggacctgccagatgccccagaaaaagccccacgtccttctgcacaagctgttgacccattctcaaaatttg

SEQ ID NO: 59590 - DNA, 414 bp, Zea mays
  Clone ID: LIB3069-026-Q1-K1-B2
gacctttgggctgatttagtgcttggtctaatagggttctcgtacacgtcgtacgcgagtcatccgtaggttagttacggtgtgcaggatatcctcgccgttcgtaagtcgaaagtgtgtaatgttagcacctcgccctcgctgtcatagaaaaccgcataagccccgccaccctccggctaaattcggcacatgtatctaggagaacccctggccagtgcattgcataggtagtcaaaattgagcaatcgccccgatcctagcccgtgaacgagacgtcccgccccagctggaaggacctattacgtcacggcagtggtggttggtacttggcgagagacggaggactttcgaattgcattgtgttgttgttacgcgttacgtttacgtacgtcgcgatcaattcgtatgccc

SEQ ID NO: 59591 - DNA, 468 bp, Zea mays
  Clone ID: LIB3069-026-Q1-K1-B3
gacctttgggctgatttatgtgcttgggcacgccaggagtctagcgttcggtccccatccgagtttaggcgcccccaatcccgccgcgttctagcccacgtagcacgataccggccacgcgtaactcttcggtacgcttataaattagtacatcacgcatcccggttagttcgactcaataacagggctcctcggagtcgtcgcccactgataccggttaattttaataacgacgcacttttaccgtcacgacaacgccagcttaacgacgctctaggccttctcgcattagctccctaattacgaccaggagacctcgtccgtcggaaagccgggaataacctctcgccgaatccgtcacgccgcgccgcttcacgccaagcggagccttcccagacctgagtttgccccaccataaaaaaccgcacaaggagcttcaaacctgcgaaatcaccctgcgaatcaact

SEQ ID NO: 59592 - DNA, 438 bp, Zea mays
  Clone ID: LIB3069-026-Q1-K1-B4
tttgggctgctttatgtgcttgtggaagcggctgttgtatccctcgaggcccctagccgattcagtaacttcctcggatatcggtctttaagtagcggttattacgcgcatacggacgttaagtactgcccactaggggaagttaacgtagcattctcggacgctcaccgtacctacatagactcctatagcgtctgagcgcccgtggcgcgtctcccgcggaacgcacttcaacgctttacctacactttacatcgtccctacctatctcgactcaaactcgcctagacaggcgcccacaaggcttaggacctaagaagggcgacccccccccgaaacggtcatccactacaggattagtcggcataacagtacctgaataatatcgtgaccgacccccgccttcaagacgccacctaacgcatgccgatcattcgt

SEQ ID NO: 59593 - DNA, 401 bp, Zea mays
  Clone ID: LIB3069-026-Q1-K1-B5
ggacctttgggctgatttatgtgcttgtttatgtgcttgtttatgtgcttgcctatctgcttgtttatgtgcttgtggatgtgcgggctgcaaccccacacgacgaaaccacgcgtactcctagccgcccccgttctatcgtctcgcaaggatacacaaaaccggcacccgcatccctcaaggcctcttccggaacggcagagccccatagggaattccttactactagccgtcgatacagtctgaatctgatgccctcctcctgttagccgtggtctcggacaaatctgaagtcgattcacttaagcctgatgatgggtttcctccttcaggttaacctagtccggtggacgcagtgcataccatgacctcggaaagggcctagacacatcacctttact

SEQ ID NO: 59594 - DNA, 331 bp, Zea mays
  Clone ID: LIB3069-026-Q1-K1-B6
ctttgggctgatttatgtgcttgtggatgtgcgggtggatgtgcgggccgatcagcattctcctgtgtctcctaatgagagttagccgtttgggttgattcctgagtgtaatcatggtgctcctcatttaaattagtacaaggcgcatgattctgagcctgcatctggtgtgcgtagtcgtcgttagggtactggaggatctcggcggtagtgagaatggtagggtgagtattagtattcaatcgctgagttccgcgaacgtgatcattacgtaggtgcggagtgcggtggatgtaacgcgtcgcgagtactggtcttaggtggtgtcgga

SEQ ID NO: 59595 - DNA, 380 bp, Zea mays
  unsure at all n locations
  Clone ID: LIB3069-026-Q1-K1-B7
gggttgatttagtgcttgtgaacaactctcctcctattctatcaatatctagtcagtaatctccctctcttcgtaacaacggttgtctgtcttcttcttctttagttgtagtcggctgtggtggtggtggcttcggtagtggtgtcgtcgtcgtcggtggtgggggttgggatggtgctggtggtggcgagtcgtggtgaggcgatgctgctggcggtgttgcgttctgggcatgtgacgggtagtgtggtgctgtttcttgtggtgcgtcgtagtggggcgtgtctgtctaatagttgtgtgctgctggtggtggattggtaggttattcgtaatcgttctaagagtacgatnggttggtctggtagtggtgctagtac

SEQ ID NO: 59596 - DNA, 440 bp, Zea mays
  Clone ID: LIB3069-026-Q1-K1-A3
gggctgatttagtgcttggaaagaaacagtccctaagaagtaaaacgcgtcggaagacactcatgtcggcgtctacaccgcaacagatatagtcgtcgtctacgagaaaacaccggtatcgaccgaggtaggcaatacagaattactagaatcaaccgtagacacggacgtttagacagtaaaagtaaaggaagaagtaccgagcagaaaagacacttccgacaaagcagaaagacggacgctcgtgcgcgaagaagagagtcggtccgaagaccacaattgggacgataataggcacaatctcagttgaggcgtttattcgaactcgaagtgcgtagaaaaagtctgcacttccgccaataagaccttagtatccgccgaaatctcagcggtaaagattaaggtacgggaggagaaattgcgctcgctccccacgcacg

SEQ ID NO: 59597 - DNA, 317 bp, Zea mays
  unsure at all n locations
  Clone ID: LIB3069-051-Q1-K1-G11
ggccgacgccacgcgtccgcccacgcttacgcgatgagtttctctctgttgcggccgctctgatcgagggggtggccggggcctgcctcgccgcgccgcggggcgcggacnactacgccgaatgcgcggagacgaccatggacacggtggtgatgatgctggcgctcgacgcgctggaccaggacgacacctgctgcgcgccgagcgcgcttaatgccatgaggtgcacggcatccttaagcatattcctactcatggacatgtactggaacgtccaaacacccccaacaagccacgaataaaaggcttggacccca

SEQ ID NO: 59598 - DNA, 465 bp, Zea mays
  unsure at all n locations
  Clone ID: LIB3069-051-Q1-K1-G12
aaanngggccgacccacgcgnncgcggacgcgtgggcggacgcttttggagcgtattctcaggnttgcgcgtatgagacttatcggggaactcaattgtgcgagtgacancangagctcttccaaaaggccttcacatgttaagcctgtcaaagaataacatatcaacaattgaaggccttagagagttgacacgattgcgcttgttggatatcagctataatagaatatctagaattggccatggattggcctcctgttcctcgttgaaggagttatatctggccggtaacaagatcagtgaggtagatggtcttcaccggcttctgaagctcaagattctggacttgcgccacaacaagatttctacatcaaagggcctcgggcagctagctgcgaattacaactctctagaagccattaaccttgccggcaaccctgcacagaagaatgtaagcgatgagca

SEQ ID NO: 59599 - DNA, 461 bp, Zea mays
  Clone ID: LIB3069-051-Q1-K1-G2
ctcccatccagccgccaccaggtgcagagtttttcgtcatctcttctccggcgaagaacggccagtggcccaccagatcacttgttaaactttgttgaggggtgatggcggtttctttcgcaaacctcaacaccgaggcagggcttaaaaagcttgatgagtaccttctcactcgcagctacatcactggctaccaagcttccaaggatgacttggctgtctacacttcgttttcgtctgctccctcgtccaagtatatcaacgtagcaaggtggtttaatcacattgatgcgctcgtgaggctgagcggaattactgcagagggccaaggtgtgaaagttgaatcctcagcagttccttcagccccaactccagatgttgctgaagcacaggccccagctgctgaggaggaagacgatgatgatgttgacctttttggtgaggagaccgaagatgagaag

SEQ ID NO: 59600 - DNA, 518 bp, Zea mays
  unsure at all n locations
  Clone ID: LIB3069-051-Q1-K1-G4
gaattatccgggctcgacccacgtcgtccgcagtcgatcagcccgccgtattggagcagcgagttatnggagtcttgcgatggcggagaaagaagcnagcggcccaggtagggtcccaggaaggggacgagtgtggttaccccgcgtagtacanctcatcaacctccacatagcgcctccacgngatgcanccttcaagatagaaaggcccccaatggctatcaanggaaatcagggaagtttgcacagaaggcaatgggcaccactgacatcaggattgatgtgaaactcaacaagcacatctggagcagtggtatccggagtgtgccgaggcgtgtccgtgtcaggatcgcacgcaagaggaacgatgaggaagacgccaaggaagagctttactctcttgttaccgttgctgagatccccccagaaggcctgaaaggtctgggtaccaaggttgtggaagacgacgagtagatctgcctgggtactgatctgtgtcaactgtcaaatcatttttt

SEQ ID NO: 59601 - DNA, 450 bp, Zea mays
  Clone ID: LIB3069-051-Q1-K1-G5
cccacgcgtccgtccacgcgtccggttttgttgatcctggtccacatggagcaggtagatgttctgaccatatgttacctgaaattgtgaagaaagattggagaaagggtgcacagtggtttacagtgaaacggcagcatgcagttcttattcttgctgacaccctttactatgggaagttcaagcgttactgtaagccaggaaatgagtggcataactgctattcagatgagcactacttgccaactctcttcaatatggctgacccgactggaattgcaaactggtcagtgacgcacgtagattggtccgaagggaaatggcatcccaaagtctacagggctgtggatacgagcttcgagctgctcaagaacatctcgtccattgatgagagcgtccatgtcagcagcaacgcgaagcatgtagcgcagaggaggccgtgcgtgtgga

SEQ ID NO: 59602 - DNA, 368 bp, Zea mays
  Clone ID: LIB3069-051-Q1-K1-G6
ccaacctgagcacaccatcgagtgttcgttttggagcagccatggctacatagggggtcggctgagctagcacatgccttggcacccgaatatcggaccctgcgacactgtacgcacacctagtgaacgggttccggtttgacatgtgcggtaaggccaaaactgctatgaagaacgtggccacgacatactgctcctctgaacgatcgacgtgagtcacctgagccgtggagcccgactacctggacggatgcctgatctgataatacggattagacacgtacaggctcacgaagcctgtcgagaacatcgagttagagttggactcgctggactaaagcctgtgcacgaatgagggctcaagtata

SEQ ID NO: 59603 - DNA, 445 bp, Zea mays
  Clone ID: LIB3069-051-Q1-K1-G7
gccaccaccagcagtccctcacgtttagcgttataatatccaccggcgacggggagcgcaggcggcgcggccggggattcgaagcgatggcgttcacgatgcgggcagtgaaggtgcctccgaactcggcctcgctggaggaggcccggcaccgggtcttcgatttcttcaagcaggcatgccgctctatccccaccgtcatggagatctacaacctcgacgacgttgtcacgccctctcagctccgctcgaccatcgctaaggagatccgtaaaaaccagaacgtcaccaaccccaaggtggttgatatgcttctgttcaacgcgacggaagagctgaacaacatagtctaacatgcagagcatcgccatcatgtgattgggcagtatgtgatcggccaagagggcctggtgcatgaactgtggtcgaaggatctagggaactc

SEQ ID NO: 59604 - DNA, 235 bp, Zea mays
  Clone ID: LIB3069-051-Q1-K1-G8
cccacgcgtccgcccactcgtcttcctcttttctctgcctcgccgcgccgcagggcagagcatggcgcccccacgccctctcctcgccgccgtcttcctcgccgcggcggttctgctcctcctttctccggcagaggcggagacggtgggcgtgaactacggccgcgtggcgaacaacctgcccaacccagctgcggttgtgcagctgctcaagcatcagggcgctgcgcaggtt

SEQ ID NO: 59605 - DNA, 400 bp, Zea mays
  Clone ID: LIB3069-051-Q1-K1-H10
gacgaataatctcttcttcatctcactaacttcagctagcaactctttctgggctgcaatgagggccgctcgctcctcctcgtcccagccgcagctggtcgcggcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaggccacctgcaactgcctcaagagcatgacgggccggctcggcggcggcgtcagcatggccaacgccgtcaacatccccgggaagtgcggcgtc

SEQ ID NO: 59606 - DNA, 427 bp, Zea mays
  unsure at all n locations
  Clone ID: LIB3069-051-Q1-K1-H11
caggatggcaacaacatttttgcgatgttcgattgctacaccccanccggcgagccaagccccaccaacaagaggtacaacgcccccaatatcttcagcagccctgaagtcgccgccgaggagcccgggtatggtattgagcaggagtacaccctcctccagaaggacaccaactggccccttgggtggcccatcggtggcttacccggccctcagggtccttactactgtggaatcggcgccgaaaagtcgttcggccgcgacatcgtggacgcccactacaaggcctgcttgtatgcgggcatcaacatcagtggcatcaacggggaggtgatgccagggcagtgggagttccaagccgggccttccgtgggtatatcttcaggcgaccaggtctgggtcgctcgctacattcttgagaggatca

SEQ ID NO: 59607 - DNA, 276 bp, Zea mays
  unsure at all n locations
  Clone ID: LIB3069-051-Q1-K1-H12
ggccgaccacgcgtncgntatcttctggttgctgttatcgactactatgagttctacgaagatgcggacggtaccggtggcaacaagatggtagagagcacgcagctgttcgagagcatcaccctccatccgacattcgagcaagcagacttccttctgctcctcaccaagttcgatctcctagagcagaagatcagcagttccccgctgacctcgtgcgactggttcagcgacttcactcccctgatcagccgcaacctcctcaacggcggcagc

SEQ ID NO: 59608 - DNA, 454 bp, Zea mays
  Clone ID: LIB3069-051-Q1-K1-H3
gaaagccgtccgtgcagctggtgagcctcttttcgattattggagctgtctcaagtccacggttcggacttttgaggcgcaatgtgggtcgttggcgcagtatgggatgaagcacatgcggtccttcgcaaacatctgcaacgctggcatccttcctgaagcagtgtccaaggtcgctgctcaggcttgcaccagcattccttccaacccctggagttctatccacaagggttttagcgcctaagaatcataaggtgaggcgaaatatttcagccgctccaccgcaacgaactggtttacattaccagtcctcaggggggtcctagttcttgaaccataagtgaagcagacttataccactattatagctgttccaccgtcgttccagattacatagctatgcccaatttgcggtgtacatatatagtcggaaagttatttggcaattgtattg

SEQ ID NO: 59609 - DNA, 300 bp, Zea mays
  Clone ID: LIB3069-051-Q1-K1-H4
cagaggcgatggctcccttgcatattacttttccaatttatatctgaccaatctatttaggctacgtggacttactctcgaggaaacatgtatccacaacaagcaagtcaaaaacccatcactggcactaccgatgaacagcaattgtctcaagctacctttaccctaaatttagctatgacctgaacgtccacatggtttacactatctacacacttactactgataatatgataaggttgatacttacacatctaacaagaatagcatctgtgaagaaatcgatctttgtgaagattt

SEQ ID NO: 59610 - DNA, 426 bp, Zea mays
  Clone ID: LIB3069-051-Q1-K1-H5
cccacgcgtccggcagccaacaactttgcctttggtcactacaccattggcaaggagattgttgacctgtgccttgatcgcatcaggaagcttgccgacaactgcactggtctccagggcttcctcgtcttcaacgctgttggtggaggaacgggctctggccttggttccctcctcctagagcgcctgtctgttgactacggcaagaaatccaagcttgggttcactgtgtacccttccccccaagtttctacttcggtagttgagccatacaacagtgtactgtccacccactccctcctcgagcacactgatgtggctatactgctggacaatgaggccatctacgacatctgccgccgatcccttgacattgagcgcccaacctacaccaacctcaacaggcttgtgtcccaggtcatctca

SEQ ID NO: 59611 - DNA, 263 bp, Zea mays
  Clone ID: LIB3069-051-Q1-K1-G10
cggacgcgtgggcggacgctttggtttagttttgtgtaatggatttctgcagcatcaagagtgatactggcaactccattgataagactgcatgctcaaataaagcttggaccatgaagtgagatcaagctcatggacaagtagcgatcatcttttatccaatcttagtgtattcccaatagagcacacgtgaagaaaatattttgtttgactactgtaaatgtttaaggcaatgaaaattacaaatatgaaatagttgtggt

SEQ ID NO: 59612 - DNA, 449 bp, Zea mays
  Clone ID: LIB3069-051-Q1-K1-E4
cggacgcgtgggcagcatggaagcatggcttatgtcctacatttaattaccttttatcttgcactttggggtgccattttgtacaatgggtttacatactatgaagtaaaccgcatgctgaataatgcaacgcagatggctgctggcataagtgatcgatcaaatcagtctgacatgagggcagacaggaaggcatttaaccgatggggttattaccctctaattctaatcggttcatgggcttttgcaactatcaatcgtctttatgactttgccaatccagggcacaggatagtctggctctcctttcttgatgttgggttcgctggacttatgggcctattcaattccattgcttatgggctaaactcttttgtgcgccgagctattgcagagagaatcgacacgttcctacctgagagaataaaaaggagcctccctgctttgtc

SEQ ID NO: 59613 - DNA, 452 bp, Zea mays
  unsure at all n locations
  Clone ID: LIB3069-051-Q1-K1-E6
ccatggatgaaattaatgaacagactgaatttatgaaacaaattcaggatgctttgtcaggtcctctcggagcttctgctgatttcgatgaggatgaactggaagccgaacttgaagaactggagggagcagagttggaatctcagcttctggagcctgttgcagctcctccggtgcatccagtgcatgccccagccaacaagcaaccagcgcgccctgctccacagaaagctacagctgaagatgatgagcttgctgcactgcaagctgaaatggcattgtgatcaggtttccaattaagaggtggaatgtgtatatgaatggcgttatgctaccaagatgaaagttgagtcaggatttattatatttgccatgtgtataatcttgggggatatttggcaagcagaaaaaagctgctccaggcagtgtttgtttcagtgantttgggctct

SEQ ID NO: 59614 - DNA, 441 bp, Zea mays
  Clone ID: LIB3069-051-Q1-K1-E7
tggagagcgagaacgtggtctcggttaagatcagcaaccggctgcatgacacccggtgcggggtggtcacctccaagtacgggtggagcgccaacatggagaagatcatgcaggcgcagaccctgtcggactcgagcaagcaggcgtacatgcgcggcaagagggtgctcgagatcaaccccaggcaccccatcatcaaggagctccgcgacaaggtcgcccaggacaacgagagcgaggagctgaagcacacggcgaggctggtgtaccagacggccctgatggagagcgggttcaacctgcccgaccccaaggagttcgcgtccagcatctacaagtcggtgcagatgggcctggacctgagccccgacgcgaccgtggaggaggacgacgaggcagaggagcagccggaggtggaggagaaggatccggaaccggagc

SEQ ID NO: 59615 - DNA, 320 bp, Zea mays
  unsure at all n locations
  Clone ID: LIB3069-051-Q1-K1-E9
ggagaaacaggggcgacccacgcgttcgcccattttncgcngacctgttgtccgacgtttaatcatctcaatacattcgagacatggggctggtctggacccaactagcaccacataacaccacacacaatgcaccgtagtgtgcgctgaatacaccatctcccaaccgaaattggacagagtgagcccaggacgggcaaaaactctcctactgttgattgcaaagaacaggacacaaggaggtccggtgacctagcagaggggggacgactgcggaggacccgagcctcacctacccaaagaccagtgcatctgtacca

SEQ ID NO: 59616 - DNA, 326 bp, Zea mays
  Clone ID: LIB3069-051-Q1-K1-F2
aaaaaaaaaaaaaaaacataaaaaaaaaatttttaaattaaaaaaaaaaaaaaaaaaaaaagaaaaaaagaaaaaaaaaaaaaggaaaaaaaaaaaaaaaaaaaaaaaaaaaaaaaaaaaaaaaaaaaaaaaaaaaaaaaaaaaaaaaggggcgcccttttaaaaaatccaaaatttactaacccgtaaatgcaagttaaaaacttttttaaagggcccctaaaaataaataaattgcccaatttttaaaaaatacaaaattggaaaaaccttggggttcccaaaataaatcgctttgaaaaaaatccccttttgacaacttgggt

SEQ ID NO: 59617 - DNA, 328 bp, Zea mays
  Clone ID: LIB3069-051-Q1-K1-F3
cccacgcgtccgcccacgcgtccgcgttcttattcgctgttgaagatgtcttctccatcagcggtcgtggtacagttgccactggccgtatcgagcgtggcaccgtcaagattggtgacacagttgatatcgttggaatccgggacacccggaactgcaccgtgactggcgttgagatgttccagaagaccatggacgatgccatggctggagacaatgtcggactgctgctccgtggtatgcagaaggatgacattgagagaggcatggtgctggcaaagcccggctctatcacaccgcacaccaagtttgaagcttgtgtgtatgt

SEQ ID NO: 59618 - DNA, 447 bp, Zea mays
  unsure at all n locations
  Clone ID: LIB3069-051-Q1-K1-F5
ctcggccacgacctctgggtgcacctcttctccaccagcgaggctgtggtcagcgccttgggctccatgacgccgatgctcatcggctccgtcgtgctggactccacgcagggggtactctgcggcgtcgccaggggctgcaggtggcagcacctggcggcgtggaccaacctggtggccttctatgtcatcggcttgccgctcgccatccttttcggattcacgctcgccttccaaaccaaggggctgtggatggggcagatatgcagcctcctctgccagaactacgtcctcttttttatcaccctgtgaaccaactggcaggagttagacctgaccatgttcaacaaggacaacgattttgtgtgctaggaatctagaaagagtttttattntcttttttgccatgtgctgttgctgaaacattgaaccatcagcatcaggctt

SEQ ID NO: 59619 - DNA, 455 bp, Zea mays
  Clone ID: LIB3069-051-Q1-K1-F6
cggacgcgtggggttccaggtattagcagtttaccggttcctcggagcacgatgaagttggttgctgcctacctgcttgctgtcctcgctgggaacgccagcccctccgctgacgatttgactgccattctggagtcagttggctgtgaagttgacaatgaaaagatggaactcctgctgtcccaactgagcggtaaggacatcaccgagctcattgccgcgggcagggagaagtttgcttcagtcccatgtggtggcggcggtgtcgctgttgcggcagctgcacctgctgctggcggagctgcttctgcagctgaggcaaagaaagaagagaaggtggaagagaaggaagaaagcgatgatgatatgggcttcagcctcttcgactaggctgcacagtcatcacagtattgttttgggcagtgaaaccagaggaaaaccagagtcatgtttag

SEQ ID NO: 59620 - DNA, 439 bp, Zea mays
  Clone ID: LIB3069-051-Q1-K1-F7
gatccacaggcattcctgtgaagaatttgtttctgtcctcaaagggaagggtacgctcttgatgggatcaagctcactaaagtacccagggcagccacaggaaattcctttctttcagaataccacattttcaatccctgtaaacgatccacaccaggtttggaattctgacgagcacgaagatttgcaagctcttgtgatcatttcgagaccacctgctaagatatttttatatgatgattggagcatgcctcatacagccgcggtactgaaattccccttcgtatgggatgaagactgcttcgaagcagcaaaagacgaactctaggtcacaagtgttttctgcaatgtatctgcttcatccatgatcctgctggactactaaaattcacatgcactagtcgtaataaagccagtgcgctattcatgtataattctg

SEQ ID NO: 59621 - DNA, 352 bp, Zea mays
  Clone ID: LIB3069-051-Q1-K1-F8
gtacaccaagcccaagaagatcatacacattcacaagaaggttaagctctccgtgctgcagttctataaggtggacgacacgactagcaaggtgacccgcctccgcaaggagtgccccaacacagagtgcggcgcgggcgtcttcatggccaaccacttcgaccgccactactgcggcaagtgcggactcacctatgtctacaaccagaaggcgtaattgcttgccccgatttgctttatccgcctaccctatcgaacatccagctgttggttactcgaattgtatctcatgtagatctggctgaggttgaaacttaaatggaacagtagtatatgtcatattggaacccgt

SEQ ID NO: 59622 - DNA, 440 bp, Zea mays
  Clone ID: LIB3069-051-Q1-K1-F9
aaaggggcgagcacgcgttcgtgaggttactgaccattttgctatggcttatgcaggcgcgccaagggggacgaccggcggaggggtgactgtcgggctatcactcctctgcgctggggccggcccgggcgccgcgcaaaaatgcggatggcagccaaacgtatgctgcagcaagattggctactgcggcacgaccgacaagaactgcggggacaggtgccagaccggcccgtgccgctcgggcggcggcggcagcaacggcggccgcggtgcgaacgtggctagcagtcgacaccggctccttcttcaacggcatcaagagccacgccgggagcggctgcgagggcaagaacatctacacccggagcgcgttgctgagcgccgtcaaggcgaacccaggcttcgcccatggcgggtcgcaagtgcatggcaagcgcgag

SEQ ID NO: 59623 - DNA, 451 bp, Zea mays
  unsure at all n locations
  Clone ID: LIB3069-051-Q1-K1-G1
cagaaggagaagctcgccggttcctataacttgtngtttgttaaactactacacctcacggggctccgaaaacatcgatatctgaccaaactactcacctgtgctcaacactgacgacgcctacgccagtcaagaagttaacgggcctgacgggaagcccattggtcctcctatgggaaatccatggatctacatgtaccctgagggcttgaaggatctccttatgatcatgaagaacaaatacggaaacccacctatctacatcacggagaacggaatcggggatgttgataccaaggagacacctctacccatggaggatgccttaaatgactacaaaaggctagattacatccagcgccacatcgctactcttaaggaatcaatagacttgggatcaaatgtgcaaggctacttcgcttggtctctgctggacaactttgaatggttc

SEQ ID NO: 59624 - DNA, 441 bp, Zea mays
  Clone ID: LIB3069-051-Q1-K1-E3
cccacgcgtccgcgcgttctccgtctccgtttccgtctccgtccgcccggcgtaaagaaagccctcggtcaccacagccggcacgccatggccgaggagaccgacaccaggcctgcctccgcgggctcccgaggccgccccgcgcccgaggacgacgacagggaggagggcgagatcaccgacctcgcctgcgctccttccccgcccgccacgcacccgctcgagcactcctggaccttctggttcgacaacccgcagagcaagtccaagcaggccgcctgggggagctccatccggcccatacacaccttcttcaccgtcgaggaattctgggggctttacaataacattaatcaccctagcaaattgatcgtgggagctgatttccattgcttcaagaacaagatcgagccaaaatgggaagaccctatttgtgcgaat

SEQ ID NO: 59625 - DNA, 92 bp, Zea mays
  unsure at all n locations
  Clone ID: LIB3069-051-Q1-K1-C9
ccggntggaaaaccggccgacccagcgccgactagtaaaagcaggatggtcaataaaattttaaaaaaaaaaaaaaagggaaaaaagggaag

SEQ ID NO: 59626 - DNA, 292 bp, Zea mays
  unsure at all n locations
  Clone ID: LIB3069-051-Q1-K1-D10
cggacgcttggggaaatgtgttctcataccttattgattagagatattgcggcctttattaatctgatctgtttggagctccgttanctcacccccaaactttatttagagaaggtgttatgtcttttgtcaagattataacatttctgaacaattgtgctacacacgacgtggcaccattctcatcatgtatcctaggatgagttatcactgttaaatatttcaagtcattttaatcatgcatctgcacacaatattatagaagcactctcaaatggtgggacgctaactt

SEQ ID NO: 59627 - DNA, 402 bp, Zea mays
  unsure at all n locations
  Clone ID: LIB3069-051-Q1-K1-D12
ggccgacccacgcgtncggccgctattagaagaaccctttttcaagactatgccatgtccgtcttcgggggacctgggaggcggtggcgcagctccgcaaggccgggaaggtcaccgtgagggagaccacgctcaagaggctgggcgccacgcacttgaggtacggcgtcgcagatggacacttcgaggtgacggggttcgcgctgcttgagacgatcaaggaggcgctccccgctgacatgtggagcctctagatgaagaaagcctgggccgaggcctacagccagctggtggcggccatcaagcgggagatgaagcccgatgcctagtagtggcgattgcgaccagtgtttaacccatgacgcagcgccgtcacagatgtcccgtgtggtcttgcgcttt

SEQ ID NO: 59628 - DNA, 448 bp, Zea mays
  unsure at all n locations
  Clone ID: LIB3069-051-Q1-K1-D2
aacccagctcgctcgtcccagctgatcatgttgagcacctagtagcgacctgctcgatcagcantgtagagtgtcggtaggtgtctgtctctcttggtggctggttgcaacggtcatggcgacgtcgtctcgtcgggtgcccttgctgctgctgtgcctgggcgtgctggtgtcctgctccttcgcggcgggcagcttggaccaggagctggacatcacgtggggcgacgggcggggcaaggtccttgacaacgggcggctgctgacgctgtcgctggaccgcacgtccggctccgggttccagtcccggcacgagtacctgttcggcaagatcgacatgcagctgcggctggtgccgggcaacttcgtcggcaccgtcaccgtctactacctgtcgtcgcagggcggcgcgcacgacgagatcgacttcgagttcctgggcaacgtg

SEQ ID NO: 59629 - DNA, 455 bp, Zea mays
  Clone ID: LIB3069-051-Q1-K1-D3
cccacgcgtccgcccactcgtccgcccacgtttccgccaatctttaccccaggacaatgtgtttatgatatcaaacccaaaggcaaaataccctgtgctgcagctggaccttagattgatatcagatcttgttgttgttatcgtgtctgctacatgtggtggaatcgcttttgcttgccttgggcaacctgtgattacaggttatctacttgcaggatctataattgggcctggaggttttagctttgtcaatgaaatggtgcaagttgaaacggtagcccagtttggtgtgatatttctcctgtttgcattgggacttgagttttctactgcaaaacttcgagttgttcgtgctggtgctggtctcggaggaatgctccaaattatgctgttcatgtttctttgtggtattttggctacactatgtggaggcaaaacaaaagaaggtgtttttg

SEQ ID NO: 59630 - DNA, 438 bp, Zea mays
  Clone ID: LIB3069-051-Q1-K1-D4
ggacgcgtgggcattcatcaaactggctatttttgataaggagcaggctgcgtgtagtggtcagagaagacgagctgctgacatcagtaattttgccagtgctgttattagagttagcagatcacagacaaaactaaacactgaaattgtaaaacatctgggtattatccatgagtacatggagacaatggcttctgttcataatgcttttactgatcgttccaatgctttgcttcgtgtgcaaaatttgtcagcagatctatatttcttgcatacccgggcaggaaaacttgaatctgtatcagcgagaggaatggatcaggagagatcaaggtatcaaaagatagaagaattgaaagaaacagtatgagccacggaagatgcaaaaacacgtgcacttaaagaattggaacttatcaaggaaaataacatgaatga

SEQ ID NO: 59631 - DNA, 441 bp, Zea mays
  Clone ID: LIB3069-051-Q1-K1-D5
cccacgcgtccggtaagttgttgactgtgcttcgctgagaaccatagagggcacagtgagtatttgaatttgatgggagcctcgaggatttgcctttgtagagtttgttgatccttacgatgcctctgaagcccagtatcacatgaatcgccaagttttctttggtcgggaaatagctgttgttcttgctgctgagtcacgaaaaaggccagaagaaatgcgcagcagaactagagtaagaggttactctggtcatgaaggtcgccggtcttcttactatggtcggtctcgttctcgctctcctcgctatcggggccgtcctcggtcgagatcatactctcctgctccaaggcggtggaatgactactctgcctctccaaggagacaggaagcccatcgctcatctccttccaggcgcctgccaaaggagcatgatgaaga

SEQ ID NO: 59632 - DNA, 449 bp, Zea mays
  Clone ID: LIB3069-051-Q1-K1-D6
gcttgtgggactgaaaggtaggattgaaattaaaagtgcttacctacaggagctgcaagggcaatatgtaggtctgcaaaacctgattcaacgaaatgagcaatcatatggttcaggaaacacgccttctggtggagtggctttgccatttatcttagttcagacccgacctcatgctaccgtggaagttgagatatcagaagatatgcagctggtgcattttgacttcaatagcaccccattcgagctgcatgacgactcatacgtcctaaaagaaatgcgattctgtggaagagaacaacatgacagcactcaagagtcgatatcaaatggaggtgagagctcaagcgtgtcaaatatttattggcaacacgtacagcatgtggaaaggccaaacaatggcacaggtaggttaccgagctcaccgtctattccagggatcttgaaag

SEQ ID NO: 59633 - DNA, 448 bp, Zea mays
  Clone ID: LIB3069-051-Q1-K1-D7
acggtacaatattgaacctcgcgtttcagtttggtacttccaacagaagatagagtactggaaagacaaggtgggagcaaactttgttagggagaggagagcaatgaagagagaatatgagggattcaaagggagaatcaatggcttaatttgccaaagccaaaaaggttcttgaaaaaggttgaccattcaagaatgaacccccttgcctggaaacaatggtcgtgatcattctggaatgattcaagtctttcttggccaaagcggaagccttgactgtgagggaaatgaactgccacgattggtttatgtttctagagagaaacgaccaggctataaccatcataagaaagctggtgctatgaatgcattggtccgagtctctgctgtactaacaaatgctccatatttgctaaacttggatggtgatcactacatcaacaacagc

SEQ ID NO: 59634 - DNA, 229 bp, Zea mays
  Clone ID: LIB3069-051-Q1-K1-D8
gaccgacgcgtgcggtaggacgtcatcgagatctgcgtttaccttttctccaccgtcgacacgtacgtgtccaagctcaattacctagggtccgggggcgccatactcgaatggatcggcctgtagggacacttctacaagcccaacatcccgatcatgagaaccatactcgacaagctctccaccctgtgcctgcccatcttgtttaccgaaatcgacatcatcaaca

SEQ ID NO: 59635 - DNA, 474 bp, Zea mays
  unsure at all n locations
  Clone ID: LIB3069-051-Q1-K1-D9
ggaaaaaagggccgacccacgcgtncgcccacgcgttcgcccacgcgttcgggatgtttctcgccgaaaagatcggccagatgacgcgggtcgggagggaagacgccacggccgacgcgctggccaaatacttcataggtagcgtgctgagcggcggaggcagcgtgcctgctcctcaggcgtctgctcaggcttgggccgccatggtgaccgagatgcagaagggcgctctttctacgcgtctgggtataccgatcatctacggtatcgatgcagtgcatgggcacaacaacgtctacaaagctactatttttcctcacaacgtcgggcttggagctaccagggaccctgacctcgttaagagaattggagaagcaactgctcttgaagatagagctactggaattccttacgcctttgctccctgtatagcgggttgtagagatccaagatggggacgctgctatgagagct

SEQ ID NO: 59636 - DNA, 451 bp, Zea mays
  unsure at all n locations
  Clone ID: LIB3069-051-Q1-K1-E1
cttacgaggatgtccagaatgtcggtgaactcgagcctgcgggtggcggacggnggcttggcgtgcttcggcgggccgttcgaccctaagtcacgctcgcctaccgtgctcaccattgccctcgtcgtcctgggtgtcatttttctcattgcctacttcaacagcagcccaggtgtaactgttacgagcaaagagactgtgaccaggtctgaaggttcttgcacatcagaagttatgcgggcgcttccatatcttaagaaggcatatggcaatgccatgcaaaaggttctccatgtaggccctgatagttgtacagtagtttctaacctgttgaaagaaggaaaggttgaagcatggggagtggagccttatgatttggaggatactgacagtacttgcaaaagactcgtgcgcaagggctttgtccgtatgtctgatattaagttccccc

SEQ ID NO: 59637 - DNA, 444 bp, Zea mays
  Clone ID: LIB3069-051-Q1-K1-E10
cactgttgcaccaaatgctgtacctgagctttaagatatgtttgcaaacacagcctccttggcttcagaggtagcaccagcaaacccatctgtggttctccaacagccagttcctactaatttctcctctcaggcacctcaggctgcccctgcattttcttattcacaagggcctcatcctggtgctgccatccagtctcaatttcgccagactgtcgccccatcatttcctccttcgcaggtgcctcaatctgtaacacccaatctgccaccaggccaatcgaacttctttttgcaatcagcatcagggtctggtattgacagcctgtctggggttcctacccagaatggagcaccatcctacattcccccacagaattctcagttcactgctccggcaaatcaacaaccatcgcagccaagcttccttccacaaactagcac

SEQ ID NO: 59638 - DNA, 435 bp, Zea mays
  Clone ID: LIB3069-051-Q1-K1-E11
atccaggacacggagggcatttctacggatttgcagcggctcatttttgccggcaagcagggggaggacgggcgcacgctggccgactacaacattcagaaggagagcaccctccacttggtgctgcgtctcaggggtggcatgcagatcttcgagaagacacttactggcaagacgatcacccttgaggtggagtcctcagacaccattgacaacgtcaaggccaagatccaggacaaggagggcattccaccggaccagcagcggctgatcttcgccggcaagcagctggaggatggtcgcaccttggctgactacaacatccagaaggagagcaccctccacctggtgctccgcctcaggggtggtatgcagatttttgtgaagacattgactggcaagaccatcaccttggaggtggagtcgtctgacaca

SEQ ID NO: 59639 - DNA, 444 bp, Zea mays
  Clone ID: LIB3069-051-Q1-K1-E12
tcacggtgtccaccgtgatcttgtacaagtttcagacggacgcgtcggcgtggggtgccggcgcggcgtgcggcggcgtgggggtgctgggcatcgcctgggccttcggcggcatgatcttcgtcctcgtctactgcaccgccggcatctcggggggccacatcaaccccgccgtcaccttcggcctcttcctggcgcgcaaggtctccctggtgcgcgcgctgctctacatcgtggcgcagtgcctcggcgccatctgcggcgtcggcctcgtcaaggcgttccagagcgcctacttcgacaggtacggcggcggagccaactcgctcgccttcggctactcccgcgggaccggcctcggcgccgagatcatcggcaccttcgtgctcgtctacaccgtcttctccggcaccgaccccaagcgcaacgcccgcgacttccacg

SEQ ID NO: 59640 - DNA, 418 bp, Zea mays
  Clone ID: LIB3069-051-Q1-K1-C8
aaggaatgtaagcttgtcttccattacaatttctgcatacacagtggcagaccttcagggggcaacgtgcagcttcagtcctgaaagttttatcggtgagggatcggtaggccgtgtttacaaagccaaattcggtgatcagaaggtcatggctgtaaagaaaataaacttgtctgtatttccaagccatccttcagatttgttcattgagttggtcgcaaacatttcaatgttaaatcatccaaaccttgctgagctcgctggttactgcttaaagcatggacaatgcttgctggcatatgaattctaccgaaacggttctcttcatgattatcttcatctgaatgatgaacacatgatgccattgtcttggaacagccgtgtcaagattgcgctaggatctttgagagcattagag

SEQ ID NO: 59641 - DNA, 424 bp, Zea mays
  Clone ID: LIB3069-028-Q1-K1-H10
gcgtccgggaggaggtgagccaccggaagcggagacttgtgtagtcgaccaaccccgtcggtccggcgagtccggctgcggcgcggcgtgctagatcgctaccgaccatggtggtggaggagatcgccgagggggtgaaaaacctcaccgttaccggagatgcggcggcttcaggcggagaggggcagaggaggggcggcggcggcagcagcaaccgcatccaggtgtccaacaccaagaagcccctcttcttctacgtcaacctcgccaagaggtatatgcaacagcacgacgatgtagagctatccgctcttgggatggccatagcaacagttgtgaccgtggcagaaattctgaagaacaatggatttgccgttgaaaagaaaattaggacctctactgttgaaataaacgacgaatcaag

SEQ ID NO: 59642 - DNA, 293 bp, Zea mays
  Clone ID: LIB3069-028-Q1-K1-H11
gctccttcgcctcgaaccctctcgcgcttgtcttgctttcactctccagggccccactcgcacgtcgccgccgcagccatggcgatcacagcgccaactcccgacatcctcggcgagcgccagtccggccaggacgtccgcacgcagaacgtgatggcttgcggggcggtggccaacatcgtcaaatcctcgctcggccccgttggtctcgacaagatgctagtggatgatattggtgatgttacaatcactaatgatggagcaaccatacttaagatgttggaagttgagca

SEQ ID NO: 59643 - DNA, 334 bp, Zea mays
  Clone ID: LIB3069-028-Q1-K1-H12
gccctgctcctctgcaggatatggcaattcattttgctacagccaatggccctactggtatgatagggattacctgttctcaatggagaaggcattagccagcattagccacgaagatgattcgatcatagagcttgcaaacgaggtgaggaaggtgctcaacagaacaaaggagaccaagatcactggtgccaatgcttccctgaaatcacatgcccctcttgtgcacctgtccgcgcttccagaaggcaccgttgtggactcgagatagcgagagccttggacgttggacctctactcggaatttacttccagctcttgcatgtttgtggcc

SEQ ID NO: 59644 - DNA, 403 bp, Zea mays
  Clone ID: LIB3069-028-Q1-K1-H3
cccacgcgtccgcggacgcgttggcggacttttttgattcaaaacggataaagagaaatggagagctttaccttaatgtgggctgcaattttgccgagatatttggagaaaattctgtagcttctattcttgggtctcttctagatatcttgcttcttaagaaagatgtgaagcaaaagtcgcgtttattacaacctcttttccagattctatcgaagcttctttctgatcaatgggtctcagatattggtagtcagtataacgaccaacaagatacctcatctgaaatccctgatttatctaactttgtcaaagaagttcaacacttggtactgctggccctcaaagatattacagataccctaccatcgggtcaccatgatgcaatggtcaacagctccca

SEQ ID NO: 59645 - DNA, 283 bp, Zea mays
  Clone ID: LIB3069-028-Q1-K1-H4
cccgcgcgtccggcaagggtgccgaggatttcttttttgtccgtgtaatgtcgataattgttgttactgtcgttgtgaaagtgagtcagtgggacttgttaggttgtcttgttcagatgtaatgcacatagagttgtggaacaccgaaacatgttgtagggggtggggcggtagcagagggtggacagtaacagtagcgcgcccagccctctacggcctaccctttgaaagccttggttgtagccaatgcagcttgctgtaaagaagtggcattttttttgtc

SEQ ID NO: 59646 - DNA, 433 bp, Zea mays
  Clone ID: LIB3069-028-Q1-K1-H5
agccaacctgaatggctctttagctgttgttcatggcccaactcccagtatggacattgggattctgatggactctggtaagggtctctgggtcaaacaatacatcatacagttcaaagagtatgccagttttcaatatgtgcatccattggtggtattacgtgacggaagggtggtcctatataaagaagacatgcagcttttacagatctatgacccaagaactaacacactcacagattcagtggaggtgtgccatttttctgcagttgctttgtttggaggaaatctactgagcttatagtatatttttgtcgctgggcataatttatggcaaactgcattcttaccgacataagctgcaaatgtaaagcttaggacactagtagcttagctaataataggatagaattcccaaatctattttggtaag

SEQ ID NO: 59647 - DNA, 402 bp, Zea mays
  Clone ID: LIB3069-028-Q1-K1-H6
aggagtcaaggatgaggaccaactttatttgcccaagtacgtgtgtttcaagggagatggtggtctgtacctgagtgctcgaacagttgaaggccacccctacctgcagtttgcatcggaagacattggcgacccaagtgtgaggttcatcacctacaaccacaaggtgaacggcaaacgggtggtgcgcttcaagtcgaaccatctcggcaagttctggaggcggagccccaactggatctgggccgacaccgacgacaccagcaccaacaactccgacaccctgttcgaggtcatcaagatcgacgaggatggtgtgtacgcgctccggaacctcggcaacaaccacttctgccacaggctgacctacgacggctaggagagctgcctgaacgccacaat

SEQ ID NO: 59648 - DNA, 319 bp, Zea mays
  Clone ID: LIB3069-028-Q1-K1-H7
cgccggccgagggcctgcgcgtggaccgttgggccggggccaggtacgcggccgtgcgcggcttcgggggcttcgtggcggacgccgacgtcggggagcaggcggcgcgcctcgaggccagcctccagggcacccggtgggccgccgccgtcaacgacgcgcgcagggccgacccggcctcgccctacaccgtcgcgcagtacaactcgcccttcgagttcaccggcagggtcaacgagatctggatgctcttcgacgccggcgaacccggccaacgaccccagtatgtgatgcgattccaagcgtgctctcggggcac

SEQ ID NO: 59649 - DNA, 405 bp, Zea mays
  Clone ID: LIB3069-028-Q1-K1-H8
gagagaaacagcccaacatcactattggcattttggtctccgttgtcatcgtgttcggggccgttctcttcaagctcctgtttggtggcaagaaaccagtggcacctgtgaaacctgcagctgaggcgaagaagcccaaggccgcggagacggacggtgctggaagcagtggtgacaaggatgagaaagaggatgaaaaggaggagacaggcccacgtcggaggacccgaagggagacatagacctgtttttgacgtgttttagctcttctggcgtctgcttattttgagacctcttaatatttgtgagtgtataataggagcttatgtcacctctgcggcttcccccgctgctgatttgtttttaatggttagaccaggacccttcacgagcgtaaaaaataaa

SEQ ID NO: 59650 - DNA, 435 bp, Zea mays
  Clone ID: LIB3069-029-Q1-K1-A1
atacaattcaaggtattgaagacaagaaattttctatagcatcaacttctcagctgagcgcctctcagaatttactgaagcaaaggcaccacttagattccaattcaccaagcaacattacttatgaggcctatgaagaaaagttcggtccatctagtggttcttttgcacaaaggaattcaaaagtgcagaagaaaactatgaacatgcaaccaacacagccgacaaatgataatgtcatgaacagacatcctcaaacattgacaagaagtgcttcttatccttgtgagaacaatgaatctgaaagaagaggattagggaaaagaactctgggggatcctcaagttacaatgggtacttcaatggtagtggatggctcatttgtatcatccatgtcctctgatatctctggtgaagaaagtagctttcgacaac

SEQ ID NO: 59651 - DNA, 379 bp, Zea mays
  Clone ID: LIB3069-029-Q1-K1-A10
cagggtcgtctggctttccatgcgctgttttgtagagaaaagcttccgcaaagcttttgtgccccacaagcagaaggctcgaaggaagttggcaaggaggaggaagatgaagtcaccacagtggcagttgacctcaacaagagtaccacaagcattgatcatgacctcgacacaattggcttcaaaccatacaagagatgttctgtggaagcgaaggagaatagggtgccggctagcgacgaggttggtaccaagaggattcgtcttgatagtgaagcatcaacatgagcgatttctacatggttaccgctcggactttctctgccgccatgaagtttatgacaaagttgtatttacatctaaactagtataggactta

SEQ ID NO: 59652 - DNA, 430 bp, Zea mays
  Clone ID: LIB3069-029-Q1-K1-A11
acgcccacgcgtccgcccactcgtccgagagcttttaaggagcgagctcagtcagacttgaaggaagctgcagacaaacattggagtgatggtgccttggaggcagacctgcgacgagctgacttggttgttaaacgacgtgccatggaagacgctttcatggcattgaagtttgttcaggatatccatgacatgatggtgaacagattatatgagcagcttccgaaggacggttcatcttctcgtacaaattcaacagggtttattacacttgagaagaacgggaaggctcttgaactgtttcctggtgaagtttctgctgatcagatttatgccatagaggaagcataccagagtatggcatctgccttttctgaagctgatggtattgactacacagatccttaggagctttgaatgttgtagcaac

SEQ ID NO: 59653 - DNA, 362 bp, Zea mays
  Clone ID: LIB3069-029-Q1-K1-A12
ataaccgggccgacccacgcgtacgcggagctggtttgactattgtagccatatttgtattgcctgcgagaagcttggcccaaggttatattattatctgcagaaggccggcttacatccattcccaattgatctaattcgccggatcggacagcaacttttggaatctgttgcattcatgcatcgtcttcagctaattcatactgatctgaaaccagagaacatcctcctcgtttcttcagattatgtcaagttacctgatcccaaggacggatcattctcaaggaaactgccaaaaacaagtgccattaaattgattgactttggaagtgcagcataccattaccaggatcgcacttaca

SEQ ID NO: 59654 - DNA, 308 bp, Zea mays
  Clone ID: LIB3069-029-Q1-K1-A2
gcagccgcggcgaggtcgtccgtcggattttgaagctcagttattactgaaaagataatagcagtacctatggcttctctggacgccgtgcgaggagacctcgccctgctgattctgtacctgaacaaggccgaggcgcgggacaagatctgccgagcgatccagtacgggtccaagttcatcagcaacggcgagccagggcctgcgcagaacgtcgacaagtccaccagcctggcccggaaagtgttccggctctgtaagttcgtcaacgacctgcacgctttgatcagcccttctgccaaagggac

SEQ ID NO: 59655 - DNA, 426 bp, Zea mays
  Clone ID: LIB3069-028-Q1-K1-G9
cctgaaggaagcaggaatcggagcgatgcttaacgagctcagtagcacagtcgtgtttggaaggccaaaggatgaagaatttgtccgaaggtggcagctggcttgtgaagggaatatagctcacgttgtggtgatgcccagtgtcaacattgacaagctagactatttcctgaatgagttagtggacaaacgggcgacttggtaccaggacgggataagccagccaccctgcattgccagagacgtaggtgttgagaactgtctctgtggccttcacaagtagcgagccttttgctttgcaagtgggttcactcttgagtcgagttaaaaagtgttatgttgtactgtgttcattcttgagttgagttaaaaagtgttatgttgtactgtgttcatgcgttctgcttctgtgtttctccacagtgt

SEQ ID NO: 59656 - DNA, 442 bp, Zea mays
  Clone ID: LIB3069-028-Q1-K1-F3
cccacgcgtccggctcaagaagctcgtcgtctgctgcaagctgaccaaggtgaagaactggggaagctgtcgtccgccacgaagccgaatcccaagcccaaggccgccccgaagaagcccaagaccggcgctaagaagcccaaggccgctgccaagcccaaagctaagacccccgccaaggcgaagcccgccacaaagcccaagcccgccgcgaagccgaaagccgtagtgaaaccgaagacacccgccaagcccaaggccaagccagctgccaaggcgaagcccaagaccgccggcgctaagccgaagccacttgctaagaaggccggccgccccgccaaggcggcgaagacgtcggccaaagacacgccagggaagaaggcccctgccaagaaggccgctccctcgaagaaggcggcgaccccggtgcggaaagcgccgt

SEQ ID NO: 59657 - DNA, 440 bp, Zea mays
  unsure at all n locations
  Clone ID: LIB3069-028-Q1-K1-F4
gaggaagtcgtgattgctaagatggacgctactgccaatgacgttcccagtgagtttgaggtgcaaggctacccgaccttgtacttcgtgaccccgagcgggaaggtgacatcctacgacagcggcaggacggcggacgacatcgtcgacttcatcaagaagagcaaggagaccgcaggcgccgtcaccaccaccaccacccaggcgccaccggcatccgagaaggcagccgccgccgagcccgtcaaggacgagctgtgagcatccaaggtgtggacggctgtggctgcgtaagcatgggaggaaaacctggcgctaacgtgccttcaacgcctagtttttgcgggaccagagggagagagagagagggacggagttagagagagaggggatctgcgacgtgttntgctctgcggcggcatgtctgtgtatcccattga

SEQ ID NO: 59658 - DNA, 433 bp, Zea mays
  Clone ID: LIB3069-028-Q1-K1-F5
ctagtcgtcgcttgaagactgagctacttattcagatggatggtttgacaaagacggacgacttggtatttgtacttgcagctacaaatcttccctgggaattggatgcagccatgctccgccggcttgagaagcggattcttgtaccgcttcctgaaggtgaagcaaggcaagcgatgtttgaggaacttctgccagcaactacctcaaagttagaaatcccgtacgacatactagttgaaaagactgaaggttactctggttcagatattcgtctcgtgtgcaaagaagctgccatgcaaccactgagacgtctcatgtcagttcttgaagccagtgacgagttggttccggaggaagaactgcctgaggttggccctctgaaacctgatgatattgaacttgcattaaggaacactaggccgtcagcaca

SEQ ID NO: 59659 - DNA, 433 bp, Zea mays
  unsure at all n locations
  Clone ID: LIB3069-028-Q1-K1-F7
cgctgcttcaagaaaccaccgagagcccattcgcacaggcaggagagagagcagggagcgagggacagtagagtggggccggggagcaaagatggaggggaaggaggaggacgtgcgcctgggcgccaacaagttctcggagcggcagcccatcggcacggcggcgcagggcgccggggccggggacgacgacaaggactacaaggagcccccgccggcgccgctgttcgagcccggggagctcaagtcctggtccttctaccgcgcgggcatcgccgagttcgtcgccaccttcctcttcctctacatcaccgtcctcaccgtcatgggcgtctccaagtccacctccaagtgcgccaccgtcggcatccagggcatcgcctggtccttcggagggatgatcttcgcgctcgtctactgcaccgncggcatc

SEQ ID NO: 59660 - DNA, 319 bp, Zea mays
  Clone ID: LIB3069-028-Q1-K1-F9
agtagatcgccgtcgtccccttccgaaatcttctttcgtgtattcctccccaccgcaagaggttgcttttccttccatctacggaggcattccttcccttcggctttcaaccacaagaacttcaacttcaacccggcttggccgccgccgaagaccccattttggaaaatccaaatggaacacccctggcccattaacaatcagaatccgtttctggggctaacctcttaacagggcccccttggcaaacccgggcaacaacattgcgcttcggggcgctccattggccgttggaaaccctgtaacggggagcccccca

SEQ ID NO: 59661 - DNA, 469 bp, Zea mays
  Clone ID: LIB3069-028-Q1-K1-G1
gaattaccgggcggacgcgtgggcggacgcgtgggcggacgcgtgggcaataacacttggagaacccattggtgttgatgatgtcagtaggatgaagtacaaggacaacatttatgcctcaactccacaggtcgagacatctgacatctggattcagcaagctagagagatgccacctatgcaggttccttcatattacaacataccaggtcaagcaacaccaggtgcttttgtgccaaatccagcaaatgcatctttcaatgctacagctcaatcctctcatgtgcagttcccaggcttgtaccatcctcagcaacctccctctattgtaagtccgcaccccatggtgcatcaacaggtgccatcggccattggtcccaatgttggggttggggtggcagcttcaggcccgcaagttggagcttatcagcaaccacagcttggccatatgaattggagacccagcttt

SEQ ID NO: 59662 - DNA, 391 bp, Zea mays
  Clone ID: LIB3069-028-Q1-K1-G10
cacgaccacgctagcacgcactctccgtctctccccttccggttccagtagctgcatccgctgcgccaagtcccaataatcccgcagcccggcggcatggcggtgagcaacaacatcacggcatgcatcaacttcctggtgcttctctgcaccatccccatcgccgcgacggggctgtggctggcctcgaggcacggcagcgaggactgcgccaggctggcccgctggcccgtcgccgtgctgggcgcgctcctcctgctggtcgcgctggcgggtttcgcgggcgcctactggaaccgcaggggcctgctcgcctgctacctcttcgcgatggccgccctcatcacgttcctcctcgccttcctcgtcttcgccttcgccgtcgcgcacg

SEQ ID NO: 59663 - DNA, 410 bp, Zea mays
  unsure at all n locations
  Clone ID: LIB3069-028-Q1-K1-G11
ccgggccgaccgacgcgtccggaatccgcgaatcacagacgcgtctatcttagcttgctgcgctgcactaccctgccctggcaggatatcgtacgtgagcccggccgagcgagagcgagggagaggcatggctgctccgaagctcgcgacgctggcgctggccgtgctcctggcggcgaccgtggtggctcccccggccgcggtgcgcgcggcgatgtcgtgttccaccgtgtacagcacgctgatgccgtgcctgccgttcgtccagatgggcggggccatgccgncccagccgtgctgcggcggcatccgcagcctgctgcagcaggccaacaacacccccgaccggcgcaccatctgcggctgcctcaagaacgtcgccaacggcgccaacgggagcggcacctaca

SEQ ID NO: 59664 - DNA, 81 bp, Zea mays
  Clone ID: LIB3069-028-Q1-K1-G12
cgcgtccgctcactctggagagcacgacaaagtgaatgctgtggagatttggcttgaaaataagcatgacgatttgagaac

SEQ ID NO: 59665 - DNA, 443 bp, Zea mays
  Clone ID: LIB3069-028-Q1-K1-G2
aggcaatccaaagggttaaagagctggctgttatcatagaaggaaaaagccttgaagagaggagatcactgctagccaagtgcgctgctacaacactctcttcaaaacttataggtggtgaaaaagaattctttgcttctatggttgtggatgctgtccttgccattggcaatgatgacaggcttaatcttattgggattaaaaaggttcctggaggtaccatgagagactcttttttggtgaatggtgttgcattcaagaagacgttttcatatgcaggatttgagcaacaaccaaagaagtcccttaatccaaagattcttttgttaaacattgaactagaattgaaatctgagaaggaaaatgcagagatcagattgtctgaccctctgcaataccaatcaattgttgatgctgagtggaacattatttatgacaaactg

SEQ ID NO: 59666 - DNA, 427 bp, Zea mays
  Clone ID: LIB3069-028-Q1-K1-G3
gcaccggcacagaggccttctactgctgatagatgtcctgttaccagagagactgtactgaagcaagctaatgttgccaactcatgtttacctttgacgccagatagacgcctcaccaaaaaaggtgacatttccacccttgagtgcccttctacaggaggaaggtgccctatcaccaatggtactgcactctggtcaagaacaatgccgtactattcaaaaggtgctttggtcacagaagttactccccagaagacaataactcccaaggttgttagaaacagcaagctagaaaacctaagctatgcaaaagaaagggtggaacttcaagtggatagaaagcaaaagtcaagtctttttaacctgtcctcgaagaaaacattgacttccaacgttagagatgaccaaggtcttgaaatgttcaaaa

SEQ ID NO: 59667 - DNA, 442 bp, Zea mays
  Clone ID: LIB3069-028-Q1-K1-G4
ggagagcccagttgtggttctatgcctgttaggtattctttgtaattttttctcctgtgtctggttctgttatcatcattattttcctggtgtggggcaatcatgtcagagagcgagttagcagtaataaaaccagaggcattgaaaacttatatctggcttcagtgctttgatggctccatacaacaagtggaggaagaagttgccatgttctgccctatgatatgtcgggagataatgaaaaatgggacagggtcatctaagaatcatgctatagttctaccgcaaagagttaatccggcaagtttgagtttgattcttgattattgtcggtttcatcaggtccctgggcgctcaaacaaggagcggaagtcattcgatgaaaagtttgtcaggatagacacagaaaaactgtgtaagttggcttctgcatcccttggtc

SEQ ID NO: 59668 - DNA, 436 bp, Zea mays
  Clone ID: LIB3069-028-Q1-K1-G5
cctgtcctcgcgtctcccttcccagatccatcgactcgctcgggccgcccctcccgggggccccgttcgaaggtgcggcagccggcaggcgagcgatttcattcgacatgaatcccgagtacgactaccttttcaaacttctgcttattggtgattctggtgttgggaaatcatgcttgcttctcagatttgcagacgattcttatttggacagctatatcagcacaattggggttgatttcaaaattcgcacagtggagcaagatgggaagaccataaaacttcaaatttgggatactgctgggcaagagcgcttcaggacaatcactagcagctactaccgcggagctcatggaatcattattgtatatgacgtgacagaccaagaaagcttcaataatgtgaagcaatggttgaacgagatagaccgttatgc

SEQ ID NO: 59669 - DNA, 317 bp, Zea mays
  Clone ID: LIB3069-028-Q1-K1-G6
aaagaaaaaaaaaaaaaaaaaaaaaataattaaaaaaaaaaaaaaaaaaaaaaaaaagaaaaaaaaaaaaaaaaaaaaaaaaaaacaaaaaaaaaaaaaaaaaaaaaaaaaaaaaaaaaaaaaaaaaaaaaaaaaaaaaaacgccgaccacttaaaagaacccaacataacttacatggccccacaaaacaaaaacattcaaaaagttcccccaaaatcaactaaaataccccagtagaaaaaacataaaaactcaaaaacccctaacaatcacaaaataaacctaccgcaaagaaatccccattcaacaaggagcc

SEQ ID NO: 59670 - DNA, 437 bp, Zea mays
  Clone ID: LIB3069-028-Q1-K1-G7
attgttgtagcagatgactctggcaaaactgttactatttctctctggaatgatcttgcgactacgactggccaagagcttttggacatggttgacagttcgcctgttgttgcgataaagagcctaaaagtatctgacttccaaggcgtatctctttcaactattggcagaagtactctcgagattaatcctgacctgcctgaggctaagaatctgaagtcctggtatgactctgaaggcaaagatacttcactggcaccaatcagtgcagaagtgggtgccacacgcgctggtggtttcaagtccatgtattctgatagagtttttctgtctcacatcaccagtgatcctgctatgggccaggaaaagcctgttttcttcagtctgtacgccatcataagccacatcaagcctgatcagaatatgtggtaccgtgc

SEQ ID NO: 59671 - DNA, 442 bp, Zea mays
  Clone ID: LIB3069-028-Q1-K1-F2
cccacgcgtccgcccacgcgtccggctgctgaggcgctcctgctgcggcttctgcgtgcgaaggttgatgagtttatgagacaatctgatggtatcaactggatggctgatgactctcctcctggcggcaatgagtatgcgaatgaggtcatcatctaccttgagacgctcacatcaacggcacagcagatccttccccttcctgtgctacaccgtgtacttgtggcagtgcttgcccacatctctgaaaggatcatcgagctcttcttgaacgattcagtaaagcggttcaatgccaatgcggtcactggtatagatactgatctcaaaatgtttgagacgtttgcagagggcatgtctagcctgtttgtggactcaggtcaagaatctgcaaaaaatgaaatgaaggctgcactagtggaagcaaggcagctagtgaatc

SEQ ID NO: 59672 - DNA, 441 bp, Zea mays
  Clone ID: LIB3069-028-Q1-K1-D7
gccaaccatatccactctcggcggcgccgttcatctctcctctcttcttgcccttgcttgccccaacccacacagcctcactaggggtctaccggcggcggcaacgagatggtgcagcgcctcacctaccgaaagcgtcacagctacgcgacaaaatccaatcagacccgggtcgtgaagaccccaggtgggaagcttgtgtaccaatacaccaagaagagggcgagcggtcccaagtgccccgtcaccgggaagaagatccaggggatcccccacttgagacctgccgagtacaagaagtccaggttgtctaggaaccacaggactgttaaccgtccttatggtggagtactctctggaattgctgttagggagagaattatccgtgctttcttggttgaggagcagaagattgtcaagaaggtcctgaaaatacagaaa

SEQ ID NO: 59673 - DNA, 429 bp, Zea mays
  Clone ID: LIB3069-028-Q1-K1-D8
cggacgcgtgggaaagggctcctagcgattcaagtggtggcagtccggcttcacctcaggcatcatagagaagcccagagactattctgtctgcccctaggtgcacgacaacaggagcagtgtgttctggtgatgcaattagtaagcatagtagtgttcctcttgttgagaactgcaccactccgactgtagcagtgtgcacaactttgaagcgcgtagctgagaaagttgtttcagagctagttggaagtgaaaggctggggagcaacaacagtgcggaattgttggagagtatggaaaaggaggatgtccttgctgaaaatgttcgttttggcgggaatggagttgcgcaaggtggccttccagaagagttagaggtatgaacaagtgtacattgtggaagtcgtcactgaggcatggtcttgaact

SEQ ID NO: 59674 - DNA, 422 bp, Zea mays
  Clone ID: LIB3069-028-Q1-K1-D9
ttcttcggcctcacgcatctcctcctccttctccaatccaattcacaaacacacacggggaatgaattagcagaacccgggccacccccccttcctcggagtcggagcgagtcgaggaacggctcgtctgcctctcccgttctccttcctctcctccccagaagatctgatccatcatcgaggactcgccgggaagaatcaaggatatatagataataaacaaacaaaggttcctccagagcccagaggagggaagtcaccggccgtcggcggggaggagatgtcggacggcgcgggctcccggacgggcgtcgctggcgcgctgggcctctcggtcacctcgtcggtggccatcgtcatctgcaacaagtacctcatcagcactctaggcttcttctttgcgacgacgctgacgagctggc

SEQ ID NO: 59675 - DNA, 431 bp, Zea mays
  unsure at all n locations
  Clone ID: LIB3069-028-Q1-K1-E1
cggacgcgtgggctatagcaaccggtccatcactttcacgctcagcttcagcaatggctgcctgcaccatggcgatctcctccacggcgatggccggcacccccatcaaggtgggttccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgncgggctgtccgccgaccccgagacattcgccaagaaccgcgagctggaagtgatccactcccgctgggccatgctcggcgcgctcggctgcgtcttccccgagctgctcttccgcaacggcgtcaagttcggcgaggccgtc

SEQ ID NO: 59676 - DNA, 386 bp, Zea mays
  Clone ID: LIB3069-028-Q1-K1-E10
cgagtggacgactactggcatcattggctttatgtatttgcagggggtcttataggtctgacagttgcttcgttttgctacctacagtttttcccatatcctttcgatggcgatgctttgtggcctcacgcatacgcggtccggttagccgaggaggggaacagcagaaatgcgaactcgtacagcgtgagaccaaccgagatcgaaacagtcgatattcctgggcacggtgcgatcatcaccctaagagagactctaaacgatgtggagtctggcagtgccaggagattgtgagatgggtctgcaggtgtggagattgatgtctcagataccatgggagttgcttgcatatgtgtacaggtagatctattggagagctgttgact

SEQ ID NO: 59677 - DNA, 208 bp, Zea mays
  Clone ID: LIB3069-028-Q1-K1-E11
gaccgacgcgtccggagacgttgtgcgcctcttgttacgacacttgatgaacagcatagggaatgataccatcgtagttttagtagtccttcgtggccttcagtttgtcttcaaagagttcttgttgcctcttcacatacatgtaaacactgtaaataccgttacctgaataaagcttcagcctgctaggctacaagcagggttcact

SEQ ID NO: 59678 - DNA, 306 bp, Zea mays
  unsure at all n locations
  Clone ID: LIB3069-028-Q1-K1-E12
gtggtggacgcgctccttgccgagggccttttgaagcgcctcctctgcctgcagcgctgcgagctctgcggctcgctcgcggacacggacgaggagggctgcccaaaggcgaaacccgaggacgccaaagccggtggctttctcctcgtgccctgccttcctctggtgtatctgtggtggcgtcgccagggcgacggcgccgcggacgcggacacggaagagcggccgttcgtgagcgctgtggcgcggttcgcggtgcangtggaggtgggcgtggggttgagcccgcgggagaagcgtgaggcg

SEQ ID NO: 59679 - DNA, 429 bp, Zea mays
  Clone ID: LIB3069-028-Q1-K1-E2
cgcacgcgtcgcagcacgccacacgtaatttccgaagtctacaacatgtgccaaacccggcgcgaaatctgcctcttcttgcggctttcgttcccgcttctggccaaattcctccaaaacctgacgagctggatgaccagctcgagggtccatgccgggtgatccgagcagtgatctgagcccagtcctggatccaagcgggaatccatacttgatctcctacatcagctacgcgatcgatcgatccaccgatagatgctgcggcctcagccacaatgtgagacatagctgtggatatacctgctgctatgcgaaatgggcatgcatagaggacttctatgagacatactatgatagagatgatggtcatatagatggtcatataggaggtcttgatggacatggtgatggtcatggtgcagattatgt

SEQ ID NO: 59680 - DNA, 357 bp, Zea mays
  Clone ID: LIB3069-028-Q1-K1-E4
cccacgcgtccgcgtcagccgaactttctcgacttctccaggaccgcatcaacgatcagtgggactcgctccccgagccagggccggtgatgatctcgcgctggaactgaatccaccagcaatggccgggccgaggatcgatttccgacagcaggaagggtgcagcatgtaaagggggaacagatgagatcatgtttgggttggtcccccgttgtatatgtagttatgtatcagccagtcctttgtttgtaaattaccagtatttagaagtaataagaaaatgggggtttacgtgtacgtttcctgtgctctgtcatctgaagcaataaaactggttagcaagaccggaagagcgac

SEQ ID NO: 59681 - DNA, 442 bp, Zea mays
  Clone ID: LIB3069-028-Q1-K1-E5
gcaatatggggacgtacagacattcgacatatcctgcaagagccatggaattgttacagggtcttactatgacattagagctgcacaggacgcagtgagagcagtccataacaaacctctggggctgatgaaacttgatgttcaattttcccttcctaaggaaaatgttccaaacaaagatcccaacaatggaacactggtggtatctcttattgactcttccatctccagccatgatcttctccaaaaatttagtgtttatggcgatgtcaaggagatttacaagtctcctacaagctgcaataagaaatttgtagaattctatgatatcagagcagcacaagaagcactgaatgacctcaacaagggtgaaatatcatgctcacaaatcaaagttgagcatagcttttctggaggagcaggatcttgcttcgcagagcaa

SEQ ID NO: 59682 - DNA, 361 bp, Zea mays
  unsure at all n locations
  Clone ID: LIB3069-028-Q1-K1-E6
cccacgcgtccgggaacagctagatgagtttgaactggaagctaaaatacaaggagcagggatatctaatgtctgcgtccaggttgctgaaactggtcagagtgagtcactctactgtaataactgtaagctctcgatgagccgattattaaggtgctgcccaacatgcccgtttaagctgtgcctaagttgctgtcagaagatacgtgaaggaaacatgtcggacaacacccctgaagataaattcaagaatcggttgattcaacangagtctgtccatgaggatggcagtattacttgcccttcgattgagctgggtggatgtggtgacgccatgctgaacctaatatattcatctcca

SEQ ID NO: 59683 - DNA, 90 bp, Zea mays
  Clone ID: LIB3069-028-Q1-K1-E7
cccacgcgtccgattcatttgttaagaagttaacgaggtaaaggatgtaaatgatgccgggggctttgctgaatatgaaagttgaacagt

SEQ ID NO: 59684 - DNA, 260 bp, Zea mays
  Clone ID: LIB3069-028-Q1-K1-E8
aaatatacacgctcaacatatcaacttcataacataatcactcctcctctcatacatccaagcttatccaaacgatcacatcatctaccttcacacactcacatcaacctcacatcaaatccttccccttccttttctacaccttctacttgtaacaccccttccccacatcacttaaacgatcatcaaactcttctacaactatccactaaagctattcaataccaatcccgtcactggcatatatactaatctcaaaa

SEQ ID NO: 59685 - DNA, 409 bp, Zea mays
  Clone ID: LIB3069-028-Q1-K1-E9
aataccggccgaccacgcgtccgacaggcgtacgtccactcgttcgcccattctttcggtcgggaacgcagaggcgggagcgacgggaaggtcgggcgagaagacatgaggaagccaaaaggagaacgagttcggaagggagcggatggcaatggctctggtccagctattgctggcgctcctaatcgtctcctgcaccgcgcaatcgccgtacgcgtcgaaagctcctacgatcagcgcctcggcgccggggggctctgtcgcgccaccgacaacggcggtctcggcgccgcaggcgtctgcacagccgccgacaacagtcgccgctgtctgggcctcaagcctcggccgtagcaccaacaaaagcagccttggcgccacatgcctatgctgcgccgccaactacagc

SEQ ID NO: 59686 - DNA, 335 bp, Zea mays
  unsure at all n locations
  Clone ID: LIB3069-028-Q1-K1-F1
gtcctcgtctttaactcctacctctggtgtttctccggggacaaaatccagatcctgaggggcgcctacaacgacccgagctaggacatcgtggagatgaagtcggaggaggcctaccggctggtgctgcaccaggtggtccgagggctggagcgcaacgtggaccccggcaagtcgcgggtgttcttcgtgaccgcttctccgacgcacacggactgcagagcgtggggcgacgacgacacggagggcaggagcaactgttacaaccagacgtcgtcgatcagcgccgnctcgtcctaccgtggcggcacgagccatgagatgctgcgcgcaac

SEQ ID NO: 59687 - DNA, 127 bp, Zea mays
  Clone ID: LIB3069-028-Q1-K1-F10
caaattgtatctcatttagatctgtctgttttttaaacttaaatggagcagtagtatcgacgtattggtacccctgttactgagtataattttgttttcatatctatccttacagacgattgcactt

SEQ ID NO: 59688 - DNA, 428 bp, Zea mays
  Clone ID: LIB3069-028-Q1-K1-F11
ccttgctcttcgtcttcgccggcgttggcttcttcatggcaacagggaagctggccggcggcggctttgacacggtagtgggcctgacggcggtggcgctggcgcacacgctggtggtggccgtcatggtgtcagcggggctgcacgtctccggcggccacatcaacccggccgtgacgctgggcctcgccgccacgggccgcatcacgctgttccgctccgcgctctacgtggccgcccagctgctcggctccacgctcgcctgcctcctcctcgctttcctcgcagttgccgacagcggcgtgcccgtgcacgcgctgggcgccggcgtcggcgcgctccggggcgtgctcatggaggccgtgctcaccttctcgctgctcttcgcggtctacgccaccgtcgtcgacccgcgccgcgccgtccgc

SEQ ID NO: 59689 - DNA, 306 bp, Zea mays
  Clone ID: LIB3069-028-Q1-K1-F12
tgcgtatctggttttcaattggatccatctcatcttctctacatagttttgtttgtgtggatggttgtagcatatgctcttgttgcaataaaaaaaatgtggcagttgtttggctggtgactgcctattatgagcctgcggcaataaatgttcagcaaattgcggagtaaacattgagagctccagaacatggagagaaagtgtgtattgtatatttgcgttgttcctgtaaagcatgtttagtcaaactcgaatattgtctataacaccgagtaaatctcaggcggaaacatgggcgagctttct

SEQ ID NO: 59690 - DNA, 440 bp, Zea mays
  Clone ID: LIB3069-028-Q1-K1-D6
cccacgcgtccggttctagatcgcgacggtcgcccttttttttttttttttttttggtggtttttttttttttttttccggcatcttttaagactttagataacagcttcacacatttttcaaatccacaaaagaactggaagtcaaaaaaagaaaagaatggtactgctgatggacagaatttgtgcaaacctatttcctgcagcatttacatattacaaagattacaaaaatcaccatacatcaagttacgctcaaaaaacaatgcatgacacagctaagaaaaaacaaatagagactactaacatctactggatgtcaagctgccaatgaggtactgtgccggcaggaagaacaattgaacagatggtgcgctgaatccaacctaatgcttgacagaatatcctttacagccaagccggcaaccaagacgctgagtt

SEQ ID NO: 59691 - DNA, 436 bp, Zea mays
  Clone ID: LIB3069-051-Q1-K1-B10
gcgaagacccacctgccaccttcgatggacttcgccggccgggtatccgtcgggctcttcggcctggtcgctggcactgtagcaaacgaccagatcttcaccacttcaggtttgccatttgggcgaagttcgcgtgagccaaggtaccgcgtcgagttccatcctgttgattcgccattccatccagagaatggtcaggaatcggtaccaatggctagtcatgaggggaagcgttataagtgctttctaccagttgaagaaactaaaaccatgaagtcaatgctcccacaaaatgcgactaatattataatagaaagtgaaaggcgaattaagccaaaggagccggatgagttacttgaggttctcaaggatcagtgtttctacaggcacgaaggttggtggtcgtatgaattcttgtattatgggaaaatcagac

SEQ ID NO: 59692 - DNA, 68 bp, Zea mays
  Clone ID: LIB3069-051-Q1-K1-B12
cggacgcgtgggaaaaaaattaaaaaaaatttttaaaaaaaaaaaaaaaaaggggaaaaagagggaag

SEQ ID NO: 59693 - DNA, 447 bp, Zea mays
  Clone ID: LIB3069-051-Q1-K1-B2
gcacaagcgcactctagctatggcttctgatgttgtccgccctagcgacgccgagctactggaggcacaagccgacatatggcggctcagcctctcctacctcacgcccctgtcactgaggtgcgccgtggagcttggcatccccacggcgatctaccgccatggcggggctgcctcagccgctgagctggtcacggcgctgtctctcccctccactaagctgccgttcctccgccgcctgctgcggctcctcgccgcgtcgggcgtgttcaccgtcgacaagcagagcacggaagaagagcggtaccgcatcagccccgtgtcctacctcctggtggacggcatccctcacgaggaccacatgaaccacaccgctctggtgctcacctgcacctcgacgcgctacatcgaggcggggatagggctggcggagtggttcaagaggga

SEQ ID NO: 59694 - DNA, 454 bp, Zea mays
  Clone ID: LIB3069-051-Q1-K1-B5
ggcggttagaataggtttataattttatattatgaaattatgtgcatcttcaggggtttgtgcctcactgctctgtaaggacatataaaattggtatttgtactttctaaggttctccttggaatggtagagttttacagggaaccttccatcatcagttgctgacatagctcgaactcgacgtttcttcttcgccagttgcggctctggataaactcgaagctgacctatccaagttcgacgacgggcccttcttcctaggccaattcagcttggcggatgtagcgtacattacgattctggaaagggttcagatatactattcccatcttaggaactacgacatcgccgaaggcaggcccaacctccaggaattcatcgaggagatgaacaagattgaagcgtatgcgcagaccaagaacgatcctctgttcttgcttgatcttgccaagaa

SEQ ID NO: 59695 - DNA, 447 bp, Zea mays
  Clone ID: LIB3069-051-Q1-K1-B6
tcgcggggaccaagacaccgtcgtggttttgattctcgacggcttcgcgaaggcgcgggtgccgtactacccggtggcgggccgcatcgtggacgcgagccccggggagcctgtggtggagtgcaccgggcatggcgtctggttcgtggaggccgctgctagctgcgcgctcgccgacgttaactacctcgagcgccctctgctcatccccaaggaggagctcctcctgcgccctccgcccgaggagaagctcgaggacctcgtcctcatggcacaagtgaccaagttcgcctgcggcgggttcgcggtcgggatctgcttcagccacctggtgttcgacgggcatggtgcggcgcagttcctcaaggcggccggcgagatggcccggaggctgacggcgccgtcggtcgcgccggtctgggaccgcgacgcgatcccggacccgtc

SEQ ID NO: 59696 - DNA, 468 bp, Zea mays
  Clone ID: LIB3069-051-Q1-K1-B7
catgtatccaagcagatccagcagatggtgcggttcatcttccagtgttgccgacgagaaggccaacgagagctccgtctccgccgaggaggaattcaacattgagaagttgcagcttgttgaagctgagaaaaagaagatcaggcaagagtatgaacgcaaagagaagcaggttgaagtacgcaagaaaattgagtactctatgcagttgaatgcttctcgcatcaaagttcttcaagctcaggatgatctagttaacaaaatgaaagacgatgccatgaaggaacttctccttgtcagccacaaccaccatgaatacaagaaccttttgaaagacctaatcattcagggtttgctccgtttgaaagagccagcagtattgctccgttgccgcaaggatgatcaccatcatgtggaatcagtgctgcattcagcaaagcatgagtatgcatcaaaagcagatgtcca

SEQ ID NO: 59697 - DNA, 449 bp, Zea mays
  Clone ID: LIB3069-051-Q1-K1-B8
gagaagggtgatataacgacaaactacttctttcctatccatcgtgaagcccctgctttcgttgagcaggccactgagcaggaaattcttgttactggaatcaaggtcgtggatcttcttgcaccctaccaaagaggtggaaaaattggtctcttcggtggtgcaggagtgggtaaaactgtgctcattatggagctgatcaacaatgttgctaaggcccatggtggtttctctgggtttgctggtgttggagaacgtacccgtgaagggaatgacctgtacagagaaatgattgaaagtggtgtcattaagctaggtgacaagcagagtgaaagcaagtgtgctcttgtctacgggcagatgaatgagcccccgggtgctcgtgctcgtgttgggttgactggtttgactgttgctgaacatttccgtgatgctgaaggacaagatgt

SEQ ID NO: 59698 - DNA, 417 bp, Zea mays
  Clone ID: LIB3069-051-Q1-K1-B9
cccacgcgtccgggcggcgcgtgcggctactagacggccgtcggaaagaaggcattcgacgggatgatcgccggcgggagcacgccactgtacaggggaggcgagggctgcggcgcctgctacgaggtgaaatgcacgaccaacgccgcgtgctccggccagcccgtgaccatcgtaatcaccgaccagtcccctggcgggctgttccccggcgaggtcgagcactttgacatgagcggcaccgccatgggcgccatggcacggcccggcatggccgacaagctccgcgctggcggcgtgctcaggatcctgtacaggagggtgccgtgcaagtacaccggcgtcaacatcgcgttcaaggtggatcagggcgcgaacccgtactacttcgacgtgctcatcgagttcgaggacgac

SEQ ID NO: 59699 - DNA, 452 bp, Zea mays
  unsure at all n locations
  Clone ID: LIB3069-051-Q1-K1-C1
gcgcgtaatctggtacgaactaatgacaaacagtancgattgacattgaagctaccaagagggcgcacgagtttcatgtaggatgggtcgcggacccgttcttcttcggagactacccggcgacgatgcgggctcgggttggagagaggctgcccaagttcaccgcagacgatgctgcccttgtcaagggggccctggacttcatgggcataaaccactacaccactttctacacgaggcataacgacaccaacatcatcggacggctgctgaacgacactttggcggacaccggaaccatcagcctgcccttcgacaaaaacgggaagcccattggagatcgggctaattcgatatggctgtacatcgtacccagcgggatcaggaagctgatgaactatgtcaaggagcgggacaatatcccaacggtttacatcactgaaaatgggatg

SEQ ID NO: 59700 - DNA, 350 bp, Zea mays
  unsure at all n locations
  Clone ID: LIB3069-051-Q1-K1-C11
tcgattgctgaattcagggtggttgctcgagctttattttgattttggggggtgggtttcagtggcaattcatgacggtgcggccggggtgggtcgtgtgggtggcgcatggctcggcggaattnaagaaaaggctggcttgcaagacagactccctggccagtatacgggtgattaaccaaaacaaatgcacgtccaacacacccaaatacagatttgttgtgcgatttaccaacaaggacatcactggccaaatcatatctgctattatagtgggcgatatgggttttgcttctgcctactcccatgagctggcaccatatggtcttgaagattgtctgaccaactat

SEQ ID NO: 59701 - DNA, 452 bp, Zea mays
  Clone ID: LIB3069-051-Q1-K1-C2
cccacgcgtccgcttcgcttggcctacctattggaattggccccagctctagaagaattgggattgcatgtgaatggcggtggcgtggatgttgggtgggcactcagacggaatatgttaccgtactcacacaataggctcaagagggtccttatttcaggagccactgtatgggaggggctaatggagctggcatactacattcttcggagtgccaatagactcgaaagtatggtcttagatccaaagataaggattgggggtcctcagctggatggttggatgattgatattggtagggagacgatcaaaaatatttttgagggagaggagtttcagagcattattactattctgtaagaatggtaagataggccacaggattttggtggtcacaccaagtggccatgtttgattatgccataagtttgaccagtatggtcataaatgtt

SEQ ID NO: 59702 - DNA, 444 bp, Zea mays
  Clone ID: LIB3069-051-Q1-K1-C3
gtcggcaggtcccgtgctcgactgcctggttaatctgtcggacagcgtgggccacctccgggacgcggcgcaggagatgggcggcgccgggatgggccgcgcggggacgccggcgttcaggtggcacctcagcaacgtgcagacctggtgcagcgccgcgctcaccgacgaggacacctgcctcgacggcctctcgtcccgcgccgtcgacgccggcacgcgcgccgccatccggggcaaggtcgtcgaggtcgcacaggtcaccagcaacgcgctcgcgctcgtcaataaggtcgggcctgggtactaacacggggaggggacccaagatccaggcccaggcccagcccaggtaccacacccgctactagtatagtactaggcgccttcaccttcacggcgttgggtgtttctcgtccgttaatagctcggtttgctttgctt

SEQ ID NO: 59703 - DNA, 446 bp, Zea mays
  Clone ID: LIB3069-051-Q1-K1-C5
ccaagatggcggaggagaaggcgtttgcagttggcggactcggaggagccggggcggcgggcgcggcgcaacagcagcagctggcagcaggggaggccgcggcggcgcgggtgcggcccgtggagacgctgcttcgcgcggcaccgctggggctctgcgtggccgccatgaccgtcatgctccgtaaccagcagagcaacgagtacggcgccgtcgcctactccgacctgggaggcttcaagtacctcgtctacgccaacggcctctgcgctgcctactcgctggtatccgcgttctacactgccgtgccgaggcctgccaccgtgtcgcgctcctggctcgtcttcctcctcgaccaggtgttcacgtacctgatcctggcggcgggcgcagcggcggcggagctgctgtacctcgcctacaacggtgacaaggaagtgacgtgg

SEQ ID NO: 59704 - DNA, 446 bp, Zea mays
  Clone ID: LIB3069-051-Q1-K1-C6
actagttctagatcgcgtctaaacccttgtttccttcttatccccacctccctcgcggagcgactcgccgccgccgccggccgcagccatcgccgtgatgctgtccctgtcgagggcgatcgggaggcggctcttctcgtccgccgaggccgcgtcgacggctgcggtgaggacggcgcagaacccgctcgaggagttcttcgaggtcgagcggagcaccgaggagggcaagcctcctccccactacggtcgcagctggaaggcttctgaactgcgactaaaatcttgggatgaccttcagaaattgtggtatgttcttctaaaggaaaagaacatgctaatgacacagcgtcaaatgctgcattcagagagcatgaggttcccaaatccagaacgaatttccaaggtaaagaaatcaatgtgccggataaagcatgtcttgactg

SEQ ID NO: 59705 - DNA, 449 bp, Zea mays
  Clone ID: LIB3069-051-Q1-K1-C7
cccacgcgtccgatctcacccgactcgtcttacgtcagccagcagttcgaaacgaaggagggatccaggagcttccggaaggcgaggcgcgcgcgcagcgtcgaggtgctggtgccggtgccgcccatggatcgggctcgcggatccgcgttcctgctcggcgtcctgctcgcaggatccttgttcgcgttttcagttgctaaagaggagaccaagaagctcgggaccgtgatcggtatcgatctcggtaccacctactcctgtgtcggtgtctacaagaacggtcatgtcgagatcatcgccaatgaccagggtaaccgtatcacaccctcatgggttgccttcaccgatagcgagaggctcatcggtgaggctgccaagaaccaggcagccgtcaaccctgagaggaccatctttgacgtcaagcgtctcatcggaagaaagttcgc

SEQ ID NO: 59706 - DNA, 456 bp, Zea mays
  unsure at all n locations
  Clone ID: LIB3069-051-Q1-K1-B1
cggacgcgtgggcggactcgtgggatagccttcaatctaacaaagccaccgcttaggctgagttcgctgatggcatggcccgggtgagcaaggcagcaaatggcagcagtttgctggccaattgttccttttagccttggcacctgttatttttaaatctttatgaattttgtctctttattttgcccaaaatacccttttcatatttcggactcatagaacttcaaatgtctcagtgctgcacatattatggagctgcaggacttcaattgtcttgtagcctagtttcagttaaaacatggtaatttggatatttcgtcatgattacatcggtatttatgttggtgtcgggcaattacatatattttgtgtttaaaagttagccctgggaatagtgaaatcctggctatgccaccggtatagtttggacatangcaacaacatattgtctcatat

SEQ ID NO: 59707 - DNA, 171 bp, Zea mays
  Clone ID: LIB3069-050-Q1-K1-H5
cccacgcgttcggagtcctgctttttcgccttctttccctgcaccatctcctagagcattggtggcttcatttaaggaccgatgtgtggcatcaaaccctccgctattcatccgcttgtacatgtcatgcaagcttgcttgctgggactgatgcgcgacacctccctttaa

SEQ ID NO: 59708 - DNA, 449 bp, Zea mays
  Clone ID: LIB3069-050-Q1-K1-H6
cccacgcgtccgcccacgcgttcgggtggtttgacggtgctggcatcgccaattcaactccgcatctgcatcggcagcgcgccagctccatagtgtaggaggagatggcgctcacaagaatcggtcttgctggccttgcggtcatggggcagaaccttgccctcaacattgcagagaaagggttccccatctctgtgtacaacaggacaaccttcaaggtggacgagaccgtgcagcgtgccaaggcagaaggaaaccttcccgtctacggcttccatgaccccgcgtcctttgtgaagtccattcagaagccacgggtggtgatcatgctcgtcaaggccggcgcgccagttgaccagaccatcgcgacgctcgcagctcacttggagcagggcgactgcatcatcgatagggggaacgagtggtacgagaacacggagaggagggag

SEQ ID NO: 59709 - DNA, 460 bp, Zea mays
  Clone ID: LIB3069-050-Q1-K1-H7
cggacgcgtgggcggacgcgtgggcggacgtttgggcggacgcgtgggcggacgcgtgggcggacgcgtgggagagaaggaaaaatatccccaaaccctagctcccgatctcgatggcgaaccctcgcgtcttcttcgacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagttccccgacgagaagttcgtgcgcaagcacaccgtccccggtgtgctctccatggccaacgccgggcccaacaccaacgg

SEQ ID NO: 59710 - DNA, 498 bp, Zea mays
  unsure at all n locations
  Clone ID: LIB3069-050-Q1-K1-H8
cggtcttgaattaccacgcgtccgaccacgcgtgcgccgtcgacggcttcccgaatcggggccttcaccatctccaactgcaaccccaccccatgccgccgtcgactgcgctagggttttggagtgaggatcgccgatgtcgacggctcccaggcgccccttccgaggccgcggcgccccgccccctggcaccggctacgtccgccgcggccccgcccctgccccaggccccgccgacggcgccaagaccctgcgcaagcccgtcttcaccaccgtcgaccagctgcgcccccagacgcacggccacaccctcaccgtccgcgtcatcntccgccgcaccgtcctcgacaagcccttcacgcacatcggccgcacccgcgtcgcaaagtgcctcgtcngagacagcaccggcaccgttctcgtcaccgtccgcaacgaacaggttgaccttctgaagccagataccacagtgatcttccgcaacgctaagaatgacat

SEQ ID NO: 59711 - DNA, 339 bp, Zea mays
  Clone ID: LIB3069-050-Q1-K1-H9
accacgcgtccgccttcccttccctttcttttcccaggctcccactctcacccggtggcggctacctacacaaacgggacacgaactaacagccacctatcacgtaccccaccctctgggtcatgtactgctgctccccatgtcgcctccactcgagctcgactacatagagcctctcgccgccggcggcagccgtcgccgctgaaaacgacgaactgaagggtactgagctccgactcgggctgccagggtccgggtcgccggaccgccgtgtcgcggctgtcaccgcgaccaccctggacctggtaccgccaaaggcgccaagcgcgggttttctga

SEQ ID NO: 59712 - DNA, 197 bp, Zea mays
  Clone ID: LIB3069-051-Q1-K1-A1
tctttctaactgctttgtttaactttaaaatcttattatttactcaacaaacagcaacaggcaccggtctctcctgctccagtggcttgcagatcaatatcaatccctgcctgccttggcaccaccaccaccaaccagcagcacgagcatgacacattggctggcttcagtctaaaaaaaacccccagatgccatgg

SEQ ID NO: 59713 - DNA, 463 bp, Zea mays
  unsure at all n locations
  Clone ID: LIB3069-051-Q1-K1-A10
ccgggccgagcacgcgtncgggacgcgtgggagagaggttttatcgcaatttgaaattatttgctgatcgagacagcatcggtttagaattgagacagttaaagagaaaaagagaagatgaggagttgcatgtggagcgtaaaaaggcacagttggttgataccaagaaaatttctattgacaatagtcatgcagctgctgtggatacctctgagctagtagttgaaatgatgcaagtgaaggaagacattgagaaccaagaattagttgtgcagaaaattaatttgaaacttacagatgctttgcaagaagagaataatagaagagcgtcttacaaggacttcattgagtctgtacatgctgaaatggggtctattagcgatgctgagcgtgaattgcagcttgttgaagaaaaaatacatgatgctgagcaagagaaggctcactatgaacgtgttatgga

SEQ ID NO: 59714 - DNA, 439 bp, Zea mays
  unsure at all n locations
  Clone ID: LIB3069-051-Q1-K1-A11
cccggctccagcattnccactctcgcgcggttgtcgccggagcgagcacaggggcncaaaggcccgtctgatcggccgccgccaagatcaatgacgccgatgtagccaagcagatccagcagatggtgcggatcatccgccaggaggccgacgagaaggccaacgagatctccgtctccgccgaggaggaattcaacattgagaagctgcagcttgttgaagctgagaaaaagaagattagacaagagtatgaacgcaaagagaagcaggttgaagtacggaagaaaattgagtactctatgcagttgaatgcttctcgcatcaaagttcttcaagctcaggatgatctagtaaacaaaatgaaagacgatgcgatgaaggaacttcttcttgtcagccacaaccaccatgaatacaagaacctttttgaagatctaat

SEQ ID NO: 59715 - DNA, 448 bp, Zea mays
  Clone ID: LIB3069-051-Q1-K1-A2
gaagaagaggtcggatccaggtgacatgggttctgcatctgcaagtacctcttcaataccggacaagggacctgaaaaggctaaatcaggcgcagataagaaaaataggccaaaagatgtttttggtcggccattggcaacagaacaagaatttgaagttctcaagaatgctccaaggttagacacaggtgctcctgcaagggtcaaaccatttggagttgaagttcgtaatgttagatgtttaaggtgtggaaactatggtcaccaaagtggtgaccgggaatgtcccttgaaggatgcaatcatgcctaacgaggagagtctgttgaaaagagacgatccacttacaactataatggcgcatacggattcaagtgagcctttgaagtgggaacttaagcagaaaccatgcatgagccctcctcgtggtggatttgacccagatgat

SEQ ID NO: 59716 - DNA, 362 bp, Zea mays
  Clone ID: LIB3069-051-Q1-K1-A3
cccacgcgtccgctagttctagatcgcgagtggccgttctttttttttttttttttttcttgttttgggtttttttttttagcttcgggagggcctgcacattttgctgcacaatatgaaaataaatcttccaggatcttgatcgagttagatgaccagaaagtagcatggacaatttggaaaaaaatccaattggaatctaccgttcttgattcattaattttaaccttgcctaacgcatttcagtctactatattggtacttgacgtttcgatttatgtgcactctttgatcattctgtaattcttgtaacatggtattttattgccatctgaaatggtccacaaccagcaaatatagtt

SEQ ID NO: 59717 - DNA, 385 bp, Zea mays
  Clone ID: LIB3069-051-Q1-K1-A4
accagccggtcggacttcttgcgctccaagttctcggcgaggatggaaatgttttttgggagctttgtcagtgaatcagtatcaccgcagaaccttttcggacacccggatgttgagagatgcccattcctgaggaatatcaatggagctacaaccttttccctcgcttctgctttgccagtagctgctcaaggaggcaagggtccaatttttgaggaagggtcaggctttgagtcagcattcaagcttttccatggccgagatggaatagttcccctttcagaaagatcatatgtatctgatgaaaaccacaatgagagcattgatgtcaggactgaacctgctctgccgtttaatccattggctgctagagcaagcacaataa

SEQ ID NO: 59718 - DNA, 455 bp, Zea mays
  Clone ID: LIB3069-051-Q1-K1-A5
aacaccagccgtcgtcatgtcgattcgaggtttgggaggttcggctgggaacaggttccgggtggcactgggtctaccggtggcggccacggtgaactgcgcggacaacacgggcgccaagaacctctacatcatctacgacaagggcatcaagggccgcctcaacctgatcccgtgcgcctgtgtccgcgacatggtcatggccaccgtcaagaatggaaagcccgacctcaagaagaaagtgatgcccgtcgtcatcgttcgccagcgcaagccgtggcgtctcaaggacggtgtctacatgtacttcgaagataatgctggagtgattgtgaatcccaagggtgagatgaaaggttctgcaatcactggacctatcggcaaggactgtgctgacctttggtctacgatcgtcagtgcatcaaatgccatcgcttgagagcttgatggaatgt

SEQ ID NO: 59719 - DNA, 444 bp, Zea mays
  Clone ID: LIB3069-051-Q1-K1-A6
cccacgcgtccgcccacgcgtccgtccacgtttccggttccgcttcctgtccgtcggaaaggttcatcgcttcctaaaacacctccatgtgttggatcaaagagaatttccgagaacagtgttgctagaagattctcgaccgggactctatctacgatgaaatctcatagcaatgcacctgcaaaatcaaacggtttatctaggactggtgtacaaagaaaacttcacttggatcgtcagccaccgcagaagagtacaaaaccgaccgagaacagcaataagctagctacaaatcgggtcccagcccggaacagcccatggaatcctgtacttaggcattcacgcagcttgcctgaaactggtcgacgagcagtacagaaggtctcatcaatcacagagaaactgtcgcaaatgtcggtgacctccagaacacgaagcgccgtg

SEQ ID NO: 59720 - DNA, 453 bp, Zea mays
  unsure at all n locations
  Clone ID: LIB3069-051-Q1-K1-A7
gactagttctaggtcaagagcagttcagcttccaaacaagctctcctttcgctggcgatccatggagctcgacggcgacaacctgagcgccaccgagctccgcctcggcctgcctgggaccagcagcagcagcagcgacgactggcagaagaagccgtcgccctccgtcggggccaagcgcgctctggacgacggcaccaagagcgaggcctcggggaccagcccggccgncagagacctcgacttcgaccacgaccacgacaccgtcgcgccttccaaggcgcaagtggtcgggtggccgccggtgaaggcgtacaggaagaacaccttccaggcggcggcggcggccaagaaggtcgagcagaagcagaagcagcagcagcagggaggcctgtacgtgaaggtgagcatggacggcgcgccgtacctcaggaaggtggacctncggatgta

SEQ ID NO: 59721 - DNA, 465 bp, Zea mays
  Clone ID: LIB3069-051-Q1-K1-A8
cccggccgacccacgcgtacgccacgcgtccgttttggtgcccttatgggttcattggatggaggcctggatatgcctcagagcgagaagaggttggctggattcaagaaggacgacaagcagttggatgctgatacccaccgcaggtacatctatggtggccatgttgctgactacatgaagaaccttgctgaagaggacccagaaaagtaccagagtcacttcagtgcgtacattaagaagggagttgaggctgatgaaatagaagcgctgtacaagaaggtccatgctgccatccgtgccgatccttacattgttaagtcaaccaagcagccaccaaaggagcataagaggtacaaccccaagaagctgacatatgaacagaagaaggccagcctcattgaaaggctcaaccaactcaactgcttcggtggtgctgatgacgacgatgaagacgacgaagta

SEQ ID NO: 59722 - DNA, 343 bp, Zea mays
  Clone ID: LIB3069-050-Q1-K1-H4
caatgggccctctgaaggagatcgtcggcagcatacagtcacaggttgccaagatcgaggatgacatgaaggttcgagcatcagaatataataatgtaaggagccagcttagtgcgatcaacaggaagcaaagtgggagcttagcggttcgtgatctttccaatctggtaaaaccggaggatatgatcacctcggaacatctcgtgacacttcttgcaattgttcccaagtactcccaaaaagactggttgtcaagctatgagaaaattgacacattcgtggtacctaggtcctctaaaaagctctatgaagacaatgaatatgctctctacactgtaacact

SEQ ID NO: 59723 - DNA, 303 bp, Zea mays
  Clone ID: LIB3069-050-Q1-K1-G1
cgtcgcacgctgcgattctttctgaaattcttaccattcttatactatcctacacggcatttgggctcgttgctggatgtcggacgctgctatctgcctgccgctcactccacgccccaatgtgccactcccactcgggccgtcccaccaccgggaggcgctaggctactatgtctctgccctagcctagtcgccgtcgcgtcgtcgcagcaccgagcgaatgcgagcccaacatcacagcgctcatgtcaagggcgcgagcaaggctttctcgtcgctgctggacaagttctacgacgcgct

SEQ ID NO: 59724 - DNA, 420 bp, Zea mays
  Clone ID: LIB3069-050-Q1-K1-G10
cttgcccgccccctcctatggggaattcttcggagctgtaccacaagatcctcagcaggcccaaggacacctcgccggacgaaatccgcgccgcgtacaagaacctcgtcaagaagtggcaccccgacaagcacccgccgtcgtccaggccggaggccgaggcgcgcttcaaggccatcagcgaggcctacgaggcgctcctggaccagcaggagaacaggggcgtgttcgagctgtgcaacgacggccgggcgggtgagaggacgcgcggcgccttcggcggcgccggcggcggcggtggcggaggaggaggaggcctcggcgccggcgtcggggcgcgcatggagaggacgcgcagcgacgggttctgcacgaggagcgcgcccggcacgccggcgagggagttcaagaaggtgtaca

SEQ ID NO: 59725 - DNA, 406 bp, Zea mays
  Clone ID: LIB3069-050-Q1-K1-G11
cccacgcgtccggaagaacacagggcacttgcactacacgcacggcacgcagatacatagagagagaggttagctatagcttgcacatctatttaactaactaactaactggctagctagctcgatccgcagagcaaagcgaaagcagcaagaagcaaagcaatggagaaccctgcgagtgtgctagttctaccagcgcagttcaccaaactcaccttcggaaacctgtacatccgccgggccgggccgggcagcatggagataaccgaggagggcaggtgcgacctggacaggagatacgtgagtaacttccccgtctacgacggccgcggccccgacgccagccttgtggcccgcgtgcaagggatcaccagccgaaatcggaacgcgcaccaactgttcgtcg

SEQ ID NO: 59726 - DNA, 407 bp, Zea mays
  Clone ID: LIB3069-050-Q1-K1-G12
cccacgcgtccgctttttcttttttttttttaaaccgaacaccataattcattttgaggtttttacccgctgccagctaccaaccaatgcatgtacgtgtgttgcccttgtggctgaccgcggtgccactcgtttgccagccaccgagtcatcggcaaatgaactggcggggtaccgagccaagcaggaaggccagtacgacacacgcagaagaagaacacggcgggccatgcacgccaaaaacattgaagtcttcagtttaccaacacacatgtcatgaagcaaaacagcggggactcgtccatgatatacaggttcctggtacagatgcagagtggccatgggacggagagtcggatagacaggacaccggtgtgttacgctagggctggctggctgacgacgtg

SEQ ID NO: 59727 - DNA, 442 bp, Zea mays
  Clone ID: LIB3069-050-Q1-K1-G2
gcaagccatgtggaggagggctttagcgattttcctgtttatggctggcgccgcgctgctcgccggggctgccggcgccggcgcgcagcagggcgtgtggagcatcatcacccggcccatgttccagagcatgctgagccaccgcggcgacagcgggtgccagggcgccttctacacctacgacgccttcatcgaggccgccagcaagttccccggcttcggcaccaccggcgacgagcagacgcgcaggcgggagctcgccgccttcttcggccagacgtcccacgaaaccaccggtggatgggcgactgctccggatggaccgtttgcctggggatactgccgggtgaaggaacagaaacagacggacccaccctactatggacgaagacccatacagctaactcataagtacaactacaggctcgccgggcaagcgctg

SEQ ID NO: 59728 - DNA, 467 bp, Zea mays
  Clone ID: LIB3069-050-Q1-K1-G4
gcgccacgcgtgcgcgcacgcgtccgctctccttccgtcgctttggcgagcgataaccgcgcgtggctcctccccttcgccgccgccgtccttgtggtgctcctcgctggcggcgccgcggcggacgatgcctccagcgacgacgacgctgggacttcacggacacccggctgctccaacaagttccagctggtcaaggtgaagaattgggtgaatgggactgaaggtacaacttttgttggcctaagtgcaaaatttggagctcccttgccaagagatattcatgaagcaaaaaagtcatttgctgtcctctcaaattcaattgactgttgctccaacttgacatcaaagttaacaagttcagttgctatagcaacacgtggggaatgtgctttcacggaaaaagcaaatattgctcaagccagtggttcgaccggtttactagttatcaaagataatgaagagct

SEQ ID NO: 59729 - DNA, 461 bp, Zea mays
  Clone ID: LIB3069-050-Q1-K1-G6
cccacgcgtccgcccacgcgttcgataatcttttcttcacctcactaacaccagctagcaggtctttctctcctgcaataatggccgctcgctcctcctcctcccagccgcagctggtcgcggcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaggccacctgcaactgcctcaagagcatgacgggccggctcggcggcggcgtcagcatggccaacgccgtcaacatccccggcaagtgcggcgtcttcgtcggcgtgcccatcagccccaccgtcgactgcaccaag

SEQ ID NO: 59730 - DNA, 460 bp, Zea mays
  Clone ID: LIB3069-050-Q1-K1-G7
cgaataatctcttcttcacctcactaacactttctagcaactctttctctcctgcaataatggccgctcgctcctcctcctcccagccgcagctggtcgcggcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaggccacctgcaactgcctcaagagcatgacgggccggctcggcggcggcgtcagcatggccaacgccgtcaacatccccggcaagtgcggcgtctccgtcggcgtgcccatcagccccaccgtcgactgcaccaagatcaactgatcgatggaacc

SEQ ID NO: 59731 - DNA, 440 bp, Zea mays
  Clone ID: LIB3069-050-Q1-K1-G9
gttgctatggtcttgggctacgatgatgttaaaaatgcccaactactcaaatgcgaccgtgctggtcacttctttggacataaggcaactagtgccgggctcaaggagcaggaagcaataaattttctggagaagaaaatgaaggatgacccgaaattcacctatgacgaaactgtgcagattgcaatatctgcgttgcaatcagttctccaggaagatttcaaggccactgagatcgaagttggtgttgtgagaaaagatgaccgcgttttcagagctctcacgacagaggagatcgatcagcacctgacggcaattagtgaacgtgactgagatgtcatatgctgcacatttcagcgctgcatacactgcgccgtgccattgtgcttcggcagtcaattaagtttcatagtcatcataggaactgagtgtaccatttc

SEQ ID NO: 59732 - DNA, 287 bp, Zea mays
  Clone ID: LIB3069-050-Q1-K1-H1
agcctgataacttatgggttatggctcatccgataatcagggttgtgatgcagaacataaccgatgataccgcccagaacagcaagaacagacctgtccacagcagcaacgactacctgatcgacaggacttacaccgacactgctggtatgtctatcatgtacgttaccgatctcttcaactcgtaagacttcgagcacgacaagttcaatgacttgctccacgataagaacggtatcacaatatacgcgaccatggtatacaaccagagatgcattataaagtaa

SEQ ID NO: 59733 - DNA, 411 bp, Zea mays
  unsure at all n locations
  Clone ID: LIB3069-050-Q1-K1-H10
caatcacggaagggcttcaatctcgggatggcaacnttcttttgtcatgtagagagaagcacttcatgccatcataagaaacgcgaagagctgatgatgctagttgtgtcagactagggacaatgtttgctaaatactgggtctagttcagtcaagccacaggaacctgatccnaaatgctttccaagtcctcctgtttcggcctgcgaacttctgaaacatctnggacattcaattggggagctttcttatggctcagcnaggctgcatatncctgcatatcgaaacttatgactatcagccattcaaatgccacaagcctgctgctcaaacagctgcctatggcgcttatccttcaacatactctggtcaggcctatacacaacaaagctacacacaacctgcaacaat

SEQ ID NO: 59734 - DNA, 309 bp, Zea mays
  Clone ID: LIB3069-050-Q1-K1-H11
accacgcgtccgacccactctactactcttagttactaccagcagcttgcttcaacaggggaagagagcgagccgaggatggcgtcaccgaagccctcgtcggcggccctgctcctactggcggcggcggccgtgctggcgctggcgcgcgcggacctgacgcacgacaactgcgtgaagaacacgaaggtgacggtgcagaacctgtgcagccacgacgtgacgctgacgctggagccgatggccaacagcccgtcgctgttcgcgggcacctacacgttgcacccgcgcagacacgccgagttcccc

SEQ ID NO: 59735 - DNA, 289 bp, Zea mays
  Clone ID: LIB3069-050-Q1-K1-H12
cccacgcgtccgcccacgcgtccgttcactcgtccgcccacgcgtccggcaacccaccgtgtcgtccgcgtcctccacgccctcgtcgtcctcctccacaccgcgcgcgcggcggtgttgacccacccacccgttcctcccccaccccatcagcgctggaggcggcggtgcgtaagtcccccggacccttcggcggcggcggcggcgcgcgggtatgccgagaggcttccaggtttcatcaccgggctctgctggagttatagcattttcaggcaggatatggagtaca

SEQ ID NO: 59736 - DNA, 124 bp, Zea mays
  Clone ID: LIB3069-050-Q1-K1-H3
tcgcggaaaggctgttttgcggtgtgatccggtgtcgttctttttgttgctgagaactgctttgggttggtgtatcagcttttgatgccgggtaaaacgcctgtgagctgtgatgtgatgcttc

SEQ ID NO: 59737 - DNA, 459 bp, Zea mays
  Clone ID: LIB3069-050-Q1-K1-F8
cggacgcgtggggcgtacgcgttccgaacgttcgtgggtcctgcagcctccgtctccacctagggttctggcgatggcgcacggcggctacccacgccgcggcgccgccgtacgcaggcccaagtcctcggcctctgccgcagttgccgaccgcaagcggaagcggaccgccgtcgtcgccaagaccacctcccttaagaaccagatccgctccaccgagcgcttcctccgcaaggaccttccggatgagattagggttgctcaagagaagaaactggaagaactgaagaggcaacaagagcttcagaatcaacttgctgtccagcggacattacagtttagagatagaaagataaaattctttgagagacggaagattgagaggatgataaggcgactcgagaagcaacaacgttcaaatggggatggtgtcaacaataatctgtcaaaattgcgaga

SEQ ID NO: 59738 - DNA, 413 bp, Zea mays
  Clone ID: LIB3069-028-Q1-K1-C11
aaaagatctggcatcacatccttctacaatgtatcttcgtgtcgcaccagaaaagcacccagttcgttttacaaaagcccctgttaacccgaaggctaacagggaaaagatgacacaaatcatgtttgaaaccttcagtgttcctgctatgtatggtgctattcaagctgtgctttccctatatgctagtggccgtaccactggcatcgtcctggattctggagaatggtgtcagtcacactgtcccaatctatgaaagctacgcccttccacatgccattcttcgtctcgatcttgctggcagggacctcactgattccctcatgaagatcctcaccgagaggggctactcttttacaaacactgccgagcgggaaaattgtccgtgacatcaatgaaaagcttgcatatgt

SEQ ID NO: 59739 - DNA, 156 bp, Zea mays
  Clone ID: LIB3069-028-Q1-K1-C2
acgatttctttgggcgatgacactaggcctgtgataatgatgtgtccatttgttcgatgcgtggcctctgaacctcggaaccggttgatagttgttgttttcctagctgtgtcgggtcgggtgcagcatgctctaattgttgattacctcaagaat

SEQ ID NO: 59740 - DNA, 273 bp, Zea mays
  Clone ID: LIB3069-028-Q1-K1-C3
ctgatccatccatctccatccccatcccgttactctcgtgcacgccgccgcttcaagtcctggcgagccgcatcgcatcgcatgcgtgtgctgtccgaccgccatcttcgcagccggctggcctagctacctcaccttaccttacgcaggcacactgcacacacacccatggtggtggcggcgatgcggcggccgtgcgctgtgccagcgctgctggtggcggcggcgacagcgacgctagtgcttctgctgctgctgtcaccgtcgagcgcg

SEQ ID NO: 59741 - DNA, 442 bp, Zea mays
  Clone ID: LIB3069-028-Q1-K1-C4
agcacacttatgttgaaactgaaaatgtgttttatgtttatcaacctattgaaggattagatgttctacttatcacaaacaagcagagcaatattcttgaagatctggacacattgaggctcctctccaagcttgtgcctgaatactccccttccttggatgaggacggtatttgtaaaacagcatttgagattatatttgctttcgatgaagccatctctcttgggaacaaggaaaatgtgacagtgcaacaagttaaacaatattgtgagatggagagccatgaagagaaggcacacaagctgatgatgcaagccaaaatcaacgaaaccaaggatctcatgaagaagagggctaatgaacttgacaaaatgaggatggaaagaggcaagcttgacaaaggaggatactcatcaatatctggtccacgcgtgattgaaaa

SEQ ID NO: 59742 - DNA, 412 bp, Zea mays
  Clone ID: LIB3069-028-Q1-K1-C6
cccacgcgtccggcaaaggtcattggtgattttcaggcactgatagcttttccactgtggccgtgcctgatcctttctatgttgtatatgttctggttttctgctacactccatctcttcagctctggtcaagttgtccgaaatgattgcaatactgattgttgttcatatgatctgaagctgggaaaagtaaattgtgacaactgctgtgggtacagcatccattacacccctcatatcagcattgccattctatttcacttatttggttgctactgggcgactcaattcattctcgcatgctcttcaactgtggttgcgggatcagttgcttcatactactgggcccctggtgaaatatcacatgatataccatttctcactgtagtctcttcactgaagcgactgatgc

SEQ ID NO: 59743 - DNA, 436 bp, Zea mays
  Clone ID: LIB3069-028-Q1-K1-C7
gggcaagcttactagggactttggttttgttattgatttgataagcatgttgatggcggtgggtcattactcgatgatcgtttggcttcgtggtatggcgtttcatctggttgatgcagttctcttatggaacttgcgtgctcttatagtttcctttttgaagaggattaaaacttacatcaaattacggaaggcacttagttcactcgacggagcacttccagatgctacttatgatgaaatttgtgcatatgatgatgagtgtgccatctgcaggggaccgatgggtcgagctaaaaagttgtcctgcaaccatctatttcatctagcttgtttacgatcatggttggatcaaggattaatggaaggttactcctgcccaacttgtcggagaccgctcgtattgtcatctgaagggcaaacaaggtctccgatt

SEQ ID NO: 59744 - DNA, 427 bp, Zea mays
  Clone ID: LIB3069-028-Q1-K1-C8
attcccggtcgaccacgcgtcgaccgtcgtcgcgcccgccgtcagatctagctatctggcaccactgcgttgcgcgagtgcacaataaccatgtgatccggatgattcacggtgctcttttgtagcccattgtatccctctaccgggtgaccggagctagactaacaagtcttcggcgccaccggttgccgatttgggttggcggtacaaggagccaccgtgctaacctcagtttgtatgcttgctttttcttgttcgcacttcgtgtcttcagctttccttcattttgttcttgtccactcggttttcgtatggatctttgattgtctgaggctctggatctatgaactaggagaaatgcgataatatattgcaaatgatttagagtttcaggcttaatcgcgagcttggtatatgattaatttat

SEQ ID NO: 59745 - DNA, 440 bp, Zea mays
  Clone ID: LIB3069-028-Q1-K1-C9
agaatgttctcttggatggcagcccagcttcacttcttaagatctgcgattttggctatgccgagtcatcagtgttgcattcaagacccaaatcagcagtaggaacgccagcatatattgcacctgaggtgctatcccgtcgcgagtatgatggaaagcttgcagacgtatggtcctgtggggtgactctttacgtcatgcttgtgggagcatacccatttgaagacccagatgaccccaagaatatacgcaagaccattcagcaaataatgcaagtgcaatacaagataccagatcatgtccacatatctacggaatgccagcaacttattgcccgtatctttgttgccaatccaatgaggagaatcacaatgaaggaaataaagagccatccatggtttttgaagaacctaccacgggaactcacggagactgcacaa

SEQ ID NO: 59746 - DNA, 435 bp, Zea mays
  Clone ID: LIB3069-028-Q1-K1-D1
ctccgctagccgccgccgccgctcgtctttttgttaggtgccgggaccgaggatttgggcgagttctaggtagagaatcggttttacttgtctcagcccggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttctatgatgtatgaagctccccttggctacagcattgaggacgttcgacctgccggaagcgtgaaaaaattccagtctggtgcttactccaactgcgcgaaagaaccattctgatattccttttggcttcctcaatctagtagtttaagatttcttttctgacactttgattc

SEQ ID NO: 59747 - DNA, 418 bp, Zea mays
  Clone ID: LIB3069-028-Q1-K1-D10
cggacgcgtgggcggactcgtgggcggattctttggtggccacctgcgttggcttccaggaggcatccgtcagacaccgtggccgcggctgcgcgacacagcctcacgcccagatcgagcgggcgagcccaagctcccatccggcgatccccgactccccgtcgtccgtccgcccgaggcccgagctcgtcgcgccgctggacggaccacggacgggcgagctcggtcagctccctgctcaccgcgccgccgctggacggaccacggacgggcgccgctcggtcacctcgctccctgctcaccgcgccgcgtccgtccgagctctcaccggtcaccgcgctccctgctcccaggtgccagccaccgagccgggcagctgaccgtaccgcgccgtcgtcagaccgagcgccgtccgagc

SEQ ID NO: 59748 - DNA, 427 bp, Zea mays
  Clone ID: LIB3069-028-Q1-K1-D11
ctttcttgcgtttgggtgaagccgtcactttcttcgggcacttccccttgacagccgaggcagtgaagaatgttctcaccggtcatgcctcaaaggatgtgctaatgagcatcgtccatgcgatgctgggttggcttattgctgcaccaattgtactggtcgtgctgtacgccgtttcgttcccttgtttcaaggtcctggtcaacaggtttggtggtattccttcgagccccaggaccccaatcaaagcggtgtagccagtgcctggccggatcctctgcagttacatccgtggacatagctgcagatgtgtcgctgacatccggggccggccgtggcgtggccccaaacgtcagtgactcgacgtaattgcagaggaaacggtttcagccagtgaggcatgctgaatgcccctggaattgtgtgc

SEQ ID NO: 59749 - DNA, 439 bp, Zea mays
  Clone ID: LIB3069-028-Q1-K1-D12
aaacgctcacaaaaaccctcgctccccacattccttcgccgcccacgccgccgcctgtacgagcggcgtcaagatgagtcggcaccctgaagtgaagtgggctcagaggatcgacaaggtttacatcactgtacagttacctgatgccaaggacgctaaggtcaatttggaaccagatggtgtcttcacattctctggcagtgttggtacaaacttatatgaattgaaactagatctgaatgacaaagtaaacgttgaggctagcaaaataagtgtgggtgtcaggtccatattctgtattgtagaaaaagctgaggccaaatggtggaagaaacttgttcgagatgatcaaagggcacctcactttgtgaaaagtgattgggacaaatgggttgacgaagatgatgatggtgctgatgtcaacttgggatggatggac

SEQ ID NO: 59750 - DNA, 334 bp, Zea mays
  unsure at all n locations
  Clone ID: LIB3069-028-Q1-K1-D3
gcgcaaggccgatccgagggtggactgtgttggtgccggccatggtgatgatgatgcggtggtgcctcggcggtggcctgctgccggtggcggtcatgctctgcctcaacgtggtggcggcggtcatggtatcgctcgtcaaggtggccatggacggcggcatgaaaccgctcgtgatcgtcaccctgcagcagctcaccgncgccgtcttcctcgcgccaatcgcattcttcaaggagaggaagtcgaggccaaagctgacgctggagatcttcgcctacatcttcgtcagtgcggcgctcggggcagctcttcgtcagtacatgatcttcgt

SEQ ID NO: 59751 - DNA, 429 bp, Zea mays
  unsure at all n locations
  Clone ID: LIB3069-028-Q1-K1-D4
cccacgcgtccgcggacgcgtgggttcctctctcaccaagccaacagccaaatccaatgcggggctactctctttattcgtgccgctcgccgccgccgccaccgcctgagggcaagaagcgagcgagcgcaccgcggatctccctcccggccccgccgcgcgcaccggtgaagacgacgagcccctcgtgaatggtgggagcccgcgcgacgtccgtcgcctcgcagccgcagccggaggaggcctccttccgcggcttcggttactgcatgcagggctggtaccaccgctgcatcggtctcgacccctgaaccccgccgncacttgcttctttgatttgatttcattcggttcgttcggtgcccctcccgtcctggatctgttgcgcgagagcgcggcagcgcgcgagattcgcccccttctcttctc

SEQ ID NO: 59752 - DNA, 441 bp, Zea mays
  Clone ID: LIB3069-028-Q1-K1-D5
acaccatctatgcagtttccatcacaatttttatagtgcttggatttatgctcattgcggggatctggcaatacgatttctctcccttcatggttcttatcattgccattctcaatgacggtactatcatgaccatctctaaggatagagttaagccatctccgttgcccgacagttggaagctgaaggagatctttgctacgggcatcgtgcttggaagctaccttgctctgatgactgtcattttcttctgggctatgcacaagaccgatttcttctcggacaaattcggtgtgaggtcgatcaaggacagcgagcatgagatgatgtccgccctgtaccttcaagtgagtatcgtgagccaggctctgatcttcgtcacccgttcccgtaacttgtccttcgtggagcgccctggtctgctccttgtcaccgcgttcc

SEQ ID NO: 59753 - DNA, 319 bp, Zea mays
  Clone ID: LIB3069-028-Q1-K1-C10
gcgtccgaccacgcgtccgcatctttcttctttggctacatttccaacatctgctatacattctactgcaagttattataaatacatgccggacccaaaacagcattatgaacgcccacatacattgcacccaaggtgctatcacctcccgactatgatacaaagcttccatacaaatgaccctgtcttgagactcttcacatcatgcttataacatcatacccattttaatacccagctaaccccactaatatacacatcaccattcaccaaataatgcaagagcaatacaagataccacaacatgtgcacatatcta

SEQ ID NO: 59754 - DNA, 376 bp, Zea mays
  Clone ID: LIB3069-028-Q1-K1-A4
gctgtgcatccacttctcggtggagttccttgactcgctgagcccggagcagtgcaaggccctggatgctgtgctcccgcccaagccggtgtcgcagtacaccgacatggagctggacgagtgcgaggagacgatgccctatgacgtgaacatcgaagcggagatgcggaggcggcagcagcagcaccaggaggcctacgacgaggatgaggacatgccgggcggcgcgcagagggtgcagtgcgcccagcagtaggcagcagcttggtagcagtgataaaatattcgacggcggcggaaaaatttgtgcgactactgttaggtccaaccgtccaagtttacacgcgcgtattaatgtgatgaccatacttctctt

SEQ ID NO: 59755 - DNA, 435 bp, Zea mays
  unsure at all n locations
  Clone ID: LIB3069-028-Q1-K1-A6
tggtattcctagagaaagcttcagggtcattgtgaatgcccaggaacttggttttgaatgcactgaaactccaagaactgatagatcaattctaaggaacttggagcttggtctggcagcactaggtggcgaaaaaggagcagcgtatgaccgaatcgttcttaacgcggctatggctgaccacttactaggctgcagcggagctgaggatatcgacgctgcacttgaccgggcgagggaagccattggtagcggtgaagctctgagaaggctcatgagttacataaagatctcgcacaaagtgtcctagtgttgacccgtgagtctgtgaccatgtactgactgtacaattttggcgtgagtcacgactggatatcttcttcgcgttgtctgagtgcctttcccactcaatgttacanagccaccatgaaaaag

SEQ ID NO: 59756 - DNA, 404 bp, Zea mays
  Clone ID: LIB3069-028-Q1-K1-A7
cccacgcgtccgctcaccacctctcctcttagcttctccccacctttggtcaggcgggctgaggcaaagggggcggccaacaaggacgagcgatggcgaccaaggtcatctgcttccttgtgctcgcatccctgctcctcgccgtcgcctttcccgtgtctgctctgcggcagcaggtgaagaaaggcggcggcggaagcggaagcggaagcagtgttagcggaagcggaagcggcaacctgaatccctgggagtgctcgcccaagtgcgggtcgcggtgctccaagacgcagtacaagaaggcctgcctcaccttatgtaacaagtgctgcgccaagtgcctctgcgtgccaccggggttctacggcaacaagggcgcctgcccctgctacaacaactggaaa

SEQ ID NO: 59757 - DNA, 325 bp, Zea mays
  Clone ID: LIB3069-028-Q1-K1-A8
cggacgcgtggggtgattgagatcttttgtatgcgctctgggactgttcggtgtcagggggggcatcattatgtcatctgaagcgacatggccagcaaaagcttgattttcaccattagtagctctgtaaattattcggatggaatgtatcgaaatgtgcatgtggtccaactgcattttcctgttccttttctgtggcgtcttttttggcagaacgcgaaatgcggcgcgcgtagcgccaccgattgtagagttgctattcctactgccggagtactccatgtgtgttggatatcttgttggcatattaaataaatgcttggac

SEQ ID NO: 59758 - DNA, 414 bp, Zea mays
  Clone ID: LIB3069-028-Q1-K1-A9
gaagggaaagaagaagaaccagtagctctgatacgcattcgaactgatttcgatgtcagcgtgcctaaaccttggaaacttgtttgactcagagcaggagttcaaaagagaaacaaggtttacatcaaaatgtccccccaaagaaattgtccgcaagatcgaggaagctgcaaaacctctaggatttgatgttcagaagaaaaattacaagttgaggctcgaaaaggtaaaggcagggaggaagggaaacctcaacgttgctactgagatactgcaagttgcgccctctctccacatggtagaagtccgaaaagcaaagggtgacactctggaatttcataagttctacaagaacctttccaagaccttgaaagacgtcgtctggaaatccgacgatcttcaaacgcaacatgc

SEQ ID NO: 59759 - DNA, 379 bp, Zea mays
  Clone ID: LIB3069-028-Q1-K1-B1
gcgcgccgtagagccataaggcatctgagttgctccatagtagtacatgccaccatatgacggggagcggtgccggacctaaagccaggcagcggattcctactgagttcagggaagtgcagaacgactgtagtacctccgtagcgtatgccaagtctctggaacctgaaacagtgggttgagacttataatggtaagcatgcagcacattgcacacgcttgcttgctactctcctaagacttaactttgttaccggagtagctgtcgagactatggacatatatactcatatgtacatgcgaacagtcacctatggacatcgacatagaacatggtcatgctgttgtagacaagcaatggagccatgcactgacagta

SEQ ID NO: 59760 - DNA, 300 bp, Zea mays
  Clone ID: LIB3069-028-Q1-K1-B10
gccgcgcgtgcttccactcgtcctggagcttatagggatgcgtgcttgatccgatccggggagggcacaccagctttgagcgactacgatcgaatggatggccgccaatggcgagaagaagatgataaccctgaaaagctccgatggcgaggagttcgatgaggaagaggccgaggctatggagtcggagaccatccgccacatgatcgaggatgactgcgccgacaacggcatccgtctttctaacgttaactacgagatcctatgcaaggtaatcgaatcctgctgcatgcacgtaca

SEQ ID NO: 59761 - DNA, 427 bp, Zea mays
  Clone ID: LIB3069-028-Q1-K1-B11
cgcctcccggttcaaccaaatccctctcgtcttatccccaccagcgcaaagccgccctagcgggctgtcgtgagaagcaatggcgggccgtggcaaggcgattggcgctggtgccgcgaagaaggcgacgtcaaggagctccaaggctgggctgcagtttcccgtcggcaggatcgctcggttcctcaaggccggcaagtacgccgagcgcgtgggcgccggcgcccctgtctacctcgccgctgtcctcgagtacctcgccgctgaggtcctggagcttgctgggaacgcagcgagggataacaagaagacccgcatcgtgccgcgtcacatccagctcgccgtgcgcaacgacgaggagctgaccaagctgcttggtggtgccaccatcgcgagcggcggcgttatgcccaacatccaccagcac

SEQ ID NO: 59762 - DNA, 430 bp, Zea mays
  unsure at all n locations
  Clone ID: LIB3069-028-Q1-K1-B12
aaatgtacttcgctgacaaataatcatggttcctaattttaatctccaaatatgtgtaggaagtggatgacccatggcaggttgatatgtcggaattatgtctaagtgaaggcctctctcgtaacatgccagacaatggtgcagaaaatggcaccgagggaggaggctctagagttaaatatgctgtgatggatgttcccatcaccttaccttcgttgaaaccagcttttgacaagcctaaccccaaacaaggcattggtatgctgtcatggagcagcgacagccactatttcttcaccaggaatgacaacatgccaactgttctttggatatgggatatatgccgncttgagcttgccgctgtgctcgtgcagaaagatccaatccgtgctgcagcatgggaccctacctgcacacgccttgtttatgc

SEQ ID NO: 59763 - DNA, 444 bp, Zea mays
  Clone ID: LIB3069-028-Q1-K1-B2
cccacgcgtccgcaagaacaactccaactttcatctctcactacggcaacactttgcgagctgagccatcaaagctcggggcggatggcggggcggcggcagatcaagaaggagtgggtgcaggcggcggcggacgcggcgtcgtggtgcgtggcgctgtcgctggtggcgatgctggtggtgctgtgcacgctgggcgccggggaaggcggcggcggcgcgccggtggtggtggtgcgcggcgcggcgctgtcggcgcggccgtgcgaggagatctacgtggtggcggagggcgagacgctgcacagcatcagcgacaagtgcggcgaccctctcatcctggagcggaacccgcacgtgcacgacccggacgacgtcttccccggcctcgtcatccggatcacaccgtccaagcccaggtagatcgatggcgatccatcggtc

SEQ ID NO: 59764 - DNA, 300 bp, Zea mays
  unsure at all n locations
  Clone ID: LIB3069-028-Q1-K1-B3
gaactcgaagcttgcgttcttgtagtagatgtcttcagcaagcggtggtagagcgagaggtcgagaagatgaagagcagcactctgttggcgatcctagttctccaggcccttctggtctctgcggccgtggccaaaggacctgcagggccgacgacgaagaagcagtgctggtgcggcgagtgcaccagctggtcgggcgtgtggacctgcgacgacctnctcaccaagtgcgccgncacctgcaagaactgcgtccccgtgtccacggacaagggggccatcaagtacaggtgccgcg

SEQ ID NO: 59765 - DNA, 367 bp, Zea mays
  Clone ID: LIB3069-028-Q1-K1-B5
ctcactctccgctggtcgctcactcttgcttctccacccttcactcagtcttagtgtctgattagctctaggctctagctagccgcgccactccttcgtgtagccatcagccttctcatcgccaccaatggccactgccgaggtccagaccccgaccgtcgtggcggccgaggaagcgcccgtggtggagaccccgccgccggccgtcgtgcccgaggagtctgcccccgccgaggccgaggccgaagccgaggctgctgctcctgctgatcccgaggagcttcccgcggccgagcagcaggcagccgccgaagcggaggccgcggctcctgctggtgccgaggagcccgtcgcggccgaaccggcc

SEQ ID NO: 59766 - DNA, 255 bp, Zea mays
  Clone ID: LIB3069-028-Q1-K1-B6
cccacgcgtccgcggacgcgtgggcttgttcgtcagccctcagctatcgacactacactggtatttttggccccttgttggggagagtccagttcctacgtgacgacgaccacccccagttcggcgtagatgaaacacaaactagcagaatgcagattgttaggatttttttttttcaggcggcggggtggagccattcattgtcatggtgacaggactcataatagaaatacaggtaacatgtgtatctccgtc

SEQ ID NO: 59767 - DNA, 444 bp, Zea mays
  unsure at all n locations
  Clone ID: LIB3069-028-Q1-K1-B7
gatcagaaagaaagaagcacgcgcatctctcacccgagcagcacaaggaagcacgcactgccccacacttgccagcccgctgcactgcacacacgccctcccactcgctccccggtctagcctcgtcccaatcccacatcgtctccgaaatctctccatctaccggcggcgcaagcccgaccgcgctgcctctccttctctctccctctccccagtctccgcgcgaagttctcttctctcgcgtgctcgcatatagtcgcatcgttagggcgcgtactgggagagggaggccttcgctacctccgtggcagcgacagacgaccatgaaggcgctggtggtgacggtgcttctcctnctctcttccaccctcgccgcgtcacagtggtgcgtgtgcaagcaggacgcgtctcaggccgcgctgcagaagacgatcgactacgcct

SEQ ID NO: 59768 - DNA, 435 bp, Zea mays
  Clone ID: LIB3069-028-Q1-K1-B9
cgggccgaccgacgcgtccggcatgagcggcttcgatttctcatggttcttagttgaaagcctggctcatccttgcatgggtgagcaccgtggctgggaacctcaccctcctaggctctgcggcgaatctgattgtctgcgagcaggccaggcgggcccagttcttcggctacaacctcaccttctggagccacctccgattcggggtcccgtcgaccatcatcgtcacggcgattggtttgctcatcgtcatcagttactgaaacagctgaaggcagaagagcgtagtgtaagagaagcagaatggataaaaatccttccaataagaagtacatgtaaattaggcttgccctataactcaagtgtgtatcggtacgttatgtctccgtctgtgctcttgctcgtgagcaagcagcacatggctgaccgtgtagc

SEQ ID NO: 59769 - DNA, 417 bp, Zea mays
  Clone ID: LIB3069-028-Q1-K1-C1
cccacgcgtccggttgagctgctttcatgtgtaccagtgtcaaagacatttgcaaagatggcggcatattcaagaagatccttaaagagggagagaaatgggagaacccaaaggatcctgatgaagtacttgtgaaatatgaggcccgtctggaagatggtactgttgtatccaagtctgagggggttgagtttactgtgaaagatggctacttttgtcctgccctggccaaagctgtcaaaaccatgaaaaaggcagagaaggtgctccttacagtaaagccacaatatggatttggtgagaagggtagaccagcagctggagaagaaggtgctgtgccgtcaaatgcttcgctgctcattgaccttgagttgatttcatggaagactgtcacagaaattggggatgataagaaaa

SEQ ID NO: 59770 - DNA, 167 bp, Zea mays
  Clone ID: LIB3069-027-Q1-K1-H10
aaaccttttctaaggaattagaatcagatctaacagaggccctgttcgtccaaacaagcagaaaggcaaaacacaagttcatgactgagtcgatttcaaacaccactgcaacaaatgaacatcttagacacttggctatggaccgtaggtctacaagagatgaatgc

SEQ ID NO: 59771 - DNA, 453 bp, Zea mays
  unsure at all n locations
  Clone ID: LIB3069-027-Q1-K1-H11
cccacgcgtccgggttgctccagctgagttttcatcatcttccgcttcagacatcgataatgttaaataaccagagcacagttgctaaggctgtttctgcaagaggtgtatactctcctcagattgctagcaattccatatctcggaacaatcatcatttgatgggattgctttcttatgcagaggacacaaataattcatttgagggaaccagaaaatcacaaacttcattttcagcttatctttctggcattgggaagaatcaggtggatgaagttgctcttgtaaggaaagtacttgatttcaagtttcataatgtcaaaggattgctgcaactgattcgtcattcgttggagtctatcaaccatganagtgggtaatgatctaccaagtataggtatcttggnaaaagagataatgatgggaagggtgctttggcaactgtgctataca

SEQ ID NO: 59772 - DNA, 415 bp, Zea mays
  unsure at all n locations
  Clone ID: LIB3069-027-Q1-K1-H12
cccacgcgtccgcttccgtgaaacggttcttgagaagtcctgccgtactgtcatgagcaagtctcccagcaagcacaaccgtctgtacatggaagcgcgccccttggaggagggtctcgctgaggccatcgatgacggccgtattggcccacgtgatgatccgaaggtgcgctcccagatcctctctcaggagtttgggtgggacaaggacctggccaggaagatttggtgttttggacctgagaccactggcccgaacatggttgtcgatatgtgtaagggagtgcagtatctcaatgaaatcaaggattctgttgtggccggtttccagtgggcatcgaaggatggtgcacttgctgangagaacatgcgtggaattgctttgaggtatgtgatgtcgtcttcatgctgatgc

SEQ ID NO: 59773 - DNA, 465 bp, Zea mays
  Clone ID: LIB3069-027-Q1-K1-H2
aacctttgggttgatttatgtgcttgtccggactagagagtagtatactgagcatcccacttcctgtgcccttagcatcatagaatcgccggaatagtagttttgcgaagacggttaaggttgattgtaggtgctagaaggaagattgaggtcggggccatagaacttcccgtcgcaaacctcgaacggtgtccgttcttttcgtacttcccccgttcgctgagccgagtttcctgctctcgctacgtccgagttttgcggaggcttacgccaaacctacctactaaacgccctctcttctcttctcttctccgctccctcgtcttttcgtcgactccacccactctcagtaggccaacggtccgctagacctggcagcggtccgcaacccatagaatatcacgaagagcgaagatctaagctacagtcccggcacagaacccgtggacatccgcctgagcacca

SEQ ID NO: 59774 - DNA, 360 bp, Zea mays
  Clone ID: LIB3069-027-Q1-K1-H3
ctttgggctgatttatgtgcttgcagtgactcctccccgaacgtcaggtcctcacgcatgttaaacgatacacgtcgtacgtgcgcagctctatttaggcggcggcgtgtcttaatgatgtcatctagacctctctcgctatagtcttacatgatgatgcacttcgtgatcgctaccaatttacggtgtataagttgctcgaattgttcaagattagatttctttatttgctgatgctcggtgaagttcaagaagttcgaagtatttaagggtaccattctgcatttagtgttcgggtattaactgcttaagagttttcctcattttcggggtgctggcttacttaagggttttactatg

SEQ ID NO: 59775 - DNA, 494 bp, Zea mays
  Clone ID: LIB3069-027-Q1-K1-H5
ctttgggctgatttatgtgcttggatgtatgtattcagtgctgctattgacttacagcttgacacgcgctctaagcgccgcgcgggtgtgtctctgttgttcattttcgcttcgtagcgccgtgcagcacacggcctcatgattcatatgcatcgtcgtcatcatcgtgcgtcaatcccaactcgacggtagcttatagtcagtcagtatactattcttcgcaagcaacgcgtccactcacacgcgtattgattggaattggaggtgcgtgcatgtcgactcgttatgaagttcatcagcagccaaacgcaatgcaattcgtaggtaaccaagtagggtgtcgtcacacacagtgcaaccaaccgcgtgcacgggcacggcggcctgaccactggacgcgcaactttcgcatgcggttgggtttgcgttaaatgcatggcgattcgcgtaggtctcgcgcgctgacgacgccgcatctcgacaacgacacaact

SEQ ID NO: 59776 - DNA, 496 bp, Zea mays
  unsure at all n locations
  Clone ID: LIB3069-027-Q1-K1-H6
ttgggctgagatatatgtgcttgctcgcagctatcatttagaagttggtatacaccgaattcaaaatcttcgttaaaagttagagctaggtcatcggcctaaagatcacccccgccgggaacccagttcatagcacagagtgcgaataagccaaggaaccccccgaggaggtcggcgaagccgccgacgcctgcccggtcatccccgacgacgggagccctaagggccccggatacgccgaacctgtcatcgccgaagtcgtctagaaggtctccgaacccgccggctacgattcgacgggatggttctcaaggaccgatacggtcattgagaggggcgtacatatcttcagtagtgggaaggataatggcctccctaagaagcctgtcttaaggctaggtaatattgcgcccaccaagggtcccgatattctcggcggagaagattagacttgtattgtctccgaagagtacccccnactacgcggagacactat

SEQ ID NO: 59777 - DNA, 498 bp, Zea mays
  Clone ID: LIB3069-027-Q1-K1-H7
aaccattgggttgatttatgtgcttgtgtaggcgcttcaagacgagtctaatgagcctagaaactctgcgcggaataaaagggcaggggtctgcccgacctcgacccgtagcatgaacatgaattgcgaaagtgcggttcactgacttcccagattcctggagcccgaagtcagaggcgctagaaaagccattatagggacaatcggtccgcggtagttaagtgcctacagtgatgccgtcccccgacttcctgacgctggtctccttcactaccgcgaagtagaacctattaagcgccggaccgcctatttattaacagggaatgcgagtcgggaccagattgctgcgagataggccagccccatttcatcgacgattgtgttgtgacagcaacctaattcagcatgagaggaattgccgacctatataaccggctactgtgtccggccgaaaagttagcggtgtgaagtcattgcgcgttcgaccacgatcgaatg

SEQ ID NO: 59778 - DNA, 460 bp, Zea mays
  Clone ID: LIB3069-027-Q1-K1-H8
gatttatgtgcttgtttgggatctgctacggaggtgaataggtccgagattcctgatgattcaattgcgactgggggtcgtcccgattttgattctgatggtggtctggacatgtttctggagtaggcgttggtcggaaggactaggcgttgtaagagtccgatgttagaggtatctcgtaagtcgaagagacggtctgagctcgattagtagatgtcgtcactcgcagaggttagtgttagttcgtgctctcgcgtagtggtcgcgcatacaccggtgtcgacggcgcattgctcagcatggacgcgtccatatgggtagtaaccacgttgtcgagagagaggcttttctaatgttatcgatgaccccgtcctatattgcaccgcatccacgctgaacggatacattaccattactgacgtctgacctggtctagcccggtagatagaactatcatctc

SEQ ID NO: 59779 - DNA, 453 bp, Zea mays
  Clone ID: LIB3069-027-Q1-K1-H9
aaaaagtccaggagtttcagcacaagcggttttatggatctgacatgtccttaaaaggacgagttagtgaacttggaaaaaaggaagacgtgagtgaagatgggggtgatgagtatcctccaccagattcagatcatgaatcaacagaatctgatgaggacttctatatgtgtcagatttgcaacactgaagaggagaaaaactcattgttttgttgctgtatttgtgcttcacgggttcaccctggttgcctcactccaccttcgactgacatcgtgaatgatgattggtcatgttatggttgcaaggagaaagttaaaagctacttaaaagaaagagatgcttacttgactgaactctcaaagaggtatgatgctgcattggacagaaagtcaaaaattcttgacataatcccgtccttggatttacctagtaatcctttagatgatatca

SEQ ID NO: 59780 - DNA, 433 bp, Zea mays
  Clone ID: LIB3069-028-Q1-K1-A10
cccacgcgtccgcggacgcgtggggaaaattacccaggccaacctgctgcagccgcagagttggctggagaagacacaggatttaacatttaccatcaggatacaagtgaactaaacagcagtcagatgcatacaggtgcaggcattaccgaagatatcaatgaagattcccagcgttttgagttacgggaggacaatcaggtggattcaacaccgaaagactatttgttcaatggtggtggtttttgtatggagggcgagggcgagggcgatgaacaagaaccagcgtgtgatcaatctggtgcagaagtagaacctggaccaagtggtccatgtggcgccatggatgaagtttcaaagagtgcaagcatatcgacggctatggagtgtaccgagaatgcaagaatggaggcacgtggtgcatcttcgtcgc

SEQ ID NO: 59781 - DNA, 437 bp, Zea mays
  Clone ID: LIB3069-028-Q1-K1-A11
cggacgcgtgggcggacgcgtgggctgaatagctgtctatgccacttgctgctgtgaaggcggccgtgggacgttcatctttcctggcgcacagccagccccccacaggagcttctctgaggaagttgctgcacttaaccgctactttggcggcctgaaatctggtggtaatgcttatgtgattggagatccagcaagacctggacagaagtggcacgtcttctacgccactgagtacccagagcaaccaatggttaaccttgaaatgtgcatgactggtctggacaagaagaaagcttctgtctttttcaagactaatgctgatgggaacacaacatgtgccaaggaaatgacaaagctctctggcatctctgaaatcatccccgagatggagatctgcgattttgactttgaaccctgtggctactccatgaatg

SEQ ID NO: 59782 - DNA, 432 bp, Zea mays
  Clone ID: LIB3069-027-Q1-K1-H1
tttgggctgatttatgtgcttgtacgggcttgactaaaagaatcatatgaacctccgtggcctacttacgtttcgtaaacctgggaggaggaagttctattactactttaacattcgattcgtccctactacggtctcggacgcctggagtggttacagtcgtagtagcgttctcccatagaaggcctagagtaccagaagacaatgcagagaagatggtggaagtggtgactgaggcgactgatctggcggtggaggtgattgagaaggctgttgatgaggccgtgtaagtgccttttggtagcgaaatctctaagtaggtagttcttaagaccaagatgactgtggacgagactgaggaagacgttgataaagtcgaggtttcgaccgagaaggccgatgagacaaagaaagaggcggacctaactgctg

SEQ ID NO: 59783 - DNA, 375 bp, Zea mays
  Clone ID: LIB3069-054-Q1-K1-H4
cacaagcttgaactcgaccgattcagtcgcgcttatgagataagaaactactagacgggctcggggaccattcaactggcgaccccctacatttacttgaccagaatacggtgctgttggctctcaaatcagctgcagggaataagagggctgcacccgatgacgacgaccagaagttcgaggtggaccctgaacgccgtataatcgtacgcgaagagcgccagaagtgcataacgaagccggcccctcgtgacgacgaggaggctgatggaaagagctctgtcacaagccaatccatcacgaagaggaggacatccggctctggctgggcctacactggtcacgagtacaccatcaagagggccagtggcgatc

SEQ ID NO: 59784 - DNA, 438 bp, Zea mays
  Clone ID: LIB3069-054-Q1-K1-H5
aacaaattgaagctgcaaagcaactgatcagtgaggttaccagtgagaatcgtgctaggaatccaatgtctggtggctagtctcagcaaggctatcgccctcctcgtcctcagtcaaactggggcccgccttctgtgccaccccagcagcctggctatggttatatgcagcctggggcttatcctggggcaccgccacagtatggtgcacctcagcaaccttatggtagctaccccccaacatctggtggttatcagactggatgggatcagtctcaaaaccagcaatctcatacaactccccctggtactgggtatgattattatagtcagcagcagcaacctcagcaacaatctgcccctgggacagctgcttctactgatgccactagctacaattatggtcagccttcgacgtatgcttcacagggatatgatt

SEQ ID NO: 59785 - DNA, 430 bp, Zea mays
  Clone ID: LIB3069-054-Q1-K1-H6
ggactccaccgtcaactgccgcgccaactgcagcctcttcgacgtcgaccacatgtgcggcctcagcctcaagggccgaggggccatccccttactcgagtccctcgtcgtcgccgacgtcgccgcgctcagggacggcaccggcaccctcaccgtcttcaccaacgagcagggcggcgccatcgacgactccgtcatcgccaaggtcaccgaccaccacatctacctcgtcgtcaacgccggatgcaaggacaaggacctcgcccacatcgaggcgcacatggaggccttcaacaagaagggcggggacgtcaagtggcacattcacgacgaccgatcgctgctcgcattgcagggtcctcttgctgcacctactctgcagatgctgacgaaagaagatatgagcaaaatgtacttcagtgacttcaag

SEQ ID NO: 59786 - DNA, 433 bp, Zea mays
  Clone ID: LIB3069-054-Q1-K1-H7
ggcactttccctgcctgattggcgatttatagcggtgggggagggaaggccgatggtcagggaaagagagtaggtggacggacggtgctggcatcgccaattcaactccgcatctgcatcggcagcgcgccagctccataggaggagatggcgctcacaagaatcggtcttgctggccttgcggtcatggggcagaaccttgccctcaacattgcagagaaagggttccccatctctgtgtacaacaggacaacctccaaggtggacgagaccgtgcagcgtgccaaggcagaaggaaaccttcccgtctacggcttccatgaccccgcgtcctttgtgaagtccattcagaagccacgggtggtgatcatgctcgtcaaggccggcgcgccagttgaccagaccatcgcgacgctcgcagctcacttggagc

SEQ ID NO: 59787 - DNA, 413 bp, Zea mays
  Clone ID: LIB3069-054-Q1-K1-H8
cccacgcgtccgccaaaagcagctcctttctcgggggtccggccacttccaggagttgttgcctgcgaagcttgctccgttctttcgcctgcttgccctcactcctctatcgccttggcctgcttattgcccagacagtttctgcttgaccccacgattcttcactgatgattcacagaaagcttggcgagcacgtacataacttgccgatcggacagttgatggacggcacgagcccaaaccgtacaagtccacaataatttctccctccggctccggctccgcctagactcactcgtccatgtcgcgcgccggccgctccctgcccctgcccgtggcggcgctcctgctcgcggtggtggcgctgtgcgcggcgcggcgcgcgcgcgcgatcggcgtgaacttgggcacgc

SEQ ID NO: 59788 - DNA, 204 bp, Zea mays
  Clone ID: LIB3069-054-Q1-K1-H9
taacacaccacatcttctcttcataccattctttaaccccctagattattcatccctttcatgcttcatttaaaataatttaggcacctaccatttattatccactaactatttaataccctatctctttatatccttttcctattctcaattcttcaccttctcttcttcttttacctactctataccctcttttccttctac

SEQ ID NO: 59789 - DNA, 406 bp, Zea mays
  Clone ID: LIB3069-055-Q1-K1-A10
cccacgcgtccgcccacgcgtccgcccacgcttacttacggtatatggccggcactgtgaaaggcatgaggacacccaaaacagcttatgactttgaggtttcttggagagctctttctgatgacactgcccagcaaatacagttactaaagtcgattccaccagcaagcctaccagagattttcaagaacgcactctctgcaccttttcttattgacatcgtgaagtgtgcagccttaatttttccggatgcggaggcattagctggcaatattttggataatttggctcgagttccacgcttcgacttgataatcatgtgcctttcatccatgcacaaaattgaactgaagaagatatgggaacaagtattccttgctgaaaaagcgcttgctgatgatcggat

SEQ ID NO: 59790 - DNA, 387 bp, Zea mays
  Clone ID: LIB3069-055-Q1-K1-A11
cacgcgtccgccttcgcgcacgcaacgcaaaaacaagcacattcactcgcgatccgatctgggccggccaaggagcgacccatccatggcgactagggtttggctcaccgccctcctgcttggtttcctcgtcgccgcctcccccttcaccggccgagttgctagagctgaatccgaggaagatgctgctgcagctgaggttgttgaaggggctgatctatgtattgtgggtgatgatacacaggtttccagtgatggacctttaagtcctgctcctggtgtagagacagtaattgtcttcccaaaaaatgctggcaaaattgtactagcaggtgaagaaactgaattactagttggtctgcaaaatgacggtgaatcaattttgaa

SEQ ID NO: 59791 - DNA, 217 bp, Zea mays
  unsure at all n locations
  Clone ID: LIB3069-055-Q1-K1-A12
cccacgcgtncgccgacgcccagaattcacgtgaacgcacacgcacccacacgacacatacaggagaggcttanggtttccccgtgcccggccgccacagtgccaacccagctctccggtgcgcccgcgacccctgctcccgtcgacagggtggcagcgccgtgcggagtcgactcgccgtccgctggcgccgtgtgcagggccgcgggcaagggga

SEQ ID NO: 59792 - DNA, 216 bp, Zea mays
  Clone ID: LIB3069-055-Q1-K1-A2
gcacaagcttagtcgagaatattgcttttgagtcgcggaagcagaggggataaaaatcttagtcatgtttggactttaactttgttttatgttggaaagtacttgaaagacttttcctgtggtaattctaggcgtaggttgctgtgctggttggggtttactggtgaaccagagtttttctatcccactatgaatttgttacctcaagttacctgg

SEQ ID NO: 59793 - DNA, 314 bp, Zea mays
  unsure at all n locations
  Clone ID: LIB3069-055-Q1-K1-A3
ataattaaaatcccaaattaaagaaaacgaggggaggaaaaacaactttcatcggcgtccgacaccggagctcccttcgtcggccttccttgagtgtcaacccccttctcaaaacttggatttgcacctcagtccctgccggtctgcccggtcgacgcctcgccggaggaagcccctcgtctccttgccctgcggcgggttcatggggttctcgctgtaccccatgaagacgtccacgcggatgctctggagcactagcttcttccgccataagctcagctcctgctnctgcttcctctgaggacgccccaccc

SEQ ID NO: 59794 - DNA, 376 bp, Zea mays
  Clone ID: LIB3069-055-Q1-K1-A6
ggcaacttcaccaccatcgcctcccagtgcctcatgaagctccccgcaagcaacaacgaggtcacctacaactgcgacggtcacactttcaattacctcgtggaagacggattcacatactgtgttgttgctgttgaatcggtggggcaacaaattcctattgctttcatggatagggttaaggaggatttcacaaaaaggtatggtggtgggaaagctgctactgctgcagctaacagcctcaatcgagagtttggatcaaaacttaaagaacacatgcagtattgtgtggatcaccctgaagaggttagcaagctggccaaagtgaaggcgcaagtttcagaagtcaagggtgttatgatggaaaacattgaaa

SEQ ID NO: 59795 - DNA, 293 bp, Zea mays
  Clone ID: LIB3069-055-Q1-K1-A7
gcagtactgattgcacttgctgttctctgtctgctggtatctcatgtgaaatgaccgagtgccgtgaatctagttttggttcacgttgtgttatatattaccacagtccacgctgtactcatagtgatcacgcttgagctgtgtcatggattctggaagaccatcattggttcaaagcatttcaatgttgtgctccaatgtgccatgccctacaaatgggaggtctgggtgcttgctttgcaatggcatgatctggcattaaaaatattattcacttatccctgtatttggtc

SEQ ID NO: 59796 - DNA, 369 bp, Zea mays
  Clone ID: LIB3069-055-Q1-K1-A8
ctaccaagtcagctataaagggacaagatgttaagaccaaatcagcaacaaatacaagcggggtcactaaagggtcacctttaaaagaaatatcaggtgtcaaaacgaagcaaatcttgcaaaaggtttcaaattaaagcactgttgtacctcttgagtccaaaaccttgaatgaaaaccactggaattagtcagagcattacgtctggcatggctaataatcaggtaccccaacctaatgacttttgaaaagataccctaagtgttaacccagctggagataaggagcaatctcctgtgacaaccgagccaactactaacgtactggaggctgatcttgctcaaccagcacatgatgttgatgaaaat

SEQ ID NO: 59797 - DNA, 382 bp, Zea mays
  unsure at all n locations
  Clone ID: LIB3069-055-Q1-K1-A9
cccacgcgtccgctcgcggtgttattcctctcgagtcgcctccccctcaagttccacaaacgcaagcgccaatctcgccgtcaccacctcaatccagcaaacgcaaaccccatctcgccgccgccgcgatgtctcgccgctatgacagccgcacgacgatcttctcgccggaggggcgtctctaccaggtggagtacgcgatggaggcgatcggcaacgccgggtcagccctcgggatcctagcggccgacggcgtggtcctcgtcggcgagaagaaagtgacctncaagctcctncagacctcgcgctccgccgagaagatgtacaggatcgactcccacctggcgtgcgccgtggccgggatcatgtccgacgccaacat

SEQ ID NO: 59798 - DNA, 410 bp, Zea mays
  Clone ID: LIB3069-054-Q1-K1-H3
aacaagttcgtgggctaccacacgacgtttgcgttcgtgttcaccgacaaggcagagggcgcgagcgtggtggtggtgtcgttccggggcacggagcccttcaacatgcgggactggtccacggacgtaaacctgtcgtggctgggcatgggcgagctgggccacgttcacgtcggcttcctcaaggcgctgggcctgcaggaggaggacggcaaggacgccacgcgggcgttccccaaggccgtccccaacgccgtcccgggcaagccgctggcctactacgcgctgcgcgaggaggtccagaagcagctgcagaagcacccgaacgccaacgtcgtggtcaccggccacagtctcggcgccgcgctggcgaccatcttcccggcgctgctggcgttccacggggagcg

SEQ ID NO: 59799 - DNA, 188 bp, Zea mays
  Clone ID: LIB3069-055-Q1-K1-B10
ctctccttctagcgaagtatctgcggcggcgtagcgcggcacgctagagcctcgttgctgaggaggggagatggctggtattgacgatatgccgataaggcctgctcggccgggcccgccgatgcagcaccgtggtccgaccccgatggcgcgccttcgccccgaaccaatcgaccgcgagaagacct

SEQ ID NO: 59800 - DNA, 348 bp, Zea mays
  unsure at all n locations
  Clone ID: LIB3069-055-Q1-K1-B11
cggacgcgtgggctccagcctccagcgtgatctgagtcctgaccaagccctaaacgccaccggccgtggcaaatctcctttccctgcgatccatggccgccgccgtcgccgaccccgcgccatcccgcaagacggagacctacaccgacaccaagcgccgcgacgacgtgcgcggcgccaacatcgccgctgcgcgcgccgtcgacgacgccgtgcgcacctcggtgggcccccgtggcatggataagatgatcgcttcgggcgaccaggctcaggaggtcatcatcaccaatgacggtgccaccatcctctcccgcatggcgctcctncaggccgccgcgcgcatgc

SEQ ID NO: 59801 - DNA, 284 bp, Zea mays
  Clone ID: LIB3069-054-Q1-K1-F9
cccacgcgtccggagagtctgacatgatttttagtactacgagcaggactaatactaggcggtgctgatgaactggagcgaagggatctcataacttgctgttgctcggctccgccattcgctcgctggctgtgtccgctgcctcagccttcactctccgttctagcttgaatggacaattgtaagataacccgactaactcgacgcttttaagatctcttctaggtaagctatcgccagcgattccctgcgggaagaagaacagataaggaacctgtcttgat

SEQ ID NO: 59802 - DNA, 438 bp, Zea mays
  Clone ID: LIB3069-054-Q1-K1-G1
atgggtgccgtcgagggctaccgcattgccggctggccgctcggcgaggtcgtcgaccggctggaccctggcggcagcttcgaccccctcgggctggccgacgaccccgaggccttcgccgagctcaaggtgaaggagctcaagaacggccgactagccatgctttccatgttcggcttcttcgtccaggccatcgtcaccggcaagggcccgctcgagaacctcgctgaccacatcgctgacccagtcaacaacaacgcatgggcctacgccaccaacttcgtacccagcaactaagctcaacggctatgctatgcaacttcattgactttcggatcggagagggtgtacgtacgtggattgattgatgctgcgagatgcatgtgtgtcttatggttcacgttgcattgcataggcaagtcgagatgatgagttggc

SEQ ID NO: 59803 - DNA, 361 bp, Zea mays
  Clone ID: LIB3069-054-Q1-K1-G10
cggaggagaagctgctggaaggaggcaattttagaggcagactggaggctaggagggcactgttccaaggcagccaggataggtcggccaagctggctggatacaaagcagggtcacgagttgttccatacgaaggtggtggtaatttggaagagatttcagaagttgaaggtagatcggaaaggtatgcagttcagaaagacgagagcttgtcagaaataaggacgcaactccttcagattgaaaatcagcaaagcagtttactggatcttctccagaaatttatggggaagtccgaaaacggtatgcgttctttggagacaagagtgcatgggctggaaatggctttggatgagatctc

SEQ ID NO: 59804 - DNA, 280 bp, Zea mays
  unsure at all n locations
  Clone ID: LIB3069-054-Q1-K1-G12
cgatagatctcagcggggtactcgctggtttcacggccatctggtttttaatccacgttagggagtaccatctnctcaccttggtgtgccactgtctcatcgtcttgcttgccatcctgttcctgtggtccaacgcctncagtttcatcaacaagtccccaccaaacattcctgangtgaaaatccctgangatgtgtctgttaatgttgcactgacactgagatacgagatcaacatgggctttgctaccttgagggagattggacatggacacgatct

SEQ ID NO: 59805 - DNA, 439 bp, Zea mays
  Clone ID: LIB3069-054-Q1-K1-G2
ggccaacgggatcgatccaccgaagctctcgacgcagcctgacaaacctacatcttcgtgctgttcgagcgaacgtgctaacatcgacgctcttctctccaagttatgctccgcagatcctgaggaacagagatcagctgctgcggagctccggctcctggcaaagcggaatgcaaacaatcgtatctgcattgccgaagctggtgccattcccttactattgagtctcctgtcgtcatctaatctgcagacccaggaacatgctgtgactgcacttctgaacctctctatacacgaagataacaagacgagcatcatatcatccggtgccgtcccgggcatagttcatgtcttgaagaatggaagcatggaggcacgggagaatgccgcagccacccttttcagcctgtctgtggtcgatgaatacaaggtaacaatc

SEQ ID NO: 59806 - DNA, 377 bp, Zea mays
  Clone ID: LIB3069-054-Q1-K1-G3
caaccgcgccatcgttaccgactcaccgtcgactcttgctcactcactcgcactctccggccagatcagagcgctcgcttccaatagcggcgtcttgtacgagaaagcctgcgcagtaagccatggcacactaatgacaccctgagaagatgcaagaggcctccaagcttagcgcctacgatccaaccaagattaacaaagctaataacgttgtcatacaatagccttttgatgaagtagacaagcttgcagagaagacacaatcactagacatgcactgaaccagctgaacataactatactggacaggacaagaatcatatgaagcaggtgcatcctgagcaaagtatagatgaccgtgaatataaggatgacac

SEQ ID NO: 59807 - DNA, 397 bp, Zea mays
  Clone ID: LIB3069-054-Q1-K1-G4
cctgctagctctctgtctcctgctcatattcgctgttcgcttcgttgtactagagcgcggatgagatctttccttggttcttcattccggtacgaaggggaggggtccaagtgaagagaagagaaagcctgcgagcgatgggcatcggcgacgtcatctccgagttctgctccttgccgaagaactcccggcatctcaagaagaagaagcagtttcagacgggggagatgaaagtgcgcattgactgcgaagggtgccagcgcaaggtgaagaacgcggtggagggcatgaaaggcgtgagctccgtggaggtggcggccaagcagaacaaggtgacggtcacgggctacgtggacgccaccaaggtcatgcgccgcgtcgcctacaatacaggcaa

SEQ ID NO: 59808 - DNA, 434 bp, Zea mays
  Clone ID: LIB3069-054-Q1-K1-G5
tgcaaattatttttcttcgcatttccaccacacagcatttttttcccagtactatatacgaaaatgagtcattgataaattctgcagtttcatgtgtttgataggcactgttagcagctagaagttctggagctgtcatttttctaggcacatttggagctcttgcggtaatgaccattatatctgtagttcttggtcgagcattccactatgttgatggcatcattccgttcagctttggtggtactgatttcccagttgatgacattgctgcggcatgtctcttggtttattatggggttactacattacttgatgcagcctcaggtgatgatgaaaagatcaatgatgagcacgaggaggctgagttagcagtatcgaaattttctggaaatggtgcggtggtcatgtctgctgctggtactattgctagc

SEQ ID NO: 59809 - DNA, 378 bp, Zea mays
  Clone ID: LIB3069-054-Q1-K1-G6
aatcgaaatcgatccgatctacgcttgctctgaagcctgatctccaccgtggtcgcagcatgggcgcatgaccttgatcaccaagaggcaatggagcatgcatccacaaccacatgccatggcagtgagggccctcatactcacttacaactacgtcctgatcgcactcatcgtcgacatagtacaccgtgactggcttcttgattgccgactgtgtgcatgttgatctgcccatgaaaaccaactaccttgtcgtcgacatcaataccactgctaaacaaatcgaggatgcgtacaatgaatttactacgagggatgatatcgctattgtgctcatcagtcaggatattgccaacatgataaggtgtttggtgggta

SEQ ID NO: 59810 - DNA, 379 bp, Zea mays
  Clone ID: LIB3069-054-Q1-K1-G7
aacactcgtccgcccactcgtccgtcgttccgaaccctgacctgtacacggtcgccagggggctcgcaagacctagatcactagtagacaaggatagcagcatccacaaacacaatccatatcagtgaaggccaacatatacaataacaactgcagactgatcataatgatattcgaccagatctccgtgactgacatcttgaaggacgacgatggctacgttgatctgagcaagaaaaccaactacatccacttcgacaaaaatacgacagtttaacaaatacaggatgcgttcaaagaatatactacgatggatgatattgctattgtgctcatgaacaagtataatgtcaacatcataaggtgtctggtggatagc

SEQ ID NO: 59811 - DNA, 120 bp, Zea mays
  Clone ID: LIB3069-054-Q1-K1-G8
cagatgcacccatactgtattattctgtttcagcgtcctatacaaagtatacattggggctgaattctgattagcccgtgctgatgcttgcaatgacattggttcttgtgtgtacagact

SEQ ID NO: 59812 - DNA, 294 bp, Zea mays
  Clone ID: LIB3069-054-Q1-K1-G9
cccactcgtccgcacacacctcctcagatgtgtcttctataccatttaaaccttttacctagacgactatcaatcttaatcaggcaaatacaaatacttaaactagcactttcaccaacaatattctctataaatctcaatattctcaagcccattctttaacatattatatactttcgaatcttactctacaaacctgctattattgaaaactcatttattccattactttatacacttaacttatattataatataaagtatttgttctacattaaatcccaatatgctttt

SEQ ID NO: 59813 - DNA, 439 bp, Zea mays
  Clone ID: LIB3069-054-Q1-K1-H1
cccacgcgtccggcgaaggcacctagcatccgtcactcgccgaactgaggaacacgccgggcgacgggatacagcagcagcgcgcccctctatgcccgacgcgacggcgccctgcagctgcagataaacctgttccaatggccaaacaaaaagagggtgtggacaaaagaactgctaggaagacgatccgatctacggaaggctgtgcaaagagcattactttcgagaggaacaacaaatcagacgctgtgcagcttcacgatctgccgaatgacatcctaggtagcatactatcacggttgacattcagagaatcctcacagatgggccttgtttctcatacctggcggcggctgtggagaagctgttgccggaaactggtcttcaccagtgccaccatgttccaacccggaaataggagcatcaaacatacaaagac

SEQ ID NO: 59814 - DNA, 304 bp, Zea mays
  Clone ID: LIB3069-054-Q1-K1-H10
ccgggcgactcgtccgaaaaaagaaagagagggggagagacacagtttcctcactccacacactgtcttgtctctgagtgccagagctttcttggatcgcgaggaatccactggaaattttgcaattgtagtagagaactgtatcgtccgacgaaggtgcatggtgttggccatgggtcacggcagggaacagagacgagcaggtcggcgctcttcccccagctcattgatcctgtcctcgctataaggtagtcctgcggtggcctccgaatttcactcgatcgaacacgacatgaagcgggca

SEQ ID NO: 59815 - DNA, 403 bp, Zea mays
  Clone ID: LIB3069-054-Q1-K1-H11
cccacgcttccgcccacgcgtccgcggacgtttgggtggcttcacgcctcgcagcacagcagcatccaaatcagatcttccaaccgccgccgtgcttgcacagagtgcctttggggtagcagttgctgcagccgtagttatcgctggctacttgtacgaggcttccaagaaggccaagtagagggcgaagttcttctccacatggctttgctttagtaagtctgaagatcgaataacaggaccatatctgaagatcgaataacggatcatataaatgagttactcggaaaatgttctgaaatccttacgaacagaacgttgccttcatgtttacactgtactcatgagtcacagtgatatggagatggcatagcctactattggaagtttatgcattctgtgt

SEQ ID NO: 59816 - DNA, 432 bp, Zea mays
  unsure at all n locations
  Clone ID: LIB3069-054-Q1-K1-H2
cccactcgtccggctaaggctcctagtttccgtttctcgccgaactgaggaacactggggncggcgggatacaacaggggcgcgcccctctatgcccgacgcgacggcgccctgcagctgcagataaacctgttccaatggccaaacaaaaagagggtgtggacaaaagaactgctaggaagacgatccgatctacggaaggctgtgcaaagagcattactttcgagaggaacaacaaatcataccctgtgcagcttcacgatctgccgaatgacatcctaggtagcatactatcacggttgacattcagagaatcctcacagatgggccttgattctcatacctggcggcggctgtggagaagctgttgccggaaactggtcttcaccagtgccaccatgttccaacccggaaatatgagcattaaacata

SEQ ID NO: 59817 - DNA, 383 bp, Zea mays
  Clone ID: LIB3069-054-Q1-K1-F7
agctgacggacacatatatacatgtgctcatgcatgcgggaatttctttctttgttctgcgtcttcttcattgcacccccttttaagaatagttggtaccgaactgtccattctgtaatttattataaattcggtaattattacaaatactgtggttaataaagaatgttccaccagcgtaagactaactacctgcccgaaccctctacgagtacaagacagaagcctcaactgaaggatctgagcctgagcgccctccggacgacaagaacaggttctgctttttatagataccatttatcactagctagaatacatattcacacgcatcatctatcacaccgcaagcttataattgacctcaaagtttacacatgcttgtc

SEQ ID NO: 59818 - DNA, 173 bp, Zea mays
  Clone ID: LIB3069-054-Q1-K1-E3
caccaatgggaaccataacatgggtgaaagccttattatattggggaaagggttccacgggttggggttgaaaaatagaacccggtctttttggaatcccttattccttaccaccatgctttctcctttttggttaaagtcccccaattttggaaaaatttaccaaataaagg

SEQ ID NO: 59819 - DNA, 436 bp, Zea mays
  unsure at all n locations
  Clone ID: LIB3069-054-Q1-K1-E4
tggatattgctagcactgaagctggaaacatttattcatatagcatcttcacacctacgtgcgatgcatcttttgcctcctcaaagaacaaagtgatgaaaaggctacattctgctggaaaaatgggagaacagtatgatccatgcactgagaagcattcaactgtatacttcaatctagctgaggttcagaaggcacttcatgttaatacagtcattggaaaatcaaaatgggagacttgcagtgaagctgttaatactcattggggagattgcgaaagatctgtgctgcatatctatcatgaacttatacagtatggcctccgtatatgggtgttcagtggagatacagatgcagtgattccagtgacttcaactagatacagcatcgatgctctcaagcttncaacaataactccatggcatgcttggtacga

SEQ ID NO: 59820 - DNA, 290 bp, Zea mays
  Clone ID: LIB3069-054-Q1-K1-E5
gaggagctgagctgcatctcgttggcgttcagcatcggcttcatcgcgtccaggtgaagtcgttcgagcctgggcacgagaggcagccagcccatggatgtaaattacgtggagcacactctgtatcctatgactttcaagtatctaggtccatgtaagctttttgtgggtgtctgtgttcaactgagacgtttttatccggagttgaacatcacaataaagcaaagtcactgataccatgtaatggaactctgagcgcttgaaaaaaatgaactcacaataaaaaagaa

SEQ ID NO: 59821 - DNA, 439 bp, Zea mays
  Clone ID: LIB3069-054-Q1-K1-E7
gttttccgtgcttcctttcaggtatgctgcgattgctgatcagtcaaaacaaagccctgtacagcagcctgaactgaacctgcccatgctgacacgcacgaggtccatgcccagcatcaggctcgccaaatacgcaaagtggttcgacgacagctcggaggacatcaggagcctctgcgggaaggcgctgcagatgctgcgcacgcactacggctgggagagcgtggacgtcaccgtccctgagatcgaagagatgcggctggcgcactacgtgaccatgggctcggagtgcactgcctccctcgctgccaagtacctggacagcatggacaggtccgaggtcgggtgggacgtgcggatcgcgctcagcgcctacgggtccttcagcagccgagactacctcagcgcgcagcgtctccgatgccggcagatgtacttc

SEQ ID NO: 59822 - DNA, 440 bp, Zea mays
  Clone ID: LIB3069-054-Q1-K1-E8
cccacgcgtccggacgccgtttcttgtctcagggtcgcgccgccgccgccgccgccaatgccagccccctccgcgacgtcgccgccgccgctgctggcggccggatcaccatgggcaacgacctgtggtacggcccggaccgcgtcaagtaccttggccccttctccgcccagacgccctcgtacctgaccggcgagttccccggcgactacggctgggacaccgtcgggctgtccgcggacccggaggcgttcgcgcggaacagggcgctggaggtgatccacgggcggtgggcgatgctgggtgcgctgggctgcatcaccccggaggtgctggagaagtgggtgcgcgtggacttcaaggagcccgtgtggttcaaggccggcgcgcagatcttctcggagggcgggctggactacctgggcaaccccaacctggtg

SEQ ID NO: 59823 - DNA, 329 bp, Zea mays
  Clone ID: LIB3069-054-Q1-K1-E9
aaagatatcacggtagtgatcaactatttattccccactggtgttgaagactacgttcacagtattttcatgacaggaatggctggtgccactggtgttgcatatacatttttttgtgatcaggattcaaaatatgctgctgacctaatcaaaattcttgaaggggcaaaccaacgaatgccccgtgatttaaaagatatggcttcttctggcggtggacgaagtaagaataagaaccattgggcatccccgccttacaagggtggttcaccttctgaactggattcaaggtacagcaacatagatggactagcatctttctggaaatc

SEQ ID NO: 59824 - DNA, 372 bp, Zea mays
  Clone ID: LIB3069-054-Q1-K1-F1
cagcgaagttgtctacatcacttgactttcgagctaccgcggctcacgtcggctgcatgaattgcttctgtagactagtaccacacagtttgcgagaaggggagaggtagaggttccgaggtagagagatagagaggaggagagggagggcgaggcggcggattcgtcactccgttcttattcgctgatctggaggaaggaggcgaggtacgcactgctatctccttccagttcgttcgagaagacggtcgttgggtgattcggcgggcgctcctgttctgtagtaaagttgtttgcgtttttgtctcttgtatgattggtctcttgatcggaaacagaagtcccaaaatctttctttttgcttggtcaagt

SEQ ID NO: 59825 - DNA, 387 bp, Zea mays
  unsure at all n locations
  Clone ID: LIB3069-054-Q1-K1-F10
agactacctcgactgggaggttggaaagtttggtttaattattgaatttacagctccagagtccaactcaaaacacagtgcgacctatttgcctgaagttgcgggccatgaaggtgaaaatttcctttttcatcgatgcgatgtacacttatcgtttctacagagttctttagtttctagaattattgcaggggataataagaagaaatgagttaagaaaatatgtaatttcatctttctaaatcatcatggaccaaatgcattataatgagcaataacggtaaaataaagagtcaactgatcagtacattccaaatctgtattgaatagtttgtaacttaggctttatcttttggcangttggacacatgtagaaactattgattc

SEQ ID NO: 59826 - DNA, 151 bp, Zea mays
  Clone ID: LIB3069-054-Q1-K1-F11
cccactccttcgactactcgtttacaaacttctgttcaaatacctaatctacatctccacagttcaactcaaaacacattgcgacctataagccttaaaataccggccattaaagcacaaatttcctatttcatttattctatctacactt

SEQ ID NO: 59827 - DNA, 284 bp, Zea mays
  unsure at all n locations
  Clone ID: LIB3069-054-Q1-K1-F12
ttcgacccactcgtccgcccacgcgtccgcccactcgttcgcccacttttccgcttctttcccctccccttcctgtcagtncgtcttaaaacggttttgcgcacaccttgtcgttctcggtttcctcttctgccggtctgcccagtcctcacggcttcctttttctttcgggccactcttcggcctcttacttgctgcgctcggcctttctgcgcattgctcctctgttccccccgtcagtccgttcctgagcccagccgcttcgcgttcccttgattccaccc

SEQ ID NO: 59828 - DNA, 440 bp, Zea mays
  Clone ID: LIB3069-054-Q1-K1-F2
agcaaacttgtgtcgggacttggattacgtgtttgtgcactttgaaaagcagataaagctgatggtgtaaagcagcagtgcccggtaccccaccagggtacgtgatgcaggcaggggtggtgctgtctgtgtcgatgccgtcatccttttctggcgtggcgctgcatatgaccgacgtgtcacggcgcgtttgggtgcgcggcgcgcgcgcgtcaaaacgtatcaagtactactactacgtgccgtgccaggtgttgcgtcaaaacgtaacaagtttctcccttccgttcttttgtccgagcgagtttacaagtactatactaccaaaggcgaaagcgaacccgcaattttcctatgtaggagtatatactagtggactgcaccaacatccggtccacgtaaaccatgtgccttttccgacgtgtatgttttatttaatg

SEQ ID NO: 59829 - DNA, 442 bp, Zea mays
  Clone ID: LIB3069-054-Q1-K1-F3
tcgatcgaacttgtgtcttgacttgtatcttgtgatttttcacttctaaaatcatataaagggtgtggtgtaaagcagcagtgcccggtaccttaccagggtacgtgatgcatgcatgggtggtgctgtctgtatcgatgccgtcatccttttctggcttggcgcttcatatgaccgacatgtcacggcgcgtttgggtgctcagagctcgcgcgtcataacgtatcaagtactactactacgtgccgtgccaggtgttgcgtcaaaacgtaacaagtttctcccttccgttcttttgtccgatcgagtttacaagtactatactaccaaaggcgaaagcgaacccgcaattttcctatgtaagagtatatactagtggactgcaccaacatccggtccacgttaaccatgtgcctttttcgacgtgtatgttttatttaat

SEQ ID NO: 59830 - DNA, 443 bp, Zea mays
  Clone ID: LIB3069-054-Q1-K1-F4
attacaagactgcttacagctacttctttgaatcatttgaagctttcagttcactgggggatgccaatgctatcttcaggttgaagtacatgcttctgtgcaagataatggtcaaccaagctgatgatgttgcaggaatcatctcatcgaaggctggcctcaagtatctgggtcctgatgttgatgctatgaaagctgtggccgatgcctactccaaaaggtctctgaagtacttcgaaactgctctccgtgattacaaagctcagctggaagaagatcctattgtccacaggcacctttcctcgctgtatgacactctcttggagcagaacctctgcaggctgattgagccctactcaagggtggagattgctcacatagcagagatgattgagctgccaatgaaccatgttgagaagaagctgtcccagatgatcctcgac

SEQ ID NO: 59831 - DNA, 430 bp, Zea mays
  Clone ID: LIB3069-054-Q1-K1-F5
tgatttttaccacctgaagagcaggaatggcatgagccagcttgagttggaagattaggggcacgatgatttgaaggctgcaactggtgggtttactaaggatgcagatgatgcaaacaagcttaaccgcattcttcaattgactgggttcagcgatcctgtgtatgctgaagcatttgtaacagtttaccattatgacattgtacttgatggtactgtcattaaccgcacaaaggagacacttcacaacttgtgcttggaattggctacaatgggagacctcaaacttgctgatcgccctcagaactacaccttggctcctgagtctagcaaacagatccgtgctaatatcaaggtttcatgaacagagacggcggttatatttggcaacatagtttacgagacttcaaatgtgatggaacgatcagtg

SEQ ID NO: 59832 - DNA, 412 bp, Zea mays
  Clone ID: LIB3069-054-Q1-K1-F6
cccacgcgtccgcccacgcgtccggcctcgcgtccgcccacgcgtccgtccacgcgtgggggcggaaacatccaatccccgggccaccactacctgcctgcccgtgcccacgcttcttctcttctactccccaagccccagccccagctaccgggccccctgctgtctgttccaccagcgtcggcctagctacctgccccgcccctctccgagtaccgtcggaagcctcagctgaaggatctggcctgggcgccctccggacgacgggacaagttctgtatggtcttcatgaagttcagcactagctagaagacatattcacacgcatcagctatcaaattgcaagcttagaattggcctcaaagctgggacatgcttgtcttaccagaagccactgatagcttggagttgt

SEQ ID NO: 59833 - DNA, 422 bp, Zea mays
  unsure at all n locations
  Clone ID: LIB3069-054-Q1-K1-E12
acgagagagacgaatcttccgaatctctcggtggcgatggcgctctccgaccgctcccgggggtcgctcctcccgagcttcctgtacgcctcctcggcgcgctctttcgctgccacaggagccgccgcgcgcctccctgtctcctccccagcgcctgccacggctggagcaggaggcggcgtgccgttctcgatccaggcgcccaaggagaagatcgagatgtactcgccggccttctatgccgnctgcactgccggaggaatcgccagctgcgggctcacccacatggccgtcacgcctctcgacctcgtcaagtgcaatatgcagattgacccagcgaaatacaagagtatctcatctggatttggtatcctggtaaagggagcaggggccaggggtttcttcaggggatgggtgcctac

SEQ ID NO: 59834 - DNA, 402 bp, Zea mays
  unsure at all n locations
  Clone ID: LIB3069-030-Q1-K1-H4
cccacgcggccgcccacgcgnccgcaagcagngaagaaaacaagaggcnaaaaaccccagggaccccnccaacaccggcggagccgncactggaaaaaccctatcaganngggacatcancnnggataaagaaaaggancaacacctatgcacttgagcaatttcttgcgttatcagtgaagttctgcaactcgattgggttccggatggcttgcacaatcacccttaagacagcaacgaacagcaccagatcatggcaggtgcgtggtactgcatacaagtggcatcgctacatcatcggagtgggctggaagagcttttgccaggataacagactcaaggcaggcgacctgtgcaaccttaacatcatcgagaccacgctgtggcatgttactatcacgc

SEQ ID NO: 59835 - DNA, 303 bp, Zea mays
  unsure at all n locations
  Clone ID: LIB3069-030-Q1-K1-H5
ccggccggaanccggggcgcccagcgccgaaagncaaanggacacagagaagaagaacacaggaacgagcnncgcccgggaccgagacccgggcgagcaangaggcnaaacacgggacgggggacggcaagcccgggagggcgaggagggancnaaagcaangccaancgggggagaaccagcgagccagcagcagcagccacgcanncacgccaacaaggcaagggaagggaagnccgaacgggcagaggggaccaggaaaccgaaaaaaaaaaaaagaaaaaaaaaaaaggaaaaaaacaa

SEQ ID NO: 59836 - DNA, 300 bp, Zea mays
  unsure at all n locations
  Clone ID: LIB3069-030-Q1-K1-H7
ccggccnccccgaaanaagcggaaagggcaacccggnccacgggacggagcccccaaaccgaacccncccgagcacgcccggcgaaggggancacgagcaggccggagccgcgggacagccngcnggggnaccaggagaacaacgcggaggngncgaacgcggcgccggcggggcaggngcgggcggcgcaggagaaccgggaccagcaggccgcgcagcagcccgggggcgcgggagcgggcgcggacgacgacggcggggaccggcacgcggcgacgggccccggcccgggcccgggc

SEQ ID NO: 59837 - DNA, 311 bp, Zea mays
  Clone ID: LIB3069-030-Q1-K1-H8
cccacgcgttcgcccacgcgttcgcaagcagtgaagaaaacaagaggctaaaaactccagggacttctccatcaccttctgatccgtcactggaaaaaccctatcagattgggacatcatcttggataaagaaaaggatcaacacctatgcacttgagcaatttcttgcgttatcagtgaagttctgcaactcgattgggttccggatggcttgcacaatcacccttaagacagcaacgaacagcaccagatcatggcatgtgcgtgggactgcatacaaagtgcatcgctacatcatcggagtgggctgg

SEQ ID NO: 59838 - DNA, 277 bp, Zea mays
  Clone ID: LIB3069-030-Q1-K1-H9
aaaaaaaaaaaaaaaaaaaaaaaaatttaattaaaaaaaaaaaaaaaaaaaaaaaaaaaaggaaaaaaaaaaaaaatagaaaaaaaaaaaaaaaaaaaaaaaaaaaaaaaaaaaaaaaaaaaaaaaaaaaaaaaaaaaaaataataaaaaaaaaaaaaaaaaaatataataaaaaaaaggggggactttttaaaagttccaagtttatacttcccttattttgaaaaatttatttttttttttgggtcaaaaaaaatttttttaactgcctgttttt

SEQ ID NO: 59839 - DNA, 364 bp, Zea mays
  Clone ID: LIB3069-031-Q1-K1-A1
cccacgcgtccggcaccctttcatcagcctgcctgtccactgttggcttggtgacttcctccgctccgctcccctccgctcccgaacggtcgatctttgcatggcagcagcagctggctccaaggggcgggcgatcgctggaagcttcgtcagccgcgtcctcgccggcaaggccgcctcgccgaggagggccgtgcacgcctcggcgtacgacaagaacctggaggaacaggtgcgcccggcgttcgtgccggacgatgtgatcggcagcgccgggagccccgacaagtactggagcccccaccccaagaccggcgtgttcggcccggcggcggtggaccccaagctggcagctggtggcgcg

SEQ ID NO: 59840 - DNA, 214 bp, Zea mays
  unsure at all n locations
  Clone ID: LIB3069-031-Q1-K1-A10
acggaagaagccccaagcaagcgacactcttgtcctcttcgcgccagatcggtgnttatgagctcgaaggagaagcccactcttggaggcacgcggattaagacccgcaagcggaacattgcagctcctttggaccctgcatcattctctgatgcaattgttcagatttatctggataaaggtggagatctggaactcgtcgccaaaagtattg

SEQ ID NO: 59841 - DNA, 404 bp, Zea mays
  Clone ID: LIB3069-031-Q1-K1-A12
aaaaaagtacttgtatttcttttgttccatggtgtatgtggtggtgggcggctcagccgcgtgagtgcagtattgggcaaaccggaggctgcggcaaccttgtgcagttcggccacgaatatactagggaagatcgcgaccaatcaatcaatcgatgaccgagttcaattgttcagcattctttattagttttggtgggtggatacttcaatcggtgagccgaacagacagttgttttgagtatgaattgctctgcatctgcaaagttgttgtttgtcatccgtcgtctcaataaggcgaagggaagaaaaaaaacgcaaacattaatctatgttaaattagtgtggcaaaagttgaaacaatttttgccttttgacctctaattccaaaaaaaaaaggggggg

SEQ ID NO: 59842 - DNA, 383 bp, Zea mays
  Clone ID: LIB3069-031-Q1-K1-A2
cacctttcaaggcagttcttgatgaaagtccagcactacctcagacacatgctgcaccagctggttctttccaacccactggacctggtacggatgtgaaccctttccagcctgcttcagccgcaagctttggttttggagacactcttggtgatctcacttttgcaccaaatgctgcacctgagctgcaagatatgtttgcaaacacagcctccttgccttcagaggtagcaccagcaaacccatctgtggttctccaacagccagttcctactaatttctcctctcaggtatctcagccagttgctggcacattgcatgctgctcctacagcatttgctccttctcaggctcctgccacatcatttgctcattctcagggg

SEQ ID NO: 59843 - DNA, 371 bp, Zea mays
  Clone ID: LIB3069-031-Q1-K1-A4
cccacgcgtacgagtcaagttaccgtttcaaaggatgtttcttctagggaagcttcaaaggacgtcacatggatgggagcttcatggaaatgccaacgaagtctgaagcactacaaatctttctgccgtacaggaattactatctcggtgcatagctttgtatacattatgggtgaagagatgaacagacttattgcttatgtggaagatctctatgaggatacaaattcctgcaacatggtcaaggtacaatggtttggcaaagctgatgaagttggtgttctgttgcccatggattttgatgacagggagattttcttttctctgggacggcaagatctcaatgtaatatgtattgacggattggctgc

SEQ ID NO: 59844 - DNA, 316 bp, Zea mays
  unsure at all n locations
  Clone ID: LIB3069-031-Q1-K1-A5
caaagctaaaagtcttgaaagctattgcccaagagtacaatattgaatgggattcatcgaatactgaagcagaattcaacaagaaatatgaagatctactggacggctcgggatcttcggtccaccagatccatacacctatcattgagggctcagtgagctcaccagttgtttctgctccaagagataagactccagcattgaattcacctgtcattgatgccgaagaacaccaagttcgcgaatctccgacttcaccagctggaggtgcaagagctggtgttgtcactaanggcaatgtggtaaccatgggcca

SEQ ID NO: 59845 - DNA, 373 bp, Zea mays
  Clone ID: LIB3069-031-Q1-K1-A6
gagaggggaaggtcagcgtcaccagcaaccccgtcaggacctcgacctcaccgtcggcgacttctaggaggatgagatcgaccccgagctgcgctagtccttacagcgaaacagcagggtcctcgccatttcgggggattgttaccctgtccctggaacacgctgaacacgaagcagctgccagaggcggagccccctgcgaacaacgagctgctcacgacgaagcacgcgagagggggcggcgcgtagggagcccccacactggcaactcatccttggcttatgcgaattggcggacacccactggtttgggtgatgctgtcggtctgcgccagatgccctccactgtcgtcgatgtcagatcactgcctat

SEQ ID NO: 59846 - DNA, 356 bp, Zea mays
  Clone ID: LIB3069-031-Q1-K1-A7
ctcattattattgcgaaacttgaatagaaaagttttgacctgtcttacgaagcatttatagttattattgaaaaaaaaaaaaaaaaaaaaaaaataaaaaaaaaaaaaaaaaaaaaaaaaaaaaaaaaaataaaaaaaaaaaaaaaaaatgaacataaaacacaaaaaaaggggaaccttctaaaagatgcaaagctccgatgcgaacaatgagatgctaacgatgaagcacacgagaacgtacatgaaagtaaggagcccccatactagaaactcatacttgggaaaaccgaattggcacccaactaaagcctttggcgataaattccctttttaccagatgccctaaaatggaa

SEQ ID NO: 59847 - DNA, 374 bp, Zea mays
  Clone ID: LIB3069-031-Q1-K1-A8
cccacgcgtccggtgtcatccgcatattggatgatggggaaattaaagtcctccccaatcgggaggggagcttgagcatgtcaatgttttttccttgttaatgatggattgcaaaaggtacatagcaaggacaaaaagcaatggggacagtgggtcaccttgtctaactcctctttggcagcggagacctttccgggcaccccattaagaagcacttgagatgttcccgagtccatgatcatatttatccactaatgccattttggtccaaatcctttgtgtgtaaaaatgctcctgattaccggatgctccatcttgtcaaaagatttctcgaaatctagtttgaagataaccgacccttttttactgcttac

SEQ ID NO: 59848 - DNA, 368 bp, Zea mays
  Clone ID: LIB3069-031-Q1-K1-B1
caccttccctcctcccttctccaatcatccctttctggctttctcctcccccctgagaccccgagtcctgccggaatccgagatcccggaggcagcttcccacgggctcctctcactacggtagctggatcaaaccatcgtgctctcgtctcgacagaaaccccggccgaaaacccagccctgttcgccgcgcgcgcggtgcccaggccgtgccagatctgcgagatccgcgccgactatcaccaggtggatgctctcgtgatctctcggaggccgcggggactgagcagcgtctcggcggcggcgtggcctgcatagctgttggcttgccgagatgcaacggaacggggtggtggaatgcagcgtgt

SEQ ID NO: 59849 - DNA, 370 bp, Zea mays
  unsure at all n locations
  Clone ID: LIB3069-030-Q1-K1-H2
agcgccccgnagngcagngcagngcagcagngngcnaccnccncagnccncncacaccaggacaagcgccagncagccgcaaaagcgcggagcgaggcncagaagcgaaggcgnccaagaggcngcagcnggcggcgcagngcgaggaggcggcggcgcggcgcgccgagcggacggaggcccacggccnggaggacggcgcaagcagcgacgcgacgccggagaagcagaccnncnacaagcccgaggccgcggcgcacccggaggcccaggacgcngagcacaagcccgccgnncaccaggccgcgaagccggaagccacggcgagcccgaccaccaccaccggcaccacggcggcggcggcgggcac

SEQ ID NO: 59850 - DNA, 416 bp, Zea mays
  unsure at all n locations
  Clone ID: LIB3069-030-Q1-K1-F12
agaggggaagagagagagagagacttttgggggagatgagccggagcctgnggagccgggtgaagttgctccatgaggcagcgggtcacgtggtgacggtggagctcaagaccggcgaagtgtaccgggggtccatggtcgagtgcgaggataactggaattgccagctcgagaacattaccttcaccgccaaggatgggaaggtttcgcagctggagcacgtcttcatcagaggaagcagagtgagatttatgattatacctgatatgctcaagaacgctcccatgttcaagcgcttggaagcgagaattaggggcaaaggatcagctattggagttgggcgtggacgtgcagttgcaatgcgtgctcgggctgcttctggtcgtggtggtggtcctgttgggcgaggcagcgcg

SEQ ID NO: 59851 - DNA, 100 bp, Zea mays
  unsure at all n locations
  Clone ID: LIB3069-030-Q1-K1-F2
cccacgcggccgaacagagaaagcnganganacagannnggngangnnganaggaaagggncaggggaaaaaggaacacagacnacaggccgaaggaaga

SEQ ID NO: 59852 - DNA, 366 bp, Zea mays
  unsure at all n locations
  Clone ID: LIB3069-030-Q1-K1-F5
cggacgcgngggcggacgcgngggncgacccacgcggccgcggacgcgngggcggacgcgggggcggncacagaggccgacaggaagaacgannngncgccggagaacgncaagacgnccggcgnancccgcgacggggaaaagagnaaggcacgagagcagnngccnggaaaggcgacgcaaaaggggcaggangaggcgcngacgnacncggcccgggaagcgccaccggancccgggagaaggaaggccaaaggagggaaaacaacaaagagacccagcagcagccggctgcagaagcttggcaagagccgggttaccaaattcgttcttcaggaaatactgagcatcaccattgaagaattt

SEQ ID NO: 59853 - DNA, 262 bp, Zea mays
  Clone ID: LIB3069-030-Q1-K1-F7
cccacgcgtccgctctcagacagcataagctcacatcggcaataaaaaagcatgcccgtgtcccctgattctctccgcccagctcagctcagctccccgccgctcctctccgcgccccttcatcccggatctcggcatgggcaccgccaccaccaacggctcggcggagcaggcgtccgcgcccgtgccggcgctcaagttcctcatctacggccgcacgggctggatcggggggctgctgggcggtgtgtgcgcggcgcgc

SEQ ID NO: 59854 - DNA, 365 bp, Zea mays
  unsure at all n locations
  Clone ID: LIB3069-030-Q1-K1-F9
cagccgccgtcatgtcgaagcgaggtaggggaggttcggctgggaacaagttccgcatgtgactgggtctaccggtggcggccacggtgaactgcgcggacaacacgggcgccaagaacctctacatcatctccgtcaagggcatcaagggccgnctcaaccgccttccgtccgcctgtgtcggcgacatggtcatggccaccgtaaagaagggaaagcccgacctcangaagaaagtgatgcccgccgtcatcgtccgccagcgcaagccgtggcgtcgcaaggacggtgtctacatgtacttcgaagataatgctggagtgattgtgaatcccaagggtgagatgaaaggttctgcaatcact

SEQ ID NO: 59855 - DNA, 99 bp, Zea mays
  unsure at all n locations
  Clone ID: LIB3069-030-Q1-K1-G1
tcgnccacgcgttcggccacgcgttcgaagagatcatactagcagcaaagaggtaagaaaccttggcaagccaatcgatttagcaagcccgtactacat

SEQ ID NO: 59856 - DNA, 401 bp, Zea mays
  unsure at all n locations
  Clone ID: LIB3069-030-Q1-K1-G10
gctttagcgatggtcctgttcatggctggcgccgcgctgctcgccggggctgccggcggcggcgcgcagcaaggcgggtggagcatcatcacccggcccatgttccagagcatgctgagccaccgcggcgacagcgggtgccagggcgccttctacacctacgacgccttcatcgaggccgccagcaagttccccggcttcggcaccaccggcgacgagcagacgcgcaggcgggagctcgccgncttcttcggccagacgtcccacgaaaccaccggtggatgggcgactgctccggatggaccgtttgcctggggatactgccgggtgaaggaacagaaacagacggacccaccctactatggacgaggacccatacagctaactcataagtacaacta

SEQ ID NO: 59857 - DNA, 378 bp, Zea mays
  Clone ID: LIB3069-030-Q1-K1-G11
cccacgcgtccgctcacgcgtccgtttacgcgtccggccacgcgtccgcccgaagccgaggcatcgaaccaccccggggcgagccgcaagcaagcagccaagcagtgtgaactgaccgttcgttccgtccaggccaccatggaagcgccgccggtaccggagctcatggatctggacgcgcccccttccgtcgcagccgacgccgcagccgcggcgccggttccccctgccgtcagcgacaagaagaaagaaagggaaaggggagacactgttacgggccacatcatcttcaccaccatcggtgggaagaacggcgagccgaagcggaccatcagttacatggcagaacgtgtcgtgggtacgggctcatttgggatc

SEQ ID NO: 59858 - DNA, 363 bp, Zea mays
  Clone ID: LIB3069-030-Q1-K1-G12
gttatgagcgaaataatccataatgtatcctacatgctttattactttgaaggaactcggggttccagatgcttttatctcatcagtgactgctggggtaataccatcttgtaaagcccttatctgtgttcctaatggcctgggtgcaatatgcctcaataatcaaggacttgaggctgtcagggaaacttcagcactgcgatttcttgtagataccttcactagcatgaaatacttgataccaatgaatgagggtgtggtccttctagctaatgcagtggaagagcttcttcgtcatgtgcaatccctgagaagtattgatgttgacatcattattgaaataatcaatagactaagttcgtc

SEQ ID NO: 59859 - DNA, 365 bp, Zea mays
  unsure at all n locations
  Clone ID: LIB3069-030-Q1-K1-G3
gactagntctagacgagattagttgaatttacatgcatatgtttccatcttaagaagctgtccgcgacagaagtctacaatgatgcctccatggtcgtcgccggcggtcaagccaagtaggggatgcaggaggaggggtcccgcggcgaggatgagtggatcaagtgggctagaggcaagacttggccatcccttggctcatggtcgcggggttgggcgctctagtgtggcgcgagctccgtggttctactgtgggccacaccagcgtgggagctctaacgcgtggtggagttgcctctgttgggtgggcgtggtgtgatgttaagaaggtggcagccggcggcccgtatcggggcggttggtgg

SEQ ID NO: 59860 - DNA, 368 bp, Zea mays
  Clone ID: LIB3069-030-Q1-K1-G4
caagaaaactagaaaaggctcctcccgaccgcaacgcccctcatctccctcgaccccgggatccccgacccgatggcgcccaaggcggagaagaagccagcggagaagaagccggcggccgaggagaaggcggagaagacgaccgcagggaagaagcccaaggccgagaagcggctgcccgcgtccaagtcctccggcaaggagggcggcgagaagaaggggaagaagaaggccaagaagagcgtggagacctacaagatctacatcttcaaggtgctgaagcaggtgcaccccgacatcggcatatcctccaaggccatgtccatcatgaactccttcatcaacgacatctttgagaagctggccgg

SEQ ID NO: 59861 - DNA, 366 bp, Zea mays
  Clone ID: LIB3069-030-Q1-K1-G5
tccaattcagtatactctaatgaaagatcctgtgacactgccatcgtcaaaggtcacaggggaccggcccgtaattatcaggcatctgctgagtgattctacagatccatttaaccgctcccacctcactcaagacatgctgataccaaacacggagctcaagttgcagatcgaggagtttgtccggtcccagcagtcgagaaagcgaactgctgcggcgttgctggagattggcgaagcggagggtactgatgatatggccgaatgaattgtgccaggagcaagggatggacacattttttttgtggggaaagagtgatggttaattcacatgaagtgtatcggtccatctgtccgtataaagtt

SEQ ID NO: 59862 - DNA, 347 bp, Zea mays
  unsure at all n locations
  Clone ID: LIB3069-030-Q1-K1-G7
ccgagangnncaggaggagcaacagngggatcagcctcaagttcgatagccctagccccggcggtggtgctgctggcaccatgtcttctgcgagatcattcatgtcgtcgttgagtatagacaggagcatggcgagcttggatgggaagcggccgttccatttggtaggcaccccggtggcgagcgacccagcagatgcgcaccgtgcgcccaaacggcgatgcacgggtagaggggaggatggaagaggcaagtgtgccactactggcagatgccattgctcaaagagaatgaaactgcggattaagaggtccattagagtgccagccattagcaacaaaatcgct

SEQ ID NO: 59863 - DNA, 320 bp, Zea mays
  unsure at all n locations
  Clone ID: LIB3069-030-Q1-K1-G8
ngcgccggngcggcggagggagaagagnggcggcggcgggccggcggcgagnacaggcgagggcccgagcagaggccccggcaaacgcgcagcgcacacaaacacacaccagcccagcaccgagagaacagccggcggccggcgagaagagccgcggcacgggcgcggggaaggaccggcacaacaccaggancgcccccgagggacgccngnaccaaggcgaggacgcgnncaaggcggagaagacagccggaggcacggcgaacggcgnccgcggcgcggacaccgacagcggcgacacccagaagaaagccccggac

SEQ ID NO: 59864 - DNA, 345 bp, Zea mays
  Clone ID: LIB3069-030-Q1-K1-G9
atgacgtctcgcccaatgaaggggatgctgactggcccagtcacaatcctcaactggtccgtcgtccggaatgaccagccgaggtttgagacttgctaccagatcgctcttgcgatcaagaaggaagtcgaggatcttgaggctggtggtattcaggttatccaaatcgacgaggctgcactgagagaagggctgccgctccgcaaggctgagcatgcattctacttggactggggctgtccactcttcagaattaccaactgcgagatccaggacaccacccagatccacacccacatgtgctactccaacttcaacgacatcatccactcgatcatcgacatg

SEQ ID NO: 59865 - DNA, 179 bp, Zea mays
  unsure at all n locations
  Clone ID: LIB3069-030-Q1-K1-H1
gcaagaagaacgacgncgcccgcggcacngcacaacggcncagncgaggcacccaangcggaccggcaccagngagaagaggcggcaaanangggccggcnccggcacggcccgggggggacnacgagcacaggcgcancgngannaacaagcncggcgggagggcgccagcaagcaac

SEQ ID NO: 59866 - DNA, 436 bp, Zea mays
  Clone ID: LIB3069-030-Q1-K1-H10
cccacgcgtccgcccacgcgtccgttcacgcgtccgagacgggcctgggcgtcggcgtcggcatctcgctcttcaaggtcctgctgcaggtcacccgccccaacgtcgtggtggagggcctcgtcccggggacgcagagctaccgcagcgtggcgcagtaccgcgaggccgtccgcgtgccgggcttcctcgtcgtcggcgtcgagtccgccgtctacttcgccaactccatgtacctggtggagcgggtcatgcgctacctccgcgacgaggaggagcgcgcgctcaagtccaaccacccctccatccgatgcgtcgtcctcgacatgggcgccgtcgcggcgatcgacacgagcggtctagacgcgctgtccgagctcaagaaagtcctggacaaaagaaacatcgagctggtgcttgccaaccccgtggggtc

SEQ ID NO: 59867 - DNA, 393 bp, Zea mays
  unsure at all n locations
  Clone ID: LIB3069-030-Q1-K1-H11
agcgcagccatctcctgaccgcacattagccaccccacgtcttgctcaccgtcgggcagaggagccgtgccgcgctcaccatcgctcatgtccaaaccatcggcgtcccggccatgtatcaagattgcaatccgtttccgagcttcgaggaatcgaagatcaagagttggcgaccaagtgatctggttcttcgagttctatgaggctggagatcctgagcatctgtttggtgaaggttgcctttggtgcaatctatgctcaagtaaagaagaaggcgttgaggcggatctctaagagttccaggacttttgacgagttcgaggattaggctagcgaccacccncactcagctgcctgtggtgggtttatttacgttggctacgtttctattct

SEQ ID NO: 59868 - DNA, 354 bp, Zea mays
  Clone ID: LIB3069-030-Q1-K1-F11
cggacgcgtgggcacgcactgctagttagcgagcttagctactgatcgtcgacaagcacggtctaactcgatctctggaagcggctagctgctaacagccaattaatggcgaagccttcgcaggtgctggtgtcggcgctcgccgcctgggcggtggtcctgctgctgctgtgcgccgacgagccagggggcgccgacgcggccacggcgtgcgacgccgcgcagctgaccccgtgcgctgacgccatcatcgggagcttcgccgccaccgcggcgtgctgcagcatgctcagggagcagcagccgtgcctgtgcacgtacgcgcgcgaccccaagctgcagcgctacgtcagc

SEQ ID NO: 59869 - DNA, 414 bp, Zea mays
  unsure at all n locations
  Clone ID: LIB3069-030-Q1-K1-H12
cggacgcgtggggccgcggtccatttcgtctgaagaccctcctcctacctaatgagttggctctgtcgtgacgtgaaatgccagcgcgcagcttcttgatccgttccggctgatcccgtggaccggacttggggttgggggaggccctctgtctccatggatgaggcagcagggctgctgttgcaagaagagggtggaggtggggaccaagaagctctcctccttccacttccacaggatgttggcctttacacaggtgatggatctgttgatgtcaaagggcgccctgcgttaaagggcactacaggcaattggaaagcatgctntttcatcctagggaatgaatgttgtgaaaggctggcctactacggaatngcantaaacctagttacttatttgaaagtgaagcttcat

SEQ ID NO: 59870 - DNA, 323 bp, Zea mays
  Clone ID: LIB3069-030-Q1-K1-D2
cccacgcgtccgcacagccgccgccgccgtcgccaccgccgcacggggccgcccggcgcggcgggggaggtggaggggggtggtactggcgcgcagtcgcgttcccgctcgtcgtcgcgctcggctgcctcctgtccttcgccttcatcctcgccgtcgtttccgcgctctaggcaagcggaagcaagtgcttcttcgttcaggccacatgcattttcacgcctcaacaatatttacctttgctgttagtggttcatccggtattctgtttcgtactgaactccttcgtgtcatgatatcattgcactgcaaggaaaaaataa

SEQ ID NO: 59871 - DNA, 202 bp, Zea mays
  Clone ID: LIB3069-030-Q1-K1-D4
cccacgcgtccgtatatatgtacgtaaagatagacaggcataagacgacgtctctacctagctagctatagctgctgaatacatacatatacttgtcgatcgagacgtcgcttgtgacgtccgtccagtgcatgtataatccaacaacagatcgatcgaagatgattcataatgcactggacggacgctagttctagatcgc

SEQ ID NO: 59872 - DNA, 62 bp, Zea mays
  Clone ID: LIB3069-030-Q1-K1-D5
aaaaaaaaaaaaaaaaaaaaaaaaaaaaaaaaaaaaaaaaaaaaaaaaaaaaaagggaaggg

SEQ ID NO: 59873 - DNA, 434 bp, Zea mays
  Clone ID: LIB3069-030-Q1-K1-D7
gtttggatcaaagcttaaagagcacatgcagtactgtgtggaccaccctgaggaggttagcaagcttgccaaggtgaaggcccaagtctccgaagtcaaaggagttatgatggaaaacattgagaaggttcttgaccgtggcgagaagattgaactgcttgtcgacaaaactgaaaatctgcgttctcaggcacaagatttcaggcagcagggcaccaaggtgcggcggaagatgtggctccaaaacatgaaaatcaagctgatcgtcctgggcatcatcatcgcgctcatcctcatcatcatcctgtcggtgtgccatggcttcaagtgcggcagcaagtgaagaaggggacttacagatggccgtgccctgccctgcccttgcctggcacctgcgagaaggaagagacttcatgtggaggtttttttttttg

SEQ ID NO: 59874 - DNA, 349 bp, Zea mays
  unsure at all n locations
  Clone ID: LIB3069-030-Q1-K1-D8
cggacgcgnngggaccnggcgnacaggaggacgacccaacccaagcggcacacaggaaggaagaggangccgccgccgccgccgagcgggccgcnggcgcagccgcaggacccgaaccacgcggcggcgcaggagggccggnaccgcaacagccaggccggggacgccgacgcggccacggcggcggaggcccggggccggcacgcgccggggcacgaggccgagaccgccgagcacgacgaccggcacccggcgcaggagcacgaggccgcgaccaccgacgggccggaccacgnggaccnccaggccggccgacgacgcgggcacgccgacaccaacgccggcgcgg

SEQ ID NO: 59875 - DNA, 389 bp, Zea mays
  Clone ID: LIB3069-030-Q1-K1-D9
agcccaccgaattccctgcgattcctctcccctcgcctcctcgtctccccctaggggatcgtcggagaggaatcgcaaagagggccgtctcatccgagttaaggaagccatggagcacaaggaggctgggtgccaggcccccgagggacccatcctctgcatcaataactgtggcttcttcggcagcgcggcgaccatgaacatgtgctctaagtgccacaaggagatgataacgaagcaggatcaggccaagctggctgcctcctctatcgacagcatcgtgaacggcagcgacgccgtcatggagccggttgttgctggcagcaacacggtagtagctgttgcccaagtcgagttgcaaacaatgaacgtgcagcagcccgctgatg

SEQ ID NO: 59876 - DNA, 368 bp, Zea mays
  Clone ID: LIB3069-030-Q1-K1-E1
gcaggccaacccacccccaccccctgcactgcacacacaatccccccatggcctctgctggagctgctgctatataagcgcgacccggacggctctgcttccccagtagtcctctcctcccatccatgcttcggtccacgcacccacccagccccaccagcggcagctccgcggcgccggcgtccaactccgacgccgcggcgatggtcgggggcggcgcggcggcgggcagcggcggcgcaccgagcggcgccaagctgctgcagatcctcaacgtgcgggtcgtgggcagcggcgaccgcgtggtggtgctgtcccacgggttcggcacggaccagtcggcgtggaaccgcgtgcttccctacctt

SEQ ID NO: 59877 - DNA, 153 bp, Zea mays
  Clone ID: LIB3069-030-Q1-K1-E10
cgggaattaggactatgctggaggttaagtggaaattagaactatgttgttcttttggtgtgtaataatggctttgctatgtcgaaatactgggtttgttatgaaatattgggtttgttatgaccaacacggatgctcggtttgtttgttttg

SEQ ID NO: 59878 - DNA, 382 bp, Zea mays
  unsure at all n locations
  Clone ID: LIB3069-030-Q1-K1-E11
gtggtgttgggattgatgattggtgtttgaatgagcagttctgggtcattggaggtgtggcctcgcacctcttcgctgtgtttcagggacttctcaaggtcatagctggtgttgatacaagcttcaccgtgacatcaaagggtggagatgatgacgaattctcagagctgtacacatttaaatggactaccttattgatacctnctaccactttgctcctattgaacttcattggtgtggtcgctggtgtttccaatgcaatcaataatggatacgagtcatggggccccctcttcgggaagctcttctttgcattttgggtgattgtccatctgtatcccttcctcaaaggtttggttgggaagcaaaacaagacaccgac

SEQ ID NO: 59879 - DNA, 417 bp, Zea mays
  Clone ID: LIB3069-030-Q1-K1-E2
ataaaatccaaatttctcccagcgaaggcacacagccgccgccatttcttcatcctcccgtctcctgatctccatctgcctcgcagcgccggcgatccatcttccgctgcctcccttcctcgcgctcgggctctcagtgacggcatcagcggtttcccctgccgcctatcgccagtcgcatcacgccctcgcctccggtccaccgcacaccggccggtcaccctgcattacttgctaatctttcctgagggcagatggccggtgcttttgcaaatgtcaacgctgaggcagggctgaaaaagcttgatgagtaccttctcactcgcagctacatcactggctaccaagctttcaaggatgacctggctgtctactcttcatttttggttgatccctcattcaagtatatcaatgtag

SEQ ID NO: 59880 - DNA, 360 bp, Zea mays
  unsure at all n locations
  Clone ID: LIB3069-030-Q1-K1-E3
cacctccccacacgggcacacctgccctccccgncgccgcggacccactcccatggcaaagctccggcgtctaccctgctcgtttgccgttctcgcgctcatgtgcatcatcccgctcacagcgccgcggcctgcactgtcctcgcgcgcggccccaagggacggtgtctccttcgccggcgcaagcaacacgatacatcaacttcttaaagatcacggccttcccggaggactgctcccgcgcggcgtggagtcgtacaccctggacgagtcgaccggcctgctggaagcgcggctgtcggcgccgtgctacgccacgtacgacaacggcgaactggcctacttcgacaacgtggtgcg

SEQ ID NO: 59881 - DNA, 357 bp, Zea mays
  Clone ID: LIB3069-030-Q1-K1-E4
gatgtatgacgtcgttgtccactttgtttctgggtggcgtcaagatgggaccggccgtggtatgtgactgtggtaagtatgcgactaaggagctgtagtgtgttcttccaaccacatgcactagcactgtgggtttgctttgggcagctgcaagatttggaaatttatgaatgcgatgatcttgtctactggccggagaaagtattccaaagcttgatttccttgcggaggctagagatttacagttgcaagaacctaattggatacgcagcggcggtggcgaatggtcctgaccaggaagcaatgagccagttgcttttgccccatctagagtctctaaagatattggggtgtgaa

SEQ ID NO: 59882 - DNA, 355 bp, Zea mays
  Clone ID: LIB3069-030-Q1-K1-E5
cggacgcgtgggccgtgaacggcaacttgactgcagggttggagtcctacaagcacaaagccgcaaaagctgccatggattatggctttcacatggccattacaaagtggaatgatgaggttgcaagggaaatggaagtgatggttaaagaacatgggataaattctttcaagtttttcatggcatataaaggctccttgatggtcactgatgacctcctcctgcaaggcctacggaaatgcaagtcgcttggtgcccttgctatggttcatgcagagaatggtgatgctgttgccgagggacaacagcggatgattgaccttgggataactggtccagaagggcatgctctctc

SEQ ID NO: 59883 - DNA, 199 bp, Zea mays
  unsure at all n locations
  Clone ID: LIB3069-030-Q1-K1-E7
ccccgaggaagacgcggagcacggcngcagcngcngcngcaaggaagcgggcaacggagccngctccggcgaaggcagngccggccaagaaggaagacgaggcagcggnngccgagnngaaagggaggaagaggggcaagaaggaagccgaggcggagacggcggccaccgagccgaaagggaggaagagggacaagaa

SEQ ID NO: 59884 - DNA, 207 bp, Zea mays
  unsure at all n locations
  Clone ID: LIB3069-030-Q1-K1-E8
cggacgcgngggcagcagggaagcanggcaaagggccaacannnaanaccngggaacggccacnnnggggngccaggngggacaangggnnnacanacnangaagnaaaccgcaggcngaanaaggcaacgcaganggcngcnggcanaagagancgancaaancagncngacangagggcagacaggaaggcannnaaccganggg

SEQ ID NO: 59885 - DNA, 402 bp, Zea mays
  Clone ID: LIB3069-030-Q1-K1-E9
atagatttggttttactcaagggccttctacgggagcacgagtaccagatctatcgtgtgaaatatccgtgttcgtgacaatttcacactctcctaacatggtatcacttgtttgaagtacatctaattattcactcttgtttgaagtacttcatttctttttattcggcatcttagattctgggtgattttggtttttatagggcagacctggtgcagtagtgagagctgtttcaccaagtcaccaagtcatgggttcgaagtaacctcttcacattttcgtgggaaaagcttgccttggtttatccctttccgagaccccactcatgtgggagcctccgacattgtgtctaccctttttataagcctacactcgtttcaaagcatgcatatactgctttc

SEQ ID NO: 59886 - DNA, 402 bp, Zea mays
  unsure at all n locations
  Clone ID: LIB3069-030-Q1-K1-D12
tccccgtattgttggtgaaggccttgtgattgacgaatggaaggaacgaagagagaggtgccttgctcgccagcagattgaaggtgttgattcggtgtagacacgaggcagccctgtaaactatgcagaatgaacataccgttttatgggcacgcactccagctgtcaaatggatttggagcttgattttgcgaaggttcggatttggagcaatcaagcaacaatgaggcttttgtgtatttggggttcacgctgaacttctgtcctgggtttgggtgtgtgtagataagcagccactgcttggtaatagtacgtccttcagccatgtactcgtgttgntgaatgtgggtctctatgtgaatgtgatgcattctctagctgctgtcctgtcaacattaaaag

SEQ ID NO: 59887 - DNA, 388 bp, Zea mays
  unsure at all n locations
  Clone ID: LIB3069-030-Q1-K1-F1
gagaacattgagaaggatattgagagggaaaggcggagaaaggacaaccctgaggcgatggangaagatgaagtggatgagatcgccgagatcagggcccctcacttcgaggagtcgatgaagtatgctcggcgtagtgtcagtgatgctgatatccgcaagtaccaggcgtttgcccagactttgcagcagtcccgggggtttggcagtgagttccgcttctcggatcagacggcgacagctggtgctgctgctgcagccgatccgtttgcttctgcgggtgctgcggctgatgacgaccatctatacagctagttgggttgctcaatatcagtcccgtcactcatctgtttaaaactgatcattcttaacacgcatgttatgcaat

SEQ ID NO: 59888 - DNA, 423 bp, Zea mays
  Clone ID: LIB3069-054-Q1-K1-C8
cccacgcgtccggtggatgaacaaactgtaagagcttcacacaccctagcagagagcagcgggacagctagcattccagtgactgtacctgaaggaactcatcctgatcaaacaagtgatcaagtgggaatcaatggaagcatgaacccatgcatccatccaatggtttctgcagacccaaaatttggtagtagtgccacaccacagacttttcctcataattatgctgcctttgctccaatgatgcagtgcaactgcaaccaagatacgtacaggtcattcaccaacatgtcatccacgttctccagcatgcttgtttccacgttgttgtcaaaccctgccattcatgcagctgccaggctcgcagcatcatactggccagcagctgaaggtaacactcctattgatccgaatcaagaaaac

SEQ ID NO: 59889 - DNA, 366 bp, Zea mays
  Clone ID: LIB3069-054-Q1-K1-C9
cggacgcgtgggcggactcgtgggcggactcgtgggcggacgcgtggtgagccgaatagggaggttgtgatagcagatagcggcgagctgccgatgtgaccgccagcttaactgatgttccatcccgaagcatgattataagaaattgctggtagccgtctgtcgttctagaactggtaggccctggttggaatcttagtattttaccgatttgaaagaatgctatggtattggatgatactatggtatagaaagtcaaaaactggttgtttgtatcaggtaaaacgctgtttcgaatactatggtgtacctaccaagctacaaacccgaatatttttacagtattgaaaacttcacttggacttc

SEQ ID NO: 59890 - DNA, 416 bp, Zea mays
  Clone ID: LIB3069-054-Q1-K1-D1
agaatcgtctcgctcgtggctgccctgctcatactgcttgccctcgccgtatcgttcaggcgcggcgcacaggaggattccatgggcgacaacaccgggacgttggcgggcggcatcaaggacgtgccggtgaacgagaacgaccttcacctccaggagctcgcccgattcgccgtcgatgagcacaacaagaacgccaatgctcttctggggttcgagaagcttgtgaaggccaagacacaagtggttgctggcacgatgtactatctcactattgaagtgaaggatggcgaaatcaagaagctctacgaagctaaggtctgggagaagccatgggagaacttcaaggagctgcaggaattcaagcctgttgaagagggtgctagcgcctaaggatctctacttatacatgtgcg

SEQ ID NO: 59891 - DNA, 357 bp, Zea mays
  unsure at all n locations
  Clone ID: LIB3069-054-Q1-K1-D10
aattcccggtcgagcacgcgttcgcggacgcgtgggcaaaaagtcctagtttactatttttggatacattgttgataaaccctcggtgtaaacacatagttggtgacttgctgttctgctgtccaaacacatgtctactggctgaaaatagctcattttggaggtacatttgcatcaagctttgatgaatgctggacaaggatgatatgggcctccgcccaaagctgtctgggattcagaaacaggttttggcgctgtacaggggattccttcggacagcacgccttaaggcccctgaagaacgccgcangatcgagtctggtatcttggcagagttccgtgacaacgcaaggagtg

SEQ ID NO: 59892 - DNA, 451 bp, Zea mays
  Clone ID: LIB3069-054-Q1-K1-D11
agcagcttggagtccagcatcatgacttcttcttcttcatcactcaccccatgtgaacgtgggatccggagtggcttgcaaagaaccacatgggtacagtttgaagctagtgatattacctacccaccaccaacggggtagcaaaacgtttacagtacaatgcgctggtgaaatgagtctaacaatcgcaggatagatttatacttgagtttactgctgcagcgaataccaaacatgtcggcactcaaaaaggttttctggttcttggttcttggcagaaaaatgtaactgatctgtacagaagttttgcaactaatttggtatccaatgtgggggttgagctgttgcttgtgaactttagtaccctagagaatgttagttccaggatgaaactgtttacgcagactctagctggacctgaatctgtcgatgacaattagttatcttctac

SEQ ID NO: 59893 - DNA, 278 bp, Zea mays
  Clone ID: LIB3069-054-Q1-K1-D12
cgcagctccgctgccctgctctccacctcctccagacctccaccatggacgagccgccggtgcatccaccgtcccttccccatgccctcaccaccgccgagtaacaccttctcggtgctggagctcgaggcagcgatcgccgggcacgccgacttctgccacgcgctctgcaggcgcccgacgccggccacggccgaacggctcatcgcaacggtgccgcagctgcttcgcggcgcccacgccggcggcaaggaagaaaaaaccctggtggttgttga

SEQ ID NO: 59894 - DNA, 435 bp, Zea mays
  Clone ID: LIB3069-054-Q1-K1-D2
tcggccatgcgccttggaccagcatccaacaagaataatactggtggaccacaaccatcgagtgctatttaccagaacacccaaggaactgattctgatagtgatccgaacaatactactgtatttgttggcggccttgacccgagtgtgactgatgagcttctgaagcaaaccttcagtccatatggagagcttctctatgtcaaaataccggtaggaaagcgctgcggatttgtccaatattctaacagggcatcagctgaggaggccataagggtgttaaatggaagccagctgggaggtcagagcataagactctcatggggccgtagccctgcaaacaagcagcctcagcaagagcagagccaatggagtggtggtggctattatgggtatcctcaaggatacgatccatatggctatgctcggccccct

SEQ ID NO: 59895 - DNA, 119 bp, Zea mays
  Clone ID: LIB3069-054-Q1-K1-D3
tcggaacaatgttgacgctgtttttctcattggtcatgctaagttaatttaccatctttgtgatatgcataatgaactgattagcaaatgacctcagtaggtgaacccagttgtatgct

SEQ ID NO: 59896 - DNA, 171 bp, Zea mays
  Clone ID: LIB3069-054-Q1-K1-D4
ggtggttgaggttaatgttaaagtggatagtgcatgcacacataatgtgcataataatgctttgtatgctgaagagaagttgctcaaatctgagttgcaagcaatgcgtgattgcgacccttcatctgcccgccactggattgtacgcaacacacgaactgtgaatcggac

SEQ ID NO: 59897 - DNA, 438 bp, Zea mays
  Clone ID: LIB3069-054-Q1-K1-D5
cggacgcgtgggacgcctcggcgccgttgccggcgtgcgccttctccaagccgttcggggacacctcgttccaggcgtcgctgggcagcgacacgctgcgcctgggcaaggacgccatcgccggctacgcgttcgggtgcgtgggcgcggtggccgggccgacgaccaacctgccgaagcaggggctcctcggcctcggccggggccccatgtctctgctatcccagaccgggagcaggtacaacggcgtcttctcctactgcctgcccagctacaggtcctactacttctccggctccctccggctgggagccgccgggcagcccaggaacgtccggtacacgccgctgctgaccaacccgcaccgtccgtcgctctactacgtgaacgtgacggggctcagcgtgggtcggacctgggtgaaggtcccccgcgggt

SEQ ID NO: 59898 - DNA, 436 bp, Zea mays
  Clone ID: LIB3069-054-Q1-K1-D6
gtgcagggcgcgagcgcggagggcacgcccaagaggctgacctacgacgagagccagggcaaaacgtacatggaggtgaagggcacgggcacggcgaaccagtgcccgaccatcgacggcggcgtggagtcgttcccgttcaaggccggcaagtaccagatgaagaagctgtgcctggagccgacgtccttcaccgtcaaggcggagggcatcgccaagaacgccccgcccgagttccagaagaccaagctcatgacccgcctcacgtacacgctggacgagatcgagggcccgctcgaggtcggctccgacggcacgctcaagttcgaggagaaggacggcatcgactacgccgccgtcaccgtgcagctcccggggggcgagcgcgtgccgttcctcttcaccgtcaagcagctcgtcgtcaccggcaagcccg

SEQ ID NO: 59899 - DNA, 440 bp, Zea mays
  Clone ID: LIB3069-054-Q1-K1-D7
ggagggttggttccacaggaagcacttttatgctctcccaaccccaaccgcgccgccgggtgctgaagaaaccttctacaacggtcctgttcactatccatccatagactctacgcctgtcgatgtaaccatgccggctaccactggaggcggtagtacaacagtcatcgcaacggcagcacctacagaacagttagaaaatgaagctgatgcaagtgacagcggcaaaactccctctggtacttgcgttatatgtctggatgcccctgtggaaggtgcctgcatcccgtgcggccacatggctggttgcatgtcctgtttgaaggacatagaatccaagaagtggggatgccctatctgccgtgccacgattaaccaggttgttcgcctctatgctgtttgaggagttgaaacggtgggttcagaaagttggcaatgga

SEQ ID NO: 59900 - DNA, 438 bp, Zea mays
  Clone ID: LIB3069-054-Q1-K1-D8
gttgtcatggccgagactgctgagacctactacaactcgagcttctcgatgcagagtggagaaagatgttgggaagggtgataaatcaggggataagggaactgctgagaagtttgcaatatatcagaagcatcgttcttcgttggcagacactgttcaattcaggaggccagctgctccaacttccagtgtgaatgctgatattgtgggaacatccactctgcagtctgcatctctaccgaaacaagaatcctcaacagctacatccaagagctatactttcagagaaggtgatagggtgcgttatgtgggtccagctcagttatcctcattgtcacaaaggctcctctccttttgctggcttcgctgttggaagcgagacatcatgtggtgtggataacgtccttgcagagcacgtgaactcaaatttcactctaa

SEQ ID NO: 59901 - DNA, 276 bp, Zea mays
  Clone ID: LIB3069-054-Q1-K1-D9
attagcatgtcctaggaaaagaagtgacttatacttgttgcaatgacaagggcaactggtgttaaacatatcatattcatatgcttttgttcatttttcttttacaattccttgcatattaagcaaataattggtttaatattataaggagaaaattaagcaaccattggctttgtacccaggtgtatgtccggttcaaaatgaattttctgatcaagctgacaatacattttgcaatgctttgtcttaattgctgaaacattgtatcggtaacga

SEQ ID NO: 59902 - DNA, 438 bp, Zea mays
  Clone ID: LIB3069-054-Q1-K1-E1
ctagttgatgttgttgagggaaaagtaatggatgtattcaaggaggatcaagctgtgggggttgtcaagttcaatccaagcaaccccgatctcttcctatctggtgggtccaagggttcccttaaactctgggatattcgatgtggtctggtaacaaaagaatttcagagaagccttggaaccatccttgacattgacttcagtgctgatggaagacaatttatctcttcaactgacacaaccagaagcaatattagtgagaacactataattgtttgggatgtcctgcgacaagttcctttatctaaccaggtttataccgaagcattcacatgcccgtgtgtaaggtaccacccacgtgaagcatcatttgttgcacagtccaatgggaactacattgctattttttcagcaaggccacccttcaagctgaacaag

SEQ ID NO: 59903 - DNA, 301 bp, Zea mays
  Clone ID: LIB3069-054-Q1-K1-E10
gatcgtttcagtatcaacttccacgactcatcactcacgagcgaatacatctggatcaaaggacccactggccacacattactgcatagagagagtacacagacagaagcgcacacatcggttcatgcctacgtactctgctcgcggcaacatgcatccacgatacaccgtttacgaactgtgtatacaattgctaaacaccatgcatgactataaactttcacacattggtctagctcaaaatagccccatccctactgaacttcgcaacggtttgcaagatcttattgggattgggtac

SEQ ID NO: 59904 - DNA, 397 bp, Zea mays
  Clone ID: LIB3069-054-Q1-K1-E11
cccacgcgtccgctgctacggccgccgtcttttgcgtcgagttcccgctcattggcgttggcggggccacgctcatcgtgacgggccttgtcgcggccctgatgcgccggcggcggcgtccctggcaccaagcgccttttgtggaagggaaacccgcaccaaaagcaagctgcgcggtcagcgatggcgggacggacgtcatcatcgtcggcgccggggtagctggatctgcgctggcatacacgctcggaaaggatggccgttcggtgcatgtcatcgagagggatctgacagaacctgacagaattgtgggcgagctgttgcaacctcggggttacttgaaattaattgagctgggcctccaagattgtgtggaagaaattgatgcccaacgcgt

SEQ ID NO: 59905 - DNA, 434 bp, Zea mays
  Clone ID: LIB3069-054-Q1-K1-C7
cccacgcgtacgcccactcgtccgggctacgccgcgctgtacgtgggctaccggtcgtgcgccgacaaccacccgctccacgacaacaaccggtgggacacgtgggcgcggttcgtggagcgcagcgtggcgtaccagccgtgggtctggactgcagtcaaccacgagctggacttcgcgccggatctgtgcgagaccacgccgttcaagcccttcgcgcaccggtacccgacgccgtaccacgccggcgggagcacggagcccttgtggtactcggttaacgtcgcctacgcgcacgtggtcgtgctggactactactgcgcctacggcaagtacacgccgcactgggcgtggctgcaggcggagctggcgcgcgtggaccggaagaccacgccgaggctcgtcgtgctcacgcactcgccctggtacaacag

SEQ ID NO: 59906 - DNA, 440 bp, Zea mays
  Clone ID: LIB3069-054-Q1-K1-B10
ccggtctcctccgcccgttgccttcgtcctttccatctccggctgcgacgccggcgagccggacaccgcgaatcggatccgccgacaaggcgagagggaagagatggggctcacgttcaccaagctgttcagccggctgttcgccaagaaggagatgcggatcctgatggtgggactcgacgccgccggaaagaccaccatcctctacaagctgaagctcggcgagatcgtcaccaccatccccaccatcggattcaatgttgaaactgtggagtacaagaacatcagcttcactgtctgggatgtcgggggccaagacaagatcaagccactgtggaggcattacttccagaacacccagggtctcatctttgttgtggacagcaatgatagggaccgtgttggtgaagcaagggatgagcttcaccgaatgctgaatg

SEQ ID NO: 59907 - DNA, 382 bp, Zea mays
  unsure at all n locations
  Clone ID: LIB3069-054-Q1-K1-B11
gctagggttttccatcaccgccgccgccgtttcatccaaacccaaatcaagccaccacccgctcctcctcctcagcggcgagcaccaccagcgacagcgagacacgatgaggccgatcttgatgaagggccacgagcgcccgctcacgttcctgcgctacaaccgcgacggggacctcctcttctcctgcgccaaggaccacacccccacggtctggtacgccgacaacggcgaccgcctcggcacctaccgcggccacaacggcgctgtctggacctgcgacgtctcccgcgactcggcgcgtctcatcaccggatccgccgaccagaccgncaagctctgggatgtcagcacggngaaggagctcttcagcttccgcttc

SEQ ID NO: 59908 - DNA, 185 bp, Zea mays
  Clone ID: LIB3069-054-Q1-K1-B12
cggacgcgtgggcgacatctggcgcgagattagcggcgccggcgaacgcgagcccggccgggccgacgtgtacatagtcagctggaacgaccacttcttcgtgctcaaggtggagagcgactgctactacatcatcgacacgctcggcgagaagctctacgaaggctgcgacaaggcctacatgc

SEQ ID NO: 59909 - DNA, 418 bp, Zea mays
  Clone ID: LIB3069-054-Q1-K1-B2
ctttagcttcccatgcttcgtatgcatttaatatctactaccagcaaaatggagccagcgttgtggcctgtgactttggaggtgccggaatacgaacgacgaaagatccaagttatgacacttgcgtctatttggctgccggcaataagatgagcacgacgaactcaacatctattccagctcgcagcgactgcggtccagtcccatgcgccaaatgcttcgacactttgctccccatgctggccatcgtgatggctgcagttatggtgtgatctatggaaaaaaaaaatgctccagctagcctccttaagacctgagatgaaaggtgaattgcgtaatgctgctggtaaccattgaagttctgtttttgccatgagcagtagactagtagtagtctagtagagaggcaccttatgct

SEQ ID NO: 59910 - DNA, 412 bp, Zea mays
  Clone ID: LIB3069-054-Q1-K1-B3
cccacgcgtccggaccgacaggacgagtactcgcagctagctgacacggccgagaagcagcttgcattgcaggcgtagtacgtacccagcagcagctagcactagcagtccatcggagcgacgatggtgagaaggacggtgctggcggcgctgctggtggccgccgccctcgccggcggcgcgcgggcgcagctcaaggaggggttctacgactactcctgcccacaggcggagaagatcgtcaaggactacgtgaaggcgcacattccccacgcgcccgacgtcgccttcaccctgcttcgcacccacttccacgactgcttcgtcaggggctgcgacgcgtcagtgctgctcaacgcgactggcggcagcgaggcggagaaggacgcggcgcccaacctgacgctgcgcg

SEQ ID NO: 59911 - DNA, 226 bp, Zea mays
  Clone ID: LIB3069-054-Q1-K1-B4
cccacgcgtgcggtcttatgtgacatatctatccttggtatctagtacaagtgtttcggttggcgtgatggctcaattaacgtgtgctagtacgatgcatctagcagtacactgcagaagctcgaggttgacagaaccaacgcgttgaactgcgctttgaccatggtattctacgagctgcacggtcacgacagatgcgatatgcagacaacttgttgtgagcaca

SEQ ID NO: 59912 - DNA, 319 bp, Zea mays
  Clone ID: LIB3069-054-Q1-K1-B6
gaccttattgccatttgcaggcgtgctttccatcggtaccttccttggcggcacgacgttcctgaccggccttcttgctttcgccgccgctatgactgtctggctgcttgtgggcacctactgcatcaaaggtctcatagagttgtgattagagtatgttagacttggtgcagggggttcaagggtggcacagttttaagagctcaagcgtgggacagttatggctgcattgcattcctgtataacggattcttgatgttattcatgcacctatatgctgcaaaatccgaatgaatcgatgcacttgtccgttgattcc

SEQ ID NO: 59913 - DNA, 439 bp, Zea mays
  Clone ID: LIB3069-054-Q1-K1-B7
cggactcgtgggtccctgtacagaagcttgcaggtgacgttcgagctggtgaacgtggtgaaccaggtgatcaccaacgtgtcgaacaggaacttccccccgcagctgacgcctttgtactacaaccagtcggggccactgatgcctctgctctgcaaccccttcacgcctgatctgagggaccgcaactgcagcagaggagaggttaccttggacaacgcatcccaggtgtggaagaagtacgagtgccagagcaccaccgtctcaggaggagccgagatctgcgcgacggtggggcgtgtgacccccagcatctacgggcagatgaccgcggtcgtgacggtgagccaagggctgtaccagtacgggcctttcctcatccagctgcaggactgcaccttcgtgcgcgacaccttcacgaccatcaaccagggctact

SEQ ID NO: 59914 - DNA, 431 bp, Zea mays
  Clone ID: LIB3069-054-Q1-K1-B8
cccactcgttcggcaagagaacgaacatgtagagttttgactcttcaatcattcattcgtggtgagaatgcacggcaaatttactcctctttgttgaagaaacatatagccgcaattgttttgcagagaaatgtgagaagttggcttgcaagaaagtatttcataaatgttccgaaagcctaagtgatcatacagtctggtattcgtggcagtcttgatcgaagatgtaatggcaatattgatctaataaatgtgctaagagagtttgaatcagaacaggacgcacatggtgaccaaattttgatcaaggccttagtcctggctgagttacagaggctgatactaaaagccgaggccacagtacgtgaaaaggatgaagagaacgagatgctatatcagcggcttcagcaatatgaaaaccgcttgttaga

SEQ ID NO: 59915 - DNA, 349 bp, Zea mays
  Clone ID: LIB3069-054-Q1-K1-B9
cccacgcgtccgccacgggataatcatgattcacaagtacagtttgcattggagagaggggtccctgcatatattggtgtcctcggatcaataaagctgccatttccatctcgtgtttttgacatggcccattgctcgagatgtttaattccatggagtggaaatgatggtatgtacatgatggaagttgacagagtactaaggcctggtggatattgggtgctatcaagcccacccattggctggaagattcactataaagggtggcaacgttcaaaggaagatcttcggaatgagcaaagaaaaatagaatacttcgcacaacttctttgttggaagaaggtatctg

SEQ ID NO: 59916 - DNA, 387 bp, Zea mays
  Clone ID: LIB3069-054-Q1-K1-C10
ggaatgctacagtgtcatccttacccacattaatatgcagacccttctaggcagtgtgctcgtggtgctttcttcatgggcttgtcaaggaaagaaggtgtgaaaatacaggaaggacaacagttcgatattcgaggaacggtggatgagttcaagcatgaaatcaacatgtatatgttctggaagcctgggatggagttagctggttctcatgttcgtaagaagcaggtcccagcttatgtgtttccagaaggttataaaaagacctcgccttcaagacatgtgaaccatcagtctgataaaaatgacactgaagatggcacaacgaccaagtcttcaaacagtcaactgaagagaaagcatgatttctgtggaactgatgatatc

SEQ ID NO: 59917 - DNA, 426 bp, Zea mays
  unsure at all n locations
  Clone ID: LIB3069-054-Q1-K1-C11
agacagtgaggagggtccgtgttcgtggatgtaatgtgaaatggagggctcttcgccttgagactggtaactactcatggggaagtgaagctgttacccgcaagacccgtatcctcgacgtggtctacaatgcatcaaacaatgagcttgtgaggacacaaacccttgtgaagagtgccattgtgcaagttgatgctgccccattcaagcagtggtacctcactcactatggagttgacattggtaggaagaagaaaacccctgctgcatagaaggataatgctganggacaagaggttgaggcagcagctgaggaaacgaataagagcaaccatgtcacgaggaagcttgagaagcgcaaggagggacgtacccttgacccacacattgaggagcaatttggcagtggacggttgctggcatgca

SEQ ID NO: 59918 - DNA, 204 bp, Zea mays
  Clone ID: LIB3069-054-Q1-K1-C12
ggagcgcgcacgcacacacgagacagaagccttgaatcgaagcatcaagccctttctctgagcgccgattgcacggtatcttctcgcccccacttccacctcctctgcccttctccccaaagatggcgtcaagaactcgccgacgtcacggcccctccgccttcgtgcgctcggctccaggaccagcaaggcgcggcacatcat

SEQ ID NO: 59919 - DNA, 421 bp, Zea mays
  Clone ID: LIB3069-054-Q1-K1-C3
cccacgcgtccgcggacgcgtggggcctaccgctccatggccgagctcgaccaagccggcaggcgcacgccatttcgtcttaaccgcattaaggatcttcagtgcttccgtttcttcctctcccattattttctttggtaaccgacgccattgaaggcctccatgaatacccgccggcgcccccatgacctccctggccgacccttcccctctccctcctgctccctataaaaccgagctcctcctctctcctctctccctcgcctacccgagctctctctcattcctcgcactctctccctcgccgttcgtcgccggagttcgccgttcatcaccggagctaagccaccccaaagttgagcccctgctcttccacccggccgataccccgtcgagcccttcccgtcacacgtacgaacct

SEQ ID NO: 59920 - DNA, 407 bp, Zea mays
  Clone ID: LIB3069-054-Q1-K1-C4
attacctgccctagccgtcgtcgccgctcgtgttcctgagaggtgccgggaccgacgggttgggcgagttctatgtagagaatcggctttacttgtctcagcccgttgtctgctgcgtctggcggtggtgaacgggagaaattcgtgagatctgatccggatcaggcgcgcgagctcgggaatcaggggtttcacacatagcttcgtcgatttgaatctgatgtactaatggactctaatggtggcaaaaagtctagcattagtcgctctatgatgtatgaagctccccttggctacagcattgaggacgttcgacctgccggacgcgtgtagaagttccagtctgctgcttactccaactgcgcgaagaagccatcctgatataccttttggcttcctcattctag

SEQ ID NO: 59921 - DNA, 437 bp, Zea mays
  Clone ID: LIB3069-054-Q1-K1-C5
cccgctcctccactccaccaccaccggtcagatacggatgtctccgcccgcacgttcggttcacaaacgaaaacccgcagcaaacgctagcagcggcggcgccggcagttggtagccgcgaccgagacacggcgggtgacctgccccgccgcagtcggggtgtatgtattaccaccgacagaattccaggagacgaggatcgaggaggcaccgatccgtagcggcgatatcgtagagccgctggtctcacgccgcaccgagacaatggcagaccagttagggtcttacactattagatcccatggaatgatattggcaaggttgcacatgtatgactggataatacttctcctgcttgctgtcatagacgggctgttgaatataattgaaccatttcaccgttttgttgggaaagacatgatgactgacttgagata

SEQ ID NO: 59922 - DNA, 413 bp, Zea mays
  Clone ID: LIB3069-054-Q1-K1-C6
ggaaagactatcgaagctgaagctggctatggtactgttacccgtcattaccgtgttcgccagaaaggaagtgaaaccagtacgaacagtattgcctcaatctttgcgtggacaagaggacttgcacacagggcaaagcttgatgacaatgctagactacttgacttcacccagaagcttgaggctgcctgcagttggagccgtcgagtctgggaagatgaccaaggaccttgcccttctcgttcacggatcttcaaatatcacgaggagccattacctgaacactgaggagttcattgacgctgttgctgacgagctcagatcaaggctggcggccaactcgaacctttgaaatccttgccgaagttgtggtgctttcctgcgcgacgctctcgaaccgtttttattatgtc

SEQ ID NO: 59923 - DNA, 423 bp, Zea mays
  Clone ID: LIB3069-054-Q1-K1-B1
aatggaactgctgatacctgtcacgcttttggccaccctgatcaagacaagtcatttgggaggcgttcaggccaaagatctagggtccggaaacttcaatacattgctgaacttgcaagaactgttgactcacttcagaacattggtgctgatttggctgtcagagtgtcatcacttttccagcttcataatgctctatctatggaaaacaagcagctgaggatacagatttctagtcttcagcgtgcaaaactgattaaggatggtcagacgcaggccctaaagaacgaagccgaaaggttgaagcggatgtccgtccgccggagcagaagcgccacggactactgttacgacccgggctcgttctcgttcggagcagatgcttcgtcagtcagctggcagatgcctgacatggcaaggctc

SEQ ID NO: 59924 - DNA, 384 bp, Zea mays
  Clone ID: LIB3069-053-Q1-K1-H1
aagagctcgccgcaatcaaaatgcaggccgccttccgaggttacgtggcaaggaaggcactaagagcactacgaggccttgtacgattgaagtcattggttgagggtaattcagttaagcgtcaatctgcaagcactctgcgctgtatgcaaactctatcgcgggtgcagtcacaaatacgatctaggagagcaaagatgtccgaggagaaccaggccctccaacgccagctcctacttaaacaggaactggagaatttcagaatgggtgagaactgggacgacagcactcaatccaaggagcaaatcgaggcaagcctaataagcaggcaagaggcagcgataagaagagaaagaactcttgcatatgcattttcacatcagt

SEQ ID NO: 59925 - DNA, 353 bp, Zea mays
  Clone ID: LIB3069-053-Q1-K1-H10
tccgcccggggttccttttatatatttcccggtttttttttgcggatgaggagtcaacaagctgggttattgtatgcaaaggcgtcctgaaccaaattcccgtcgttatcttggtgtttgtttccactctagttggctgggcagtgaagcaagccaccaacgtcatccagatgaaaactgctgcggacgcatgcgtggtgtatgatctgaagcgcagcaaatgaagcatgaaggcagcttcacggtttagtatcgacatatccaagggaaaactctgcgagggggcgggctacgtcttgcgtgccttgacatctttctgatgatgcggtcatatgtgggaccaggggatgaca

SEQ ID NO: 59926 - DNA, 231 bp, Zea mays
  unsure at all n locations
  Clone ID: LIB3069-053-Q1-K1-H2
ttggccgatttcttggccgaacccttggcctcgcccaaaactgaactcagagccatttcctaaattttagtggganaaaggggcaaatttgcaccgtattaccatggcatggctatatgcggaactgttgattgatgagtcgctgtacggtttgtcgacttgatgatatgttgatgtgggagcccctgaatgaggcggtattaatggaaatataggatggcaatgacaatc

SEQ ID NO: 59927 - DNA, 364 bp, Zea mays
  Clone ID: LIB3069-053-Q1-K1-H3
gtccctccaaggttgttaaggtttctatctccaagactggtaagcatggccacgccgagtgccactttgtcgccatagacgatattcaatgggaaaaagcttgaagatattgttccttcatcacacaactgtgacattccgcatgtgaaccgtactgagtatcagctgattgatatttctgaggatggatttctgagccttcttacttcagatggcaacactaaggatgatcttagactcccaactgatgagactcttgtggcccagattaaggaagggttcgaaagcgggaaggatcttgttgtgactgtccactctgcgatgggggaggagcacatctgcgcgttgaaggatgttggcccca

SEQ ID NO: 59928 - DNA, 268 bp, Zea mays
  unsure at all n locations
  Clone ID: LIB3069-053-Q1-K1-H4
acccacgcgtccgcccactctttcgccctctcgtccgttnatggtccacaagcgactattactggaatctagaaacattctattgaatgcgtcgatggctgcaacgtaatcagagcgtagctctgggtagtttgggatctgcaaacactctattgaatgtatcctggactcagcataaatgatagatatatcggaggatcactatatgatccacaccacgtgagatggcaacactaaggatgatcttaaactcccaaataatgagact

SEQ ID NO: 59929 - DNA, 112 bp, Zea mays
  unsure at all n locations
  Clone ID: LIB3069-053-Q1-K1-H7
cccacgcgtncggaatgatggatatcgtgtctatgcaagtttccaaaagggaccccatagctgcttctgtctctgttgacgggaaagaaaaaccctgcnaccccctcaagca

SEQ ID NO: 59930 - DNA, 336 bp, Zea mays
  unsure at all n locations
  Clone ID: LIB3069-054-Q1-K1-A10
aaacaagcaatagtgaagaaagctgtcggcctttcgctgcctgctcgcagttgccagccccgggggtcgtggaagacggaaggaagcgaatcaaccgcgactgtctncgacgggaataaagcaggcgaagccagccggtcgcggaacccccaattctcagctgcggccggcgatcgagtcggttccgtcccgcgccgatgcggatcccgcggcggaagggcggggccgggccgctcgctgtcggggtgcccagcatgcgggcgcaagtcgccgcggtcttcgcgctcgtcgcactgctgggggtctccgtgctctacgacaacgcccacattggcg

SEQ ID NO: 59931 - DNA, 74 bp, Zea mays
  Clone ID: LIB3069-054-Q1-K1-A11
ggtattcttacattcttttgcactgcttttttcaacttcgatcaattgccacctaatcggggggacaacaaaaa

SEQ ID NO: 59932 - DNA, 389 bp, Zea mays
  Clone ID: LIB3069-054-Q1-K1-A12
gctgcagatatgttggtaggagtagttgtttatgtagctttagtcggcatgttagcgccatgggctcgatttggtagcagatctgcatcaaaaagtctccttgggcgcgttaggcatgcttatgatgcccttccaagcagcgttttttaaacttaaaagccaagatacaaattttctgtgcaacaacggataagaacatactttttcaaaggaataattgaattggtcttgtggattctttttggagtcttgtgggacaagggattgctaattttgataatgacagccaaaacgggagtgtaaagaagtcagaggatgatgtccctgttccacctcttctcaagacttctgctttgtggggtgcattccttgctgtttcttccaacaca

SEQ ID NO: 59933 - DNA, 410 bp, Zea mays
  Clone ID: LIB3069-054-Q1-K1-A2
ccactcatcttttcgcgtttagaacctttaaaatttcccccactcgccagtcgcagcaggacctgtagccatggacgccagcggagccggtagcaaggggaagaagggtgcggccggtcgcaaggcatgcggacccaggaagaagtcggtgacgcggtccgtcaaggccgggctgcagttccccgtcggccggatcgggcgctacctgaagaagggccggtacgcgcagcgcgtgggcactggcgcccccgtctacctcgccgtcgtcctggagtacctcgccgtcgaggttctggagttggcatggaacgcggcgaaagacaacaagaagacgcgcatcatcccgcgccacgtgctcctggcgatccgcaacgacgaggagctcgggaagctgctggcaggcgtcacca

SEQ ID NO: 59934 - DNA, 277 bp, Zea mays
  Clone ID: LIB3069-054-Q1-K1-A3
taccatgaccgagcgaccgtagcaagggaaaaggtcggcggcgcaagcagcggcccagaaaagtcggaccggccgtcaaggcggctgcagtcccgtcgcggatcggcgctacctgaaaaggccgtacccacgctggcactggcccccgtctacctcgcgccgtctgagtacctgcgcgagttctggagttggcaggaacgcgcgaaagacacagaaacgcgcatatcccggccactgctcctgcgatccgacgacgagagctgggagctgctgcagc

SEQ ID NO: 59935 - DNA, 443 bp, Zea mays
  Clone ID: LIB3069-054-Q1-K1-A4
cggacgcgtgggcggtcgcgtgggcggtcgcgtgggctatccgcgagcctcgtaccggggcagccatggcggaggagcccgccgttgtcgtggcctcctccagctacgaggttgacctcgggaacctcatggcgtacgatccgtcgcatcacgtcgccaccgccttcagggaggagctgagacaggagtgcctgcggaagggtacagagctggcgcaggcggtggccgacgtcctcttcgcgctgccgtccaacgaggaccgcgacggccccattatccaccttccgccgtccaccttcagactcccgcgggagaagcatctacccaagcccaagccaccgaccaagtgggagctgtttgcaaaggcgaaaggaattaccaagcgcaaaaagaacaagcgtgagtgggatgagcaaactcaatcctggaagcggactcatggc

SEQ ID NO: 59936 - DNA, 444 bp, Zea mays
  Clone ID: LIB3069-054-Q1-K1-A5
ctacaccaagggtgatggccttggcgctgagattgttggcaccttcatcctagtctacaccgtcttctcagccaccgatgccaagaggaatgccagggactcccatgttcctatccttgccccactgccaattgggttcgcggtgttcctggtccaccttgccaccatccccattactggcactggcatcaacccagctaggagccttggcgctgccatcatctacaacagggatcacgcctggaacgaccattggatcttctgggtcggccccttcattggcgctgctctggctgccatctaccaccaggtgatcatcagagccatcccgttcaagagcaggtcttaagctgccgtggccgtgccgagacatgccagtccgaagaacgggcgtcttcctgtgatgtcttcttgtctggccacgcctagtttctctgtcgattc

SEQ ID NO: 59937 - DNA, 438 bp, Zea mays
  Clone ID: LIB3069-054-Q1-K1-A6
tcggttcacaaggctgttggtcatagaacttttactgcagagactgtgaagctagagatcgttgtgttgttatcctaccatacacttttgaacgcacaggactgccatgctgctatgcttggccgactatcatatgctgtcgagtctgttatgcagacccttgtcggactccgcattagcgtaacgattctcaacatacttaggatcctgggcactagacacatgtacatctggcttaactcgttgcacaaccatagggccttatagggcgtgaccatgattgtcgctgatcatactggcacttacgaccagatggtcataactgccatacctttctagagcacgatttacgctgaccaggtcatactttgacatgccatgatccagaacggactgttacctgtgatggctacttgactgacaacgcctagcatgaat

SEQ ID NO: 59938 - DNA, 247 bp, Zea mays
  Clone ID: LIB3069-054-Q1-K1-A7
tcgtcacgcgtccgcccacgcgttcggatcttcacacatgagctggagttctttgtttggagaaatggtacctttacaaattgttttatagaagtgacttttcattattatagtaaagaatgtgtgtgatctctatgcttgcttcattttgatcctgttattttgtattaaaaaatccctgtttgaggggaaacaatacttaggatcctgggcattagattgatgtagttgtaacttaagtcgattg

SEQ ID NO: 59939 - DNA, 434 bp, Zea mays
  Clone ID: LIB3069-054-Q1-K1-A8
agcgaacgtgttgataaactagttggttatgcttcgagttatcaactcaaggatgaccgtattcaaactcctggaaaggatgcgagagttgtcctttctggtgtaagccttaagtatggaattgatttgttggaaagtatccaaagtggccctaagaagaagagcacaaagaagtcactcaaggatgttgtcacagagaatgaatttgaaaaacgtcttcttccagatgtcatccctccagatgagattggtgttacctttgaggatattggagcattagaaaatgtcaaggaaactttgcaggagttagttatgcttcctttgcaaaggcctgagttgttctccaaaggacaacttatgaagccatgtaaagggatattgctttttggtccacctggcaccggtaagaccatgcttgccaaagctgttgcaac

SEQ ID NO: 59940 - DNA, 355 bp, Zea mays
  Clone ID: LIB3069-053-Q1-K1-G9
cccacgcgtccgaatatatctgaagattgttgcaaagaagaagggttccaaggattgcagggctaatggtttgaagaagaaggctactactgctactggctctgatgaggaccactcatcctctccaactcgcagacatgatggtgacaaagcagctgcagatgatgatgacgatgatgtccagtggcagactgacacttcaattgaggctgcgaagcatcgcatgcaagagcagctgagtgcagcaactgctgaaatggtgatgctgtcgactgaggagactgagaagaagatgaaacaggcaacccacaaagatggaagcactaatggttcagcaaaagaaatccctaatgac

SEQ ID NO: 59941 - DNA, 406 bp, Zea mays
  unsure at all n locations
  Clone ID: LIB3069-054-Q1-K1-A9
cggacgcgtgggcaccaatgatgcgaagttttgtgatgggaacatatgtcatcgcaaaggtgaagaaagaagacggaaatatttatgtcttgttgaatgggatgggtgccacaccagaaggaaatgttccattcctcgatttgtttgatataaatactgngagtaaagagcgtatatgggagagcgacagggaaaagtactatgaaactgttgttgcactgatgtcagacaaaactgacggggaactgctccttgatcagttaaagatacttacgtcgaaagaatcaaaaacagaaaacacacaatattacttgcagacttggccagaaaagaatcaagttaagataacaaatttcccncacccatatcctcagcttgcttcattgnataaggaaatgataagatc

SEQ ID NO: 59942 - DNA, 381 bp, Zea mays
  unsure at all n locations
  Clone ID: LIB3069-030-Q1-K1-B5
ctagaacgcgagcggccgccctgggnngaaggcgacgaggagaactacggctacagcgacgnggaagaggagaagggatcnccgaaggcctcgccggaggctagcgaggaggagagcaaggatgcgtcggagtcagaatccggtgagtctgatagcctctccgagtccagcggatcggaagcttctatgaggaagaagaaagggaggaataaaagtcgccgtagtagcaagcgcagccggcagcgccaccgtcaccgctcatacagttcggagattgaggacgaaagcaagagcgacgatgattctgtgggctcttatgattcggaggagtctagggataggagcaaaaagaagtcgcgcaggcataatagatctaagaag

SEQ ID NO: 59943 - DNA, 424 bp, Zea mays
  unsure at all n locations
  Clone ID: LIB3069-030-Q1-K1-B6
cccacgcgtccgnacacataatatttctgctgtttgtttccatcctgagctccctataatcattactggatctgaagatggtacagttcgtatatggcattcgacaacttacagacttgagaacacactaaactatggccttgagagagtctgggctgttggatacatgaaggggtctagaaggatggtgattggttatgatgaggggaccattatgataaaaatgggccgtgaagtacccatagcaagtatggataccggtgggaaaatcatttgggcgaaacataatgaaatacaaactgtaaatatcaagacagtcggtgcaagttttgaagccacagatggagaaagattacccttggctgtaaaagagttaggaagctgtgatttgtacccacagagcttggagcataaccctaatgga

SEQ ID NO: 59944 - DNA, 425 bp, Zea mays
  unsure at all n locations
  Clone ID: LIB3069-030-Q1-K1-B7
cggacgcgngggngctcccaacacgccagcgngctatccagnatgctaggncgggatataatcctgtcgtgtccctgggatggttatatccccccagcttagtttcagaactacagcatactccgtacaggttatgctgacctgttcccacacaatgtgctgtacagttggtggggctatgttgtgattactactccgaatggtgttctggatcatgaggaagcaatcaggcagaacgtgggtgggcaagtccttggttatatccattgactgacaagtaacgtcgctcttagtcctgaatgaggcaacgggttgtgcccatttggtattactgtactgntgttattaccgaacccattctggatgcatcttgggagctgttttgtagtcggtcatggccatgcaagaaaggaaataacatgcca

SEQ ID NO: 59945 - DNA, 366 bp, Zea mays
  Clone ID: LIB3069-030-Q1-K1-B8
ctcttcctctgctcttctctgcctgcctgagctcaccgcacctcgcctcctcagcgcgtggcctccgttaatccggtagaaaatggccgatgccgaggatatccagcccctcgtctgcgacaacggaactggcatggtcaaggctgggttcgccggcgacgacgccccgagggccgtcttccccagcatcgtggggcgcccgcgccacactggtgtcatggtcgggatggggcagaaggacgcctacgtcggtgacgtggcgcagtccaagaggggtatcctgaccctcaagtaccccatcgagcacgggatcgtcagcaactgtgacgacatggagaagatctggcatcacaccttctacaacga

SEQ ID NO: 59946 - DNA, 405 bp, Zea mays
  Clone ID: LIB3069-030-Q1-K1-B9
cccacgcgtccgcccacgcgtccgttgacgcgtggggcgaaggcgaccctccctggttcgctccttccgcgccgcctgccggccgtcgccgccatggtgaagtactcgcaggagccgggcaaccctaccaagtcggctaaggccatgggcagggatctgagggtccacttcaagaacacaagggagacagcctttgcgcttcgcaagttgtctttgaccaaggctaagcgataccttgaggatgttattgctcacaagcaggcaattcccttccggagatactgtgggggtgttggtcgcaccgcgcaagctaagtcgcgccactccaatgggcagggccgctggcccgttaaatcagccaggttcatcctggatttgctgaagaatgctgagagtaacgctgat

SEQ ID NO: 59947 - DNA, 183 bp, Zea mays
  unsure at all n locations
  Clone ID: LIB3069-030-Q1-K1-C1
gaccgaccatggccaccggggccgacaaccgcgacggcatgggctaccagacccgcgncgggctccgactcgccgacgcgctctccttcccacccccattccccgccagcaacttcgacttctacccgctctccctccacgtcgcgctcagacttcttgccagcggcgcgggtggcgccactc

SEQ ID NO: 59948 - DNA, 294 bp, Zea mays
  unsure at all n locations
  Clone ID: LIB3069-030-Q1-K1-C10
gaagaaaggaatccctcctacgcggtagcgaagagattcgtcgcctcagccgcctgtctgctcagatctgcggcggagcctcgccggcggcctgcgcccgcggcgccgccgatccaagatgccttcgtgcgtgcagggctgctgctgctgctcgtccctgcgccttctcccccgcgacgacgcgctctcgtccccctccggctgcgcgcaccgnctgaagccttggtcttggcgtgcccaatcccccacctcgtcctnctaacgcttggtccccgccgctccccaccctgatct

SEQ ID NO: 59949 - DNA, 298 bp, Zea mays
  Clone ID: LIB3069-030-Q1-K1-C11
cccacgcgtccgtccacgcgtccgtttacgcgtccggttttgttcacggacaaaagcggaggaacttcattacttaggaaaaatttaaccgaacttaaccactggaattaccttccaaacattacggccgggaccatgtgccacaaggtcaattcatggtcaagcttaagggccccaagtgtgccttaaaagcagagaccaaaccaagcttggacaccaaccttcacttttcttacggttttttaaaacggaccagggcaaaccaatggttccaaaacatttgggcaaaaacttgacc

SEQ ID NO: 59950 - DNA, 302 bp, Zea mays
  Clone ID: LIB3069-030-Q1-K1-C12
cccacgcgtccgcccacgcgtccgttcacgcgtccgcccacgcgtccgctcgtagagagagggaaaaatatccccagaccctagctcccgatctcgatggcgaaccctcgcgtcttcttcgacatgaccgtcggcggcgccccggcgggccggatcgtgatggagctgtacgccaacgaggtgcccaagaccgcggagaacttccgcgcgctgtgcacgggcgaaaagggcgtgggcaagtccgggaagccgctccactacaagggctccaccttccaccgcgtcatccccgagttcatgtg

SEQ ID NO: 59951 - DNA, 385 bp, Zea mays
  Clone ID: LIB3069-030-Q1-K1-C2
cccacgcgtccgcccacgcgtccgcccacgcgtccgcccacgcgtccgcccacgcgtccggaccaccatccacgcactgctagtaagcgagcttagctactgatcgtcgtcaagcactctcgagctcgatctctcgaagcggctagctgctagcagccaattaatggcgaagccttcgcaggtgctggtgtcggcgctcgccgcctgggcggtggtcctgctgctgctgtgcgccgccgcgccgcggggcgccgacgcggccacggcgtgcgacgccgcgcagctgaccccgtgcgcgggcgccatcatcgggagctcgtcgaccaccgcggcgtgctgcaacaagctcagggagcagcagccgtgcctgtgcacgtacgcgcgc

SEQ ID NO: 59952 - DNA, 371 bp, Zea mays
  Clone ID: LIB3069-030-Q1-K1-C3
cccacgcgtccgcccacgcgtccgcccacgcgtccgcacgttttcgtcgtccggccggccggcgagcattttgcttctgcgatcgatcggcgcgacgtgcacggccatggagatgatcgacgcagagctgcgtctgggtccgcccggcagcaacaacagagacgtcatcaacgtcgtgcagccggcgttggcggcggcgaaacggccgtcgtcgtcggtgctggagagcgaggcgtccgggacggacgaccatgaccatgacgacgccgcaccgaccttcaaggtgcatgtggtggggtggccgccggtgagagtgtaccggaagaacgcgtttcacgcggcggcggaagcgaggaagaccaagcggggcg

SEQ ID NO: 59953 - DNA, 425 bp, Zea mays
  unsure at all n locations
  Clone ID: LIB3069-030-Q1-K1-C5
cgagngccccgganggggagacagccannnngngaatcnggggtagatgtacaagatngggtcattcatctcatgacaatatgctcgccgcatctctgtcgggtagtttaagcccagttggatggttggttgtggttagcgttacattgatcaattctttgaagcagcatccaagacgaccagctctagtttcagaaaaaagagggccttccgattccataaccagggtggtccaagatccagaattggttcttggtggttaaaaaaggtaccattttaaatatatgtaaaggttgtcactgaattaactgcttggtgatgttgtaagttgcaacaatccgtgaagattcaatgcatgaattttcttattgcaaaaaaaaaaattttttggttgtggttatttttattaaaaaaaaaaggggcgg

SEQ ID NO: 59954 - DNA, 433 bp, Zea mays
  Clone ID: LIB3069-030-Q1-K1-C6
cgatcacacgcagacacgcttccgcggcgccaccaccttccgccctccgctgcccgctcgcctccgcgcccgaaaggcaaagcctcctcgctcctgccccgccccctcctcgcggcgtcggtcaaaccctagcacaccgtacgcgcaggcccgcccgctcccattccccacctccacccatggcggcgctctccgcgcccctccgcgccgtcgccgccggatcccgcgtcgccgcgtccgaccccgtcaaggtctcgtgcgtgaggagcactggctcagctcacttcggctgcgccttcccctacatcagggcctcctcttcggctgcgaggaacctcgagccgctgagggcgatagccacgcaggcgccccctgccatgccacaatattcgagtggggagaagacaaagattggcatcaacgggttttgggc

SEQ ID NO: 59955 - DNA, 380 bp, Zea mays
  Clone ID: LIB3069-030-Q1-K1-C7
cccacgcgtccgcagacggacgcacacaaaagcgaaagggaggagagagaggggcaggggagagcaggagagagaaattcgatagggttcccatgcccctttcccaccggccaccacttgccaagcgaaagcgggagtgaaggaggggagagtcccatttccccaagccctacacgagagaaagagagagaggggggagcagaggagcacgctacgagagagggaggtcgagggagacagcagaagctgcagcataagccagaagcattagaagcggcagttgtaaccaagtggcatcagaagatagagccagccatccgtctatccatctatctagctttacaggtataaatcctcgcgcctcggtaaggggccaaggg

SEQ ID NO: 59956 - DNA, 431 bp, Zea mays
  Clone ID: LIB3069-030-Q1-K1-C9
cggacgcgtgggcggacgcgtggggttggatccgcttcgtcggcgtcggcgtggaggcggacgcggagcggctcagcgacgaccacggtctggtggtggccaacgcggaggacctgcggggccgcgccgcggagcggatgaaccgcccggacctccgccaggcggggctgcgtgcgctcgtgcaagtcgtcatgggcgtcaacctcgtgaagccgcagagggtcaccatgagccgctgggacgcgtcctgcctcagctacgagcagatcaagtacgcctgcatcgacgccttcgtctctttcgaggtcgcccgcaggctgcttggcggcgcgtactgatcgacgcggtgaggtgctgtgttgtttaatccttactctatcctgtcttagtttgttgtactttgccgtggactcccgttgcttaatccttag

SEQ ID NO: 59957 - DNA, 303 bp, Zea mays
  unsure at all n locations
  Clone ID: LIB3069-030-Q1-K1-D10
cccacgcgtncgtccacgcgtncgactgcgcgggcatcggccccggtgtctacgacatccactcccccaggatcccgtcggctgaagagatcgccgaccgcatcgacaagatgctggcggtgctggacaccaacatcctctgggtgaaccccgactgcggcctcaagacccgcaagtacacggaggtcaaagcccgcctgaccaacatggtctccgccgctaagctcatccgcacccagctcgccagcgccaagtgagcaccttttttttgcctttttcgtttccgaggagggcgtcgtcgat

SEQ ID NO: 59958 - DNA, 362 bp, Zea mays
  unsure at all n locations
  Clone ID: LIB3069-030-Q1-K1-B4
cggacgcgngggnccccanccgcaccgctctccatctccctgctcctccgcctccttcttgatccagccaagccagggatcgccatgtcggactcggaggagcaccacttcgaatcgaaggccgacgccggagcgtccaagacctacccgcagcaggctggcaccgtccgtaagaacggcttcatcgtcatcaagaaccgcccctgcaaggttgtggaggtttctacctcaaagactggtaagcatggccatgccaaatgccactttgttgccatagacatattcaacgggaaaaagctcgaagatattgtgccttcgtaacacaactgggatattccgcatgtgaaccgtactgagtacca

SEQ ID NO: 59959 - DNA, 267 bp, Zea mays
  Clone ID: LIB3069-029-Q1-K1-H8
ccttcagtctctgggcaccaaaatttccgtttcgattgccgccgcttttgccaaggtcagggttccgggccttgttctcgggttttgccttcggcccgccaaaggcccccgccggccccccaaaggccgacccatcccccaaccttttcgcttccggttaaagcaggcgtcccccaagtgaaggcctttaaaaaagcctttgcggagtttggggaagttttgcttgctcaagttgtgaccgatcgtgtcagtgggttttctaaggga

SEQ ID NO: 59960 - DNA, 402 bp, Zea mays
  Clone ID: LIB3069-029-Q1-K1-H9
gcagcagcaggtagcagccaccagtccactttcaccccactccggcagtgcgccgcgcagggagctgctgcctgctgtctgactgtcaccgctgccgccgccacgcccacgcctcatcaagcgaggcaatggcgtcgcggctcctgccgttggtcgcggcgctgctcctactcctcctcctgacggcggcgtcgtccgaggcgacgctgcacccggtggactacctggcgctgcaggcggtgcggcgggcgctgtcggacctgccgggctcccgcttcttcgcgtcgtgggacttcacgggcgacccctgctcgctcgcgggcgtgtcgtgcacggacgaccgcgcccgcctggagacgctgtgcgctggggacccgcgcgcgggcgcaccgggccttcggg

SEQ ID NO: 59961 - DNA, 302 bp, Zea mays
  unsure at all n locations
  Clone ID: LIB3069-030-Q1-K1-A1
nccacgcgtccgnccacgcgtnncgccacgcgtncgcagatttgacagataaagatcagggggtgtattccaccttgcccgccgagttacaagcattggttacaaggttccaatctgtgtttgctcttcctgttggccttccacctgtccgtgattgggatcaccatatctctcttctacctggtgctcaaccatttcatgtgagaccatacagatatgcacccgcgttgaagactgaaatcgagcgccaagtccaagagatgttatcttcaagcattattcaacacagcaacagtgagttc

SEQ ID NO: 59962 - DNA, 438 bp, Zea mays
  unsure at all n locations
  Clone ID: LIB3069-030-Q1-K1-A11
gccagcggcgtccgtggagtcaccttctacccaacgattttccaaaaggccatttgagtcgtccagcgcatatgatgagcagttcaagcagctcatttcggcaggaaaggatgcggagagcgcttactgggaactcgttataaaggatatccaagatgcgtgcaaactttttgagcccatctacgacgagactgatggggctgatgggtatgtctccgtagaggtgtctcctaggttggcaaatgacactcaaggaactgttgaagcggcaaagtggttacacaaagtggtcaaccgccccaatgtctacataaagatcccagctactgcagaatgtgttccttccatccaggaagttatcgctaatggcattagcgtcaacgtcacgcttatnntctcaattgcgagatatgaggctgtgattgatgcttacctcga

SEQ ID NO: 59963 - DNA, 403 bp, Zea mays
  Clone ID: LIB3069-030-Q1-K1-A12
cccacgcgtccgcgcaatataaacgttcacagcgcttaccttcatgtgcttggggactccatccagagcatcggggtgatgatcggcggggctatcatctggtacaagcccgagtggaaaatcatcgatctgatctgcaccctcatcttctcggtggtcgtgctgttcaccacgatcaggatgctgcgcaacatcctcgaggtcctgatggagagcacgccccgtgagatcgacgccaccaggctggagagggggctctgcgagatggaaggcgtggttgccgtccacgagctgcatatctgggccatcacagtggggaaagtgctactggcttgccatgtgacggtcgccaaggaagccgacgcagacgagatccttgacaaggtgattgggtacatcaaga

SEQ ID NO: 59964 - DNA, 318 bp, Zea mays
  unsure at all n locations
  Clone ID: LIB3069-030-Q1-K1-A3
gagccatcngactctccgctggncgctcactcnggcagcnccaccctncactcagnncgaggcncgtattagctctaggctctagctagccgcgccactccttcgtgtagccatcagccttctcatcgccaccaatggccactgccgaggtccagaccccgaccgtcgtggcggccgaggaagcgcccgtggtggagaccccggcgtcggccgtcgtgcccgaggagtctgcccccgccgaggccgaggccgaagccgaggctgctgctcctgctgatcccgaggagcttcccgcggccgagcagcaggcagccggcg

SEQ ID NO: 59965 - DNA, 350 bp, Zea mays
  Clone ID: LIB3069-030-Q1-K1-A4
cccacgcgtccgagaactgatgctcttgatgctgctggcaacacaactgctgctattgggaaggggtttgccattggttcagctgctcttgtgtccctggcgctttttggtgcctttgtcagcagagctggagtgaaggtcgtcgacgtcctctcccccaaggttttcattggtttgattgttggagccatgctttcctactggttctctgccatgaccatgaagagtgttggaagcgccgccctgaagatggtggaggaggtccgcaagcagttcaacaccattcctgggttgatggaaggaacagccaagcccgactactcaacctgtgtgaagatcttcactgatgc

SEQ ID NO: 59966 - DNA, 204 bp, Zea mays
  unsure at all n locations
  Clone ID: LIB3069-030-Q1-K1-A5
gcgaccaggggaccccgcggcggcgcccgagcgcnccgagccgcggcgcagcaccaggcccncgcccccgcgacggcggcggcggcggcagaaggccaggagcgggacgcgcagaagaagcagcccgacgaccagaacgcccgcgacgccgcgcgccacnccgccgaggagaggcagcgccaacaacagcgcggagccaacgcc

SEQ ID NO: 59967 - DNA, 321 bp, Zea mays
  unsure at all n locations
  Clone ID: LIB3069-030-Q1-K1-A6
aaggganncaccaaagagggggngaagaacaagaagnaccnngcagnngcngggccagaggagggngcccagacccggcnggnncaggccanngaggcnnnnggngggaagngcaacccngaggcgccgaaggaggnncccgnngnccncaaagcccncaacgaaggagananccnggacgaggaaaccanngnggacnggnacaangangcngncgcagcngggaaggacncccaggnngncaagaangccaagcacgncgncgaggggcnccagagngccgagncngangaagaaggngacgacgagngaagaagccac

SEQ ID NO: 59968 - DNA, 240 bp, Zea mays
  unsure at all n locations
  Clone ID: LIB3069-030-Q1-K1-A7
gcngngnganccgagacangccggcnncncgngggaaaggaaaaaaaggcacagacggacgagaacnggacgcaaaagcgngnccangancgcgnaagcanggcgaaaccanncaaaaggcaaancagagaagaacangggcagggcnaagcacgggaacnnggagggaccaacgaccgngngccgcgagaccagcnaggaggaaaggagaaacgngnngacaaacaacaggacgaggag

SEQ ID NO: 59969 - DNA, 356 bp, Zea mays
  unsure at all n locations
  Clone ID: LIB3069-030-Q1-K1-A8
cgccgcncncncnnnccccgagcccncgaaacccnaggggcgngccgaccggcggcggcggcgaggnganggcgaaggacccggacgcggnggcgaaagccnncgnggagcacnacnaccggacgnncgacaccaaccgcgcggcgccggnggggccggaacaggagaccnncaagcncaccnncgagggccagaagnnccagggcccaaccgccanggccggcaagcncggaacgcnacccaaccaggccggcgagcaccagaacgncaccgncgacagccagccgncggggccccagggaggcaagcncgncnncgncnccggagccaaccgcaccggccccgaggagcacccc

SEQ ID NO: 59970 - DNA, 371 bp, Zea mays
  unsure at all n locations
  Clone ID: LIB3069-030-Q1-K1-A9
cccacgcgtccgcccacgcgtccgttgacgcgtgggcgcatataaaggtgtcgatggaaggaattctacttttttttgctgatgaagaaagtgaagtangtgcaatcgatttccccattattttattacttgcattttgattatttaaattgttattcctattggtgcgactactagagttaatattacaggtaaaaatcttacgaatacaatagaaataccattgggtggtgctggagtacctatttcgtcacaaggttgtgattcctgccatgttttttttttctgcattggtagtttcacttccaaagcttttctagcttcgtggtaaggtaaagagncactactctgctatngtactagatctcatg

SEQ ID NO: 59971 - DNA, 325 bp, Zea mays
  unsure at all n locations
  Clone ID: LIB3069-030-Q1-K1-B1
cagatccagagnacttttgcaggaactgatggttattgctggtagatactcttttaatcggttattattttggtcagcttatggtaagggtctgatgatctagtgttgcatgcacattagtcttgctgtttcagggaggcgcggacacaagtatataccactcagtcgacttcaaattgtgctcgatgatgagggctattactcctcggtgctcttttccatctgtgtcatcatgcaaagaaattgaagttacaccttctagatctgtctatcacttgtaaattggggctgttgatgctgctgcaaagatacgatatctggatac

SEQ ID NO: 59972 - DNA, 393 bp, Zea mays
  unsure at all n locations
  Clone ID: LIB3069-030-Q1-K1-B10
gttcaagattcagatgatgtctggtttaagaaattggaatcttgtataacacctgcgatagaggcagcacagctaaagaagtttccagagagactatctgccattcctcccagaattctggagggtcaggtcccagacataacagaagaagtctatgaggaggataataagttgtggaagaagcatgttaatacttataagagggtgaacaagctgataggttcttcaaggtacaggaatattatggacatgaatgcaggccttggaagttttgctgcaactcttcattcttccagttcctgggtaatgaacgttgtgccctctatatcagaaaggaacactctnggtatcatatatgagcgaggtctgattggtatataccatgattggtgc

SEQ ID NO: 59973 - DNA, 437 bp, Zea mays
  unsure at all n locations
  Clone ID: LIB3069-030-Q1-K1-B11
ctcgcccttgccaaggtcgacgccatcgaggaaaccgacctcgcccagaagtacgaggtgcagggcttccccaccatgctgttcttcatcgatggcgtccccagaggctataacggagccaggaccaaggaagccatcgtcgactggatcaacaagaagctcggcccagccgtgcaaaatgtcaccagcgtcgacgaggcccagagcatactcaccggagatgacaaagccgtccttgccttcctcgacacactatccggtgctcacagtgatgagcttgctgctgcttcgaggctggaagatagcatcaacttttatcagacttcgactcctgatgttgctaagctnttccatatcgatgcagcagcgaagcgtccatccgtagtgctgctgaagaaagaggaagagaagttgaccttctatgatggggagtttaa

SEQ ID NO: 59974 - DNA, 349 bp, Zea mays
  Clone ID: LIB3069-030-Q1-K1-B12
cggacgcgtggggcctgaaagaggatcagacaccccttatcctcatccaggatggtgactgcaagaagttcttgaaggttcacgttgaggctgaccagatcgtctcttggttgaaggagtactttgacggcaaattgactccgttcaggaagtctgagcctattcctgaggtcaacaatgagcctgttaaggtggttgttgctgacaacgtccacgacttcgtcttcaaatctggcaaaaatgtccttattgaattctatgccccctggtgcggacactgcaagaagctggcgcccatcttggacgaggcagccaccactctccagagcgacgaagaagtcgtgattgc

SEQ ID NO: 59975 - DNA, 393 bp, Zea mays
  unsure at all n locations
  Clone ID: LIB3069-029-Q1-K1-H7
ctagggtttttgattttagccgccgccgctgctcatctcacatccctcgagaagacgcctgctcctcgccgatcgatacgatggccgtcttctccgacctccacaccgccgacggcctcaagtccctcgaggctcacctcgccggcaaaacctatgtgtctggtgactccattactaaggatgacattaaggtcttcgccgcggtgccgtcgaagcctggcgctgagtttcctaatgccgcccgctggtacgagaccgtctctgcggctgtagcctcaagattccctggtaaggctgttggtgtaaatctgcctgcgggatcagcttctgcggcagctgctcctgcggatgaagcttangatgatgatgaacttgatctttttggtgatgaaa

SEQ ID NO: 59976 - DNA, 415 bp, Zea mays
  unsure at all n locations
  Clone ID: LIB3069-030-Q1-K1-B2
cgncgagcaggcccgcnncggcgncgncnccggcgcggacatactcgcgnncgcggccagggacagcgncgcactcnggaggcacggcnngnnagngncagnggacgccngccgnnngannnnaacccgacanngagagncnacanggannnggaanccaangcnggactagacngaaaagcacatgngncngggcgaccttnttttgacgcacatgatgccgcgtgcagctgcctgaaagaactcgatgcattgccgggcccgggcatgggtccaactcccaactttatttttttacagtatttgcttactcttcaatccatccattcatncatccatccatccgtacgtataggccggcgggaacgcgttccaggtgccggccgggcggcgggacaggttcctgtcgcgcgcg

SEQ ID NO: 59977 - DNA, 180 bp, Zea mays
  Clone ID: LIB3069-030-Q1-K1-B3
cggacgcgtgggcaaacaccattgctgatggactacgagcttttcttggagacctgacatggcctgtggtgcgtgacttggtggacgatgttatcgttgtggatgacactggcattgtggacgccatgaaaatgtgctatgagatcctgaaagtggctgttgagcccaatggcgcaattg

SEQ ID NO: 59978 - DNA, 347 bp, Zea mays
  Clone ID: LIB3069-029-Q1-K1-F9
gtttcaagatgtcctgagaaaacagtgaacttacaggatctgcagaacagcttgattgcatctagaggagcttgtaaaagtgcttgcccacatatggggacctggagaactgaatccgtctagtgtatcactcatttctgctctacgttcagagcttgatgttgcccgttctcatgttagaaagctaatcaaagaaaagaagtctaatccctatgaaattgaggacttaaagaagcaacttgcagaagaaatggaatcgtggaaagtcaaacaaaaggagaaggttgcaaacgctctccaatttataggttcagagctagacactgagaagaagtcaagggaaagag

SEQ ID NO: 59979 - DNA, 405 bp, Zea mays
  Clone ID: LIB3069-029-Q1-K1-G1
gcctgcgttagctgttgcattgcagcacttcgagccttgagctgctagctcgcccttcagcacagtccccagacatggagttcgaagaccgctgccacaaggtccaggagcccaagttcgactgcctgctcttcgacctcgacgacaccctgtatccgctgagcgccgggatcgcaggccatgtcaagaagaacattgaagattacatggttgagaagctgggtattgacgagaccaagatcgagaacctgggcaatctgctgtacaagaactacggcaccacgatggctggtactcaggccatcggctacagcttcgattacgatgagtaccacgccttcgtccatggaaaggtgccgtacgacaacatcaagcctgaccccattctcaagcacattctcaaga

SEQ ID NO: 59980 - DNA, 382 bp, Zea mays
  Clone ID: LIB3069-029-Q1-K1-G10
tgctcgcctcgggtcaaaccctaagcaggtagttgatttatccgctgcagccatgagtgagttgcagtctgagtctgtcgaggatgccatctcccagattgttggggatgccaaggagaagaataggaagttcactgagactgtggaacttcagattggtctgaagaattatgatccacagaaggacaagcgtttcagtggctctgttaagttgccccatatccctcgtcccaagatgaaggtgtgcatgcttggtgatgcccagcatgttgaggaggccgagaagatgggacttgactacatggatgttgaggctctcaagaaaatgaacaagaacaagaagcttgttaagaggcttgccaagaagtaccatgctttcttg

SEQ ID NO: 59981 - DNA, 283 bp, Zea mays
  Clone ID: LIB3069-029-Q1-K1-G11
cggacgcgtgggcggacgcgtgggcgccttcctccgcggctcaaacctttcccccttctggcaattcccgccgccgctccatgccgtaacgcgacaccatgagggagtgcatttcgatccacatcggccaggccggtatccaggtcggaaacgcgtgctgggagctgtactgccttgagcatggcattcaggctgacggtcagatgcccggtgacaagaccattgggggaggtgatgatgctttcaacaccttcttcagtgagactggtgctgggaagcacgt

SEQ ID NO: 59982 - DNA, 367 bp, Zea mays
  Clone ID: LIB3069-029-Q1-K1-G12
gcaatggcggaccaggctaaccaacccactgtccttcataagctcggtggccagttccaggtgcgctcgatcatctctgaaggtgtacgggcccgtaacatatgcccatctgtctcatcttatgaaaggagatttgccacaaggaactacatgacccagagcctttggggcccttcaatgtctgttagcggtggcatcaatgtcccagtgatgcagaccccgctctgtgctaatgctcctgctgagaaaggaggcaagaacttcatgattgatttcatgatgggcggtgtttcagctgctgtttcaaagactgctgcttgctccatcgagcgtgtgaagctgcttattcagaaccaagatgagatga

SEQ ID NO: 59983 - DNA, 281 bp, Zea mays
  Clone ID: LIB3069-029-Q1-K1-G3
gccaccgtccgtaggagcatctgcaggcactagctccgcaacctggacccgttcctccagctcgacgagttcactgtctccaagcccgccgggttccccgaccacccgcacagaggattcgagaccgtcacccacatgtttgagggggccatcatccaccaggacttcgctggtcacaagggcaccatcaggacaggggacgtgcagtggatgacggcggggcgaggcatcgtgcactcggagatgccggctggggacggcgtgaacgaggccctgcagct

SEQ ID NO: 59984 - DNA, 295 bp, Zea mays
  Clone ID: LIB3069-029-Q1-K1-G4
gcagcaagcaggagcagtacaggaggcgcctagagcccagcgtcggagatctccgccgccgtggagacgctggccagcgccatgcggcgcgagaaccgccggtccaaggccccgccctcctcctctgcttcctccgccctcgcctcgggcagggtccctctcgtcatggccttcctctcctgcctcgcctggctctacgtcgccggccgtttgtggcaggacgcgcagacccgggcgatcctgtccggcctcctcgagaagagctctaccagcgtcccgaaagtgctctcggtgg

SEQ ID NO: 59985 - DNA, 303 bp, Zea mays
  Clone ID: LIB3069-029-Q1-K1-G5
aaggcaggcaggaatgcatctgccatttgaacagagcaacctgcacattatttatggatgcctgttcaatggagggcttggtcattacatgttcgtatatactagaaaaaacagaatattagcattaatccatagttaattaaagtatgttaatgcgcctgttctttggtgagtactgtaatcatatgacttgggactgggaaattttcacagaaagaatggatgtgagatacacaaaaattaatgccgtggtcaaaaaaagaaaaggcctgcaactctggatcaatcctatataaaagggcg

SEQ ID NO: 59986 - DNA, 168 bp, Zea mays
  Clone ID: LIB3069-029-Q1-K1-G6
atggccttgctctcccgcctcacctggctctacgtctccggccaattgtggcaggacgcacagacccgagctatcctgtacggcctcctctagaagagctctaccagcgttccgaaagtgctctctgtggaggacaagcttatgaacctcttgtgcaaggcaatttta

SEQ ID NO: 59987 - DNA, 336 bp, Zea mays
  Clone ID: LIB3069-029-Q1-K1-G7
ggccggaccgacgcattcgtccgcccacccgtccaccttttttaggcactagtctttcaacctggacccattcctccagctcgacgagttcactgtcttcgaggccgccgtcttccccgaccacccgcacagaggattcgagaccgtcacccacatgtttgatggggccatgatccaccaggacttccctggtcacaagggcaccatcaggacaggggacgtgcagtggatgactgcggggcgaggcatcgtgcactcggagatgccggctggtgacagcgtgagcgagggcctgcagctctggatcaacctctccttcaaggacaagatgatcga

SEQ ID NO: 59988 - DNA, 342 bp, Zea mays
  Clone ID: LIB3069-029-Q1-K1-G8
gcagcaagcatgagcagtcaggaggcgccttgattccagcgtcggagatctccgccgccgtggagactctgaccagcgcggtgcggcgcgagaaccgccggtccaaggccccgccctcctcctctgcttcctccgccctcgcctcgggcagggtccctctcgtcatggccttcctctcctgcctcgcctggctctacgtcgccggccgtttgtggcaggacgcgcagacccgggcgatcctgtccggcctgctcgagaagagctctaccagcgtcccgaaggtgctctcggtggaggacaagcttaggaacctcgggtgcaaggcgattggaaagaaaattg

SEQ ID NO: 59989 - DNA, 332 bp, Zea mays
  unsure at all n locations
  Clone ID: LIB3069-029-Q1-K1-G9
cccacgcgtccggtagctattgccccttttttaaaggatgtattggacagtctggaatttgcaagggggagtgcagattcagcatggggctctgttagggctgcaatggggcaccctgaacctttcctggtcaaacatgtcgcaattggaaatgaagattgcgggaaaaagttctaccgtggtaattacctcaaattctacaatgctataagagaggcctatccagacattcagatgatttcaaactgtgatggttcatctagaccacttgaccatnnctgcggattgtatgaattccatgtctatactgattcctaggacttgttaacatg

SEQ ID NO: 59990 - DNA, 379 bp, Zea mays
  Clone ID: LIB3069-029-Q1-K1-H1
cccacgcgtccgcccacgcgtccgcccacgctttcgaagaaatcagatgaagtgaccaagagcaatgtgactatataataataataaaattaacagaagaggtacatacagtttcactttaattttgaaatgcaacagcagcttgatgtctctattgaaccctagaaacaactgaaggagaaaatactcttccacaaggaataggattctcatttgtgctagcagaatcagagttaattgcatcattagttctaggaacctgctggggtgaactttaccacccagaagaggcataaccaatttcttagaaagaccaccactgttaatcttgtcatcaatggtcaatatatttcttttggacaagtcatttattataagt

SEQ ID NO: 59991 - DNA, 408 bp, Zea mays
  Clone ID: LIB3069-029-Q1-K1-H11
cccacgcgtccgcccacgcgtccgctctgatctgttgcaagggcacgcctagggtttctggccttgcctatactgtttgtggcggataagtcgtcctatcctagagggagacgccctggagcctggaatggctggctttgcagtgctcttccagcttgtgtggatgtcgttgctgcacatctaacagcagtggctgatgcctagaggtgtgttctttagttcagatctatcctgttttacagtactaggttaatgaacatagtgacagacacaatccaaatttattacaaaatagtaaataagcaaaaaactatatttcgacttacatagcatggtagctattttttcaaatagattgcgccagatcaaaacacaacgacagactatttttatgttctccaatgcatg

SEQ ID NO: 59992 - DNA, 343 bp, Zea mays
  Clone ID: LIB3069-029-Q1-K1-H12
ggcccacgcgtccgttccacgcgtccgttcacgcgtccgagacgggcctgggcgtctgcgtgggtatatagctcttcagggtcctgctgcaggtcacccgccccaacgtcgtggtggagggcctcgtcccggggacgcagagctaccgcagcgtggcgcagtaccgcgaggccgtccgcgtgccgggcttcctcgtcgtcggcgtcgagtccgccgtctacttcgccaactccatgtacctggtggagcgggtcatgcgctacctccgcgacgaggaggagcgcgcgctcaagtccaaccaccccttcatccgatgcgtcgacctcgacatgggcgccgtctc

SEQ ID NO: 59993 - DNA, 281 bp, Zea mays
  Clone ID: LIB3069-029-Q1-K1-H2
aggagctcgcacaagcctatgaggttttgtttgatccagagaaacgtgagatttatgatgagtatggtgaagatgcccttaaggaaggaatgggcggtggaggatcccatgttgatccatttgacatcttctcatcattttttggaccctcttttggaggaggtggtggaagcagcaggggaagaaggcaaaggaggggagaagatgtagtccacccacttaaagtttctctggaagatctttacaatggcacctcaaagaagctctctctttcgcgcaat

SEQ ID NO: 59994 - DNA, 320 bp, Zea mays
  Clone ID: LIB3069-029-Q1-K1-F8
ccactcgtccgcggacgcgtgggcggactcgtgggtgattttgatgggttcatccatttgcagattgaaagccaagatatgcctgggcttagcttcaaaacacacccaaatatcaataaggatttgtttaacagtcagcaaattttgggagcaaaagatccaaacaggccctttccgagtggtcaaaatgaaactcctctggtgaaatggagaatccaggggatggatgagtcgtctttacctctgtcagtcaattgctggccgtcagtatctggaaatgaaacctatttgaacattggattttgaaccttttagaatgt

SEQ ID NO: 59995 - DNA, 375 bp, Zea mays
  Clone ID: LIB3069-029-Q1-K1-H5
cccacgcgtccggcatgagaaggcttttgtttcgaaaccaggcggcattccaactggtggcggtgtagggggagctgaatgagcttttgatcacttatcgatggccaaaaaaagggaggaaacgtgattacatgcttaccacagttgtgctggaaccgaatcgccttgaccttgaatggatattttcatgtttacttcacgtatgataaggttaacagcaagaaaaatcatttacgttgcatgagagcacttaatcatacctgaagggttttgtagatctcgatgctatttcatatgatgcatcaagttttgtgacgttgacttaagacttattattatcatgattgacttatagtgggacctgtacgctatggc

SEQ ID NO: 59996 - DNA, 293 bp, Zea mays
  Clone ID: LIB3069-029-Q1-K1-H6
cccacgcgtccgcccacacgtgcgtttgctttttacaagatgctgctaacaagcaggtggattttgtgaaggagtacaaggaagattttgaacgtgatcttgacccagagagcgctactacttttcctgcaacccttgctgaacttacggagagattgaaacactggaagaacattcttcaaagtaatgtacaggatcgggtcccagcagtattaaaactggaggaagaaaaggaaacacttagggattttcatgttgatgatattgaactcccaaggcagtactttacagat

SEQ ID NO: 59997 - DNA, 413 bp, Zea mays
  Clone ID: LIB3069-053-Q1-K1-E8
cccacgcgtccgcccactcgtccgttggtcttcaacaacatcacgcggctagcctgcgggatacggttcgtggacgcgagcggccaactggacgagcaagggcgcgagttcaaggggatcgtccacaacggcatcaagatcggtgcgtgcctctccatcgcgcagcacataccgtggctgcgctggctggccccggtcgacgagcaggccttcaaagcccacggcgaacggcgcgaccgcctcaccgtgaagatcatggaggagcacgccagggccctcaagcagcgcggcgcccagcagcacttcgtcgacgcagctcttcactctcagggacaagtacgacctcagcgatgacaccgtcatatgcctcctctgggacatgatcaccggcggcacggacacgacggtgatct

SEQ ID NO: 59998 - DNA, 378 bp, Zea mays
  Clone ID: LIB3069-053-Q1-K1-E9
cagatatattgaattgtggtaatattattattattatccttttcgttgcagaccatgggagtaatccaaccttagtgcgagagtagatctgtgcactttaaagccgaacgtttgtggatccagaaagaagaaaattttgtatgtatatatgtgtagatccaggtgatcgctattgttagcttttgtttacaatggtcgccacccaaaaaagttgtaactcgccctttttttttttttttttcaacaagcatgcaaacaaagtgattatgtctagatctttacatagcgcgacaacagttcatgaccaagcaacattacaagcgtctgatagtgtcactgcataagcaaacatagtgctaacaacattattcacaactc

SEQ ID NO: 59999 - DNA, 321 bp, Zea mays
  unsure at all n locations
  Clone ID: LIB3069-053-Q1-K1-F1
cgcgtncgcaatgactctgatttataaccgagtactagatgccaaattctttgtaataaaatcctgcacggatgaccatgtacataggggcgttaantataaagtttgggccagcacagccagtgggaacatgaagctggattctgcttaccatgcagccaaagagaaagaagagcattgccctattttcttgtttttctcggtaagaacagctcatctcctttggttttttgcttttcccttcgaggaaaaaaagagtaacagtacatagtgggtgtttgatcctttattagcatgtgctaaggtgtttccgattttggt

SEQ ID NO: 60000 - DNA, 355 bp, Zea mays
  unsure at all n locations
  Clone ID: LIB3069-053-Q1-K1-F10
cgtccggctagtggtgactacccaaactgcactgtttttgcttatgaaaaggcanttgccgatgggggggatgtcattgactgtcctgtgcaagtgactaaagatggcatactgatatgcatgagctctgttgacctaatggatgttactactgttgcaaaatcacaatttgcttcgcaagtaactaccatcaacagtctgaaggctgggtctggagtcttcaccttcaaccttacttgggatgatatttctaagaacctaaagcccatgatatcgaacccaatgagcacctataatctgtacagaaatcctagaaacaagaacgcaggaaacttcatgagattgtcagactttt

SEQ ID NO: 60001 - DNA, 366 bp, Zea mays
  unsure at all n locations
  Clone ID: LIB3069-053-Q1-K1-F11
cttccgccaagggttnnntgtttccttggccggttccttttcccccgacctcaaactctaaccgggcggtttccgttgccggaaggggggccaaccttaacaagccggtccttcatccgccaccatggggaagacccgtggtatgggagctgggcgcaagctcaagacccaccgcagaaaccagatgtgggctgacaaagcatacaagaagagccacttgggcaatgagtggaaaaaaccttttgctggatcatctcacgccaagggcatcgttctggagaagattggtattgatgccaagcagccaaattctgccatccgtaagtgtgcccgcgttcagctggtgaaaaacggaaagaagattgc

SEQ ID NO: 60002 - DNA, 329 bp, Zea mays
  unsure at all n locations
  Clone ID: LIB3069-053-Q1-K1-F3
ttttaccggagcggaggctctgttttgccccctttgccgatcggaaaaagttggctgccactgacctttttaatttgaccagaactgttgactcagccacgggtttccaaccaaaggtcctgggctcttggatggagctgaccctgccagagggatgggagcaaaaaggaagaactcagcttgtcaccctgggctcangcaggttctgcgtcgcaaggttcatgaatgagatgtttgatccatacgggagtggatatgttttattgaccggtgtggagatcgttcctcattttgacaatctcactggtaatgacngtagtagtggcagt

SEQ ID NO: 60003 - DNA, 226 bp, Zea mays
  unsure at all n locations
  Clone ID: LIB3069-053-Q1-K1-F4
acccactcgtccgctcacccaacacccgtattgagcggctggtgagggatcggatcgtcggcggctatggaagacgattttcagagggcagcgggccccacctctaacnaccttgactattacgcgaaatcccatttcgtgtcatacgcactgtcctttcgcgttaaatgataatttttccaagggtcccctcctcttgacgatcccagatcacgtccgcttcctt

SEQ ID NO: 60004 - DNA, 387 bp, Zea mays
  Clone ID: LIB3069-053-Q1-K1-F5
cggacgcatggtctttaaaggggtttgttatagagacaagacagagagaacaaagggagagatagttgagtgggagacgggcgagaggctgccgtgtagggaccgtagactcagcgactgcgaaggagggataaggggatggccgggatcggaccgatcaggcaggactgggagccggtcgttgtgcggaagaaggcacccaccgccgccgccaagaaggatgagaaggccgtcaacgccgcgcgccgcgccggtgcggagatcgataccatgaagaagtacaacgctggtacgaacaaggcggcatccagcggtacatccctcaacaccaagcgcctcgacgacgacaccgaaaacctcgcccatgagcgagttccaagtgatctg

SEQ ID NO: 60005 - DNA, 343 bp, Zea mays
  Clone ID: LIB3069-053-Q1-K1-F7
cccacgcgtccggtatgtaaagcagatcttttcacagcgagtcgcagagggatagatccgggcacattcaggccccgatggcgacgacggctacgaaccggcgggtgatcctcaaggagtacgtggagggatacccacgcgaggagcacatggagctgctccggggcgccgaggttcccctccgcctgacgggcgccgagccggccgggtccgtcctcgtcaggaacctctacctcttctgcgacccctacatgcggcccaagatgtcgcgcccgctgcgggagttctacacgggcgccttcgttccgggcgacaccatcacgggctactgcgtcgcgcgcgt

SEQ ID NO: 60006 - DNA, 216 bp, Zea mays
  Clone ID: LIB3069-053-Q1-K1-F9
cttatacactcattattaaatcattttctagtaaacatcattaaatagctcttagggggagccatatgagtgtgtgtgcgggacaccagattataactcatcatcctacttgacatccaaatacactttatacagactcccctctcacatttcaaacaatcaaaaaccatacggttccccccctaatatatttccaaaatcacgtacccgttcatc

SEQ ID NO: 60007 - DNA, 266 bp, Zea mays
  Clone ID: LIB3069-053-Q1-K1-G1
ttgcatctcagtatgtctactgctgcgggatatttgaacttgaggctgcgtaaagtcaatgttaatggcggtgcaatggctcttggacatcctttgggtgctacaggtgcacggtgcgtcagtactcttctcaatgagatgaagcgccgcggcaaggattgccggttcggagtgatttctatgtgcataggttctgggatgggtgccgctgctgtgttcgagcggtgagacggcgttgatgagctcaccaatgctcggggaatctc

SEQ ID NO: 60008 - DNA, 420 bp, Zea mays
  Clone ID: LIB3069-053-Q1-K1-G10
ggggtccggattatgaattgatggttactgatctgctttttattattcgttcaaatcaagctttgtgagaggatcactgtcagtatttgcgttatcaaattcttcgtggcttgaagtatatacattcagcaaatgttcttcaccgtgacttgaagcctagcaatcttcttttgaatgcaaactgtgacctcaagatatgtgattttgggcttgctcgcaccacctcagaaactgattttatgactgaatatgttgtcacaagatggtatagagcaccagagcttttgttgaactcctcagaatatactgctgccatcgatgtgtggtctgtgggctgtatatttatggaactgatggaccgcaaacccttgtttcctggaagagaccatgtccatcagctacgtcttctaatggagctca

SEQ ID NO: 60009 - DNA, 222 bp, Zea mays
  Clone ID: LIB3069-053-Q1-K1-G11
aatgccgataggaaagcagcactatacgctggctcatagatgttcaatgtcgtcacatccgctggtatcatcatggtcaacaaagccttaatggcgacgcatggctttagtttcgctacaacgttgaccggacttcatttcgcgatgacgaccttgatgacattagtaatgaaatgactgggatatattcacccgtcctatctatccgtacctgaactaata

SEQ ID NO: 60010 - DNA, 404 bp, Zea mays
  Clone ID: LIB3069-053-Q1-K1-G3
ggggaactattagaattctttttttgcactcacacgtggtggttttgctggagagctactagttcagcagggtgaacaagatgaactacttccaccaccgaagttagagtcatcaaagtcacctgatggagggaagtccgtcagctcgttcccaaaccaagggtgtttctcacagttctttgagggtctggattggatgatcccgccttcctgctaccaagactccaatggcatccattcagttaccgcatcggatagcatctttaatccgtctgaaggtatacctccttccacaatgaacgcggacggcatggacgcgttccaaacttcctgcctttccgagtgctttcctaattccatccaagaattcatcagcagtccagatataaatacactgacattta

SEQ ID NO: 60011 - DNA, 411 bp, Zea mays
  Clone ID: LIB3069-053-Q1-K1-G4
gtcccgattcccactctcgacatcttcctgtccccatccatctcgcccgcgacgtggagtggattctctgcgggcctggggatccattatgtcttccttctccgccgtcgccagcatcaggggcgccgcttcccccaggccctcgcgcgtcgccaccctctccagcgcctgcgccggcgcccgctcccgcgcgctccttgctggccacacggactcaatccttgaggtgctggcacaggacgatatgctgaacgcaaaggagctgttccaatgggagaatggcttgtcattcaatgacataccggctacgcaggggattcgcatacgcatacactgtcagcccactgccttcttgaaggatatagaggaggagctgtgacccccccttaacattctagagcatatcatttt

SEQ ID NO: 60012 - DNA, 298 bp, Zea mays
  unsure at all n locations
  Clone ID: LIB3069-053-Q1-K1-G5
ggaacagatgtgcactctccagttgtgcctcntaaatgccactccatacaaaacatttagggacctattacctggtagggggcttccacaggacttcctctgtgcaattaaggcagcagattacagctctgcaacaacaaagattaatgtggctgtcgacagactgccacagttccagtgttgcaacaccaatcttgaatgttgtccagagcacatgggcacaatacacattgggtccgaaagcatggaggaaattgacgttgcatacacggaagcagcagacggcatctctttcaaa

SEQ ID NO: 60013 - DNA, 355 bp, Zea mays
  Clone ID: LIB3069-053-Q1-K1-G6
cggccgacccacgcgtccgggcgcacggcgcaccgcacacctcactgtctctcccttctcgtctcctctcctctgcgtggcctcgtcggatccggcgccgacccaccgcccctctgctcgctccttccgccggaatcgctgctcctctctgtgctgtcgatttgtgcggcgactgttagtttggttcggtcccatccttctgttgatcaatggctgacggtgaggatatccagccacttgtgtgtgacaatggcactggaatggtcaaggctggctttgctggtgatgatgcgcccagagcagtgttccctagtatagtcggccgccctcggcacacgggtgtgatggttggaat

SEQ ID NO: 60014 - DNA, 360 bp, Zea mays
  Clone ID: LIB3069-053-Q1-K1-E7
gtttcctcccttcccatcccccactgcttatcagtcagtcagcactcgccacccacacgggttcgttccggccacgggtcgactccaactctccgatctccaggaatccgcggctgaggcgccggcgatggcggctcccatggtcgacgccgaatacctgcgccaggtcgacagggcgcgccgccacctccgcgccctcatctccaacaagggatgcgccccgatcatgctccgcctcgcatggcatgatgctggaacttatgacctgaagacaaaaactggtggtgcaaatggttcgattagatatgaagaagagtacactcatggttcaaatgctggtttaaagattgctatcgatct

SEQ ID NO: 60015 - DNA, 366 bp, Zea mays
  Clone ID: LIB3069-053-Q1-K1-G7
cccacgcgtccggcatctggatgctgatttccaccgcaagtacatctatggtctccatggggctgagtatatgaagaatggggctgatgaggagcccgagaagtaccaggctcacttcagcgagtacatcaagaaggggattgaggccgatgacatggaagctctgtacaagaaggtccatgctgccatccgtgctgatcctagcatggccaagtcaacaaaggcgcaaccaaaggagcacaagaggcacaaccccaagaagttgacctatgagcagaggaaggccagactcgtggaaaggctcaatgccctcaattcctcgggtggtgtcgatgatgatgaggatgacgaatgaagtgctagtcg

SEQ ID NO: 60016 - DNA, 218 bp, Zea mays
  unsure at all n locations
  Clone ID: LIB3069-053-Q1-K1-C11
ctgggctgcagttccccgtcggccgcatcgcgcgctacctcaaggccggcaagtacgccgagcgcgtcggcggtggtgcgcccgtctacctctccgccgtcctcgagtatctcgcggcagaggtgttggaactggcgggcaacgcggcgcgcgacaacaagaagaaccgcatcgtgccgcgtcacatncagctcgccgtgcgcaacgacgaggaactc

SEQ ID NO: 60017 - DNA, 407 bp, Zea mays
  Clone ID: LIB3069-053-Q1-K1-C4
gcatgattgagacatctagctagaacttttagatttcaatgatggaagaaagctcagggggcagttatataacattatgggcttccagttttggcatcttctattgtgttaagaaaacttcattttaactgacaaagtgtcatcttactatttagtttgctaaagggatgttactcatggttagtccacaatattttacatttttacatatcttgtagctcttcactttcaggtttcttaaggaactagacttacaaaagagttgtgtgaaacatcaagaccatcagtggattaattgttttcccaagtcttcaacatcactagaatgcttgaatttttcctgcttgactggggaggtgaatgcttgtgcactggaggaacttgttgcaaggagtccaaatcttaaa

SEQ ID NO: 60018 - DNA, 322 bp, Zea mays
  Clone ID: LIB3069-053-Q1-K1-C5
cccacgcgtccgcgccaggtcttcgtttttcctttggctggaaacaagcatccaccagggacaactcaagggatgctcgagtggctctagttacttagcagaaccaaaagaggaaggccatcaaagatacgagggctttttctcgccatgtctcggtcgccacacctcccaccccgctgcccacccctgggtcctcagatcactcgaagggatgacagcatgttcacgcagagctgcaggtttccatctggggatacgttctttagtgagccaccgtgctggctcgatgatctccttgcagattccgggaaaagctccaagc

SEQ ID NO: 60019 - DNA, 348 bp, Zea mays
  Clone ID: LIB3069-053-Q1-K1-C7
tccagctctagtgaagcaagatttccaatttctgatataatcctaagaacagttactgggagtatgtttcctgttattgatccacggcaagtaatctccattcaggaacatgagtatgtttattgcctggcaatcgtcaagagcatgaagctcaacattattggacaaaatttcatgactggtcttcgtgttgtgttcgatcgggaaaagaaaattcttggatggaagaaatttaattgtttctcaccttcaacatctgagaactactctccgcaggaagcaaggaacccagctggtgtttcccagttgagaccactgaacaattcatcaccagcagcgttatatgat

SEQ ID NO: 60020 - DNA, 380 bp, Zea mays
  Clone ID: LIB3069-053-Q1-K1-C8
cccacgcgtccgcccactcgtccgctgtctcgtgggcggatgggcaagtgatgccatgcgttatgtgaacgtggaggtggtgggcgtggacacgcgaccggacatcgaaagagcagtctcgtttagggagaagccgaggacgagcatggcgccgccgccgctgccgacgacgcgagatggacggaagagcttggaggcagcgccgtaccacgatgtccttgacctgaagcagctgctcgatctggctgacaaggaaggccgggtggccgtgtatgggaacaaaaggaactccgacaccagcagcgtgagcagcgtcagtagcagcagcagcggcggcacaaccagcatcagcagcgctagcaccatcggtggcgcgagcc

SEQ ID NO: 60021 - DNA, 322 bp, Zea mays
  Clone ID: LIB3069-053-Q1-K1-C9
tacttctatatctcaatcagacgcccctttttttatcttatcctaatatcatttactagatttttttaacatgttagtgagccaccccaactcatctccattcattaacatattatttttattttctttcaatcttcaatatcattaatctcaacaaaaaaaacaaaatttcataactattcttcttttaaaatcccaccgttaaaccaaaattattcaacccacacatttaatcaaaaatcaccttcatcatctaaaaactactttaaacaccaaacaacgaacccccctaaaaattcccaaatgacaccactgaacaatt

SEQ ID NO: 60022 - DNA, 363 bp, Zea mays
  Clone ID: LIB3069-053-Q1-K1-D1
gggttcagattaaaaaggcagtgtgaggtctatggatgcgtgtgaggagtatataaaggacattataaatcaatgggagcaaaggaaaggaaaggaaaggaaagggagaaaatttcatatagcaattgtttcgcgtataggagggagaacaaaggtcgcgtctcgaaagttcttgccttgttgggaagggatggcgtcggaggtggaggacgacgcggcggtgccgggcgcgccgctggtcgccaatggtgcagccgacgtccgccggaggagggatcaggcgaaggcgattttgtccaagcaggccgtcaagatcgccaccaatgccgagcagcacgagcgcttcatctttaaggtcacaca

SEQ ID NO: 60023 - DNA, 286 bp, Zea mays
  Clone ID: LIB3069-053-Q1-K1-D2
aacgacgagaggtgcaatttctccaataaaagccggaacaacggcagccggcgcgtcccggtggccggagccggtggtggcggggactctctgctgaagagatcgtccagcatgagagacgccccggcgatcggccgcggctcctcggccggtgcgggcgggtgcgcggcgcatcatccgccgtcgttctcgagccggtgcgcggggctggtgaatgagcatcgggcgcgcttctacatcatgcgccgctgcgtgaccatgctcgtctgctggaaggaccgctcgt

SEQ ID NO: 60024 - DNA, 417 bp, Zea mays
  unsure at all n locations
  Clone ID: LIB3069-053-Q1-K1-D3
cggacgcgtgggcggtctcgtggggtcttcgcttgcttcctttcgaaagtccttgcgtggcaggctcctatcgatcgagtgtgtccggattccanagaggcccaactgccgaagccatcgatcgccgccacctcttcgagcagaatagttgagaatggctgacgaggatatccagcctatcgtatgtgacaatggcactggaatggtcaaggccggtttcgctggtgatgatgcgccaagagctgtcttccccagcattgtgggaagaccacgccacaccggtgtcatggtcggcatgggccaaaaggatgcctacgtaggtgatgaggctcaagccaagagaggcatcctgacactgaagtacccgattgagcatggcattgtcaacaactgggatgacatggagaaaatctggca

SEQ ID NO: 60025 - DNA, 364 bp, Zea mays
  Clone ID: LIB3069-053-Q1-K1-D5
tctgactctccgctgttcgctcactcttgtagctccacccttcactcagtcttaggctgttattatctctaggctctagggagccgcgccactccttcgtgtagccatcagccttctcatcgccaccaatggccactgccgaggtccagaccccgaccgtcgtggcggccgaggaagcgcccgtggtggagaccccgccgccggccgtcgtgcccgaagagtctgcccccgccgaggccgaggccgaggccgaggctgctgctcctgctgatcccgaggagcttcccgcggccgagcagcaggcagccgccgaggcggaggccgcggctcctgctggtgccgaggagcccgtcgcggccgaacc

SEQ ID NO: 60026 - DNA, 318 bp, Zea mays
  Clone ID: LIB3069-053-Q1-K1-D7
cagcaagatcaacgtcttcgttcaagccttcggtagtagagactacgaccgaggctggggaagctaagagatggcggatcggcagtactcggcgtggacgacttccgctgctcgtcatcgggtcttctcctgtgcgctcatggctcttgttagttttgtggctgccggacgacccatggtgctcgccgacgccatcgtctttcacgtggcgaacaagtgcccgttcccggtgtggccggcgtccgcccctaacaccggccacccggtgctcgctggcggtggcttctatcgtcccgcaggcaagtcgaggcgcgtcgt

SEQ ID NO: 60027 - DNA, 356 bp, Zea mays
  unsure at all n locations
  Clone ID: LIB3069-053-Q1-K1-D8
agcaaaccacaccagtcaccagccttattttctcaaccccaaaccaatccgtcgcggacgctcattgtcgcaggatgccggcgccnccttagcaccaccagccccaggacgaagaggacgacgataccgcaggcgttgtcaagctcatcagcgccgagggcttcgaattcgttgctgacaggaaggccgacatggtctccaacaccctccgcaacatgctcacatccccaggcgggttctctgagacgcgccagggcgaggtccgcttcccagagatccccaccaacatcctcgagaagatctgccagtatttctattggtcgctccattactccagtgggaaggagacagcggag

SEQ ID NO: 60028 - DNA, 265 bp, Zea mays
  Clone ID: LIB3069-053-Q1-K1-D9
gtgaacatccaatcttatatgccttttctgctatcagcagcaccagaatgcctaccacgataattattacatgccggggtggcctctactaacactcacaaccctttctcttaaacatctatgtatacaaatgtacgctaattgctcattatatcacatttcttgttataccacccatggcgctagccaacaccatctcatataacctctcgaacatgctcccattcccagtttgttcttctaaaaacactaacaccgaccaccc

SEQ ID NO: 60029 - DNA, 341 bp, Zea mays
  unsure at all n locations
  Clone ID: LIB3069-053-Q1-K1-E1
gtgagcttgaccaantggcgagggcgaatgattctgctgctgggggacatgaagctganaagaagatgatggagggtgaattggagatgctgaaggtgaacgtggacatggttcaggctgagaaagatagtgccttagtcttggtagatgctaaaaatgctgaggttggaaagttgagggatgaactgaagaagctcaacagttccatggctgcgctccgtgctctctatgatgatcttgatggaaagtcttctttcctccacgatgagaaagtttcggttctcaaagaacttgagcaggagaaagctgaagcagaaaagctgaagtccaaaatccaggag

SEQ ID NO: 60030 - DNA, 403 bp, Zea mays
  Clone ID: LIB3069-053-Q1-K1-E11
ttccgaactcaataactgaactctttattgattcagtaggtagctagctaggggagtcacaatggatcctaggaagttccgtccgtccagtagccacgacacgacggtgacgacgactaacgcgggcgctcctgtgtggaacgacaacgaggcgctgactgtggggcctcgcggtcccatcctgctggaggactaccacctgatcgagaaggtggcgcacttcgcgcgcgagcgcatcccggagcgcgtggtgcacgcgcgcggggcctccgccaagggcttcttcgagtgcacccacgacgtgacgtcgctgacgtgcgccgacttcctgcgcgcgcccggcgtgcggacgcccgtgatcgtgcgcttctcgacggtgatccacgagcgggggtccccggag

SEQ ID NO: 60031 - DNA, 279 bp, Zea mays
  Clone ID: LIB3069-053-Q1-K1-E4
ctcaagggtctcatgttcaggcagaacctcactccaacaatcgtcatcgtttggtccagcctcctttcatctatcttctgcttgctataaatgaaaatcgatcctttcatctccccgacacagaaagctgccgccttggggcaatgtggtgtgaactgctgatccagattgtgactcttatctgaagaggctcagccaaagatctgccccctcgtgtaaatacctgagggggctagatgggaattttttgctgtatattaggacccatctacaaccttt

SEQ ID NO: 60032 - DNA, 324 bp, Zea mays
  unsure at all n locations
  Clone ID: LIB3069-053-Q1-K1-C1
ctcctcagcaactnccataccccaggctcttttttacctgagcgagccnaccaaccnntttncctttcttatcctcctccttcaatataaattactccnatgtatccaatcatatccatcatatttttcttttcatcctccattattcctactattaattccaactaaatctccctctccccctatgaagaattcaacatttataatttgcaccttttttaatcttataaaaaaaatatcaagcaatagtattaacgcaaagataatcatgtttaaatacacaagaaaatttattactctatacaatttaattcttctcccatc

SEQ ID NO: 60033 - DNA, 358 bp, Zea mays
  Clone ID: LIB3069-052-Q1-K1-H10
cggacgcgtgggcacgccaccaccgagtacttcatcttccctctcaggtacgagttcccaggtttcgagggctcggcgccgccgctgttttgcccttttccacgccgtcgctgctgcagcaggtactcccagagctcttcatctccatttccacggctcaggtaatccatggattccatttccacgctggcctctattgcttcgttctcctccacagaaaggatgcaccgccagaaatggagtccccccagaactggatgaccaagctcttgattggccctcgccggaaatggagtccccccaggcgcaaccaaccttatccctctcaacgagatagttgtcgacatcaatggaacat

SEQ ID NO: 60034 - DNA, 414 bp, Zea mays
  Clone ID: LIB3069-052-Q1-K1-H11
gcgtccgtttgttttcctttcctttctactactaatttaaaataattttgttgtcaccaaccaatcgggcgcggcggctaaccaatcctgccccttcccaggcactctcaccgtcccttcgccttattcattggcctgggcccgtccctcccacccacttacaggtgggccctaatcgtggaatcggcatctccagctggtcgacctgcagcatattcacacatccgacacacccactttgtttgcccgttgccgatccgttccgtttcagttgcccgtgtgagcgaggggaacggtacgccgccggcgccgctgctgcgacgcgtgctcgcgccgccacccgacgacgacctggtccgacttcgcgttcgcgccgtcgcggcagcccgcttcatcggcgctggaagcccacca

SEQ ID NO: 60035 - DNA, 338 bp, Zea mays
  Clone ID: LIB3069-052-Q1-K1-H12
gttgttatgctggttggtaacaaatctgatttccgccatcttgtagcagttcaaactgatgaaggaaaagcattcgcagagagggagtcattgtatttcatggagacctctgcactcgagtcgactaacgttgaaaatgcattcgcagaggtcttaactcagatctaccgtattgtgagcaagagagcagttgaagcaggcgaagatgcagcatctgggcctggcaagggcgagaagattaacataaaggatgatgtttcggcggtgaagaagggtggctgctgctctagctgagctgccctgctgtattttttgaagttgtggtgatgtagcttatg

SEQ ID NO: 60036 - DNA, 352 bp, Zea mays
  Clone ID: LIB3069-052-Q1-K1-H2
ggccgacccacgcgttcgcgtatctccagcgacggtagcgggcgaggtttacgcgtttgcgaagcttagtagtggatgcgggaggcggcagccatggccttgatggagaagctcaagatctttgtcgttaaggagcccttagtcgcggcctcctgcctcatcgctggattcggtctctttcttgcatgagttgtgcggccaatcctggaagcatggtagaccgtgtaacaagtttcttcttctcttctaaatgatgtgggtgcatgtgtcaccggcgagaaaaagtagtgaacttgcattgttttctcatgccaatggtgccccacattttcttccccgtggtttttctggc

SEQ ID NO: 60037 - DNA, 372 bp, Zea mays
  Clone ID: LIB3069-052-Q1-K1-H3
tcgcccacgcgttcggagcggtgcacagcacttttcaacccatatggcgattaaagcatggaagggcagagcacctttgcgcagaacgggcagcagcccatgaggagcctctcgtatggccctcatgcttccccgtatcggcagtcgcctatgcttgacagctagctgcatagagtcattgtgcttgtctgtcagccataacatattttcaagactgaagtttggaccataactggagtatgaactcatccatccaacaagcatctgagctatctattattgtggatgaagcagcaacattgattcgaatttgcatatcatctgcgagtgaatttttttctctcttgttattgcttacattttagctggact

SEQ ID NO: 60038 - DNA, 124 bp, Zea mays
  Clone ID: LIB3069-052-Q1-K1-H6
cgagggcgagaagattgcgtccattctgccgttcgatgacgagacggagatgcaggacgccgtgtatgctgtcataaggtagctggacgccaaccagctcgccgaggcggacgagttcgaggac

SEQ ID NO: 60039 - DNA, 325 bp, Zea mays
  Clone ID: LIB3069-052-Q1-K1-H8
cccacgcgtccgcggacgcgtgggcgccttttgatcgctcttggtgcatctgaaggcctgggttaccttcaccatgactgcagcccacgaataattcaccgggacgtaaaatcaaagaatatactcctcgacaaagattaggaagcccatcttacagactatagcatcgctaagagcttatgtgagtcgaagactttcacgtctacctacgtcgtgtgcactattggttacattgatcccgaatacgcccgcaccttccggcttaacgagaagtctgatgtctacagctacggcatcgttctgctggagctgctgaccgggaaga

SEQ ID NO: 60040 - DNA, 386 bp, Zea mays
  Clone ID: LIB3069-052-Q1-K1-H9
cgtgcgcggacgcgtgggtgaacatcaagggtctgctctacctgacttgtcagactgttgctgacaggatcaatggcgagacaccagaagagattcgcaagaccttcaatatcaagaatgacttcacccctgaggaggaagaggagatccgcagggagaaccagtgggccttcgagtaaggaggtgctggatctattgatgcctaagtttggtggtgtctactactatgtctactttatgttgtcctaatggttgtaagtattttgggagtcactttgcttgcgaatgtctcgcgtaagacttatgtggtcaatggtcggttattaacttattaccatgaaagcacttcgtctgctgccctaagaggtttagtcccatttgcatta

SEQ ID NO: 60041 - DNA, 364 bp, Zea mays
  Clone ID: LIB3069-053-Q1-K1-A5
cccacgcgtccgcccacgcgtccgcctttctttacgagtatccaagtccaaccagggagaggggaggcgctgcacgcaggtcacgcggcgatggacatatgcgatgtttgagcaggcggtggcagatttctgctggcatgcgagggaagtagtgtcgtcagggatggggctctggggttggccgtgggggcgacgtgggccgtcgggcttcggctccgcgtccaccgccgaggaggtcaccgccggcgtcgacgcaagcaacatcactgccatcgtcacaggagcgacgaatggcattggaaaagagacagccagagttctagcactgaggggagccaaggtaatcataccagctaggacactg

SEQ ID NO: 60042 - DNA, 103 bp, Zea mays
  Clone ID: LIB3069-053-Q1-K1-A6
cccacccactcgtcctcccactcttcctcccactcgtccgttaaataatataaaaaaaaaaaaaaaaaaaaaaaaagaagtttttaaaaaaaaagggggcccc

SEQ ID NO: 60043 - DNA, 359 bp, Zea mays
  unsure at all n locations
  Clone ID: LIB3069-053-Q1-K1-A9
ctaggaatgaacctttagaatgttgttcctcacatgctgggttcatgcaaaaagggaagtntctctaaggatgacagtgtgattcttgatggcgctggaaacaaaaagtctattgaagagagggcagaccagattagatcagcagttgagaacagcacttcagattatgacaaggaaaagctccaggaacggttggcaaagctctctggaggtgttgctgttctgaagattggaggagccaccgaagcagaagttggtgagaagaaggatagagtgacagatgcactgaatgctactaaagctgctgttgaagaaggcattgtaccacgtggtggtgttgctcttctcctatgcattga

SEQ ID NO: 60044 - DNA, 293 bp, Zea mays
  Clone ID: LIB3069-053-Q1-K1-B10
aatgacacaataagggcaaacattgcctatggaaaagatggacaagcaacagaatctgagatcatatctgctgcagaattggcaaatgctcacaagtttatcagttcggcgctgcagggatatgacacagtggttggagagcgtggagcccagttgtcaagagggcagaagcagcgagtggcgatcgcccgtgcaattgtgaaggaccctaggatcctgcttctggacgaagcgactagtgcgctggatgctgaatccgaacggatcgtccaggacgcactggacagggtgat

SEQ ID NO: 60045 - DNA, 373 bp, Zea mays
  unsure at all n locations
  Clone ID: LIB3069-053-Q1-K1-B4
cccacgcgtccgcccactcgtccgctcatgcttccgcggacgcgtgggggttagggctgagccattcatcccacttgccgctagcanatctagttaaatttgtgatattttcgaacttgtcaattgttgggatgaatgtgagcttgatgtggaactctgtgggcttttatcagatagcaaagctgtgcatgatacctgcatcatgtcttctggaggttgtctttgatcatgtgcattattcccgggacacaaagctgagcataatggtcgtgcttataggagttgcagtctgcacagttactgatgtcagtgtgaatgcaagaggtctaatcgccgctgttatagctgtttggagcacagctttgcaacaata

SEQ ID NO: 60046 - DNA, 354 bp, Zea mays
  Clone ID: LIB3069-053-Q1-K1-B5
gtccattagtgttctcttccgtggaaagtctgctgcttctactgtggtggaattttgtggcgggcctatgtgctggagcacccgtacaatttctgcatctgctggcggaggagcttattgtaatgggcaaaagattcatgtcagtcagacagacaaggtggaacaatcacttctcgtcacaggttttggatatgaacacgatgatgcctggacgaccaatatgaatctgttcaaggaatttactgacattagcaggggagtgcgaaggctagggtctgctgctgctgacatgtcccacattggacttggtattacagaagcttactgggaataccgacttaagccatgggatat

SEQ ID NO: 60047 - DNA, 378 bp, Zea mays
  Clone ID: LIB3069-053-Q1-K1-B6
aacaacttatggatctttgcgcccaccttttggaaaacatcgtctgaagattgtagaagggatctctgtgctgcttacaagtggaaatgaaactgctgaaaaagagctaaaaaaggcgtcagcaataaaacgccccaatggtttggtctttgaagattcctataacaaccttttgcccccacatggtgggaatataaatggtggctggccggaggggaaaaaaacctgaagtggtgagcatgtccttcatgaatgtgataatgtgggtaaaattcttgcctcaaaaaggttttcatccttgtcgactgagtctaatgggcctactggtccctctgaagggaaaacccctccaagaattggaaatggtggtcacatgac

SEQ ID NO: 60048 - DNA, 365 bp, Zea mays
  Clone ID: LIB3069-053-Q1-K1-B7
cggacgcgtgggcggacgcgtgggcggtctcgtgggttcaacgccagggaagccaccgggggcagtaacgccgacgcgtgcagcagcaagcgcggtgtggccgggtcacagccggcggcaagccagaccaaggtgagcgcgcagaaggaggaggagatgctgaagctgttcgagcagaggaagaaggacctggagaagctgctggacatctacgagcagcgcctggaggaggccacgttcctggccggcgacaacttcaccatcgccgacctgtcgcacctgccctacgcggaccacctcgtcttcgacccgcgctcccgccgcatgttcgagtcccgcaagaacgtcagcaggtggtggcacga

SEQ ID NO: 60049 - DNA, 366 bp, Zea mays
  unsure at all n locations
  Clone ID: LIB3069-053-Q1-K1-B8
cctgttccttgttcgaatccaagtttctttcccaaaccgccaaccccccaccccaagggangaaccctacccgtgagaagcgccgccccacaaccccggacgtggtggcaagcgaccgatccggatccatcatcccaagcttcctttctgtctcctcttcatccatctccacaaggataatcaaagaaagaaggccatggttttgttcgaacttgacccggacatcatccgatggggtcttcaccatctcctccccgctccggctggatactctcctcattgtcgcacccaaaccacccctaccacaccttgtacagcttttgctcgccctcctcatcagcccatcggagacatgggtacctcaag

SEQ ID NO: 60050 - DNA, 321 bp, Zea mays
  Clone ID: LIB3069-052-Q1-K1-H1
acgcataggtgttctcctccccagccgccagatttgtatccaaccgccgaggaacatgaacgacggcgcccttagcatcctttgtgtgatactgttcttgcactgccaggccgtgcccgttcccactggtgatggcgagtatctcaactagaccttaccgacaacagagtgcgaaagcaagtgagggtgcgcgcacgtcagaaaagagccaaggagaaatcaaatggcccaaaaaagaacaagaatatatctgccatcgccttttgaaccttgccctacgaccaaaacctgacgcctactctctctgttcatgctctttct

SEQ ID NO: 60051 - DNA, 400 bp, Zea mays
  unsure at all n locations
  Clone ID: LIB3069-029-Q1-K1-E1
gtaagcaaaaacaatttcagtcattgcaactacaccgatagcaagttggtatacctctttttttgcttttccttgttagaaatactcagtcaagatactgatggatgggagcatcaatcaacagaagaaatgttatgttaaaagttaaaactgtatccatccaatgaagataacagattcgaacatctacttttctgtggggagcaagtcttcatatttgacacagtcacggcaaagtttccccaaacaaaacgactcttggaacacattggcaatgtctatacatctnccacataacatacatcttcagatgccaaacatacacccctctgcaagtactatgtctgctggtcttgcactcctttgatgggcaatcataaacaagtttgtagtttggaca

SEQ ID NO: 60052 - DNA, 371 bp, Zea mays
  Clone ID: LIB3069-029-Q1-K1-E10
tccacttcccttccacaacggaataacaatttggatacactactatgttcatgcaagtcgagaggccatacatggtatttacaggacttgaagactataaagcacgaggcacacaagcaagtccttactacacagtcactcattacacagagtttgctgagaccaaggacactgtgcttattcgaggagatgttgtttttaccagcaaactaaccgattcagaggcaaagactcttctagagactgctcactcgttctacctgaatgatgtgagatacagactcgtggagcgcttcaacaaagagactcatgattttgagttcggggacgtccttaaagtgcttgacatgccaaccatgtgacccagttta

SEQ ID NO: 60053 - DNA, 125 bp, Zea mays
  Clone ID: LIB3069-029-Q1-K1-E11
actctcctaacatgctatcacttctttgaagtacatctaattattcactcttgcatgaagtacttcatttctttttattctgcatcttagattctacatgattattgttcctataatacagacca

SEQ ID NO: 60054 - DNA, 349 bp, Zea mays
  Clone ID: LIB3069-029-Q1-K1-E12
gttaatctaccactctcactagaatgcccttggcaataaatacaaccttttcacacattggaaggttcggtacctttttcggtagcacttgttactattattgcctgggactatcacgagagagtggctgaacaaccgctcacgaattgctgattagtgaggctccggacgctttgctgatgtcgacaggtgtattttttaccagggggctaaccgtgagaggggcacatactcttgtcgcgactgatgactcgggcttactggatcatgacatatacagactcctggtgcgctttaacaaagtgacttatgatgttgaatgcggtgacgtccttaaagtgcttgacat

SEQ ID NO: 60055 - DNA, 404 bp, Zea mays
  Clone ID: LIB3069-029-Q1-K1-E2
cccacgcgtccgcggactcgtgggccgattgctttttcggatgcggcggaattagttcagaagtgctaaggttgtcagagatgtgcaagagatcaaaaacaaccttcgtccttgacacagctcatacaacccatctggccattgcaaaggtggggccttgacttgttgggtccattaccaccggcccaagggaacttaagatatgttgtagtggctgtggaatatttttccaaatggattgaggcaaagcctttagccacaataacttcggccaccattcaaaagtttttctggaagaatattgtttgtcgtttcggggtaccaaaggccatcactgtggataatggaacacagttcgactccgaagctttcagagatttctgtgatcaaattggtacgaagat

SEQ ID NO: 60056 - DNA, 222 bp, Zea mays
  Clone ID: LIB3069-029-Q1-K1-E4
cccacgcgtccgcatttcccgtgtacgcttcttttcccgaggagttccggcggcaggtggcggctcttatcgggtacacgtcgctgggagcgttcgacacgtgcttcaacactgactaggtgtctgcgggcggcgcgctcgccgtgacgctgcacatggaccggagccgtggacctgacgctgcctatggagaacacgctgatccacagcagctccacgccg

SEQ ID NO: 60057 - DNA, 249 bp, Zea mays
  Clone ID: LIB3069-029-Q1-K1-E5
agctcacccacgcatataacaagatttttttttgatcctacaccgaaaccctcaaggtggtgtctcgtacttagtgcgaacccaaatacaaatatcaccctccgaaatacagagcaccggtctttacacaccacgagataaaactcatggagcaacctgatgcatactagaaaaaatctgtatacaaacatcggaaagatagcatattttcggcagaactactaccaaatgggttgcatgacacacgac

SEQ ID NO: 60058 - DNA, 405 bp, Zea mays
  Clone ID: LIB3069-029-Q1-K1-E6
cattaccccagcggcccagcgtgcggtgactgggagacgcgctccccagtccccacggcgctctcgtgtcgtggcgacgactgggggggctgtcgctgccgccctacgtcaggtggccaggtcgtattagggcacttcgccggcgacgagtaccacaagtttgcaggcagtggacactttctctggtatcagagggtcaatgtccaattattatgatgactacgatgacattgacgagatggaggatgattatgatatggatgatcccattgatgacatggtagacgaacagcaagggattagggattctgatgcggaagataatgattatggacaaccaaatgataagatcccagatacttcatcagcagatgcaagaaaaggaagggacattcaaggaatacc

SEQ ID NO: 60059 - DNA, 350 bp, Zea mays
  unsure at all n locations
  Clone ID: LIB3069-029-Q1-K1-E7
gtctggagtctagactcagngttgttaacttaagtttaatcatcttagcaactacggtacgtgaccctgagcgcctggttgttggcaaacaaccgacaccttgggcctacaccttaaaaggttttgcgccgacattggcttttcataagtgctcaatcgggatctatcccctcgagcatagagaaaaagtatcaattttgacaagggggtccaatattctttaagcatgcctacctcaatttgccacaagccagaatgccatgatatgatcgatgaaatggctgttgccggcaaatgactttcaaggatcaattgtctttcaagaaccacaccttgtattggattacggg

SEQ ID NO: 60060 - DNA, 427 bp, Zea mays
  Clone ID: LIB3069-029-Q1-K1-E8
ctacatttcttctctctctgctcctccgttttcgcctgatccatccaagacagggatcgccatgtcggactcggaggagcaccacttcgaatcgaaggccgacgctggggcgtccaagacctacccgcagcaggctggcaccgtccgtaagaacggcttcatcgtcatcaagaaccgtccctgcaagggtgtggaggtttctaccttcaagactggtaagcatggccacgccaaatgccactttgtcgccatagacatattcaatgggaaaaagcttgaagatattgctccttcatcacacaactgtgacattccgcatgtgaaccgtactgagtatcagctgattgatatttctgaggatggatttgtgagccttcttacttcagatggcaacactaaggatgatcttagactcccaactgatgag

SEQ ID NO: 60061 - DNA, 373 bp, Zea mays
  Clone ID: LIB3069-029-Q1-K1-E9
gcattttgcactctaccagtcgctgaagatttccctttataagcctgcggcatttaacaagggaattttgctaccactctgtcgggaaaggaattgcaccctacgcgaagcagtgattattgggagtattatccagaaagtttccattccatttctccatgcaagtgtagctctagtaaaactagcagagatggagtactgtggcactacaagttacttcatcaagctatttctagacaagaaatatgctttgccataccgtgcacttgatgcagtgcttgcccatttcatgcgttttgttgatgatgagaagatcatgcctgttatatggcatcaatcactgcttgcatttgtggaaagatacaagaacgag

SEQ ID NO: 60062 - DNA, 393 bp, Zea mays
  Clone ID: LIB3069-029-Q1-K1-F11
tgactgatggcgatccaacagggttttgtttacatactctatcaattcttgtgaatgatgtccgtggagttctcaatcttggaacaggtgtattctccagaaggggctacaatattcagagtcttgctgttggcccagctgaaaaagaaggaacttctcgcatcactactgttgttcctggaactgatgaatccattgccaagctagtacatcaactgtacaagctcattgatgtttatgaagttcaggattttacccacttaccatttgctgctagagagttaatgatcataaaggtcgcggcaaatgctacagctcgaagggatgtcttagatattgctcagatttttgaggcacagaaagttgacatatcagaccacacaattacactac

SEQ ID NO: 60063 - DNA, 438 bp, Zea mays
  unsure at all n locations
  Clone ID: LIB3069-029-Q1-K1-F12
gctggtgtgacacttaagtgcgcaaatgctttgcagaagaaaactgtcaacatacaaccgagacggtcagcaaatgataatgttatgaacacaagcagagcttcttacccttgtgagaactatgaaactgaaagaagaggattagggaaaagaactctgggggatcctcaagttacaatgggtagttcaatggtagtggatggctcatttgtatcatctatgtcctctgataactcagtcgaagaaagcagctttcaacaactgcaggatgctgttagtcaggtatcatgggttactagttttctttttgatttcttttaatttcccatatagcataaactctagcctacagcagtacagccccttcattntggtattgcaaatccatgctgtgtttgtagtttctttttttttcctttggggttttttgatctctct

SEQ ID NO: 60064 - DNA, 56 bp, Zea mays
  Clone ID: LIB3069-029-Q1-K1-F2
cccacgcgtccgagattattgatttggcgtcgttgaccggcgcttgcgttgtcgca

SEQ ID NO: 60065 - DNA, 301 bp, Zea mays
  Clone ID: LIB3069-029-Q1-K1-F3
cggacgcgtgggcgaaggcgtgggcatgcttccttggtcccaccacgtccctgtgagcggcgtggacgaaggcgacgagatgacgccgtacctgctcgcggcgctgcgccagtacctgccgtgcaacgacgccggcgccgaggccgaggccgaggaggatgaggcggcggcggccatggcggcgggcgtggacggctacggctgcgacgagttccgcatgtacgagttcaaggtccggcggtgcgcgcgcgcgcgcagccacgactggaccgagtgccccttcggggcacccggggagaaa

SEQ ID NO: 60066 - DNA, 364 bp, Zea mays
  unsure at all n locations
  Clone ID: LIB3069-029-Q1-K1-F4
ccgggccgaccgcgcgcgtccgatcagagtaaacacagcagaaccctagcgcgccgtttctccgacgactcacatcccacgcgacgggccaccccatggcggccaggggctccaccagcgccgacgccccggcctcggtgcggctctccgcagcagcgcaggcggctgcgatccagccctcctccccgcgcttcttcttctcctcgctggccgggaccaacccggcctccccgcatcgccgcatcgccattgccgtcgatctctccgacgagtccgccttcgccgtcaagtgggccgtgcagaactaccttcgtcccggggacgccgtcgtgctgctccacgtgcgccccacctncgttctcta

SEQ ID NO: 60067 - DNA, 123 bp, Zea mays
  Clone ID: LIB3069-029-Q1-K1-F5
accacgcgtaagccaataaacagctttctatcttaacatagactgaataccagcaggtggagtcatttacacaattcgatgccaaatcttaacattatctttcgccatcacatgctctgaaat

SEQ ID NO: 60068 - DNA, 257 bp, Zea mays
  Clone ID: LIB3069-029-Q1-K1-F6
cgatccacatagccattggcagttcagttttccgatcctctaccgcagcagcgtaggcaaagtaggaggcaaggatcaatggcgccgccgcggatctccttcctggagctctgcctctccttcctctgcttcgtggtcttctactacttgcacatcagatccaagcggaagaaccctttcgtgccgctggactggccgctggtgggcatgctcccgggccttcttgggaacctttcaccaccttcacgactgggatc

SEQ ID NO: 60069 - DNA, 349 bp, Zea mays
  Clone ID: LIB3069-029-Q1-K1-D9
gcacctcctttcccacgactcccgagcgctttgcgtgtggcgcgcggcagcatggcgactgcgagctggagcagcaagggggcgttcgaggtgcccaaggtggaggtcaggttcaccaagctcttcatcgacggcaagttcgtcgacgccgtctccggcaagacgttcgagacccgggaccctcgcaccggcgaggtgatcgccagcatcgcggagggaggcaaggccgacgtcgacctcgccgtcaaggccgcccgggaggccttcgacaacgggccctggcccaggatgacgggatacgagcgtggtcggatcctccacaagttcgcggacctgatcgacgagcacg

SEQ ID NO: 60070 - DNA, 347 bp, Zea mays
  Clone ID: LIB3069-029-Q1-K1-C2
cccacgcgtccggtccttatcatgagtctgttttcaaataaacttatgagctatatgtgagactgacaatattacctcatgaataaatttccttactgaaacaggctctaaaaacagaagttactagagcacgcatccaactattggaaccattgattaagggatcaggtggagtggagtacctgcagaagtcttttgctggtcgctgtggttccccttctgatgcgttagcttctctcccttcaactgcccggtggattttctctttgaaagatgtcgtggaagaacaatggaatgaacatgtcagctcggtatcaattctgccagaagcagaccatgttcagaca

SEQ ID NO: 60071 - DNA, 279 bp, Zea mays
  Clone ID: LIB3069-029-Q1-K1-C3
cccacgcgtccgcccactcgtccgcccacttgttttgctttgttcacgaacaaaaccggagggggttcattagctaccaggaaagttaccaaacttaaccacttgaattaccttccaaacataacggccagcaccatgtgccacatggtcaattcaatgtccagcttaatggcaccaggtggaccttaaaaccatagaccaaaccaaacttgaacacctaccttccccattcttacgccttattaaaccgcaccaaggcaaaccaatgcttccaaaaca

SEQ ID NO: 60072 - DNA, 309 bp, Zea mays
  Clone ID: LIB3069-029-Q1-K1-C4
gcttcacaacatgctatcttcttttttgcttgagttccacagatatggaagaattttacgaatgaagggaccggcgagctaagcttccttacctgtttcatgaactttgctggttccatcgtaagagtttttaccagcatccaggagaagactcccttaagtgtgatcatgggctccgcaatcggcatcgtcatgaatggtacgctcttgggtcagatagtactgtaccagaaacccgcttcaaagaaaccgaagaaaggagatttagccaccttgagaaacctccaaaaggtctttccgggtggttaa

SEQ ID NO: 60073 - DNA, 246 bp, Zea mays
  Clone ID: LIB3069-029-Q1-K1-C5
cccacgcgtccgcccatcgtccgttgacttgtgggcggacgcgtgggctcccgggggggtgtcttgtcgcatccggcgggccaaagctctctctgctcgcaggtcgcagccatggcgaagaactacccgaccgtgagcgccgagtacagctaggctgtggacaaggccaggcgcaagcttcgagccctcatcgccgagaagagctgcaccccgctcatgctccgtcttacgtggcactacgcgggg

SEQ ID NO: 60074 - DNA, 378 bp, Zea mays
  Clone ID: LIB3069-029-Q1-K1-C6
cccacgcgtccggaaagaattgtcactaactattcatttatggagaccctaagaggcttagatcagaggggactgctagcaagatttgtgattgatgaagcacattgtgtaagtcaatggggacacgatttccgtccagattaccgtggtctaagatgcctcaaacagaactttcctacggtcccgatcatggctttaaccgcaacagcaaccgaatctgttcgtaaggacgttctttgtgccttgaggatccccaacgctgtggtacttgaaaagagcttcgacagactgaacctcaactacgaggtaatcggcaagacgaaaactttccagaagcagctgggcgatctcctgaaagagcgcttcatgaatgagtct

SEQ ID NO: 60075 - DNA, 430 bp, Zea mays
  Clone ID: LIB3069-029-Q1-K1-C7
gatcctgtccagccactcctccgacttggtgtacctcggccagcgcgacaccaaggaggggacgtttgacaccaaggtgcaggaggcgttcaagcggttcggctcgcgggtgacctagatcgagaaacgcgtcttcaccatgaacgcggaccctttgctcaagaaccgtaacgggccggccgagttgccctacacgctgctctaccccaacacctgcgacacgaacggcgacgccaccggcatcaccggcaagggcattccaaacagcatctacatttgagttctgtctgagctgaagacgtacggtcgtcgcactagttgtttgcgtttccccgttccgttccgtgaagtgtggttctcacttgcgcggtattgtgcaaatagccaagtactccttacggaagtcgctacgtgaggactgttgtaataa

SEQ ID NO: 60076 - DNA, 409 bp, Zea mays
  Clone ID: LIB3069-029-Q1-K1-C8
cttctgtcaccgcagcaacaagggaagtgttcaagaaggaagaatccaataccaattgggacttccttggcccggatttggcctgcgctgagtgagttaccaggagtaccagggaatcgaagaagatagccgaaaagttgaaggaagcaaaggggttgagcaagcaagaagaacaggtatgtggaggtaagtagtttggtatgggtctggtatgccttcatcacccaatttacagactacttatatccgatcaatatgggccaattacaatccacgggccatacggcacaatttcacaatactatgaccaccctgagtgatgcacatgcgtgacaggatggcggtggcgaactggcgagatggagaaaagggaaagcggcaggggattatgagccaggatggaaccacc

SEQ ID NO: 60077 - DNA, 348 bp, Zea mays
  Clone ID: LIB3069-029-Q1-K1-C9
ccaagccttcacaaccatccgagccgatttctaccagctcacataacgctaaaccctacggacggttctacaactttatggagaatctcttccgcatcatactggagccactttgcttcatccttctattcggctgctgccgaatagaatggtggatctgactgatgatgacaatactaggctacctgcccggaatcatctacccgacctatgtaccacttggtctcgactctcaccagtatgagaggtaatactacacgctgggttagagcatctggttgtgccaatccagtctaaacacttgattggaaatcactatctctttctctatgcggatcgtgtgacatg

SEQ ID NO: 60078 - DNA, 407 bp, Zea mays
  Clone ID: LIB3069-029-Q1-K1-D1
cttgcatcggccgccggtcctccatccatttgtttagctagcaacgacgacacgctagccagggatcgtagccgaccggggtctgcgcgcgggcattcagttcgccatggcgcgcctgctccgcgccgcggccggcctcgcgctcctcctggccgtccttgccccggcggcgtcggcgggcggcgacctggcccagctgggcgccgccgtcgagacgcggcgcggcggcgggcaggacgacgtgccgcggcggcacggtgggcgagtgcatggagtacctggacgtagacgcggagggcgaggcggacgtggcgggcatggccaccggcggcggcggcggcaagcgccgggtgctgcagggcggcttcggctacatcggctacgacgcgctgcgcagggacaacgtg

SEQ ID NO: 60079 - DNA, 236 bp, Zea mays
  Clone ID: LIB3069-029-Q1-K1-D10
aagcgctgatgattttactacgagcgggtatattgaaatttcgtgcgtttcatggcctattttcaggtggcgtggtcgaaagcgatgacaaatattttaccaggcttgctaagaatataatatctgtatactaaacatatacattctcccttcttgataagaagtctttgaaggtagaaaatgtagtgcacttcagctggtctcccactgatcctatcatatctctgatcgtgcct

SEQ ID NO: 60080 - DNA, 339 bp, Zea mays
  Clone ID: LIB3069-029-Q1-K1-D11
cccacgcgtccgcggacgcgtgggctgctttcgagttaagtatattctgagctcgtctgcggccaaaagcttccatttgcgttgcgatgggggctctacctcgtggcctgctagctggcatctgcgccgtcttgttagcagcagtggttgcccttgcccatggtgcggaacaggaaacagcgtcaatggtggtcggcttggccaagtgcgccgactgcaccaggaagaacatgaaagctgatgcggcattcaacggccttcaagtggctgtcaagtgcaagaacgccgacggcgtcttcgagaccaaggccctcggtgaggttgacaagtccggcagct

SEQ ID NO: 60081 - DNA, 378 bp, Zea mays
  unsure at all n locations
  Clone ID: LIB3069-029-Q1-K1-D12
cttcaattgaggctgcgaagcagcgcatgttagagcagctgagtgcagcaactgctgaaggggtgatgctgtcgactgaggagactgagaagaagatgaaacaggcaacccacaaagatggaagcactaatggttcagcaaaagaaatccctaatgacaagcctgccgtcactaagcctagtccctatgaagaactgattggagacatcaaggctagcctaggaagtgctccgacccctacccagctcaaggctgtgctggcctcatcaacccttcctccccaggacgtgatgaatgctctcctggaagctctctttggtggtgtgggtaaaggattcaccaagaggttgtgaagaacangaagtaccttgcagttgc

SEQ ID NO: 60082 - DNA, 426 bp, Zea mays
  Clone ID: LIB3069-029-Q1-K1-D2
aattcgggtcgattacgcgtccgcccacgcgtccgcccacgcgtccgcccacttttttgcccacgcgtccgcccacgcgtccgctgggccctgaaggacaagcaagagttcatcgacattgtggagaccgtatacaggggcgcccggaaaggccgtggtctggtgattgctccaaaggactactccaccaagtaccgttactaagaaggcaggcattccccttatgcaatctattggggatgtttacacggacagttagtccgacaggtgatccctaactgtatcttggcataccctaataattcaagttgctggcttgagtgatgcttatccatggcttggcatgccatagtgaacatgtaaacctgtgatttgaggtgattattcgagtgtaaagaaaccaggattgcgttcggctatgactat

SEQ ID NO: 60083 - DNA, 414 bp, Zea mays
  Clone ID: LIB3069-029-Q1-K1-D3
cggacgcgtggggcaccacaagcgagcgatgtattcggggcggaagaagagagagaagacgtggctctcctctcggcgtgcgcggtccccaacctctcgtctgctgcctgcctgcctgcctgcctgcaaaaaggagtttgtcatggcgtctaagcgcatcctcaaggagctgaaggacctgcagaaagacccccccacatcatgcagtgcaggtcctgctggtgaggacatgtttcattggcaagcaacaattatgggaccacctgacagtccctatgctggtggtgtcttcttagtgaacattcatttcccgccagattaccccttcaaaccttcaaaggtttctttcaagacaaaggtcttccatcctaatatcaacagcaatggaagtatatgccttgacattctcaaaga

SEQ ID NO: 60084 - DNA, 418 bp, Zea mays
  Clone ID: LIB3069-029-Q1-K1-D4
ccagccgccaccaggtgcagagtctttcgttatctcttctccggcgaagaacccccaggcgcgcaccagatcacttgttaaactttgttgaggggtgatggcggtttctttcgcaaacctcaacaccgaggcagggcttaaaaagcttgatgagtaccttctcactcgcagctacatcactggctaccaagcttccaaggatgacttggctgtctacactttcgtttcgtctgctccctcgtccaagtatatcaacgtagcaaggtggtttaatcacattgatgcgctcgtgaggctgagcggaattactgcagagggccaaggtgtgaaggttgaatcctcagcagttccttcagccccaactccagatgttgctgaagcacaggccccagctgctgaggaggaagacgatgatgat

SEQ ID NO: 60085 - DNA, 163 bp, Zea mays
  Clone ID: LIB3069-029-Q1-K1-D6
aaacagcgttcatgatatcccatgtttgttgtcctcatggaatttgtactggtgaatgagtagcacagcctggagctattcaccccatttgccgcccctcaggattttagagcaggcgaatgctctaaaatggtgatgatggtgttttctctttatggttcac

SEQ ID NO: 60086 - DNA, 252 bp, Zea mays
  Clone ID: LIB3069-029-Q1-K1-D7
cccacgcgtccgctgagctccgcctttgtgtttccagggtccgggtcgccggaccgccgggtcgtggttgccaccgcgaccaccctggacctgctcccggccaagggcgccaagcgcgggttttctgacgaggcgcccccggcatcgactgttgccactgccggaaagggaaagaaggtggcagacgaggagttcgactagaagaaagtggcagcgaccccggaaccgggcgacaaagcacaagtggtggga

SEQ ID NO: 60087 - DNA, 324 bp, Zea mays
  Clone ID: LIB3069-029-Q1-K1-C12
gtaggcgttgaggcatcactctgagacgtcttgtgcgggattattccaaagtatgaatgcgcggggtcagacgacatattgggtagataatttgctatgctttgtgcacttatgtttttagggctttctagttgaaccggtgcccctgttctgtttttaaaattgcctctatgtaagaggctgtgcagtataagtactagcccctttgttttctgtcgaccgcattgcatggtttggttcgaacctttcgatgtcgtagttctatatgataatacattcaagtgattttgataaaaaaaaaaaatatccaaaaaaaaagggcgg

SEQ ID NO: 60088 - DNA, 402 bp, Zea mays
  Clone ID: LIB3069-029-Q1-K1-D8
ttttgatccggagagtggcgaccgtttgcttattgagctagctaaatcaacttcgcgcagacctcgtggaggtgtcgaaggctaccgagttattgacaaacgggctaacaaaacagaaggaaatgctgaccatgagaacgttggtgatgaagatgatgacgaagtatggggggaagatgaggatggaggcaatgacaataatggtgatggaggatcagatgagccatcgggcacagaaaatgaaaatcccagtgataagaatgaattgcctacggataagagtgatcaaccagggcacaagcagcagaatgggcaatctctctcaaatgaaggacgagacaaatcttcaagtgatataccaccttgctctactatcttcattgcaaatttgggacatacatg

SEQ ID NO: 60089 - DNA, 100 bp, Zea mays
  Clone ID: LIB3069-029-Q1-K1-A5
gcaaggtccagaccgaccagctgtatgtttatgcatgatgccgtgccgtctcgttgtcagctggttcagtagtgatgcttactttcttgtcgttgttgct

SEQ ID NO: 60090 - DNA, 306 bp, Zea mays
  Clone ID: LIB3069-029-Q1-K1-A6
actatataatagaattagaaatatgtttgttcaaaatgcttgttgttctattgtacctgaactatcttatatttcatttataaataatgaaataatgataaccaaggtgaccgattggaaatgattatagctgagagttattggatccagtattattagtagtttggtttacacagcagaaattaagaaatctgtgcatttgctgatatgagaacagaagggtactagctggttttggttagattttgggcccctgaatacattgtgatgttttgccccctcgattagtgcagtctgcttggtacg

SEQ ID NO: 60091 - DNA, 427 bp, Zea mays
  Clone ID: LIB3069-029-Q1-K1-A7
cccacgcgtccgcggacgcgtgggtgagattctctgttaaaaggagtaccataatggcaagaaaactcctctggagcatcgaccgactctccacctgaggaccgccagctccttcctccgcctcgacaagcgttggagagatggtgaagagaagcaagaagagcaagagcaagcgcgtcacgttgcggcagaagcacaaggtgctgcgcaaggtgaaggagcatgacatggaaaaaatggttacaaaggctgatccaagtaaacggattgtactacttcacaacaagatagatcttgttcctaaggaagcggtagagaagtggcttacatatctgagagaagaaatgccaacaattgcgtttaagtgtaatacccaagagcagcggaccaagccgggatggaaatcttcaaaactagataaaacaaa

SEQ ID NO: 60092 - DNA, 402 bp, Zea mays
  Clone ID: LIB3069-029-Q1-K1-A8
gaattccggccgacccacgcgtcgccacgcgtcgccacgcgtcggttctttgagcctactacctgccttgttcgagtgggagaaggatataaacgggcaattgagtggccaaagagcagggacaaggtatggtacagcaatgttcctcacactaggcttgcagagtacaaggggcatcaaaattgggttaaggtctcaggtgactatctattgttccctgggggtgggacttaggtcaagaatggtggcctccactatattgatactattcaggacgcactaactgatattgcatggggcaaacgaaacccggtcatattcgatgctggctgtagagttgccagctgtggaagctacatgtttgataaagatgcgcttaccatgtgttttgctccaaaagat

SEQ ID NO: 60093 - DNA, 438 bp, Zea mays
  Clone ID: LIB3069-029-Q1-K1-A9
caagcatcacagttcgttactttgttcctgtacaatttgttgatgtcactggaatcacgggggggaaaggttttgcagtatgtattcttcttgtcctaattttctgtgatttcacttgtcaagacagttcactactttgctgtaaacgagataagctatcaccagggttttagttgtgtttcttactttctttctgcaacatctctatttgattagttgaaatgacaccagagtgaattatgcaagagatatttgtaatacttaagtttctagtttatgccctgaatttaaattgctccatttcaaacatttatttgattaaaattggtctctcgcaatttatatgttagcttttctgataaaaaaagaaacactgtatgtgtttctttcagttggtgtaatattttctgtagtgcatgtgagcacgataccccttgg

SEQ ID NO: 60094 - DNA, 393 bp, Zea mays
  Clone ID: LIB3069-029-Q1-K1-B1
cccacgcgtccgcccacgcgtccgcccactcgttttcccacgcgtccggccgcaaggtgagcccaattgcctatcctggaacaggaaaaacagcaatagctaaggggccccgcctgtatctaccatctatgagggcgcctccacatgaatcagtattacacatctgtatctgaaacatgtcagacactgtgccgcaaggttaatcccagatgatgaaaagaaactgcgtacaccatgtccatcagaaatactagttccaattccgacacatgcgctgggcatcaaggtcaacaccgggagtttttattattattattccagaatgcgcacggtaatttgaaaatgaaattgtggtggaaactgtggaatccgctaatccggtgcggatctgca

SEQ ID NO: 60095 - DNA, 408 bp, Zea mays
  Clone ID: LIB3069-029-Q1-K1-B11
ctcactctccgctggtcgctcactcttgcttctccacccttcactcagtcttagtctctgattagctctaggctctagctggccgcgccactccttcgtgtagccatcagccttctcatcgccaccaatggccactgccgaggtagctggatcgatcgaccctagtcttcgattcatatatacatacatgtgcacggatcgtttggatccgaataatacctatatatgaataatggtctctgtctcatcgatgatcggtcggtcgatcgctcatcttcgatgagacgtacagcgatggacgtgcggatcatatatatcctatgttaacaatggaggacgctaagattaagtgtggcgctaagatggaagagtacatgctttgatttttacgcgccgttcacgtgtgca

SEQ ID NO: 60096 - DNA, 363 bp, Zea mays
  Clone ID: LIB3069-029-Q1-K1-B12
gcaggcaaaggaaaaaacggaatgaatgattttgatggaaatagtgaggaggatgtctcggctttgaaccattctaacgagagacagtttgaacaatcctctcaactgttagatgtactgccggaacacttgtttgatgagaatttcaacaaggaagttcccaagcgcggcaaagggcgcagtcgcggtggcagagggcatgggcgtggcaaccatcaatataacaatcaccatcacaataaccagcaccaccagaacaaccagccgcagtacaataaccatggcaacaaccaccttggtgggaaccgtggcagccttcactctgttggaactacaccgaataacctgataaccaagcttgag

SEQ ID NO: 60097 - DNA, 431 bp, Zea mays
  Clone ID: LIB3069-029-Q1-K1-B3
gctggggcacgactggtgagccattttgttgtggcagctttgtctgcttcggcggcacgtgttgcttacgctcgtgaacgtgagcgtagtgtaccacccgcggcggccggagatgagcccgctccaggccatcagagctgcctgcggcgaagaccactacatgtgccgcttccaggaatttggtgtcgctgaagctgaatttgctctatatgacatcaagtgggtgtttaagaagacatttggcatgcgcaagccagctcctattattctgcccaaggacaagagcttctttgactctcttgattcagatggaacttgtccaccatggctatcagaggaagatatttcttactatgcagaaaaatttgcaaaaacaggctttactggaagacttaactactacaggtgcatagacaggagttgggagcttt

SEQ ID NO: 60098 - DNA, 240 bp, Zea mays
  unsure at all n locations
  Clone ID: LIB3069-029-Q1-K1-B4
cccacgcgtccgcaaataccctcgctccctacaacccgtcgtcgcccacgccgtcgnctgtgccagttgtttcaagatgaggcggcaccctgaagtgaagtgggctcagaggatcgacaagggttacatcactggacaggtacctgatgccaaggacgctcagggcaatttggaaccccaatgggggcctcaccattctctggcagtggtggtacaaacttatatgaattgaaaccagat

SEQ ID NO: 60099 - DNA, 345 bp, Zea mays
  Clone ID: LIB3069-029-Q1-K1-B5
cggactcgtgggctgactcgtgggctcaatgcagtttgggtaaaaaaaaaaaaagagaggataaatttaaactaaagaaacggtaaaaataaaaaaaaaaaaaaaaaaaaaaaaaggtctgccgtttttcagcttccatactttcgtttccgtacttgccacttcatttttcttttttcgtgtttccttatttctgttcattggcttttctttttacaacttcgtgacttggaaaaccttgccttttcccatttttataccccttgtccccttattccccttttgccatcctcagctttatatgcctttaggccttaaccctttttcccttcccacctttttttc

SEQ ID NO: 60100 - DNA, 312 bp, Zea mays
  Clone ID: LIB3069-029-Q1-K1-B6
cccacgcgtccggcaggggcaggcattgtgtcaaaacctctcagagagtcacaagggtctggacttttgcttctaaacgccgctgtctctgtgtatctcgttccttttcgaaaattttgaatccgatcgatccgcgtgttttcacacacttagctagcaagatcgacgctatcacgctactgggtgccctggatctgttgaagttgtgcctgtaagcttcaaggtggctgggtgtgtgtggcttcaaaatttgggcgggaacgggcgcatcctggaccgagcaaacgcgcattcgatctggctgattttttc

SEQ ID NO: 60101 - DNA, 429 bp, Zea mays
  Clone ID: LIB3069-029-Q1-K1-B7
ggtggggcacgactggggagccattttgtgtttggcagctttgtctgcttcggcgggacgtggtgcgggcgctcgtgaacctaagcgtcgtgtaccacccgcggcggccggagatgagcccgctccaggccatcagagctgcctgcggcgaagaccactacatgtgccgcttccaggaatttggtgttgctgaagctgaatttgctctatatgacatcaagtgggtgtttaagaagacatttggcatgcgcaagccagctcctcttattctgcccaaggacaagagcttctttgactctcttgattcagatggaacttgtccaccatggctatcagaggaagatatttcttactatgcagaaaaatttgcaaaaacaggctttactggaggacttaactactacaggtgcatagacaggagttgggagc

SEQ ID NO: 60102 - DNA, 368 bp, Zea mays
  unsure at all n locations
  Clone ID: LIB3069-029-Q1-K1-B8
cccacgcgcccggttttaaccgaagattcgtttatggcccccccgatccaatncgtgtagggctctatagacccctgacaggcgcggcaaccctacaggcgaggtcgacggggtttgctcaaatggaacccttgcaagggcagctggtcccaatggagcatcaactgggggaaaagaaagctcgggagcggagggagggtggctctgactattcggggaagggtgtctccaaggctgtgaacaatgtgaattctgttattggacctgctctgattggcaaggaccctacagcacagactgagattgataacttcatggttcaacaacttgatgggaccaaaaatgagtggggatggtgcaagcaaaag

SEQ ID NO: 60103 - DNA, 325 bp, Zea mays
  Clone ID: LIB3069-029-Q1-K1-C10
cccacgcgtccgcccacgcgtccgcttggtttcgcctcccgtctcttaccgcacatgcgcgtcgggccgcgtcgacatagctgcttgccgccgacacccgcagccgcaatggccgtcgcccacgcgccgccgcgccggggcgtgctccccctcctgctcgtcgccgcgctcgtggcggcgttgccggccacctgcgccgcggccaggagcaagaagtcgtacacggccatcttcagcttcggggactcgctctccgacgccggcaacctcatcgtcaacggcacgcccaaggcgctcaccaccgcgcgcccttcctacgggatga

SEQ ID NO: 60104 - DNA, 431 bp, Zea mays
  Clone ID: LIB3069-029-Q1-K1-A4
cccacgcgtccgtgagcttctgaggaggatcttttgtgatactggctgctttggttttggtattcaggagcacattgatcttggaatcaagtatgacccgtctactggtatttatggcatggacttttacgtcgttctggaacgagctggttatcgtgttgcacgccggcgcaggtgcaagtcccgcgttggcatccagcacagggtgaccaaagaagacgccatgaagtggttccaggtgaagtacgagggtgtcatcctcaacaaggcccaaaacacctcgtaatcattgatagtcatcaaacgacttgccctttagcactccagttcaagtataatctgtgtactatgaattctgtgtttggtggataccaaatgcactgccagttttgcgtctgtgcccataattcccatctgatcagactagcagt

SEQ ID NO: 60105 - DNA, 83 bp, Zea mays
  Clone ID: LIB3069-052-Q1-K1-E3
gaaaaaaaaaaaaaaaaaattaaaaaatataaaaaataaaaaataaaaaaaggaaaaaagaggaaaaaaaaaaagaggagaag

SEQ ID NO: 60106 - DNA, 391 bp, Zea mays
  unsure at all n locations
  Clone ID: LIB3069-052-Q1-K1-E5
tttgtcgtgacaaaagaagtttttncttttgctgatgattgtaaccctggggacaagagggcgaaagcaaagcgggatgttggggatgcagaatacaagagcatgctgtgtgtggagcctgcagatgttgaaaggccgattactgtgaaacctgaggattagtggaaaggaaggcttgtgcttgtagatgggtcatcgagttactgtatggtacagttagattcattgaatgttcttcagggttgaaaatcctcactttctgcatcttgtacagaagttcattgcccttaatatttgatgctgggctggcgtcaacgccgcatgttccttttgccattcccaccccctatatttttggtaccttttggatctagaatttgagttataggtt

SEQ ID NO: 60107 - DNA, 110 bp, Zea mays
  Clone ID: LIB3069-052-Q1-K1-E6
aaagaaaaaaaaaaaaaaaaaaaaaaaaaattaaaaaagaggaaagaaaaaagagaaaaagggagaaaaaaaagaaaggacaaggaaaaggacgaaaaaaaaaaaggaaa

SEQ ID NO: 60108 - DNA, 425 bp, Zea mays
  Clone ID: LIB3069-052-Q1-K1-E7
tcgcggacgcgtgggcggacgcgtgttcggactcttgggcggacgcgtgggcggacgcgtggggggacgcgtgggcttggatgaggatattgccagtccagctagtggagcaagaaagaaacgagcatgcaacactagtactgcaacaaagccctatgttgaagattatgaggggaatgtggggaactttgcaatctaatagtgctactgcaaaaatggttctacagggaaaattaaggacagagtccatcaagaatgcgatgaatctggttaagaaatgtggtgcaccagaaggaagtgttgagcattacatggctacaaaattgttcatgaaagctgaaaactgagatatgttctttacttttgaatcaaatgaaggaaggttatcttggttaaagagaaattgtcaggactatgggttgaat

SEQ ID NO: 60109 - DNA, 409 bp, Zea mays
  Clone ID: LIB3069-052-Q1-K1-E8
cggacgcgtgggcttgactgggctggtggtgctgtacggtcggaacaagcggctgcaggagctggtgaacctcgtggtcgtctgcggcgaccatggcaacccttccaaggacaaggaggagcaggccgagttcaagaagatgtttgacctcatcgagcagtacaacctgaacgggcacatccgatggatctccgcccagatgaaccgcgtcctgaacggcgagctgtaccgctacatctgcgacaccaagggcgccttcgtgcagcctgctttctacgaggctttcgggctgacggtggttgaggccatgacctgcgggctgcccacgtttgccacagcctacggcggtccggccgagatcatcgtgcacggcgtgtctggctaccacatcgacccttaccaaggcgac

SEQ ID NO: 60110 - DNA, 355 bp, Zea mays
  Clone ID: LIB3069-052-Q1-K1-F1
gccatgcgtccgcccactcgtccgaaccctattcaggtttttgattaatccggtgcatccatgagtagggtgcagtctgagtgtggctaggatgccatctcccagattgttggggaatccaaggagaagaataggaagattactgatatctgaggaactttatattgtgctgaacaattatgatccacagaagggcaatgcgtgtcagtggcgtctgattatttgccccatattccttcgtccaagatgaaagtgtgcatgcttggtgatgcccagcatgttgaggaggccgagaagatgggacttgactacatggatgttgaggctctcaagaaaatgaacaagaactagaagc

SEQ ID NO: 60111 - DNA, 223 bp, Zea mays
  unsure at all n locations
  Clone ID: LIB3069-052-Q1-K1-F12
caaaagggttttnncaaagccactatcaggagttcttttcaatgtcctagaccgcaaataacagaggaggttgaggctcatatctcacacctatcaacaaaattttacttttcccgttttatttatttctaattattgccacccctctattatggtatatcaaatagtagcagttagcaaaccttccattccaacataatatcttcagaaatattacaccaaa

SEQ ID NO: 60112 - DNA, 145 bp, Zea mays
  unsure at all n locations
  Clone ID: LIB3069-052-Q1-K1-F2
agcgtacggagatacagaagatcgtatcaccaccttttttttcattttgagcantgtgtgtatcagtgagttttggggagtgacataatatggtgaatgtggatagagaaaagaaggaaacaattgaaaccaatcctagggaaat

SEQ ID NO: 60113 - DNA, 387 bp, Zea mays
  Clone ID: LIB3069-052-Q1-K1-F5
gcgcggacgcgtgggcggacgcgtgttccggtgtcgatggccacggagccgttggcgcggttggggttgatggtgaagcggtcggtgttgctgaactcggtggccagcgtgtgctggacggggttcacgatcgactccagcgacctcagcgggtagtaggagtggagcacgtggaagcggagcaccacggccttgctgtcgttgatgagcgacttgagccgtgcccccatcgtgaggcccgcgaaggcgtcgtcggtcggcgcgaacaccgtgatcccggccccgcgctcgtcgtcctcgaactcggccgtcacgcccgacgcctgcagcatggacgccgtcacgttgaaagcgcgcgcgtcggcgaggacgcgggtgatgttcacg

SEQ ID NO: 60114 - DNA, 417 bp, Zea mays
  Clone ID: LIB3069-052-Q1-K1-F6
cggacgcgtgggcggaccaggttagcagcttcaggaaccctatcaccgttcgcatccgcagggatgggtatcgacctcgttgccggtgggaggaacaagaagaccaagcgcacagcgccgaagtccgacgatgtttatctcaagctccttgtcaagctctaccgtttcttggtcaggaggaccaagagcaacttcagtgctgtgattctcaataggctcttcatgagcaaaaccaatcgcccaccaatctccatgcgccgccttgtcaagttcatggaaggaaaggagaagaacattgctgtgattgttggcacagtcacagatgacaagaggatccaagaggttccagcaatgaaagttactgccctgaggttcaccgagacggcaagggccaggattgtcaatgctggtggggga

SEQ ID NO: 60115 - DNA, 432 bp, Zea mays
  Clone ID: LIB3069-052-Q1-K1-F7
acgggttatgtaggagaggatgtagaatctatattatacaagttactcacggtggcagattttggtgtgcaagcagcacagcaagggatggtgtacatagacgaggttgataagatcacaaaaaaggctgaaagtcttaacatcatcagagacgtatctggtgaaggtgttcagcaggcattgctgaaaatgctggaaggcacgatagtcaacgttcctgaaaaaggagcaaggaagcatcctcgtggtgataatatacagatagataccaaagatattctttttatatgtggtggcgctttcgtggatttggagaaaactatatcggagagacggcaggattcttctattggcttcggcgcaccagttcgtgcaaacatgagggtcggtggcactttaagtgctcaagtgacatcgtccttggtggaatcg

SEQ ID NO: 60116 - DNA, 256 bp, Zea mays
  Clone ID: LIB3069-052-Q1-K1-G1
ccattcggtggaggccccgcaggtaggttgaagagaaagaatcaggagaaggcatgctgtggcagtaaggctggatgatgagttgaggagtgaggatgtgtcatgttggtgtgtgcaccgagtataatggaattgtctagtgtttttggactagttcgaatgatgagtgcttagctgtgtgatccgactcagagtcccctgtgctgactctgggtcatggatggtccattttatcttgtgggattatcagccttta

SEQ ID NO: 60117 - DNA, 430 bp, Zea mays
  Clone ID: LIB3069-052-Q1-K1-G10
cgtccgcccacgcgtccgcagactcatggcgaaggttattgcgggtttatgcgaagccattggtgtggtgcatatggtgggaccaagcatgaggcaggaactgcattacttgcaagaaagtcacaaaatccattgcaagatcatacttgtggctttcttgcaagttgcgcaattgttgcctcaagcttgctgcctccctttgccagagctatcggtaaaacaggaagtactgtcagtttccgagctacaaacaagctataagtttagaaaaataatttagaaatgtacaacaaagtctagtaatacattgctaaagataaatcaatactcaataagttcctcatgctttggatttggggataacatacctgttttatttacatgctaatatttggaccaacaaaaaataccttatgaacagccatttgag

SEQ ID NO: 60118 - DNA, 337 bp, Zea mays
  unsure at all n locations
  Clone ID: LIB3069-052-Q1-K1-G12
acgccggcggcacgcgtccgccactcgtcgcccacgtgttcgtctttgctaaggacgccggtttgttatcatagctggtctagcctgcatccacctgttgtcaaaatctttcaacccaccgaaagcaagcatcgcccacgattacattcataggcaaaactgcccaatccgccattttgtgagccatataatttctttttttataacaaggcgtcagcaggagagcaactatatttatatacatctttcctgatctgtccctgtccggcnacaagaacaccaccaataaggatctcatcactacgagtaagcggcacgaccgaattatttaactact

SEQ ID NO: 60119 - DNA, 324 bp, Zea mays
  Clone ID: LIB3069-052-Q1-K1-G2
acgcatcatctcgcctcccgtggtcgacgagctttcgtccatgtttaagtggctgcactcacagttggccaggaactgctggaacgctgaactcgtcccttttgccccaatcttcttcggcaaaccacatcctctggcctctgacaggtcacaagtcccatgggtgccgatgatgaagagcccgccgacgatctgctgagcatatagctatgatatgtcaagagcgtaagagcgcaagcgtgcatcggcgtgaactacggctaggtggcgggcaacctgccgtcgacggacgagacggcaaggctgctcaagtcgacgtccatt

SEQ ID NO: 60120 - DNA, 142 bp, Zea mays
  unsure at all n locations
  Clone ID: LIB3069-052-Q1-K1-G3
tcgaacgggtctacatcgcgagcggatgcccttaggtttttttcttattgttgcgtaagggtctgtgtgggatanagctcataagcttgggaccaaatctagcaggagatccgcctcatgaaactggaacgatggttcatga

SEQ ID NO: 60121 - DNA, 396 bp, Zea mays
  Clone ID: LIB3069-052-Q1-K1-G6
aattacgggccgaccactcgtcggggacatatggccttcaaaccatgagatctttgaggttgtggaggccagcaggcagactgagctgttcaagaaagtgtacgactccatcatggaacgtaaccctaggtggaaccagctgccggttccaaaggaggcgctgtacccatggtactacaggtctaccgtactgcgcaagcctacagatctggagggcatagccatgacgccgtctgtaagcccacccactgggactgaggcctactgcctgctcaaccttggggacagcatcaccacggaccacatgtcctactcggggaagatccccgagggcacacctgcggccaagtatctgctcgagtatggggtggagcccaagaactttagctcctatgg

SEQ ID NO: 60122 - DNA, 409 bp, Zea mays
  Clone ID: LIB3069-052-Q1-K1-G8
cctgtttttttttttttttttttttttttttttttttttttgatgtttttagtgtttttgggtaggtttttatttttttttggaaacccaaccccccataaatgggtttttattggctatatatgatcaggggcttttgaaagacgagggtgccatgaatattttttctacaatataagctgagttctaaaagagtcaaatgagatttaatcagacttaagtttatgagatgcgctttcggtaattaggagccccacaggggtggggcagctttaaaatttttccatgaggcccaaaaacattgtccaatcaataacccgagtcataggatagctcctgaaaaagaagtttggggtcaccatcgaaaaggtatatttttcccagtttaacaattttgggggggcttaaa

SEQ ID NO: 60123 - DNA, 397 bp, Zea mays
  Clone ID: LIB3069-052-Q1-K1-G9
tgcggaagtcgccccctctcttaaaccctcttttttcccctcctttgctcgacccagatcgagggctcgatccggggggcatggcgctggagtgggtggtgctgggctacgcggcgggcgcggaggcgatcatgctgctgctgctgacgctgccggggctcgacggcctgcgccggggcatgatctccgtggtgcggagcgcgctgaagcccatgatgtcggtggtgcccttctgcctcttcctgctcatggacatctactggaagtacgagacgcgccccacctgcgacgacgagcacgcctgcaccccctccgagcaccttcgtcaccagaagtccatcatgaagtcgcagcggaacgcgctcctcatcgccgccgcgctgcttctctactggat

SEQ ID NO: 60124 - DNA, 130 bp, Zea mays
  Clone ID: LIB3069-052-Q1-K1-C2
tggaccggccatggccgcacctttttgcacgtttcgcgcctggcattactactgagtctatggatgatcacggttgtgctcatgcgtgtggaggtgccgatcccgtcgtcgttgaaaggcgaggtgctca

SEQ ID NO: 60125 - DNA, 321 bp, Zea mays
  Clone ID: LIB3069-052-Q1-K1-C3
cgatgaggagatgaagccatgattgccatttgtgctcttgctgccgactgtttctcgtttggcatccagggattgcttattggctattatttgcacgcaaaggaaaaaaaagatgttatgttttatatcttaggccagactgctgtatctacttatttgtgactgctgtgtgtgcatggatttatagtgaatctagattattgggcttgtgctttgttcatgccgctgctgtctgcccatttttctattcagacatgaaattctttgttgggagcttgataagctgcatgataagaagccctttttaagtattgactagtt

SEQ ID NO: 60126 - DNA, 421 bp, Zea mays
  Clone ID: LIB3069-052-Q1-K1-C6
cggacgcgtgggcggacgcgtgggcgcggttggacatattccattcacctaccgtccatgggtcaccagaagcgaaggcggaggcggaggagcggaggtaggagatctcgagcaagccggaggcagaggagatgaagacgttcgacccgtggccggtcttgttccggcgggagtggaagcgcaactggcccttcctcacgggtttcgccatcaccggattcatcatcacgaagatgacggccaacttcaccgaggaggatctcaagaactctaagttcgtccaggaacacaagaagaagcactgacgaaccaggtgaaggagttgtcagaaacgcatgtttggccagccagttctgttatgcttttgaatgaaaaatttagacccttctttctcgtttccttaatcgaaatgcttgcactc

SEQ ID NO: 60127 - DNA, 384 bp, Zea mays
  Clone ID: LIB3069-052-Q1-K1-C8
gcgccgaccagaccaatggcactgcggctacccatctcctcgacccacgggctggcctcctcgggagcgcccatctgctccacgacgacgtgccggccggccgccgccagtgtgagcttgatcccgccagctgccctgatcgcagttgccatccgctgggcgtagtcgacagcgtcccaaaagagggtgctgctgctgacgactgctaggggctgtggagtcgcgccggtgaggtcgagcgggatcgagacgacgtcgacctcggtgggagctgaagccgtcaccgggcaggtcacggaggtcaacaaggacaccttctggcccatcgtcgaggccgtcggcgacaaggtcgtcgtccttgacatgtacaccgaatggtgcggg

SEQ ID NO: 60128 - DNA, 360 bp, Zea mays
  Clone ID: LIB3069-052-Q1-K1-D1
acgaccactcatccgcccacgcgtccggaaaatttctacaatatcaacaatgttcccaatggccagtatcagggtatacttttattggcgttactggacaaccctaatcttgacagtgagcctattttcgatgtttctgttgagggttctctgttcagctattttgtgctgggcatgatcagcgacgatgagaagacatttgcgagaagctttaggttttagtcatgacttaagcttatcagtttgcttacatagtacagggcatggtgatccatcgaatctttctattgaagttctacaaatagatgacgatgcctataacattggtccaccacgggaaaaagggacagtgcttaaagc

SEQ ID NO: 60129 - DNA, 445 bp, Zea mays
  Clone ID: LIB3069-052-Q1-K1-D11
cgcgtccgcccacgcgtccggcattttgggttgggctgttgtacgattatgaatcattacaaagcattggagacatgacttttgactggagacaggaggaaagagagatgctaagacataaggtaccgttgactggtctgaagacaccatttcgcgatggatatgttagagatttagccgaggaagttctaaaactggccaagaatggattggaaagaagaggatacaaggaggtcggtttccttagagaggttgacgaagtggtgaggacaggagtgacacctgccgagagacttctgcatctgtacgagacgaagtggcaacgcaacgtcgaccatgttttcgagcacttgctatactgacgttgtagatgtaccctagtacaaaaatctcatctttgattcattcaacgccttgagtgggagggcacaggaacacatctttt

SEQ ID NO: 60130 - DNA, 350 bp, Zea mays
  unsure at all n locations
  Clone ID: LIB3069-052-Q1-K1-D12
ggcgttcagggtgttcgacaaggaccagatttgcttcatttttgccgcggagctccgccaggtgatgaccgacctaggcgagaagctgaccgacgaggaggtcgacnagatgatccgcgaggccgacgttgatggcgatggccagatcaactacgaggagttcgtcaaggtcatgatggccaagtgagtaaagcctgcggtaatggtatagtaaccccgctcggaaggaggaaaccgtgcgttgcatattagtaaggcaatgcaatgcagctcttgtttccttcttcccgtgaagaaaccgtactagctgtagctgctgaacgtttgagtccctctgctgccacccttat

SEQ ID NO: 60131 - DNA, 327 bp, Zea mays
  Clone ID: LIB3069-052-Q1-K1-D2
acggatgatcaagacagaggccagtcacaaggttatagcattaggtggtagcaagatgacttggctccacgcgacagttggaatttggatcatcgtgacctccttggtggctttcttcatcctagccagctccatcgtgtgccgtctctgcagtaggccttgaagagcgtatgcaaagtgcagtcgagcatggacgccaagaaaggcatgttaagctgtaagtcgggctgcaagaaccggtgatgagagggacaacccaagaaggggacgccagcaacgaggagtgcaactgggccaagggaaagggggtctacgacaacgtgttcc

SEQ ID NO: 60132 - DNA, 373 bp, Zea mays
  unsure at all n locations
  Clone ID: LIB3069-052-Q1-K1-D3
ctccccggcccccaaatcaccgcgcctcctttgccactcctcacagggccggttgcgtaggagaaaggggaaaggaaggatgggaggcggtcgtcgggcgagatgagcgactccttctgccccgactgcaagaagcatacggaggtggcgttcgaccactcggcgggtgacattggtgtgcaccgagtgcggtctcgttctcgaggcgcactccgtctgctagaccttcgagtgtcgcaccttcgctaacgagtccaacgacaacgaccccgttcgtgtcggtggccccaccaacccgctcctcaccgatggcggcctcttcaccgtcatcgccaagcccaacggtgcgcanggcgacttcctatccttcttc

SEQ ID NO: 60133 - DNA, 417 bp, Zea mays
  Clone ID: LIB3069-052-Q1-K1-D5
gctatggtactgaaggagtccctggttcggatctagaacactactcccactgtgcccgccttagggccaggagacatcgtggagcacattctgcggacttgtttcttgcagctttttccttaggtctttgttgagatcctgcttctcttgttccttgcttttgagatcaaagagctgatcgagtagtgtctgattctttcttgacctgatatgcttcagggatacctgtatctggttctccagctgctcgagctccttcatgctgagtgggcccagatcttcgccaaggatgtttctttgtgtagtctggagaaaatcaactctggtcctcaacttcaagtagtcttcactctccagtggagcttttacttcctgtgtgctggaattggagctgcggtatctctcgagtgttttgta

SEQ ID NO: 60134 - DNA, 388 bp, Zea mays
  Clone ID: LIB3069-052-Q1-K1-D6
atgcgcccacgcgtccgcacggtcacatccctcttttgcacgatgccagacccggacgtcgtgtggggtaatacgctgatctcaggctactgccagcgcggcatgttccggaactcgatgggccagtctatggagatgtctcaccgtggtgttgccctcgacaggacgactctcgctgtcctgctcaaggcatgctatgacttggacgacactgacacttggtgtccagatccatgcgctagcggtgaagacgggcctggagacggatgtccgggccgggagcgctctcgtcgacatgtatggcaagtgcaggagcttggatgacgcgctgcgcttctttcatgggaagggtgagaggaattcgggctcgtggggtgcggcgatcgct

SEQ ID NO: 60135 - DNA, 420 bp, Zea mays
  Clone ID: LIB3069-052-Q1-K1-D7
tcgcggacgcgtgggcggacgcgtgttcaagcttaagcaacaaggcagcagcacaagcaagaacggcaccttctcccttcgcctgtgatcatgtcgtcttgctgcggcggcaagtgcgggtgcggctccagctgctcctgcggcagcggatgcaacggctgcggtatgtaccctgacgtggagaccgtcgtcaccagcagcgtcaagaccacggtcctcgccgcgccgaccaccaaggccagcgccggcggcttcgaggcggccaccgagggcggcggctgcgactgcaacacctgcaagtgcggcaccagctgcggctgctcctgctgcagctgcaactgagccggcccggctcggcgatggcgcacgagagtcgagaggacgacgacgaggaggcgtataataaatataatagcggcg

SEQ ID NO: 60136 - DNA, 420 bp, Zea mays
  Clone ID: LIB3069-052-Q1-K1-D8
tcatgcggcctgcgtggacttttcaagggcaatggttctaattgtgcaaggattgttctcaaattctggggtgaagttttttaggctacgagcaggcgtcaaagggaattctgtgggcctaccgtcaacagactggtgaagaggatgctcatcttactccgttcttgcaccttgtatctggagcatgtgctgctatcatatttatgtctgctacttacccgatggatatggttaggggaaggatcactgttcagacagacaaatctccctaccagtaccgtggtatgtttcatgcactgggtacagtctaccgtgaagaaggctttcgtgctctatacaaagggtggctttcatctgtaatccgagttggtccatatggtggtctcaacttcgctggatatgagtccctcaaagacttgc

SEQ ID NO: 60137 - DNA, 297 bp, Zea mays
  unsure at all n locations
  Clone ID: LIB3069-052-Q1-K1-E10
cgtgcgaatgtgctacttcgagttcctgcccttgtttcagcccgtgtccgacgacgccgatcccgggcatcncgggctcgtggacctggtccacgtcaaactcgggcacgagtacaagctcgtcgtcaccacctactcaggtgcggagcgggtgatgaaaatggaacagctgctagctgatgagtcagtgacactagcttgctagctaacgaacgtacacgcacgctcgccgtgcaactgtaggtctgtaccggtaccgtgtgggcgacatgctgcgcgtggccgggttcaagaacc

SEQ ID NO: 60138 - DNA, 430 bp, Zea mays
  unsure at all n locations
  Clone ID: LIB3069-052-Q1-K1-C11
cgcgtgcggccacgcgtccgcccattctctcgctcgcttggagaagctttcttcgttgctgctgccggggccacatagatggggggtttggggaagactcataanaccaatgcgtatttcaaacgtttccaagtgaaattcaagagaaggcgggctggcaagacagactacagggccaggataaggctgattaaccaagacaaaaacaagtacaacacacccaaatacagatttgttgtgcgatttaccaacaaggacatcactgcccaaatcatatctgctagtatagcgggtgatatggttcttgcttctgcctactcgcatgagttgccacgatatggtcttgaagttggtctgaccaactatgcagctgtctactgcactggccttctgttggctctccgtgtgctcaagaatcgtggtttggatc

SEQ ID NO: 60139 - DNA, 381 bp, Zea mays
  unsure at all n locations
  Clone ID: LIB3069-052-Q1-K1-E12
cgtccgcccacgcgtncgcccacgcgtccgatcccgttgcatcccattccactaccacccatctcggggtccgccgattcgatccgggtcttccaacccaggggcagtgatggcgacgaagaggagcgtgggcaccctcggcgaggcggatctgaaggggaagaaggtgttcgtgcgcgccgacctcaacgtcccgctcgacgatgcccagaagatcaccgacgacacccgcatccgcgcctccgtccccaccatcaagttcctcctcgagaagggcgccaaggtcatcctcgccagccacctgggtcgtccaaaaggtgtcaccccaaagtacagcttggagcctcttgtccacgcttgctgagctcttggagtgagtcg

SEQ ID NO: 60140 - DNA, 461 bp, Zea mays
  Clone ID: LIB3069-051-Q1-K1-H8
gcctgggaggccaccaatgcggtgttcgatcttggtgcgggcactggacccgggtgacgcgtgcaatatcatgggcctgctgctcatccaggacaacagcgacaaggagctcatccgcttcgccttcggccccgaccacctcctccacgccttcgtctccgccgcgcgcgccgacctcgtcgccaagcccgcgttcccgccgtcgaccgtgctgggcccgctccaccagacctggggaccgacgtcgcacccgagccctaccgccggctccgaccacccacaccaggcccacttcgacgacgacctcgcgctcggctacgacttcgacggcgccggcgccggcgctgacgcgttcttccccgacgactacgactgctggtcaccggtcggcgccgtccaccggcggagcttctcgctcagagacgccgaggccgtcgccgtcaccggaagcgtctcgtgga

SEQ ID NO: 60141 - DNA, 391 bp, Zea mays
  unsure at all n locations
  Clone ID: LIB3069-051-Q1-K1-H9
ggccgaccacgcgtncggagcacatcccttctggttgccgcgatgttgatcgctggggttcacgtggtcccctcaggcaagatggtcctgctgcacgactggatgcaccctcatcacgccaagatactgatcgctggcgtggatcaagattttcctctaactcaacgtcctcttcatcaacctggagccgttcacggaactgatcctatgctgcaggacttttttctagccatgtgtcgacctccgtgcacaatgtctaatcgtacctttccaggcactgcactacatgcatattattgctgttttgtacttttgtagtaatactctacaatccatgattattgtccctgtttgttaaaaaaaaaaagattaatcccatttgcattttttc

SEQ ID NO: 60142 - DNA, 286 bp, Zea mays
  unsure at all n locations
  Clone ID: LIB3069-052-Q1-K1-A10
gttggaggaagccntggggatantaagggacactaatgggagatttgacctggctgtgcaacttggtcgacttgaaatagcgaaggtgattgctactgaggtgcaaagtgaatccaagtggaagcaattaggggagttagctatgtcaaatggaaagcttgaaatggcagaggagtgtcttctacatgcaatggacctcagtggtttgttgcttttgtattcttcccttggggatgccgaaggcattaacaaattggcatctgtagccaaagaacaaggaaagaac

SEQ ID NO: 60143 - DNA, 346 bp, Zea mays
  unsure at all n locations
  Clone ID: LIB3069-052-Q1-K1-A12
cggcctgattactccgtaccccctatcctgtcatccacttcagcagtgcaagcagcatgtggcgcgccgtgccagcctggtgcctcgccgcggcgctgctcgtcgccgtcgctgccgcggcggtgccgccgacgtgcgagcgcatcgagtgcccggcgtacgaggtggtggacagcgccaacgggttcgagatccggcggtacacggacgccatgtggatcaccacggcgcccatcgaggacatctccttcgtcgccgccacgcgcaccggcttnctccagctgttcgactacatccagggcaagaacgcgtacaacgagacgatcgaaatgacggcgccggtgct

SEQ ID NO: 60144 - DNA, 153 bp, Zea mays
  Clone ID: LIB3069-052-Q1-K1-A3
gccgacccacgcatgcgataatctcttcttcacctcactaacaccagttagcaactctatctctactgcaataatggggggtcgcgcctacttctcccagccgcagctggtcgcggcggcggcggtactggcaggggcgctgctgctgctggc

SEQ ID NO: 60145 - DNA, 139 bp, Zea mays
  Clone ID: LIB3069-052-Q1-K1-A5
cacaggcgtacgtctaggtagctagcaacgtgtgcgaaaaggtctacgtttagcgatgttgcgcatgaaccacacatgggcccatcctgtccttagtagccagatcaacggacccaacaatgatagccttatgaggcac

SEQ ID NO: 60146 - DNA, 140 bp, Zea mays
  Clone ID: LIB3069-052-Q1-K1-A6
gcggccaatcacacacgcatttatattagcttgtttcgcagcaggacgctgtggatgggatcagggctgacgtgagagcgggcgagagagagcgagggagaggcctggctagatgcaaggttgcgacgatggtggtggcc

SEQ ID NO: 60147 - DNA, 348 bp, Zea mays
  Clone ID: LIB3069-052-Q1-K1-A7
cgtcatcatcggggtgctcgacaccggcgtttggcccgagagccccagcttcggggacggggggcatggccctgtgcctgcgcggtggcgcgggagctgcgagaccaatgccaccgacttcccgtcctcgatgtgcaaccgcaagctcatcggcgcccgtgccttgttccgcggctactcgtcgggggccggcgacgggtctcgagtcggcgccgacctaatgtcggcgagggaccacgacgggcacggcacgcacaccgcgagtacggcagccggggccggtcgtggcgggcgcaagccttctcgggtacgcgccgggcacggtgcggtgcatgggccccggggcgc

SEQ ID NO: 60148 - DNA, 409 bp, Zea mays
  Clone ID: LIB3069-052-Q1-K1-A8
gcgcgcaagatgaatgacaccgacttctaggatgttctcaaggaggcgtacagagtgggcgacaggggccagaacagctgtatctgtgcggcggagctccgccacgtgatgaccaacctcggcgagaagctgatccgcgaggatgacgatgagatgatccgcgaggcctgctgtgatggcgatgtgcagatcagcttcgaggagttctgtaaggtcatgagggccaagtgagggaagcctgcggtaacggtatagtaccccgcgggaattggaggaggaaaccataccgtgcatcgcatattagaaaggcagtgcaggtcttggttccttcggcttccccatgaagaaaccgtactagctgtagctgctgaactgttggagccccctgctggcacccttatcttcattt

SEQ ID NO: 60149 - DNA, 391 bp, Zea mays
  Clone ID: LIB3069-052-Q1-K1-B10
tgcgggaaacagagatgtgaccgttgagaaatcttatcccgctgtttccgctgcttcagacaacggggaagttagcaaaaacagttgcaaaatatttggcatatctttgaccgagaaggttccagcaatgaaagaaaagggctgtggtgacatcaacaccaactatccatcccccttcctgtctttgaagcaacaagtgccgaaatcgctgggcaacagctgtgccaccgttcatgagcagaggcctgttgttgctagggtgattgacgtttcaacagtggatatgatgatctgatgtattggaaaactgtcctggaggctgtgttgcgtagtgtggacagtgtcggcttgatggttcggtatcctgaagacgggatttgattgaggatct

SEQ ID NO: 60150 - DNA, 302 bp, Zea mays
  unsure at all n locations
  Clone ID: LIB3069-052-Q1-K1-B11
aaaactttgaggnnnattgttgttaaagtaattccaggggnatccggagctgctggaaggaatgccttcacaccancctgagtttatagactatgttccatgagtagtctatagaatgatgtctttttaattcaaaagaaatctctcttctaggctggtgcttttcgactataatttggagattgttccgtgtccgtgcaatcatctgaacatgttactacttattgtaccttgtcgagcaaagttctgctaagatctctattgcttcatgtcttctgaaaaaaaaaaaagaaaccccctgt

SEQ ID NO: 60151 - DNA, 391 bp, Zea mays
  unsure at all n locations
  Clone ID: LIB3069-052-Q1-K1-B12
acccacgcgtgcgnggacgcgtgggagagtccttcttactgcattttctttctttggttctttgggtcggnttgggttgctaggcacttctgtgctgttgtaatatgggccacggggtctctcaatagctttgtcataaaacaattctacttccccttaatatagtacatgtgactctgacatgttatcgaacaaaaaaaaacattgctcgctctaaattttatgagatctggcatgatttcaaactattcttcttttcaaaatcctgttttctgactgcagtttttacaagattttatggtcttgccgcttcatttttctgactgtttgcattggaccgataccttctgatggccttgtccgcctattttcaagttcgctaccaaagcag

SEQ ID NO: 60152 - DNA, 369 bp, Zea mays
  Clone ID: LIB3069-052-Q1-K1-B3
gagagatggaagcttgttgagcttcttgcttttgaagtttaaagatggctaatgtaccaggggatgtaggtcataggttatgggtttcgaactttcaacggacgcaagtcttgaagagtggatttggctattgatgctgagattctataatgtctattggccacaccagcttttacatgctgcctatttataggtctgattagtgcccttcgaatagtgttgttatttagagcttatgaattagcctctgcctgtgtattttagaaattggccattccagagtccatttttgtgaaaatatatttattatcatactctgctactgaacgtttgtacaattaatacatggtgtatagactggtcttgggc

SEQ ID NO: 60153 - DNA, 131 bp, Zea mays
  Clone ID: LIB3069-052-Q1-K1-B5
gcaggctctcctgctccccgcgcgggccgttccgccgacgccggcgatgcttcggcagcgggcggtttctgcctgcgcgtgtgcgtcgcaggtctgccgccccctattcggtgccgccagttgcatctcct

SEQ ID NO: 60154 - DNA, 106 bp, Zea mays
  Clone ID: LIB3069-052-Q1-K1-B6
gggttggcttctcctccccctcttgttcgttttcggggacgtgaggttctacggggttcggggtcgtgggttagcggatcgagatggcggcgtcggatgttgagta

SEQ ID NO: 60155 - DNA, 395 bp, Zea mays
  Clone ID: LIB3069-052-Q1-K1-B7
cccacgcgtccggctcgatccatctcactttccgctggtcgctcactcttgcagctccacgcttcactcagtcttagtctcttattagctctaggctctagctagccgcgccactccttcgtgtagccatcagccttctcatcgccaccaatggccactgccgaggtccagaccccgaccgtcgtggcggccgaggaagcgcccgtggtggagaccccgccgccggccgtcgtgcccgaggagtctgcccccgccgaggccgaggccgaggccgaggctgctgctcctgctgatcccgaggagcttcccgcggccgagcagcaggcagccgccgaggcggaggccgcggctcctgctggtgccgaagagcccgtcgcggccgaaccggccggcga

SEQ ID NO: 60156 - DNA, 365 bp, Zea mays
  Clone ID: LIB3069-052-Q1-K1-B8
gcgggcacatctcccagagctgttccgtgctctgtccgactgatccgacgcctactgggaaatggactcgaagctgaggctgatgtcgttgatgcaggatcagggaaacaactagatggacagtatgttcagaagttaggatcagtgatattcctaccccaagtgttgtaatgcatgtgttctacccgtttctggggtatggtaaaaggctagtagctcattggatgaggatgcttgtttaatttattggcttgatgaaaccatcgggtacttgtagtgtggacatatgctggatagttagcatgtgatgaactgattacaatctgtgggggtaaaagccggcgtctatgtaaatgataaatttt

SEQ ID NO: 60157 - DNA, 431 bp, Zea mays
  Clone ID: LIB3069-051-Q1-K1-H6
cccacgcgtccgaatggcagaattcctaatcgtgaggttggcgaaaagagaaaagaactggagcatcccgtggagagaaggcggcggcagcgcctgtgggagatgtcaatcctgtgggagaagagcgcgggttggcgatggctggttcggcggacgcgtgactcgaagcccttctttttcacgttcgcggcgctgtgcggcgtcgtccccggcgtaatcggctacggcgtgatgcagctcaccggctcccgcaacgagcagctcgaggcccaccttcgctccacggcccgtcccgagaccacgatgatggggcaagtgaacagggagaggctggcggagtttctcggcgagctgcaacggaaagaggacacgaacgacaggtacgtggccgcgctgaggggggagaccctgaccaggaagcgctacgagcg

SEQ ID NO: 60158 - DNA, 443 bp, Zea mays
  unsure at all n locations
  Clone ID: LIB3069-052-Q1-K1-C10
cacgcgtncgaaaggagagtatggaagctattgtccagcttttgattaattttgcacaaaacacttctgcggacgaaaaggttctttctgatggtgggactgatgttaaagaccaatgcaccaagtttggtctcggggataatgtcaaggtacacaatgtttgctcacctcatcgactcgagccatgtgagggttcagcgtggaggttcgtcgaggcctgctgctcgtagctcctgtcgctccactcaagatccagcagaagtggagcaactacgagaagaacttaggcgacatcaagattccttgaagcaacaagctgcgcaacatgaatactatgctacacaaccaggtatgggatatttgccgccaccaccatggagatatcctacacattcaatggggccttggggacgccccccatggccaacacaaccacttccatt

SEQ ID NO: 60159 - DNA, 422 bp, Zea mays
  unsure at all n locations
  Clone ID: LIB3069-032-Q1-K1-H10
aaaccgagaagagaccaggccgaaggaatacaatcctgaaaccaagccatgggtgagcaggaggaatttgaggagcatgctgagaaggcaaagaccttgcctgagagcacgagcaatgagaacaagctgatcctctacgggctctacaagcaagccacggttggagatgtgaataccgatcgtgcgggcatattctaccaaatggacagggccaagtgggatgcctggaaggctgttgaaggcaaatcgtacgatgaggcgatgaatgactacatcaccaaggtgaagcagctccaggaggaggctgccgnctcttaaaaggatcttaatagcgttgccgaacagctatttgtcagatgagctttgtgccatttactcattagaagtatatcattcgatccattggggatcctgtaaccatg

SEQ ID NO: 60160 - DNA, 169 bp, Zea mays
  Clone ID: LIB3069-032-Q1-K1-H11
ctgtcctgtcgctccctccaccacacacttttactgaacacgcgcgcgcgcacgccattacgctgccgtagcgtgcggtgtgccgtcaattcaaaccaccaatagcaatgcctgcgacgtccgcaaactgcgccaccgccggcgtcgccgtcgcgagggacgacatgtt

SEQ ID NO: 60161 - DNA, 313 bp, Zea mays
  unsure at all n locations
  Clone ID: LIB3069-032-Q1-K1-H12
gcgccatgaacatcgacggcgacaacggtttcgcctgcctcaccaagatctccggcgcctgctccgcgtccacggtctcgccgctgccccacatgttcgtcgtcaaggacctggctggtggacatgaccaacttctacagccagtacaagagcgtcgagccatggctcaagcgcaaggaccagcccccgcagcaaggcaaggagatcccgcagaccaaggccgaccgggccaagctcgacngcatgtacgagtgcatcctctgcgcctgctgctccacctnctgcccgtcctactggtggaaccccggaggag

SEQ ID NO: 60162 - DNA, 407 bp, Zea mays
  Clone ID: LIB3069-032-Q1-K1-H2
ggaggaagaggtgaaatggtgaaggccgttacgtggctcctcgatcggctcctctacgtactcaagcaggacaagggcaacgacgccaacaccgcgcgtgaccgacggcgaaggaggcgtgctccggccggtggcgccgccaacgccgttggaaacgatgatggcgaggagcagcacctcaacacctttctcgacgctgcgaatgcgtcgtccgcctactcaagggtgcagttcaggaatatggcgtcgcgcgcgcggtgggtggaggaagccggcgctgcggaggtggtggagaacaggggcaagctgtggctgaccaccggtgtcactcgggccggcaagctgtactacaacgttgaggagaccgggttcttggccgaaatgggtgcctggattcttctcaatga

SEQ ID NO: 60163 - DNA, 232 bp, Zea mays
  Clone ID: LIB3069-032-Q1-K1-H5
cccacgcgtccgcaaggactcgcgacggtttgagcaacggaggaagcaactacgcggcagccatggtgaacgtttcgaagaccaagaagacctactgtgagaacaaggaatgcacgaagcacacattgtacaaggatacccagtacaagaaaggtgaggatagcctttcagctcaagggaagcgacgttatgaccggacacagcttggatatggtggtcagacatagactgt

SEQ ID NO: 60164 - DNA, 105 bp, Zea mays
  Clone ID: LIB3069-032-Q1-K1-H6
gcgtgtatcactaggtacgcgtactcgtatcgttgtgttcagttctgggtctatagagatgtagccctgcattgtcgaaataaatactgtgtccactcgttcgtg

SEQ ID NO: 60165 - DNA, 453 bp, Zea mays
  Clone ID: LIB3069-032-Q1-K1-H7
gttctccgtactggggttgcggtttcttgtctccctactgatgatcgctgcttggatccttctcaccaataccatcatcagttctggtcttttcctcctcttgcacaacgtggtggcggacacgtgcgtcgcgatgggcgattgggtggcgcacccgcaggcgcacacggcgctggacgacatcctcccgtgcgtggacgtggccactgcgaacgagtcgctgtaccggagccaggacgtgacgtctcagctggcggcgctggtgaacaacgtcgtcgtcaacatctctaaccggaacttcccgacggggctccgtccgctctacttcaaccagtcggggccgctcatgcccgtgctctgcaacccgttcaacccggacatgagccgacgccggtgcgcgcccggcgaggtcgactttcgcagcgcggcgcgggagtggaagcggttcgagtg

SEQ ID NO: 60166 - DNA, 453 bp, Zea mays
  Clone ID: LIB3069-032-Q1-K1-H8
tcggccacgcgtacggaaactccgagcccaagtctgataggaggacccctctggttaccacattcaatttaagttcctggaaagcaaatatattaaattttggaggaagaacctaaggaccgaactggatccttgcctacccgaggaattaaatcgagcgactagaatctaggtccaaaaaaatctaggccctaaacctagccgcctagaaccggctaatcgagcgactaatcggccctaatcgtcgactagtcggacgaccagggcgaccaggtactctagtcaagtcggctgcctaatcgagctctgctaaccgactagcccgactaatcgagactaatcgcgattagtcggacgacttgaaaacacagtttagctcttaaagaggagctaaactttagtctgtttctttagctcttggatccaaacagacccttagaatacaagtgaatc

SEQ ID NO: 60167 - DNA, 274 bp, Zea mays
  Clone ID: LIB3069-032-Q1-K1-H9
tcgattcctaaaccaaacaagtatttcagactctaatttaaccccaactcctgaaccaagcaggcagcagctagctacccaatccaccatccttccttccttcctacccaatcttaggtattcttctaacctaaagacatcagctttaccacttaagcgaaccccttaccagatgacttaacagaggaagagaagttggagcccctaaaaaatgtaaatgatgatcctaggattcggctattgaaccggttgtacgcgaagaagcgggaagagc

SEQ ID NO: 60168 - DNA, 463 bp, Zea mays
  unsure at all n locations
  Clone ID: LIB3069-033-Q1-K1-A1
cggacgcgtgggcggacgcgtgggcgtggtgggttccgatccaatcgacgtcgacgactgcgcagccaccgctcctctcctctcgtcgcttcttccgtctctcggcgtcgaatctcatccggccagtgaccacactctactagccgcccggaaggagttcttccgggattcgagccttgctgccctcacctctgcaggcccagcgtcgagcggagatccaatcggaaattcaactgacttcgtcttttgtcgcatccccgtcaggagaagcaatgtcaggagtgatcacaaagttcgcggttacatccatggtgatgtggatggcccctgttgcgatcatgtatgggttttactaccaggtgtttccaggtgtgagtcagatgtcatcctcggcgcagacacttgccagtgggttcctggctgtcatatcggttaatctagtgatcggctnttacatattcat

SEQ ID NO: 60169 - DNA, 441 bp, Zea mays
  Clone ID: LIB3069-033-Q1-K1-A10
cccacgcgtccgcccacgcgtccgcggacgcgtgggatcgccgactcgccgagtagatggcaacgtcacggacggcttagcctgtccctgctctgtaccattctactacgcctgtttttctgagactctgacacggatgttggcaagaccaccagcaccgcctttggtgactgctcaaactcctgaagtcggcatcttcattacagctcgcaacgtctcgggtgcactggtcgccaagcttcctggtaacaaaaacaagtgtggaggaagatcgaatgtccggcagcggaacatccaacctgggaaaaggggctgtcgtcgggagtggcgggcgctctcagcagctgaccaagcgcaagcttctaccttggacgtagatgaggagtgcaaacgggtgctcactccattgggtttctccagcgaagacgccgagaagatgct

SEQ ID NO: 60170 - DNA, 421 bp, Zea mays
  Clone ID: LIB3069-033-Q1-K1-A11
cttcttgttacatgacaactacacttgaggcggggaacggcaagtgttccgtctgcttgagagcaggaagagggacgagctgagccaggagttgctagacaaggcacgagctcgtaaccgcggcggagcgtacagtttcttctgtgaccctgacgctctgggagagaacctgtacacgattataaagttcggccttgttcaatacatgattctcaagacactatgcgctctcttggcgttggtcttggagccttttggagcctatggagatggcgaattcaagtggaattacgggtatccttacattgccgctgtcataaacttcagccagacatgggcgttgtattgccttgtgaagttttacaacgcgacgcatgaaaagctacaggcgataaagccactagccaagttcataagcttt

SEQ ID NO: 60171 - DNA, 238 bp, Zea mays
  Clone ID: LIB3069-033-Q1-K1-A12
cccacgcgtccggcaagcttgcagttgcagctggcctctgtggggggtcttttctgtacagatctagcaaggcagcgtcgtggcacacccagatacgcaccagacagtcaggtagatgtctgccaagatatgcaaatatggttgtagatgttctggttttcctttggatcatttgtgtttgtggatgtagtgctacgtgcaatggaatcaccacatttcccattttatttgacgcttt

SEQ ID NO: 60172 - DNA, 448 bp, Zea mays
  Clone ID: LIB3069-033-Q1-K1-A3
gcaagataccctttcatatggaattctgttcaagcattgcaaatccttgtgtatcctccatttagttggatccaaagatgggcaccactcaaatttcttgtgcagggaattcaggttattcaatttctcatctctccacaacgcatgctatttcgttccttgacataggggaaagacagaaactatccatgccactgttgtttttgtcagtcacaacaacagtaagtgagctgtcctccaagcgtgatgatgaaccagataacaatacagaacattctgaaacaaatgaattggcatcaacttctggcacaagtgatgctgctgatggcacaaaggaaatcgtacaagagaactggcttgtgttacttttcagggagcttgagaagcaaggcatcactttacccgagaggtttactgaagatgaattacgcagattttatgttgctgc

SEQ ID NO: 60173 - DNA, 437 bp, Zea mays
  Clone ID: LIB3069-033-Q1-K1-A4
gatctagatgctgtaaatttcaagaaattctgccttgttttgaagaaccaatacctatgtctaggtcaaaatgccgaaccacgcgcgaggaacgctatggcgctcctgcttaacagtgagggtatatctgggccacttcccacggccttgggcgccttctccaacttgagttacctcgccctcgccaacaacaagctcaccgggccaatcccaccatcagtcgggcacctgcaccactccctccgcgagattgtcctcctcaacaaccagctcttcggctgcctccccggcgagctagggatgctcagcaaggcggtcgtcatcgacgccggcatgaatcagctcaccggcccaatccctccgctcttttcctgcctcagcagagtcgagcagctcaacctggccgggaaccgcctctatggccatgttcccgacgc

SEQ ID NO: 60174 - DNA, 440 bp, Zea mays
  unsure at all n locations
  Clone ID: LIB3069-033-Q1-K1-A5
gggaggactatgtgtacccagctacaagatcccagaatttaatagttgtatcatgtgaaccagtaacaactattaaattctgggatcttgtagctgggaggactatgtgtacccttactcaccataaaaagtctgtccgagctatggcgcttcatccaaaggagaaagcatttgcatcagcatcagcagacaacgtaaagaagtttaaccttcccaaaggcgaatttctgcacaacatgctgtcgcagcagaaaacaataatcaattcaatggctgtaaatgaggatggtgttttggcaactggaggggataatggaagcctgtggttntgggactggaagagtggtcataactttcaacaagatcagactatagtccagcctggatcactggaaagtgaggcatgcatatatgccctctcatatgacgtgaagcgatca

SEQ ID NO: 60175 - DNA, 59 bp, Zea mays
  Clone ID: LIB3069-033-Q1-K1-A6
aaaaaaaataaaaaaaaaaagaaaaatagataataaaaaaaaaaaaaaaaaaaatggaa

SEQ ID NO: 60176 - DNA, 426 bp, Zea mays
  Clone ID: LIB3069-032-Q1-K1-H1
gtaaggccaaagcatatgttactagatatggaaattagacatacagaaactggcatattcacctttgataagactattgacttggctcatcctgccaattttgttgcacaagatggaaggctagaaagtatagcatacgatgtttcgaataatcatgcacataggacagactataaaaacgaatcttctgttggactcccagaaactgttgtgactcagagctcacttattgacttcactgacaattgttttgaagacaaaagggcttcaattgataaattgttacctaccaataatctagactggccattgaaggataagctcaattctacaacagactatgacatttgtaggcctattaatgatgatgaacgatcagacgacgaatcagtgcctaacatcagttataccagtcgtgtagtgata

SEQ ID NO: 60177 - DNA, 134 bp, Zea mays
  Clone ID: LIB3069-033-Q1-K1-A7
cccacgcgtccgtgaaagatcagcagcaatgtcaagcactcgcctccatgaaataagttgtctgaccaaagaacgtatttgcattatgtattgtgccagtgcagcgggtgtattaaaaaaatgtgcattttaat

SEQ ID NO: 60178 - DNA, 299 bp, Zea mays
  Clone ID: LIB3069-032-Q1-K1-F5
aaaactcatacgacagtctacaaaatcagttttaaaacatcacgacaaagacaaaaaaggtgctatgctaggtcggtacaaagcaccacagaatggtgctgcgcgacatactgcaggggatcacgaatccggcgatccgtatgctggccactaatggcagcaatgagcgcatctctgctctcatgtacgaggatacccgaatcgtgctcgatatgctacttgataacgtcatgcttgactccatgacctacaccgagcacgccagtcgtatgaccatcaccggcatagatgccaactac

SEQ ID NO: 60179 - DNA, 455 bp, Zea mays
  Clone ID: LIB3069-032-Q1-K1-F6
cacaaaaggatcaaggatgaaattgagcttggcaatggcctgccagatatcagaagcactcggcaatgtctccaggcagtaaaagacgccgggtttgaggttgtttgggataaggatcttgctgaagattctcccttgccttggtacttgcccttggatccaagccgattctccctgagtagcttccgtttgacctctgtgggacgcatgattacccgcacaatggtcaaggccctggagtacgttggtcttgctccgcagggcagtgagagggtctctaatttcctggagaaggctgcagaagggctggtagagggcggaaagaaggagatcttcacgccaatgtacttctttcttgttcggaagcctcttctggaatgagctcttggatcaccttttcagagagagaaggcaagtggtcatttcgaagaagccgaagagagggaacctggaat

SEQ ID NO: 60180 - DNA, 400 bp, Zea mays
  Clone ID: LIB3069-032-Q1-K1-F7
cccacgcgtccgatcgtcctcgcgctcagtggcatttgcagttcccggcagcagccatggcgtctgtgcagctgtctgggccgcgggtggtggcggctgcgaaaccggctgcgttgggcgggctcctactgacgccgtcccttgcggtgccaaaggggcggagaaccagggggctcgtggtgagggccgtcacggtcgtgtcacctaagtatacatccataaaaccattgggagacagagtacttgtgaagatcaagacctctgaagctaaatctgatggagggattttacttccagtatcaattcagacaagaccacaaggaggggaaattgttgcggttggagaagggagaagttttggaagtaaccgcattgagatcaaggtttcgggttggtgcac

SEQ ID NO: 60181 - DNA, 378 bp, Zea mays
  Clone ID: LIB3069-032-Q1-K1-F8
cggacgccctttatcgttcttgcgctcattgtcatttgcagttcccggcagcagccatggcgtctgtgcacctgtctgggccgcgagtggtggcaaatgcgaaaccgggatgattaggcggagctcctgctgacgccgtcccttgcagtgccaaaggggcggagaaccagggggctcgaagtgagggccgccacggtcgtgtcacctaagtatacatccataaaaccattgggagacagaatacttgtgaagatcaagacctctgaagctaaatctgatggagggatcctactttcagtatcagttcagacaataccacatggaagggaaattgatgcggttggagaacggagaagttttggaagtaaccgcattgag

SEQ ID NO: 60182 - DNA, 333 bp, Zea mays
  Clone ID: LIB3069-032-Q1-K1-F9
cccacgcgtccgcgactcatgcatagaatactaaaaaacgcacaaaaaaaactcaggaggggaaattaaaaaaaccacataaaacaaaaaaaaaaacaaataaaaataaaaagaaccaacaaaaaaaaaccaattgctctaagcaaaataaatgctatgcacccatatatttcatccagctagcttgcacatatggtaatctaaattgtctactgagaccgttctcctgaccaacctagcctagacaaaacttattgtcacccaaccgacaaacttggactgcaattccccttgtagcacttgctgaattacttaccagacaacaccctatgg

SEQ ID NO: 60183 - DNA, 452 bp, Zea mays
  unsure at all n locations
  Clone ID: LIB3069-032-Q1-K1-G1
tcgcccacgcgttcgcccacgcgttcgcccactcgttctcttgaagatagcttccagatatgtggggttttgcatcaaatgcttgggcatccgggctggggaagaggagtcccccaaattgcacctcttcgagtgctgcttgttccgatgacgaagcatcctcgtgcacgagcagggaagaaggcctggaatgcccaatatgttgggagtctttcaatatagtggagaatgtgccttacgtgctatggtgcggccacaccctttgcaagaactgcgtcctaggacttcaatgggccgtcatcaaagttccaactgtgccgatgcagctacccttcttcgtttgctgtccctggtgcaacctcctgtcgcttcgcatactttacaaagggaacctcacgttcccacggaagaactatttccttctctggatggttgaggngatgaatggtgag

SEQ ID NO: 60184 - DNA, 296 bp, Zea mays
  Clone ID: LIB3069-032-Q1-K1-G10
cacatttacagcgatgatcgctgggcttggtagttgactccgcatttgaagaaatggtcaacattcacattgaagttctggaattcaaattggacacatgtttcctagccagcttatgatagataatacgttgtgtataggtgtgtttaatatgaaaattgttgtcaattggttgaagagaaacttgtgtcattcttttgtagttaatcgactagcgaactatatgctatattcgttcctgtacaaagtattaggagtgattgacagtacctcttgatacagcattcatgagattg

SEQ ID NO: 60185 - DNA, 416 bp, Zea mays
  Clone ID: LIB3069-032-Q1-K1-G11
cccacgcgtccgcccacgcgtccggattatgcccctgccagtcaaacttgttgtctggtcgatggcagccgctaccacctgtggcggcttctacgctttcttcgttcacagcgagaagcctgtcatgccagcggtggcgccacggcccgccgcggccaaggatgcagcctccaactaggttcgtttgccaccacaaggcgcatactgccggccttggttcggcaccgcgcgttagatcccagggccaactaggttgttctctaattcctaatttcttggccttttctcttgcactctccgccatttgagctgtcgcctcggttggtttagcttgccggcgtggacagactggcagatctggagctcggcgcgaccagatccggtgctgctgtgcccgatggcagaggagatctctc

SEQ ID NO: 60186 - DNA, 359 bp, Zea mays
  Clone ID: LIB3069-032-Q1-K1-G12
agcaagctcagctgcacgcactgcacctaccgggccagccgccagccgccggccagcatggaggcggtggtagagtgcgccaagtgcgagtgctgcggcctggtggaggactgcacccgggactacatcctgggcgtgcgcgcggccttcggcgggcggtggctctgcggcctctgctccgaggcggtgcgggacgaggcggtcaggggcacgacggcgagaggccccgccgacgacgccgcggggctggaggacgcgctccgggaccacatggccttctgcggcaagtgcaggctgagccccgcgttccgggtcgccgacggcatgcgccagatgctgcgcacgtgcttcaagtgact

SEQ ID NO: 60187 - DNA, 416 bp, Zea mays
  Clone ID: LIB3069-032-Q1-K1-G2
aagttactgggagagctagagccaacatttactgtgttgctgcaatgatcgagtttagatttcgtttgggaactggccctgataagggaggaggcatcattcctggagtcgcggatggcaaggctctactgttgaactacaacgacctgtccgggcaacttcctgcagatcttggcttctccaaactgagcttactcgccctggccaacaacaggctaacaggcccaatcccgtcatcagtagcgcaactgaaagactcccttctcgaggttctcctactgaacaaccagctctccggctgtctcgcccccgagctcggcatgctcgccaaggcggcggtcattgacgccggcatgaaccagctcaccggcccgatcccgtcgtccttctcctgcctcatcagcgtcgagcagctg

SEQ ID NO: 60188 - DNA, 258 bp, Zea mays
  Clone ID: LIB3069-032-Q1-K1-G3
ggtcatacagtatagagccggtggcagattaattcctgtctgctgtgggtaaagcttatcttctgctttcgtgttttttcttgcttctttcgattatggtgtatgtcataatgtattagctgattatactgtccctgctcatcggactttattacgcttcattaagttaggctgattactgcttaacgggcgaaaaaagccctgaccaacacaagctaacaggcccaatcccgacatcagtagcacaactggggcact

SEQ ID NO: 60189 - DNA, 457 bp, Zea mays
  Clone ID: LIB3069-032-Q1-K1-G4
cccacgcgtccggactgcggcagcggagtgcatagagcggacgcaacgcaacaccgtccactctctgtcactgacgatcgaagtgaggagcgcactgaagccagccgccgatgagtcgcctcctctcgcggcagcaccttgccgccgtccgtcgatctgcaccctttgcgtgcgtgtccaggtggctgcacacgccgtcattcgcgacggtttctccgcaagaggtttcaggttccagcccagcggaagtgcagaattttgtgcagggcagctggacagcatctgctaactggaactggatagtcgatcccctgaacggtgataaattcatcaaagttgctgaggttcagggaacagaaataaagccattcgtggagagtttatctaaatgcccaaagcatggacttcacaacccacttaaagctccagagaggtacctcatgtatggagatatatc

SEQ ID NO: 60190 - DNA, 302 bp, Zea mays
  Clone ID: LIB3069-032-Q1-K1-G5
cccacgcgttcgcggacgcgtgggcggactcgtgggccgacgcgtggtcaagcacatcgggaagaagctcgttggcctacgacgattcatccacgcactctagctgtcgttctggatgaccgaccgtaggcacctacacctattggtcggtgacctcgggtaccggctggacctaatcagcaaggtgcacgggcttgataaagccgccgagtacttcgggatggtacccaagcagctgacgaagccgcagtgctacggctacctactgaaatgctatgtggaggcgaaagccgttgacaagg

SEQ ID NO: 60191 - DNA, 422 bp, Zea mays
  Clone ID: LIB3069-032-Q1-K1-G6
cccacgcgttcgggcgcagagaatccccttgcaaacaaacagggtagagggagaggagaggagaggagaggagaggttgggtctgggacaccatggctccgatgaagctgtacggtgcggtgatgtcgtggaacgtgactaggtgcgcaacggcgctggaggaggctggctccgactacgagatcgtgcccatcaacttcgccaccgtcgagcacaagagccccgagcacctcgttcgcaacccgtttggtcaggttccagctctgcaagatggtgacttgtacctcttcgaatcacgagcaatctgcaagtacgctgctcgcaaaaacaagccagagctgttgaaggaaggaaacctcgaggaggcagcaatggtggatgtttggatcgaggtggaggctaaccagtacaccgctgcactg

SEQ ID NO: 60192 - DNA, 361 bp, Zea mays
  Clone ID: LIB3069-032-Q1-K1-G7
cccacgcgtccgggctctcagaatccgctttcaaacaaacagggtagagggagaggagaggagaggagaggagaggttgggtctgggacaccatggctccgatgaagctgttcggggcggtgatgtcgtggaacgtgactaggtgcgcatcggcgctggaggaggctggctccgactacgagatcgtgcccatcaacttcgccaccgtcgatcacaagagccccgagcacctagttcgcaacccgtttggtcaggttccagctctgcaggatggtgacttgtacctcttcgaatcacgagcgatctgcaagtacgctgctcgcaaaaacaagccagagctgctgatggaaggaaacctcga

SEQ ID NO: 60193 - DNA, 313 bp, Zea mays
  Clone ID: LIB3069-032-Q1-K1-G8
cccacgcgtccgacgactccggattctttaacgatcacaggtagcatctggttcactttgactgagatcatgtccagcatgaactgcaagtgctactgcagctccagctggtcctgcgtcatgtcatgctactgcatcatccataacttgcagacctacttcgagagcagcctcaagaccatggttcttactgtgcataccaccacggccagcaccaccggcttcgaggctggcaccgacgtccgcgcctgccactgcaacacctgcaagtgcggtaccagctgcggctgcttctgctgcatctgcaactgat

SEQ ID NO: 60194 - DNA, 269 bp, Zea mays
  Clone ID: LIB3069-032-Q1-K1-G9
ccactccccatttctcagcgtgcgcgctctttctctctcctttgtggtaactggcggcggccgacgccgacgccctagctcacgtcttcgtcggtcccttcccagtcttcgtcgggtacttcgacgactacgagaacaaacgaggaattcaaggatacactcgctggactgaagaatagagaaacatgtctgatggaggtgcgaaagatttttaccgggcgaaaaagaaaggaggcctggagaaaacaggttgatactgacagaacaag

SEQ ID NO: 60195 - DNA, 350 bp, Zea mays
  Clone ID: LIB3069-032-Q1-K1-F4
cggacgcgtgggaggcctctgatccttgtagaatcgaaggataactctggagacgagacgtatagcatttttctacaaaacgcagaaacagttgcacttattacccctaacacaggatcaagtggaaggaccggcattcccgtgacttcgctgaaagtcggtgatgaagttctggtgaggaaacagggcgccgtccgtcacactgggatagagattcaggagtttattgttgagagatgaaaatggaaacgctgaatgcaccagtttcacgtcgctttgaacaaaataatgatgtatgattgcaacattcatctgttctgttggttaagattgtgagattccattgcagc

SEQ ID NO: 60196 - DNA, 363 bp, Zea mays
  Clone ID: LIB3069-032-Q1-K1-D8
cccacgcgtccggttggcttctcctccctctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgaaggcatgaacggcaaggagctggacggtcgcaacatcaccgtcaacgaggcccagtcccgcggcggccgt

SEQ ID NO: 60197 - DNA, 370 bp, Zea mays
  unsure at all n locations
  Clone ID: LIB3069-032-Q1-K1-D9
tgatattgcaaccacactaagaagggatatcacaaatacaatcctcacagatctaattaaaccagaaatagatcttcagaacttcttcaacaattatgataagtttttggaggagaaacgcctagctgaacaacatgctgactaccttggggctcaaataacgcacagggtagcaccactgcatctgctttggcaagctgccaattcatatactccaacactttttgagatgttcagaatggaatatgaacagatctcaaagtgtgtggtctatagttgtggtgagattggaccaatatctgagtaccaggtcactgtcaaagacaggcctcanggtcaatttgttagatttgactcaacagaatgtatg

SEQ ID NO: 60198 - DNA, 409 bp, Zea mays
  Clone ID: LIB3069-032-Q1-K1-E1
cccacgcgtccgctcagcatcaccgcattcgccttcagatctccatgccacccgtgcgatcagaggtcatcgccatcgtcgtgacctgcaaggctgacgttgatgcgttcttcgggaggctgctcgaggcgatccgtgcaagggcttgggaggtgacccctgcagctgctccgtcgagtggcacgtcggtggcccagggggccgcgcctacggaggacatcgcgatacggatgccggctgctggggtctcggagatactgcggatggagcaagagtcatgggagaacgccgggcagaacttgcacgatgcgttccaggatctcaatgccctcatgagccacgctaaggagatgatgcagctagcagaaatactgatgctcaagctattaatgaactcatccactgaatc

SEQ ID NO: 60199 - DNA, 377 bp, Zea mays
  Clone ID: LIB3069-032-Q1-K1-E10
cggacgcgtgggcgtggaagcctcagattgttccgacgaagaattcacctccgcgcgcaacagggaaacctacagatgccaccaacccgccagccatgtcaagaaaggattcgtttggggagctgctgacaaacctcccccgcatcgcctcgctaccacagttcctcttcaagataccagagggtactgagaactgaacgtggaagttaagacctcacacccttcccttggaataggtagtttgctgtaagcctgtaaagattgtatccaagcaataagaaagccccttatcacctcctcggaggcgtgttccccgctctgtaaatttgacacccggtaggtgcttcaggtgtatggttttgcgaatcatgggtagt

SEQ ID NO: 60200 - DNA, 426 bp, Zea mays
  Clone ID: LIB3069-032-Q1-K1-E11
cccacgcgtccgcccacgcgtccgcccacgcgtccgcccacgcgtccggaatccttctgtgaagatcgtcgccgtcaagaagatggagctgccgacttgcaagcaggccgacggcgagcgcgagttccgggtggagatcgacatcctgagcaggctagaccaccccaacctggtcacgctcatcggctactgcgccgacggcaagcaccggttcgtggtgtacgagtacatgcccaggggcaacctccaggacatcctcaacggcattggggaggtgaggatggactggccgctgcgcctgcggatcgcgctgggagcggcgcgggcgctggcctacctgcactccagcacggccgtcggcgtccccgtcgtccacagggacttcaagtccagcaacatccttctcaccgaccactacgaggcaaa

SEQ ID NO: 60201 - DNA, 409 bp, Zea mays
  unsure at all n locations
  Clone ID: LIB3069-032-Q1-K1-E12
gacaatctgtctatgtgtatggatgcaaggattctgtccttcaagtaaacggcaaggttaacaatatcactgttgacaaatgcactaagtttggaattgtattcaaggatgttgtagcagcttttgagattgtcaactgcaatggcgttgaagtccaatgtcagggtacgtcaccgacaatatcaatcgacaacacatctggatgtcaattatacttaagcaaagattcgctgggagcttcaattacttctgccaaatctagcgaaatcaatgtgatgggtccaagtggtggcgctgatggtgattgggtggagcatgcattgcctcaacagtacatncatagtttcaaggatggggcagtcaccacttcaccagtttcacacttangagcgtgaatacaattgttact

SEQ ID NO: 60202 - DNA, 434 bp, Zea mays
  Clone ID: LIB3069-032-Q1-K1-E2
tcgcccatgcgtacgtttatccatatccctgctgtttcagatcctcatggatccagtcaagccagggatcgatcatgatgactcggacgagcaccgcttcgaatctaaggcctacgccagagctgttaagagctatccgtagcagggctgtcacacgggcagaagaacagctgcatcgtcatcaagaaccgcccctgcaaaggtgtgcaggtttatacctgaaatactggatagcatggccatgccaaatgccactttgatgcatagacatgttcaacaggaaaaagctagcagatatcggtacttggtcacacaactgcgatatttcgcatgtgaaccgaactgagttccagctgattgatatatcacaggatggatttgggagacgtttttactcaaatggcaacactaatgatgatcttagactcccaact

SEQ ID NO: 60203 - DNA, 397 bp, Zea mays
  Clone ID: LIB3069-032-Q1-K1-E3
tcgtccacgcgtacgctcatcattaccgcagttgccttcagatctgcatgccacacgtgcgatcagaggtcataggcatcgccgcgacctgcaaggctgacgttgatgcgctctccgggaggctgctcgaggcgatccgtgcaagggcttgagaggtgacccgtgcagctgctccgtcgagtggcacctcagcggcagagggggccgcgcctacggaggacatctggatacggatgccggctgctggggcatcggggatactgaggctggagcaggagtcatgggataacgccgggcagaacttgcacgatgcgttgcaggatctcgaagccgtcacgagcagagctccagaaatgatgcacctcgcagaatacatgaggctcaagctataatgaac

SEQ ID NO: 60204 - DNA, 389 bp, Zea mays
  Clone ID: LIB3069-032-Q1-K1-E4
tcgggggcagagacagagagcaaagcacccttttatccaagatccgatccatccaatctacgcagcggaggtctggcatctcagagcgggcaaattgccgaggaagacaagatcaggaggccagtataacacctgacccgagtagtaggacaggtagagcagatcaagaaaagcggtgaggagcagcttccagatgcacctgagcggcggtggccggatgttgccgccgaaacagctgctgaccatcgtcatcatcatcttctccacgctctccttcatcaagctccttctcctcaccagctcgtcgtcctcgtcagcgggcttcaccttccgcagcagcccggcgtgggacgcagacggcggcggtaacgggacggctaggagcgcgc

SEQ ID NO: 60205 - DNA, 286 bp, Zea mays
  Clone ID: LIB3069-032-Q1-K1-E5
cccacgcgtccgggaggagttcgcggagtgttgacaagaaggtgaaggagcggatcgacgcccgcaaccagctggagacgtacgtgtacaacatgaagaacacggtgggcgacaaggacaagctcgcggacaagctggaagcggaggagaaggagaaggtggaggacgccctcaaggacgcgctggagtggatggactacaactagtcgggccataaagaggacttctaggagaagctcaaggaagtggacgtcatgttcaaccccatcttgtacggcgtgtacca

SEQ ID NO: 60206 - DNA, 213 bp, Zea mays
  Clone ID: LIB3069-032-Q1-K1-E7
actcgttcggctaggaactggtgcttaatcctgaatacctgtactgctgtttttcttgccaactgtggcatcgtcgtcttgcggctgcgaagctgcagccacctagctcgcgtatggcggcagatgagacaattcataatctaagtatatagatataaatagtattattaccgtgccgatataatgcactatctatggacatctgctgcaacg

SEQ ID NO: 60207 - DNA, 377 bp, Zea mays
  Clone ID: LIB3069-032-Q1-K1-E9
cgacaaagcccgcgaggtcgatcgatcttttttgacgcgagggattggaaaactaagttgcgggtgtagttaattttctaggaagattggggtttcagctcaaactcccatgctcgacgctgaggacgaccctggcgggagatgacgaggatcttcgtgcagcgcgggaccgccggctcctcgtccagctccggccgctcgggcacgcagccagtgcagccggcagcagctgcccgggaggaggagttgccggtgcaacctcaaccacagctgccggagctattggccatagatgatacaactgatcatttaaatgagggcagcgagaatatcagcaataagcctttgctgacggatgacaccatctcagagagctc

SEQ ID NO: 60208 - DNA, 406 bp, Zea mays
  Clone ID: LIB3069-032-Q1-K1-F1
gacccacgcgttcgcggacgcgtgggcactaatacactacaccataccagaaggagcaggaataagacgagatggcggacgagcgcttgcctcaaacggccggcgcccgcacggctctcgccagagctactggatcctcggcacggaaacgcgcccgcgatagctaggtgcgcctgtgggcccggccggctcgtcacttacataggcgcacgcaccccccgcctggtgcgtcgtcgatcgctgctttgctggcgcgcggcggccctgtggcacagtagaggtctgctgaggacgacgaccggaggcgtgctgcgtggatggtcctcatggccgggatgctccccggcgtggagtgcgcgcggcggcggctggtccggcagggcggggcggtgatgggagcggaggc

SEQ ID NO: 60209 - DNA, 121 bp, Zea mays
  Clone ID: LIB3069-032-Q1-K1-F10
cccacgcgtccaatactcatgcacttattactaaacaacgcacacaaaaaaaccggtggatcaacttcataaccgaggacatgatacccaatacaccaaaagaaatccaggagactcatac

SEQ ID NO: 60210 - DNA, 363 bp, Zea mays
  Clone ID: LIB3069-032-Q1-K1-F2
tcggacacgcgtgcgcccactcgcgcggactctaattcactacaccataccagaaggagcaggaataatacgagatggcggacgagcgcttgcctcaaacggccggcgcccgcacgggtctcgccagagctactggatcctcggcacggaaacgcgcccgcgatagctaggtgcgcctgtgggcccggtcggctcgtcacttacataggcgcacgcaccccccgcctggtgcgtcgtcgatcgctgctttgctggcgcgcggcggccctgtggcacagtagaggtctgctgaggacgacgaccggaggcgtgctgcgtggatggtcctcatggccgggatgctactcggcgtggagtgcgcgc

SEQ ID NO: 60211 - DNA, 159 bp, Zea mays
  Clone ID: LIB3069-032-Q1-K1-F3
cccacgcgtccgatttggctgtagctttccttgttagttgatcaatacacctgttcagtttgtattgttttctccctcaaatggatgtatggattcacttgcataacagtgtgaacaaacattcgctgccaaagatctggtacgttgttagtgtttgac

SEQ ID NO: 60212 - DNA, 426 bp, Zea mays
  Clone ID: LIB3069-032-Q1-K1-D7
ggggactacaaactagatgccacagtgactatagcttcaggggatgatatttatctgggtgacctcgtgtatgagccgtcaagagactggccgacgatgtgggagattggagtacctgatcgatctgctgctgagttttatgttccggatcctaaccccaactacgtcaatagattgtacgtcaaccaccctgcagatagatttagacagtatgggctctgggaacgatacgcggaactataccctgacagtgacctggtatacacagttggccaaagtgactatagcacggattggttctatgctcaagttaacaggaaaattgatgacaacacttaccagtcaacaacatggtaaatcaagttcgatcttgacagtgtcagcccaagcagcacctacaagttcatggtggctctggcgtcttct

SEQ ID NO: 60213 - DNA, 449 bp, Zea mays
  Clone ID: LIB3069-057-Q1-K1-E1
gcgtttgtttttaacccaagcggaagcatttcaatacattcactcatacagatagacaaacaggtatcagtacatagatgacatgtttccttaacaagaaaatgtcgatgagcaactaaaaacaaaacgagatgaaacacaggacaacttttcatttccagtacactattaaaatcgggcccctagcatcgatgcctttacttcttgccttcgatagggagtatttccaatccagccatccattcaagtaatgcaagccatttctgagataaatagccattggtttctctccttgtctcctttggataaaagccctactgccgtcgccgctttctcgtaacttcctttgggaacctgagaggggctgggagcgtcatgaaagtagacttaaaagcaccttctgtcacagatttgcatcccaactggtcataatatgggttaagattttg

SEQ ID NO: 60214 - DNA, 354 bp, Zea mays
  unsure at all n locations
  Clone ID: LIB3069-057-Q1-K1-E12
ccctctcttgatcgttctgttcctcacancacacggtggctgggcgacctgagaagcatgcggcccccgcggcacatgagacggccgtgcacatcgtgtacgttgaccgccccgaggacgccgaccctgaggagttccacattcgcaccctcacccccgtcctcggcagcgaacagaaggccagggacgcagtgctctaccactacaagaacgccgccagcggcttctccgcgaagctcaccccccagcaggtcaaggatctcaaggagcaaccaggtgttctccaggttgtgccgagccagacttaccagctacatggtcctgggtctggcactcaccagggcacgacacaca

SEQ ID NO: 60215 - DNA, 227 bp, Zea mays
  unsure at all n locations
  Clone ID: LIB3069-057-Q1-K1-E3
ctttactctcttttctactctctctcctaccaaaaacccatgcccttaagaaattttaaattccttttcaacaccaaacaannttacacccacttcattggcctccccccttttgttgtctccttcctattctccctattaaacaagcaccaacttttccaactctacattaacaacccatctttcaactacgtctgttttaaaaccccccttttttttccaacaac

SEQ ID NO: 60216 - DNA, 355 bp, Zea mays
  unsure at all n locations
  Clone ID: LIB3069-057-Q1-K1-E4
cggtttcggaattacccggctgcgacgccacgtcgnntccgcccgactcgtcccgtcccgagttgtcagtcatatatgataaaaatttaaacncataacgttcagaagggggacagtcgtcaacgttgagaacgcanaatgtctttttgagggtgatacccatctagaggcatcaaagaagaaaatcgtctgctatatcaacacatncctcaatgcagntgaaatcacttaagagaattgcggaccaccaaatagagatggaaaggtacctcaaagcttggttgatagaagtttnttcccctttgtgctgaaaaagataggcatgccacccgttttgacttgtcccagaagagca

SEQ ID NO: 60217 - DNA, 373 bp, Zea mays
  Clone ID: LIB3069-057-Q1-K1-E5
gttgaaaaggcatgtaaacaaggtgtcctgtatggtaaagaaatggtggggaggggcggaagaacctgccaaatccagcaaaagcaaaattgagctctgaagcattgttgaatcacgtcagtaaatctcatccgtcttccacttctcctggagcaaagttttagatggttatcggaagataaaagttacagcaacgcatccagggcttttgttagagagtttagctacataaaacgtgtacaattgtttgtttttaacttctgttatttgcagtgtacactagtaaaagaactgaactccgatgatagtttttttccaagttagttgtgtcccaattgggtcgtgtagtgtttgatactctataaaactaaac

SEQ ID NO: 60218 - DNA, 336 bp, Zea mays
  unsure at all n locations
  Clone ID: LIB3069-057-Q1-K1-E6
ttcaaaatctacaactgtaaccccagctccaaatactaatccacttccagatccctagagcaccaatgctgggagtgcacaangtgcaacacggactcctagtggcaatgcaagaactggtggtgttgggggcactggtgccaccggtggactgggaggattgggttcaccagaattgagtagtttgcttggtggtcttgctggcagtccaagaactggttctgctggtggtttaggaggttcgggttcaccagatttggggagtatgcttggtggttcacctgatgtttctccgttcagtcagatgttgcaaaaccctgcaatgatacacatgat

SEQ ID NO: 60219 - DNA, 351 bp, Zea mays
  unsure at all n locations
  Clone ID: LIB3069-057-Q1-K1-E8
nncgccgncccgcctccacagcccagtcgctacgtcgtctcttccttaccaggattcccatggcgccctcggagcgagctcgtcacagtgccctcttgcgacatccaatncaagtgttacaacccatgttcggtggccctcccgcccctttggnggtctcctctcctattcggccggttgggacaaagcaccacgtgtttccaagctctatcatgagcgtacccatctggcaatctacgtgcgggtgggaaggccgccgctgttggggccaacagccaggccgcgcagtccatgctcaagcaggactacaaggacgccttgacccgcgaggaggccgtcggtctcgcgctc

SEQ ID NO: 60220 - DNA, 238 bp, Zea mays
  Clone ID: LIB3069-057-Q1-K1-F11
gtgagatggatcggttggaggagcggaacatttaaaaaggggagagggagatggaggaagcgcgcaatgaatatgagcggaatgaggaagcggtggacaggaatacccaggagccgcagcaaggtcaaggcctcatcctctcactcgccaacggcagcgacagcggcaggtctggaatgttgccgatgtcgaacccttcagctaatcccacacagcttacaattttctatggtggatc

SEQ ID NO: 60221 - DNA, 239 bp, Zea mays
  Clone ID: LIB3069-057-Q1-K1-F2
ccatggagaggaatagttcactgcttttcatctaaaacgactaaaggattcacacaaggattgtagctcaaagctttctgaggaatctggaggatgctggtgtgacatgcttcttcctattgttaaagaagcttggaggaactgcaagaaagcaattgaggcatcttcgccaccaaaaggatccaaatctattattgtacccatggatttgtgttcatttgaaggtgattcttctgttg

SEQ ID NO: 60222 - DNA, 397 bp, Zea mays
  unsure at all n locations
  Clone ID: LIB3069-057-Q1-K1-F6
cccacncntccggaccttttgaaaaatcttaatcataaaaatattgtcaagtatttgggatcattgaagacaaagagccacctccatattattttggagtatgtggagaatggctcacttgctaatattatcaagccaaacaaattcggaccttttcctgaatctttggtggctgtatacattgctcaggtgttggaaggtcttgtttatctgcatgaacaaggtgtcattcatagagatatcaagggcgcaaatatactgactaccaaagagggccttgtcaaacttgctgactttgggagtgccactaaattgactgaagctgacatcaacactcattctgtggtcggcactccatactggatggcgcctgaggtcatcgaaatgtcntgtgttt

SEQ ID NO: 60223 - DNA, 322 bp, Zea mays
  Clone ID: LIB3069-057-Q1-K1-F8
cagatacgttctgcaaacagtatggcctgtgcaggggcacggctcttttctctggtgggacaagtgacagcacatgtgtgttctgccaccacctgcttgatgaagttatgtccaaactgaaagatccggacgcggagtttgagatagttcagattcttatcaaggagtgcaataagattgaaggccacgtccagcagtgcaagcgactggtcctgcaatacattcccctcatcctggtgaacggcgagaagttcctcgagaagaatgatgtttgcgcgctcgtacaggcttgtccagccacccataagaagactttcagctc

SEQ ID NO: 60224 - DNA, 196 bp, Zea mays
  Clone ID: LIB3069-057-Q1-K1-G12
ttggaagaaccacgcgtacgaaaaaaaacaatgcaattaacattcatatttttacatttgaactccaaacaaaacttaaagaaaccaaagcacaattcacatataaatacattctccccccactttcaaactaccagacttaattatacttaccttcaacggtttcctttttttatctcatgaccataaataattt

SEQ ID NO: 60225 - DNA, 344 bp, Zea mays
  unsure at all n locations
  Clone ID: LIB3069-057-Q1-K1-G3
cccactcgtctcgcggtactcgtgtggcgctcttcagctacagcgtacgttctgagagcgcggcgggcgccctctgcgcgcgtgggacgctgctnaacaggagtgcggacgatcctcggcgcagggagagcttgatagatagccacggcttgtgggcgtgcgtcgccggcttggacgtgagggccgcctgtggcggctcagaagatagcatggcgggcgccggctggtactcgatgtgcgggtagaccggggtcggctgatcgcgcgcgcggaggagcgagcggtcaatgaagggcatgacggcgatcggtacgccgcggcagatgtccgcccacgagttgatg

SEQ ID NO: 60226 - DNA, 247 bp, Zea mays
  Clone ID: LIB3069-057-Q1-K1-G4
ttgaccctttccatttttattacatatttcgataaaactaaaaataaagagtttctgtgcggattatgcacgctctgaatccttaaaattatatgcaaaggtatttaatcaaggcaattttttcatctatatttcccaaccggatgtacaccacttgcatggtaccaagtactatatatataaaaccaaatgttattttttgttaagccctcaaattattcatgcgagctcgcttataatatcaaat

SEQ ID NO: 60227 - DNA, 396 bp, Zea mays
  unsure at all n locations
  Clone ID: LIB3069-057-Q1-K1-G6
gggcacttctcattgctctatttgcaactgtgctccatgcaagcttcagggcaccaaggctcaaatcacgtgtgaatacattcanagaggaattccgggctgtttggcggaattatagtgagctttaagggtttcctttgtttctctcatgttcatgggtaatgaaggtgtctggtgccgttgtttgtgagctgtgctaggagatctagttgaaggtgaaacgccattgcacattacatggactacttgctctcttgggaggtgggattctggttgggttgactccgaatgcgatgctatgccagcacacgatccttcaagaacaatagttttctttcgtacttctccctaaccgagcattagagagaggacagcatgtaaaggatgtaaaaatgt

SEQ ID NO: 60228 - DNA, 252 bp, Zea mays
  unsure at all n locations
  Clone ID: LIB3069-057-Q1-K1-G8
cccactcttctcgaccaaacatatgacgctcatactttaaggaggagaataatggatggttaggganaagatatcgtggcgatagcgttataagaatgtatacannaatcttttgtgagccgatataccccatttgtttcgattgaagatnccttttgacccaggatgaactgggttcacttatgctaaagatgacttgaaagaaattggagagcaaagtgccagattggtttggtgatgaaaccttctcgt

SEQ ID NO: 60229 - DNA, 364 bp, Zea mays
  unsure at all n locations
  Clone ID: LIB3069-057-Q1-K1-H12
ggaggtgcanctgcaaaacctggggttttggatcctggacctnggctaccgctcccaggaggaagcctgggctgctggtggcaaccncnttctgctcaagaccacaaacggaaggaagagctggatgcgcgacaaagctgccgacaacatcgccgccaatctctactccgtcaagttccttgatgacaagaaaagcttcgtgctgggcaacgacggcgtgttgcttcggtatcttggctgacattctatgtatatgtgtgtacagcgaacggcatgtgctgctgctactactactgtaaaaggctgcttactgtgcttgcgttctctcttctgcaacccaaattgagtgtaaagatgcatgtgc

SEQ ID NO: 60230 - DNA, 292 bp, Zea mays
  Clone ID: LIB3069-057-Q1-K1-H2
tcgcccactcgttcggagagcgaaagcagctcatatacacaggagggaggtagaaaggagtgggagcctcggaggagggagagggcgaaaagtaaggggaaccaaatcttgaagggtaaacggagagttctttcgtggaagaagaagggggggacagcaagaggagggtagaagtagctcaatagatctactgctgtcgggggagttaatgcaaagctgagttgctgcacgttggctttcttcagagatggcttcagctggtgtagccccatctgggtacaaaaacagcagc

SEQ ID NO: 60231 - DNA, 391 bp, Zea mays
  Clone ID: LIB3069-057-Q1-K1-H4
ctgcaacaacctgccggtccccttcctcctctcctggcagggaattcaggagcggaggagctcatggcaggacggcgtgtaccgcaccaactgcccgatccctccgggcggcaatttcacttacaacatgcagttcaaggaccagatcgggagctactactacttcccttcccttctgtttcacaaggcagctggcggttacggtgccatcagggttctcagccggccgaggatccctgtcccgtttgacccgcctgccggggatttcaccatattggcgggtgactggttcaagctcaaccacaccgacctgaaaggcattctggacagtggcaatgacctgccgtttcctgacggccttcttatcaatggccaaggttggaatggcaac

SEQ ID NO: 60232 - DNA, 351 bp, Zea mays
  unsure at all n locations
  Clone ID: LIB3069-057-Q1-K1-D9
cccactcctccnattcgatgccttgcatcgcactcagaggcactttcttggggacgagcttgtcccactgagtgtgaagganttncancanctacagaaacagctcgaatgtgctttgtcacaggcaagacagagaaagacacaacttatgatggagcaagtggaagagctccgcagaaaggagcgacacttgggagaaatgaacaggcaactcaaacacaagcttgaagctgaaggttgtagcaactacagaaccctgcagcatgcagcctgtccagctcccggcaccaccatggtggagcatgacggcgccacctatcatgtgcatccaactgctcaatcggttgcaat

SEQ ID NO: 60233 - DNA, 439 bp, Zea mays
  Clone ID: LIB3069-056-Q1-K1-H8
gctgagtcaagaatatgccatggaatgaattggcattatcctcatgaaccattcatcacggagcttcagggtcggattacgaaagctgatgctgtattgagggacaaggaagaagaaaatgtgatgctgaaacagcaattggaacagtatgagagtcaatggtcagaatatgaggccaaaatgaaatctatggaagaggcatggaagagacagctctcttcactgcagctgagccttgttgctgctaagaagagcctagctgctgccgatgtggctactagaactgctcagactgattgtactccaacacatgcccagtacgactctgaagacacgttgtccactgggacccatacacccgaagtgacagaatcgaggcaccgtaaccacaaccacaaccctgaaactaaaagtttaacatgaaactcggataggcgag

SEQ ID NO: 60234 - DNA, 283 bp, Zea mays
  Clone ID: LIB3069-056-Q1-K1-H9
ccgacgcttacgaacatgtgccacattaactataaacagctgtcctacttgagagactgagcgtattattacgatgatgaggaggaaactcaacagcgcatccacacgatggagagcgaatatccaccgcgtcacgccagtgctctgagcctactagtgcgctctggcaggaccagctgtcggcatctaaacttacagccttctctcgcacagcaactccgaagatgttcctaccaaatcagatctggtttactgcacagcagcatcagacgcccaccccata

SEQ ID NO: 60235 - DNA, 411 bp, Zea mays
  Clone ID: LIB3069-057-Q1-K1-A12
cgggcggtggcaagatcgaggctgaactgagcaatatctgtgattgcatcttgaagctgcttgagtcccacctgttgccttcttctactgctggggaatcaaaggtcttctacctcaagatgaagggtgactatcacaggtatcttgcggaatttaagactggtgctgagaggaaggaatctgctgagagcacaatggtggcctataaggctgctcatgacattgctctggctgagctggcacctacccatccgataaggctgggacttgctcttaatttttcagtgttctattatgagattctgaactccccagacaaagcttgcaacctggcaaagcaggcgtttgatgaagctatctctgagttagacagccttggtgaggagtcatacaaagatagcactctgatca

SEQ ID NO: 60236 - DNA, 406 bp, Zea mays
  unsure at all n locations
  Clone ID: LIB3069-057-Q1-K1-A4
gcgttctcccactcntcccccatcttccgttcttatattgtgtttggcatacaagggttttgcgtgatgccatggagtgatccgtgnangtgcctggtgtcctccctgccagtgcctgaagcaaaccatcctccatcagatttctctatcctcctttctttatacttacaatctctctgtttgaatgtgaaacatagtggtagagtagctaaactatttatgacctgagactgacgtgttcatgttgttagggagaagaaagatcnccatggccactgactcgggtgcatggngccttgaccaggatgcttaagctcgtcttggcattagttgaaggtaacctcgtgtgttaacaaaaagacaaacaactttgttgaaagacttgaagttcttttaacttgttgct

SEQ ID NO: 60237 - DNA, 319 bp, Zea mays
  unsure at all n locations
  Clone ID: LIB3069-057-Q1-K1-A5
tcgccgcactcctnncnatgcggtctcatcagctatcggcaccaccgtccaaagatggtganattgctcaagcccggcaaggccgtggtcctccntccaggccggttcgccggccggaaggccgtgatcgtgcgcgttttcgaggagggcacccgtgatcgtccctacgggcactgcctcgtcgcgggcctcgccaagtaccccaagaaggtgatccgcaaggactccgccaagaagacggccaagaagtcccgcgtcaagtgcttcatcaagctcgtcaacttcacgcacctcatgcccacccgctacaccctcgacg

SEQ ID NO: 60238 - DNA, 341 bp, Zea mays
  Clone ID: LIB3069-057-Q1-K1-A6
tcgcccactcgttcgcccactcgttcgtgggtaggacaagcttgtcgtatcaagttcctgcgcgctcatgcacaccgctgtggatcttgttaacgagactaagcttgacagcgagattaagtcttggcttgcttttgctgcccagaaggttgttgaggttgatgctcttgctaaagcattggctggtcaaaaggatgaggcttacttcgcagcaaatgctgctgctcaggcctcgaggaaatcctcaccccgtgtgaccaatgaaaaagtccagaaggctgctgctgctctcaagggctctgaccaccgccgtgggaccaacgttagtgctagattggatg

SEQ ID NO: 60239 - DNA, 387 bp, Zea mays
  Clone ID: LIB3069-057-Q1-K1-B11
gcaagccatgtggaggaaggctttatcgatggtcctgttcatggctggcgccgggctgctcggcggggctgtcggcgccggcgcgcatcatttcgtgtggagcatcatcacccggcccatgttccagagcatgctgagccaccgcggcgacagcgggtgccagggcgccttctacacctacgacgccttcatcgaggccgccagcaagttccccggcttcggcaccaccggcgacgagcagacgcgcaggcgggagctcgccgccttcttcggccagacgtcccacgaaaccaccggtggatgggcgactgctccggatggaccgttttgcctgggatactgccgggtgaaggaacagaaacagacggacccaccctactatggacg

SEQ ID NO: 60240 - DNA, 285 bp, Zea mays
  Clone ID: LIB3069-057-Q1-K1-B12
gtctggtggccgaggtgtctaggccggctaggaagcgccttatgcctaacttcaagcgccttcagcaggacccgcccgccggcatcatcggcgcgccgtacgacaacaatatcatgctctggaacgccgtcatattcgggccggatgacacgccgtgggatggaggcacgttcaagctgactctgcaatttacagaagattaccccaacaaacctccaactgttcggtttgtttcgaggatgtttcatccaaacatctatgcggatggaagcatctgtttggaca

SEQ ID NO: 60241 - DNA, 261 bp, Zea mays
  unsure at all n locations
  Clone ID: LIB3069-057-Q1-K1-B4
tcaacttcctgagctctcattcacacctcgttggatcttnctaacnanactaatcttcacaccaaaattaaatcttggcttgcttttgctgcccacaacgctgttgaagtccatgctcttgctaatgcattggctgctcaaaaagatcaagcttacttcacaccaaatgcttctgctcatgcctcgagcaaatcctcaccccgtgtgaccaatgtaaaaatccataacgctactgatcctatcaaagacctctaccacctc

SEQ ID NO: 60242 - DNA, 270 bp, Zea mays
  unsure at all n locations
  Clone ID: LIB3069-057-Q1-K1-B8
ccctgtctctctctctctttttctctctctctcggtaggccgatccaccagaccatttggggcaaccaggtcggcggcggcggncttcaagggtggaaccctttcgacgtgatccgcagcttcccgtcgacgcccgagtcgctaatgtcgcagatcgacgcggtcatcgtctccaccgagtacgcccgcgcctgcgccctcctcgacccctcccaagtctcagcctcgtcgccgcccgagatcgatcccgtaggccagggggaccgggga

SEQ ID NO: 60243 - DNA, 286 bp, Zea mays
  unsure at all n locations
  Clone ID: LIB3069-057-Q1-K1-C10
ggtgaacaaaataagaagggctattttttttttttatatttattaccgcgttccattagaaaaaaattagaggtgtgtgtgantgatgtaagtcttgattttgttcattgggttgtggtgatcattttgtaatggtagtggccaatggaattggagagtgggttaagttttcacatatgatactatatataaggcatcatatggagtttagaggtgcagcagtgtttgttgtttacacatgccttcaaatgttagactatataagattttaccctgtacgtaacct

SEQ ID NO: 60244 - DNA, 300 bp, Zea mays
  Clone ID: LIB3069-057-Q1-K1-C12
gcggtctcgtgggtaaagatagaatgcattttgtgagtggtgagtcgttaattgaatgcgctactattgcttacaagtgtgcaaaagttggtgcagtcgggataaattgcacacctccaagatttattcatggactgatactctccattcgaaaggtcacagacaagcctattctgatatatcccaacagtggtgaaagatatgatggtgaaaaaaaggagtgggtggaatccactggtgtgtcaaatggtgattttgtttcgtacgtaaatgaatggtgcaaagatggggctgcgctta

SEQ ID NO: 60245 - DNA, 343 bp, Zea mays
  Clone ID: LIB3069-057-Q1-K1-C6
cccagcctccggtctggtggtgtgcttgtgcaaccagcaacattatgtggctatgaggatagagatatgttctgcattgttcttctacctggaagtggcaacagaaaggtattcggaaaagcagttgtgtttattgttgacacaagtggaagcatgcaaggaaagcctcttgagaatgtcaagcatgcagtttctactgctctttcagagcttgtgcaaggggattatttcaacattataacatttaatgatgagcttcactcattctcttcctgtttagagcaagtaaatgacaaagcaatagcaagcgcaactgagtggatgaatgcaaaacttgttgctg

SEQ ID NO: 60246 - DNA, 331 bp, Zea mays
  unsure at all n locations
  Clone ID: LIB3069-057-Q1-K1-D11
cccttcccttcccttggatccatacaatacgtcaggaacccannatgaccgcggcggctggggcgagaagagatggccgacggcaacancaactcatcggcgtcggtggccatgggacaagaggtgcaggctttcgttgagaacaagtatggtggaatggtgcctaagaagcctctgatttcaaaggatcaagagcgcgcctattttgattctgcagactgggtccttggcaagcaagctgcaaacagcggcaccgcacgggctgcgactgctatcgaattcttgaagccaaagctaaagaggacgccccatcaccagcttccccctcgca

SEQ ID NO: 60247 - DNA, 345 bp, Zea mays
  unsure at all n locations
  Clone ID: LIB3069-057-Q1-K1-D12
tctcttcatttcttttagactcnatacccccccgagttttagttccttctttcggtcgagagagccattctggtggcaatggcgaaaagcgagggtccggcgatcgggatcgacctctgcaccacctactcgtgcgtcggcgtgtggcatcacgaccgggtggagattatcgccaacgaccaagggaaccgcaccacgccgtcctatgtcggcttcaccgacaccgagcggctcatcggcgacgctgccaagaaccaggtcgccatgaaccccaccaacaccgtcttcgatgccaagcggttgatcggcaggaggttctctgatccgtcagtgcagagtgacatg

SEQ ID NO: 60248 - DNA, 424 bp, Zea mays
  unsure at all n locations
  Clone ID: LIB3069-057-Q1-K1-D4
ggatgaaaaaaatgtatatgttgttatttaattatgcaaaggangtgaactgctggacgaaattttggctagaggtgggaaatattctgagggcgatgctaaagttattattcaccaaattctaagtgttgcttcattttgtcatcttcaaggtgttgttcaccgggatctgaaaccagagaattttcttttcatgtcaaaggatgagaattctgccttgaaagtcattgactttggtttgtctgactttgttaaaccagatgacagacttaatgacattgttggaagtgcatattatgttgctcctgaagttctccatcgatcttatggcacataggctgatatgtggagcattggagtaattgcatatantttgctttgtggaagccgccctttctgggcacgaactgagtcaggaattttt

SEQ ID NO: 60249 - DNA, 353 bp, Zea mays
  unsure at all n locations
  Clone ID: LIB3069-057-Q1-K1-D6
cccacgcgtccggtcacttgctctccctccaacaagctaattaangccgggccatccggcttctagctcgtttcattatgcatggctgangagaagcaccaccaccaccacctgttccaccacaagaaggacgaggagcatgccgcggccggcgggtacggcgagtccgccgagtacacggaggccacggtgacggaggtcgtgtccacgggcgagaacgagtacgacgagtacaagaaggaggagaagcagcacaagcacaagcagcacctcggcgaggccggcgccatcgccgccggcgccttcgcactctacgagaagcacgaggcgaagaatgacccggagcacgcgca

SEQ ID NO: 60250 - DNA, 308 bp, Zea mays
  unsure at all n locations
  Clone ID: LIB3069-057-Q1-K1-D8
gtcgtcgtccactccggcatctccgattctaccaccaccgccgtttcttggggcaccgtggtcttggtccgctgccacgacnnnaacggccggactgtgttccggaaggacggcgtcgtgactgaccgcatcggcaggttccgcgtgcacctcgcgcacgggccaagcagcggcggcatcagcagccaccagctccggtccgtcacgtcctgctcggtggcggtgcacctcccgcaggcgtctccgccgtgcgtcgccaccgccagctccgctcgcgggctccacctcgtcggccaccacaacaagca

SEQ ID NO: 60251 - DNA, 355 bp, Zea mays
  Clone ID: LIB3069-056-Q1-K1-G2
cccacgcgtgcgacccaatctcccctacaccagaaaaattcccagttctttggtccgcgtgagagagtctgttgcgatgtctgggcgcggcaagggcggcaagggtctgggcaagggcggcgcgaagcgccaccggaaggtgctccgcgacaacatccagggcatcaccaagccggctatccggaagctggctaggaagggtggcgtgaagcgcatctcggggctcatctacgaggagacccgctgcgtgctcaagatctttctcgagaacgtcatccgcgacgccgtcacctacaccgagcacgctcgccgcaagaccgtgaccgccatggacgtcgtctacgcgctcaagcgc

SEQ ID NO: 60252 - DNA, 165 bp, Zea mays
  Clone ID: LIB3069-056-Q1-K1-G3
cccacgcgtccggatactgtgatgttgcttcttcaaatgagtatttattcgtttggaacacctggagaatgtgggtttgtcaattatcagcccatgaagaatatttggaccaccgtggggtgttgtcctgagcatggctccttgttttgaaacatacaaagcaat

SEQ ID NO: 60253 - DNA, 327 bp, Zea mays
  Clone ID: LIB3069-056-Q1-K1-G4
ccaagacttctggacccaatactatgagcttatcaaccttggaatcctcgccaaattgaggcaggtgcttgaatgtgtgcctcatgctgtggacttgagaaaggtgtggagcacgttgaggctcatggttggagctaataacggtaggatatgggcatctctaacttccgtgtcacttggtggacagactttcaggcgagttgctgttggactgattagctcgaccatctagcagcatcaagagaacgtgctgattcattgaatcgctcctgttactgctgtaactcacattgctcatgttaaggctgtaactcacatgagcatatt

SEQ ID NO: 60254 - DNA, 387 bp, Zea mays
  Clone ID: LIB3069-056-Q1-K1-G5
attttgtttcgtacgtaaatgaatggtgcaaagatggggctgcgcttatcgggggctgctgcaggacaactccaaacactatcagggccatacacagaactcttaaccaaggctgccacaagcatcagttacctgtaggctgtagcatagatctgtgctccactcctgatgctctcctcccagcagtaccttgagctgtatccccgagattccttaaccagcgcgaaccaatatactgttgcgtgttctcctgcaaatgagatgttctgcacctatgtttgtaatgttgtatttctgggtttttaagctatccaacttggagatacaaccggtgaagaagcagcaacaataggtagttctacttctgagtgaagaaaaacaacttgc

SEQ ID NO: 60255 - DNA, 374 bp, Zea mays
  Clone ID: LIB3069-056-Q1-K1-G6
cgccaagcggtgaagcagcatcggccatggtaggagaccaagccagcgccagagggcgatgggccgctgcgccagggccgcgctcctcctcgcctccctccgccggccacgcgcgccgacgccgacacaggatcgccgccggacctcctactctccctcctcggccgccgcagcggagctcgcgcggctccggtccgaggggctcctccgcagcgccgagatcgcagcggcgcggcgcgaggccgctgcccacgcgcgggtcgccggctccgagctgctcctcgtacttgccgtggcgcccgccgtactactgctcctcctgctcgggcttctctaagccagcggcggcgtgtgtagcgcggtggctggagtct

SEQ ID NO: 60256 - DNA, 457 bp, Zea mays
  Clone ID: LIB3069-056-Q1-K1-G9
cttcctcctccactccactcccaagtccccttctacccccaaccccgtctctccactgcggcggaggcttcgcttcggctccgctcggctcgagcagaaaaaaatgcaacgggcagtgcaagccgtcaggtcacacggcaatgttcttaaatatgctgttctacaacacatcagcgctcccaagccagcaatgcttcctgctgccttttctcgtttcatgtcagtttcatctgctcgcctagaggatcgtggatttgaaactgccactgtagcagatgtcttgaagtctaaagggaagagtgctgatggatcttggctctggtgcaccacagaggatagcgtctatgacgctgtcaaatctatgactcagcacaacgtgggagctttggtggttgtcaaacctggacagaataaatcaatcgctggcattgtcactgagagagattatctccggaaa

SEQ ID NO: 60257 - DNA, 129 bp, Zea mays
  Clone ID: LIB3069-056-Q1-K1-H1
accacgcttatgtcaacgcaaacaagtactctcattctatacccttactgacatttctgagcatggaatattcctgtttcggtctgcggctcaccgtgcctacattacatcaaagaagcccatacctaa

SEQ ID NO: 60258 - DNA, 344 bp, Zea mays
  Clone ID: LIB3069-056-Q1-K1-H10
ctcgctaccggcaggccacccccatacggctagtcgttcgtctcctcctcaaccgcaggtcggcagcgcccgagctctgcgtgcgatggactactcgggcaccaaggagtcgcctccctccggggcttggtggtcgagggagacggtggccgtcgtgaccggcgcgaaccgcggcatcggccacgcgctcgccgcgcgcctggccgagcacggcctcaccgtggtgctcaccgcgcgggacggcgagcgcggggaggccgccgcggccccgctcctggcgcgcgggctcgccgtcgtcttccgcaggctcgacgtctccgacgccgcctccgtcgccgagttcg

SEQ ID NO: 60259 - DNA, 463 bp, Zea mays
  unsure at all n locations
  Clone ID: LIB3069-056-Q1-K1-H11
cggacgcgtgggcggacgcgtgggcggacgcgtgggggcgcaggcttgagcgagaggtgcgggctggacaccaccgcatgctagggaggcagggaggggagccgagccgaggacgatggcgctgggcgtgttgttccacggcgcgcagctagcgctggatctggcggtggccgggatgtcgctggcggtggcgctcgggttcttcgccctcatcactaccttgctctgctccgcggcgttcctccaccactccaagcccgccgcgtagtcatagcctncacagcgaccaacgcgtctcaatctctggggatcgtaatactggtgctggtataattcctccacatcaattgcagaggaggtgctttaatcaactgctttatagcacttacagatgcaaagagtagtcgattgcacacatcaggtgatagctataggctcttggaccacgtgtatggttctttat

SEQ ID NO: 60260 - DNA, 231 bp, Zea mays
  Clone ID: LIB3069-056-Q1-K1-H12
aaaaaaaaaaaaaaaaataaaaaaattattttctaaagacacaaactaaaaaaaaaaacggcgggctgatttcaaacttcctgctattcacaacctttttactgcgccaacccaactactattactctccacctattttcactcttcgcgcaggtagctctctatctttccccagccaaaatgccgatgccactcactctcataatcttacccctcatcactaccttgctc

SEQ ID NO: 60261 - DNA, 431 bp, Zea mays
  unsure at all n locations
  Clone ID: LIB3069-056-Q1-K1-H2
cggacgcgtgggacacggcgctgcagggtaaagatctcccccgctcgccggtctctctgcgcaggccagcaggacgaagaagaagccggccgggaagacccaggcctgaccgcctgagctaggggagaggaggacgacgatggggctgctgtctcagcgggtggagcggtcggagatggagcccggcgaccacatctacacctggcgcgccggctacacctactcccaccacgggatttacgtcggcggcagcaaggtggtgcacttcacgcggaagagggaggcgggcggcgcgggtctggactcggccatcgccgtgtccagcctnctnctctcgcggggctcggacgagtgccccagcttcccggactgcggcttccagctccccgacagcggcgtggtgctgacctgcgtggactgctttctcggcg

SEQ ID NO: 60262 - DNA, 385 bp, Zea mays
  Clone ID: LIB3069-056-Q1-K1-H3
cggacgcgtgggccgcagttcccccgcgccttagacgcaaccccgcgccaggagtaagtgggttcgtttatcgatattatcgatatggcgagggaggagaatgtctacatggccaagctggctgagcaggccgaaaggtatgaagagatggttgagtatatggagaaggtggctaatactgtagatgtggaagagctcactgttgaggagcgtaacctcttgtcggtcgcatacaagaatgtgattggggctcgccgtgcttcatggcgcattgtctcttctattgaacagaacgaagagtcccgtaagaacgaagagcatgtgaaccttatcaaagaataccgtgcgaagatcgaggctgaactgagcaatatctgtgatggca

SEQ ID NO: 60263 - DNA, 309 bp, Zea mays
  Clone ID: LIB3069-056-Q1-K1-H4
cattcacaatgcacgaattgaacgacaacttgattctcatattgttgatatcaaagctaggggtggctaattgaaataatcaccatggactgttcatgtagatactgcatccgctgctagtacaatattatatacttttacagttaaccgtgtaatttcttggaaattatcaaattcaatacttgtataaaggctctaagataaagcaagttcttctagtgatggattctatgagtccatataagaatggcccgccagaatacactttctgctagctttctaatgttcaactgaaagattgtacatagt

SEQ ID NO: 60264 - DNA, 424 bp, Zea mays
  Clone ID: LIB3069-056-Q1-K1-H5
cccacgcgtccgacacacataattaaaagctcagaacctgcattcagtgttttggtgtcaaggttcttccttggggagacgtttccaattccagtatatctttctcttcttccaatcattggtggttgtgctctagctgctgtcacagagctgaactttaatatggttggatttatgggtgccatgatatccaaccttgcatttggtttccgcaacatcttctcgaaaaagggcatgaaagggaaagccgtcagtggcatgaattactacgcttgcctgtcaattatgtccctggtcatactgacttcctttgctatagctatggaagccctcaaatgtgggctgctggttggcaaaagctcttgcagaagttggacccaatgctgtctggtggattgctgcacagagcgtgttctaccactta

SEQ ID NO: 60265 - DNA, 456 bp, Zea mays
  Clone ID: LIB3069-056-Q1-K1-G11
cggacgcgtgggcggacgcgtgggtttccatgcaggcaggtcggcgaggagggcagggagacggaagaccgagccgtgcgggggctcgtgacgggaactggacaggacctcaaaatctcagatccttcctgccctgccgcccgtgcacgtcgacgcgttattcttgccggccgggccccaccttacgcctctcctccttcagggggatcggatacgccacaggctgcacgatggtgctgtgggtcattggctacggctccctcatctggaaccccggcttcgacttcgacgacaaaattctcggcttcatcaagggctacaagcgcacctttaatctcgcttgcattgaccacagaggcacaccggagcatccggcgaggacctgcacgcttgaaaccgacgactaggccatatgctggggaattgcatattgtgtcaagggtggtccagaaaaag

SEQ ID NO: 60266 - DNA, 237 bp, Zea mays
  Clone ID: LIB3069-032-Q1-K1-C12
cccacgcgtccgcccacgcgtccgctttttctccactccgattttgcttggttccatcgggccggagagggagaagctagctagctagcagcagctctgttggtgtgtgtgtgtgtgtgtgtgtggagggtagctgaagctggtgctcgctggaatggtcaggagccatggtgaggggccgggtggagctgatgcggttcgagaacaacatctaccgccaggttaccttacacaagc

SEQ ID NO: 60267 - DNA, 314 bp, Zea mays
  Clone ID: LIB3069-032-Q1-K1-C2
tttggacatttgttattcaattcttatcgttctgacttgcacgtttacatctgtaggctatgcttttgtctactttgaggatgaacgtgatggcaatgatgccatacgggctcttgatggttatccatttggccctggcagacgcaggctttcagtagagtggtcacggggtgatcaagctggtagacgtgatggcaacaaaccagaagcaaatactaagccaacaaggacactgtttgtcattaactttgatccaatgaacacaagagtcagtgacatcgaaaggcacttcacaccatttgggaacatatcaa

SEQ ID NO: 60268 - DNA, 462 bp, Zea mays
  Clone ID: LIB3069-032-Q1-K1-C3
tcggacctacaactacatcagcagctcctacttattctaataggatgtaccctagcccccgaccgtacacccagtatgggaattcagtaaaaactggtcttccctacgggagtaacggttatgattccaggatatatggtcgatgtggtcttggtaatggtatggataacaggtacaggcccagggcatgtagtggatactatggttatggcaatgagagtcaggatggaacaattgagttaaacagaggtcctagatctggccggttcaagaaccagaaattgtacggtcatactgtcactattgctgcgaaagggcagtctctcccttctagtgaaagcaagaatgatagtgctgtgcctgatagagcaaagtacaatagagatgacttccctgttcagtacgatgctgcaaagttctttgtcattaaatcgtacagcgaggatgacatccacaagagcg

SEQ ID NO: 60269 - DNA, 318 bp, Zea mays
  Clone ID: LIB3069-032-Q1-K1-C4
cccacgcgtccgcccacgcgtccgcccactcgttcgaccacgcgtacgcccacgcgtgcgctcttattcacctcactaacaccagctagcaactctttctctactgcaataatggccgctcgctcctcctactcccagccgcagctggtcgcggcggcggcggtcctggcagcggcgctgctgctgctggcggcggcggccgggacggcgtcggcggcggtgagctgccgcgaggtgacgtcgtcggtggcgccgtgcctcgggtacgcgatgggcagcgcggcgtcgccctccgcggcgtgctgcagcgaggtgcgc

SEQ ID NO: 60270 - DNA, 453 bp, Zea mays
  Clone ID: LIB3069-032-Q1-K1-C5
ccgacgcgtccgtcttgatccagttctgtcagggatcgccatgtcggactcggaggaggaccacttcgaatcgaaggccgactccggagcgtccaagacctacccgcagcaggctggcaccgtccgtaagaacggcttcatcgtcatcaagaaccggccctgcaaggttgtggaggtttctacctcaaagactggtaagcatggccatgccaaatgccactttgttgccatagacatattcaacgggaaaaagctcgaagatattgttccttcgtcacacaactgtgatattccgcatgtgaaccgtactgagtaccagctgattgatatatcagaggatggatttgtgagccttcttacttcagatggcaacactaaggatgatcttagactcccaactgatgagactcttgtggcccagatcaaggaagggttcgaaagcggcaaggatct

SEQ ID NO: 60271 - DNA, 401 bp, Zea mays
  Clone ID: LIB3069-032-Q1-K1-C6
cccacgcgtgcgctcacgagcgattgctttagccgaagtaagacgcgatggggcactacaacgtgtggaactcgtacccgaagaactacgggcccggatcccgcgtctgccgggtctgtgcgaaccctaatggactgatcatgaagtactggctgatgtgctgcaggcagtgcttccgcagcatcgcctaggacattggcttcatcaagtaccggtgaagtcagctgggctggctatctgaatgccatctcttggacagtgtaccacaggcgatgccacagttataattactgtcatttagatgctcccttcagaactctgctattgaagtccgtcatgttcgtgatggataactgaagctctgattgttatactgatgatgagttacctgtgctttggct

SEQ ID NO: 60272 - DNA, 452 bp, Zea mays
  unsure at all n locations
  Clone ID: LIB3069-032-Q1-K1-C7
gcaaggagatttttcttttatccagctttttagcatgattctctttgatcccggagagcagccaccggtccaactagtccttgctgttggtctgccggaacttttgattgctctccagatctgaggcacctgctgggtggattccaggaacccgagcacgaagttgacaggtgagttctcagggaaaaaggggaggaaggaagaggctgaaagggcggtggagagagaaagactataagggcgagctgagtcccttgaggatgccgtcaagaaaccgcgtggagaggagggcgatgagatgagggatgctggccgcggtgatggactacttcagctcctgctggggcccgcgatcgggcgccgggcaccggtgcaagggctccgacgccgtcggccggcaggacggtctnctctggtacaaggacgcccgccaggtcgtcactggggagttc

SEQ ID NO: 60273 - DNA, 429 bp, Zea mays
  unsure at all n locations
  Clone ID: LIB3069-032-Q1-K1-C8
caagcagatctaagctccaggcagcgtctcgacagagtgagtgagtagcacgacaacaacaatggcttccctgaaggccgcgaagcccagcggagttgcggcgcagggcaaggagccggcgcccaagctcagcgagacggcgacgaagccgtcagccgcgaagagcggcggcgttaagaaggctgagcagaagccccgggaaaccaaaaggaaggtgaagagcagcaaaccggcggcggcggccaaaaagtgacgtacagtacagtacgtgtggagtgtaatggagcttcccatgcatgagtgaatccatgccatgttatgaatctagtccttcctttcttgtatcttccatgtgacgcggcgtgtgcgttccctcatgtgtgatgatgccagatgaatactacaaataagacgttgntgtgactgccc

SEQ ID NO: 60274 - DNA, 378 bp, Zea mays
  Clone ID: LIB3069-032-Q1-K1-C9
cgccgacctcttacacgcgcacttctacttgtcctgcccctacctgaagttcgcccacttcaccgcgaaccaggccatcctcgaggccttcgccggctgccgccgcgtccacgtcgtcgacttcggcatcaaacaggggatgcagtggccggctattctccaggccctcgcccttcgccctggcggccccccgtcgttccggctcaccggcgtcgggccgccgcagtccgaccagaccgacgccttgcagcaggtgggctggaaacttgcccagatcgcgcacaccattcgcgtggactttcagtaccgtggtctcgtcgcgggcacgctcggcgacctggagccgttcatgcttgcaccggacggcgatgacaccga

SEQ ID NO: 60275 - DNA, 285 bp, Zea mays
  unsure at all n locations
  Clone ID: LIB3069-032-Q1-K1-D1
gcagcagctatgtaccatggacccagatttagctggngagctgcgcgtgatgaaccatgagctgcagcatcaaacgattgattggagcagcaactgttctgcaacatggaccttgacttatcaagtgaagcctttgtgatgaaccatgaacttttgagaaaactatgtatggagcatcagcatatgtatacttgtgtgcctccaaaggtagaaccctacggcagaagaatgtcgtgtttgttactgagataaagcttcattaaccgtagattcgacagaatagct

SEQ ID NO: 60276 - DNA, 331 bp, Zea mays
  Clone ID: LIB3069-032-Q1-K1-D11
gaaaacagagagccagttaagcaatctctttggacattgaggtgctgatctgctaagtggcgtgctacagcatgtcacgtaaggtacacgacgacgacgacgacattgaacggagggacactagacgaagtgatcactagtgggtgcatgatctacttctttattatgtgccagtctgatgcatgacacacacgtagctaggacatttctgctacgacgacgactgcatgctgctgatggccacgtacgctgccatccaacgagcgagctacctccactatgggtacatcgatcaattgatcttggtctacgtttactgtggcgccgatcc

SEQ ID NO: 60277 - DNA, 232 bp, Zea mays
  Clone ID: LIB3069-032-Q1-K1-D12
gaaaacagagagccattaaagcattcactacgacattgaggtgctgctctgctagcgggcgtgctacagcatgtcacgtaaggtacacgacgacgacgacgacattgaacggagggacactagaccaagcagatcactagtgcatgcatgatccactacttgattatgggccagtccgatgcatgacacacacctagctaggacatctatggtactacgacaactgcatgct

SEQ ID NO: 60278 - DNA, 317 bp, Zea mays
  Clone ID: LIB3069-032-Q1-K1-D2
agcatcccgtggagagaaggcggcggctgttcctgtgggagatgtcaatcctgtgggagaagagcgcgggttggcgatggctggttcggcggactcgtgactcgaagcccttctgtttcacgttcgcggcgctgtgcggcgtagtacccggcgtaatcggctactgcgtgatgcagcttaccggcttccgcaacgagcagctcgaggcccaccttcgcttcacggtccgtaccgagaccacgatgattgggctagtgaacagggagaggctggcggagtttcttggctagctgcaacggaaagaggacacgaacgac

SEQ ID NO: 60279 - DNA, 440 bp, Zea mays
  Clone ID: LIB3069-032-Q1-K1-D3
tcgacgaagcctaaggaagctgagaaaccatcagattatagaggaggctccaaagcctaagccaaagaatccccttgatttgcttcctccgagcaagttgattcttgacgattggaagaggctgtattctaacacgaaaaccaacttccgtgaggttgctattaaaggtttctgggacatgtatgacccatagggctactccctgtggttctgtgactacaagtacaatgacgagaacacagtgtcgtttgtgactatgaacaaggttggtggcttcctgcagcggatggatctgtgccgcaaatacgcctttggcaagatgcttgcggttggctctgagccccctttcaaggtcaaggggctctggctcttccgtggccccgaaatccccaagtttgtcatggatgaggtctatgacatggagctctatgagtggacca

SEQ ID NO: 60280 - DNA, 365 bp, Zea mays
  Clone ID: LIB3069-032-Q1-K1-D4
tcgcccacgcgttcgcccacgcgtccgggcttctcctccccctccggttcgggttcgggttcgtgaggttctccggggttcggtttcgtgggtgagcggatcgagatggcggcgtcagatgttgagtaccgctgcttcgtcggcggcctcgcctgggccacggacgaccactccctacacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccaatcccg

SEQ ID NO: 60281 - DNA, 428 bp, Zea mays
  Clone ID: LIB3069-032-Q1-K1-D5
gttaatcagtgccacctagtcgccgtcatgataacagtatttccaccttgtgcatctatgaacaggattctgttaacttggctaaggtggagtcttggcttgaagatcttctttgggaaaagaaatctattatggacatatatcgctgtaaagggattttatatatccatgattcagaccaagttcatacattacaggcagtgagggaggtctatgaagttgtgccggctcgaaaatggtctgagacagagtctcgcatgaacaagatagttgtcataggccgcaatctggatatcaatgtacttcaagattcttttagtggttgcaagagctgataatgagtatctgtttgccttgcacaatgttagttggccatttttctgtgaagtacctctgtgcaagtgaatactgaaatggacgagaatctt

SEQ ID NO: 60282 - DNA, 354 bp, Zea mays
  Clone ID: LIB3069-032-Q1-K1-D6
gttcacttctccaggttaggaaagggtttgtactcatggcgccgacgcagccaaagtcgggcctcttcgttggcatcaacaagggtcatgtcgtcaccaagcgcgagctgcctccccgcccgtgccaccgcaaggggaaatcaacgaagagggtgtctatggtcaggggcctgatcagagaggttgctgggtttgctccttatgagaagcgtatcactgagcttctgaaggttggcaaggacaagcgtgccctgaagcttgctcagagaaagcttggaactcacaagagggcatagaagaagagagaggagatggcggacgtcctaagaagatgaagtcgactgttacgcacac

SEQ ID NO: 60283 - DNA, 419 bp, Zea mays
  Clone ID: LIB3069-032-Q1-K1-C11
tttcatcctgcgagagacaagcccctcattaacccttgtcatcctgatcctgagatccgtctcctttaccccactggctggcgagcagcaaactccaggtgcagagcggacaagttcctcacgagcggttaattctacctagatgatgcgggatatggagcaaaactgggattcttgcctgctttccgtggtgtgagataccatataaaccaatggggcaataatcccgtacagaacgagacagagttggttaatctaaggcactcatctcttcgtgtcacagttgagcgtgcattcgggtcactgaagagaagattcaagattttagatgatgcatctgctttcttgcattttacaacacaagtcgattttgctggtgcttggtgtatcattcataattgggtcatacaagatgggag

SEQ ID NO: 60284 - DNA, 239 bp, Zea mays
  Clone ID: LIB3069-032-Q1-K1-A6
ctcacgcgtccgggcacgcgtgcttgttttgataacgcttatccatgatcatgcgtcacatgtgctctactatgagccatgactggttagcagctacatagagtatatacatactagtgacgtcatttagtgagcgacgtgatgattacagtcgtattatgctataaatccactatatcaccatggcaggatgagtgtgctaatgtataactacccatcatgggccagtcggtatatat

SEQ ID NO: 60285 - DNA, 452 bp, Zea mays
  Clone ID: LIB3069-032-Q1-K1-A8
cggacgcgtgggcccgatcaccggtcgcctcccttccgctcccctgcctgcctaatccctccggccaccccgaaaccgctcgctcgctcgctcgctccccgcgcccagagacaagcccggagaccatggcggaccagctcactgacgaccaaatcgccgagttcaaggaggccttcagcctcttcgataaggacggcgacggttgcatcacaaccaaggagcttggaactgtcatgcgttcactgggtcagaacccaacggaggctgaactccaggacatgatcaatgaggtggatgccgacggcaatggcacgatcgacttccccgagctcctcaacctgatggcccgcatgatgaaggacaccgactccgaggaggagctcaaggaggcgttcagggtgttcgacatggaccagaacggcttcatctctgacgcggagctcccgcacgtg

SEQ ID NO: 60286 - DNA, 286 bp, Zea mays
  Clone ID: LIB3069-032-Q1-K1-A9
attatgtgcttaattgccaatcactatgcttcgactacggctgcttggaatccctaggctttctccgtccaagcctatgaggtgctccagctggacaaaccctagacgcctacggcgtcatggcgagcagtaacgactcacaacgacacatttcacgtatcgacgacgtcatctacaaagttcgagaggattgaatcacctacggaatctggaacgccaggctaaacgaggtccaagctcattgggagatgaaaaaggctcaatgtggcccaaacattgggaacat

SEQ ID NO: 60287 - DNA, 396 bp, Zea mays
  Clone ID: LIB3069-032-Q1-K1-B1
gtctcgattcccgatcgaccacgcgtccgggacgcgtggctcgacatgattaaccgtttattcttccaactgacggatcagaaatgggtcgacacgtacgccaacatcatcgatctcaatcaggatgttaactgaatacggcaccagatcgagagcgagctgtagctacaagatctccagagaatagaggacatgccatcgacacatgttaaccgtatgatagcaatggaccctgatggtggtacccgacatcgacacaagatactgcaggtacatacacttcaacaagaagcatgcaggctagaaccacgtacacagcgcgcatggtgaatacatgttcatggactgatgatgtcatgttgatttcaattgcgctgaaaacgttacctactacga

SEQ ID NO: 60288 - DNA, 328 bp, Zea mays
  Clone ID: LIB3069-032-Q1-K1-B10
cccacgcgtccggttccctgataccgactaggtacctttggaactgaaagtaggcagagtgatcttattcatgaacggtatctgctgttgatgaatgtcaagcttcattgtaaatgtcattgatgatcacaacagtggactatttgacccgtcgctagatgggctgtcaggtagtctcatacgcaacgcggtgagatcacttggatccgttagaagaccgccgagcacacaatgaccgtcatcacacagacccattaacggatcatgtagatctaatgtcgacagaccacacagacacatcatcgttagctcttataattataggaat

SEQ ID NO: 60289 - DNA, 365 bp, Zea mays
  Clone ID: LIB3069-032-Q1-K1-B11
cgtacgttgctcgattcttggagaaaaggttggaaagggtgacaactgcggcgccgtacccatcagctaagagcccactggagagcagcgacacgttcggcagcgggagcgccaacgccaacgacaagtcctcgtgcacagacattgccctctccagcaaccatgaagagtccctgtgtttaggggggcagcccaggagcatcatcagcttcagcgaagagtcccccagcacgaagctacagatctgatcgtgcccagtgttcatagatttgtccaggctgaccgatgcagaaaaccataagaatacttttttccactcaagaggaagagattactatcgatgcccgtgttgtttaccgtgatgt

SEQ ID NO: 60290 - DNA, 372 bp, Zea mays
  Clone ID: LIB3069-032-Q1-K1-B12
cccacgcgtccgcccacgcgtccgcccactcgtccgcggacgcgtgggtttttttttgaaacggtaaaaagacacggttaaccgtttaatacataacttgaatacatatttgtttgttagtcacatcgtagctacgtggcgcaacctgcgactttatatgatacagcactcgcccattattgaattttgcagaagcgaactctgtagaccacgcaaagaacagtcgtggtcagtaacaatcgtcgtctgttggtacactggccaaaaaccgcgagcatgatgctgcagcatgtagtgtttaactagtcctgcttaagtgcttattctttaattaggcatatcactatgtccatgctcggcccatgcttgggc

SEQ ID NO: 60291 - DNA, 457 bp, Zea mays
  unsure at all n locations
  Clone ID: LIB3069-032-Q1-K1-B2
cccacgcgttcgcaactgtcagtgaagatgatgtgctgcatcgcctgttgaaggtggatgtccaggtctcttctagagacccctgctgtattgaagttgctcttcgctgcttagcagcagaaggtgatggatatgggcttcatgaagccaacgatggaggtcttcttgctgcagtcatggctgctggctttaaaggtgaactcagtcggttccaacctggagtttcgatggcaatttcacggcttgatgcttggtattctgaccggagtggttccgtggagagcaccgctgcttacataattcgagggctgtgtcggaggtgctgccttcctgaaacaattctaagatctatgcaggcatgtatcgcactctccgcggctggtgatgatctagattactctctagataaatgtgacgaactngttgagttaggtgcgtcagccgagtctggaatgat

SEQ ID NO: 60292 - DNA, 427 bp, Zea mays
  Clone ID: LIB3069-032-Q1-K1-B3
cggacgcgtgggcgaaaaacctgctctactgtcttatctaggcgcccctactcggctccgatccagtttcgccggcggccatgtcgcagccggcggcgactgtggccgcggcggcgcagccgcagggtcgcggccccgcggggcgccagggcggcctggggcagagcatcgcaggcatcgtgcggatggcggtgttctggtactttgcgtccaagttcttcgggcccaagcgcccacccgcggaccccgggatgctcatgtgcaacctcttccagaagggcgagccaatggatatgtggatgtatttgtcagagaacgagaagttcaacgattttgctaatgaggatgcacttatttggcacgaggcaaacataccatatgcagtctggggacctaccagtactagatcacggtcattaacatacta

SEQ ID NO: 60293 - DNA, 386 bp, Zea mays
  Clone ID: LIB3069-032-Q1-K1-B4
ggacagatatcgacagggatgcatataactaagctgaggagttattattattgtccctaaatgaatgggccgcgactttagttgcatcatcttcacttcattctatttgggttgaagttttaggcgacccactcctaagaaggttacttctcaggttcatcttctgccgagcaactcattccctgttcaaaccaacaaaccataagacagagttcctgccgacctgcatgcctcctttgcctgagtctgttgatgcagagagcatgctctcccaaagctgtgtgctgcgagtcgcatcattctttggcgctgccagtcagttctcatttgctgaggttaccacatggcctgatgttgaccctgaggaggctgttgtcaccagttct

SEQ ID NO: 60294 - DNA, 307 bp, Zea mays
  Clone ID: LIB3069-032-Q1-K1-B5
cggacgcgtgggctgacgcgtggtgtgttcgacgacccttggcaagaattcgtgagcacggtcgtctgcataaagatcctctccccgcaggaagtgcagcacaaggcgaagcagggcctggagctcctgagctcggcccccacgcggacgctcaggagcagctgtgactactacgtaaggacgcaggagtccataaggctggcctccgggatcacatcacggacatcagcaccggcgagcacgagcacacgatggcgagcacgcagcaacgacagacgccagttacacatactcaaacataaagcac

SEQ ID NO: 60295 - DNA, 404 bp, Zea mays
  Clone ID: LIB3069-032-Q1-K1-B6
cccacgcgttcgcaaaggttgatgggaagtttcagttcagtcccatcagtgttaactttctgacggaggttatgaaagtcatctttgctgtcgtcatgctcataattcagtctagaaagcaaaaggttggagaaaagccacttttggcacgttcaaccttcatacaggcagcccgtaataatgtacttctagctgatcctgctcttctatatgcaatcaacaattacctaaaattcatcatgcagttgtacttcaatcctgcaactgtgaaaatgctaagtaacctaaaggtactggttatagctattcttctgaaatttataatgagaaggagattctcagctattcagtgggaagctcttgctctattgcttattggaatcagcatcaatcaactccgaact

SEQ ID NO: 60296 - DNA, 460 bp, Zea mays
  unsure at all n locations
  Clone ID: LIB3069-032-Q1-K1-B7
caccgaccgcggatatggccccgtcgccttggcctctccttgcgacttccctcctcctcatcctattccaccactcgcctcgcgccgcggcggcgtttccgccgtctcttggcgacggcctcctgggcgccgaccgcgcgccgggtttcgcggcgtggctgctcggcttgcggcgccgcatccacgagcgccccgagctcgccttccaggagcaccgcaccagcgagctcgtccgcgacgagctcgacgcgatcggggtgccgtacgcgtggcccgtcgcgcagacgggcgtcgtggcgaccatcgccggcggcagcgatggccccgtcgtcgagctccgagccgacatggacgcgctacccttgcaggaattggtagactgagaacacangagcatggagaatgggaagatgcatgcttgtggacatgatgctcacacaacgatgcttgttggggcagc

SEQ ID NO: 60297 - DNA, 424 bp, Zea mays
  Clone ID: LIB3069-032-Q1-K1-B8
cccacgcgtccgcccacgcgtccgtccacgcgtccgcggacgcgtgggcaacaattatggtcactaaggtggatgaaccatcaaaatacggtgttgtggttatggaggaggcaactggcagggtggaaaggtttgttgagaagccaaaaatatttgtgggtaacaagatcaatgctgggatttacttactgaacccatctgtccttgaccgcattgagctgaagccaacatcaattgagaaagaggtcttccctcaaattgcagctgatcaacagctctatgcaatggtccttccaggtttttggatggatgttggtcagcctagggactacattactggcttgcgtctttatctagactcgattaggaagaaatcagctgccaagctagctactggagcacatgttgttgggcatgtgctggt

SEQ ID NO: 60298 - DNA, 399 bp, Zea mays
  Clone ID: LIB3069-032-Q1-K1-B9
cggacgcgtgggtgaagacacacacggttttttcctactagctcgaccttagttcctgcgagtcctttggttgtacgatgccttctactgattcatgtctcgttcggttatgtgtgtcatcactcgtcatggcgtcggtgaagcggcttcgggtgacagggaaggacaagatcgtgcggtggtgcgccgggaagcaacacttgctcgccaagaagaacaccaggcgcaagaagagactctccaagatggcctatcgttggaaatgaagggacacgtcggtcctctgtccaacgagaatagcacttgtcttatgctaatattgccgctggacaaacgaactctgtgcttttgtgtgaaagcaatactagctaatagactgttcggatttctaatgaacca

SEQ ID NO: 60299 - DNA, 353 bp, Zea mays
  Clone ID: LIB3069-032-Q1-K1-C1
cccacgcgttcgcccacgcgtccggacatggccttaccaacctttccacaaggttcatccggtttacctccttagtaagggtcaatggcaaggagacatctaatggcaatctttctactaagaactcgtcgagaaagacatcttgcacagccgaggagaaaccacaatgcaatgggagcttaaatggtggtggcggctctgccgatgagaagtcaactgtaggtatggagcaacacaatggtgttcagaagaatgttggcagtagcaaggtccagccacatggacatgcaactgaatagagtgggacttatagtacatagacaacagaaaactgaagagacgaggagttgaat

SEQ ID NO: 60300 - DNA, 294 bp, Zea mays
  Clone ID: LIB3069-032-Q1-K1-C10
catgcgtgcaggaagatccgtgaggccaggggtgattgttactcggggtttacctgtgcctgctagcagccggtaccttgtgcgtatgcacttatgtgacattgctagcaaggctctgtatgagctctacttcaatatctacgtcaatggtgatcttgcagtctaggatttcgatctctccagtgcaactggattcttggcctatccttattacattgactttatcgtcgatgtgaaggatgaggggatactgaaattggcgattggtggcttaaaagaagagtcgatctgatg

SEQ ID NO: 60301 - DNA, 296 bp, Zea mays
  Clone ID: LIB3069-032-Q1-K1-A5
ctccaccagggaggctactgcggtggcattgtggcctggggtagaggagctgttgcagcggttgcgctacttcaacctgactgtggcaatctgctatgcaaagggcatgccaactaatgaggtgctctactcatctacattattattacatgcctctaaaggtgtatcttcagaagttcacatcgaccgtatttgcttactctagccatacttacccatcatggtccatggggcgtgtatattatcatgccatcttcaaagaatggcatcaatgctacaaaaatgaatgagaaatc

SEQ ID NO: 60302 - DNA, 370 bp, Zea mays
  unsure at all n locations
  Clone ID: LIB3069-031-Q1-K1-G5
cggacgcgtgggcggacgcgtgggaagaacactgtatgaccaagatgtcctagctgaagatactatagtcctttggttccgtaaaggttcaaacccgaagggcaggcaatcttttgtgaaagctctggagccgtttgtcaaatggctcgaggaggctgangaggaagaataagctcttgatttggagattggccgaatgtgacgaattatggttctcgaaaatattaccttttcttatttcgaaagctatgaaaggttgaggagttatggttgctgctagttattgccgagtttgttactggcgatagatttatgttatgctngttangcacttggctctcagctgcagtatgttgctgttaaggtgttg

SEQ ID NO: 60303 - DNA, 320 bp, Zea mays
  Clone ID: LIB3069-031-Q1-K1-G6
cggacgcgtgggcggacgcgtgggcagattcctggacgaacatcatcgtctaggtgatgatactctcaccctcaggactcgtggttgataaaaaccgaagggcaagcaatacttttgtgaaagctctggagccgtttgtcaaatggctcgaggaggctgaggaggaagaataagctcttgatttggagattggccgaatgtgacgaattatggttctcgaaaatattaccttttcttatttcgaaagctatgaaaggttgaggagttatagttgctgctagttattgccgagtttgttactggcgatagatttatgttat

SEQ ID NO: 60304 - DNA, 323 bp, Zea mays
  Clone ID: LIB3069-031-Q1-K1-G8
cccacgcgtccgcggacgcgtgggccagattaggaagatgaagggtttgaagcagaagaaggctcacctgatggagattcaggtcaatggtggtaccattgctgacaaggtggactacggctataaattttttgagaaagaggtccctgttgatgctgtcttccagaaggatgagatgattgacatcattggtgtgaccaaaggtaaaggttatgagggtgtggtcactcgttggggtgtcacccgcctttcccgcaaaacccacaggggtctccgcaaggttgcttggatcggtgcatggcatccggctagggtctcgtata

SEQ ID NO: 60305 - DNA, 379 bp, Zea mays
  Clone ID: LIB3069-031-Q1-K1-G9
cccacgcgtccgagactgaacagcagtccgagacgccatgaacgtggaggaggaggtcgggaggctcaaggaggagatccataggctcggccagcagcagcccgatggctcttacaaggtcaagtttggcgtcctcttcaacgacgaccggtgtgcaaatatctttgaagcactagttggcaccttgagggccgccaagaagaggaagatcttgacctacgaaggcgagctgcttctgcaaggtgtccatgacaacgtggagataaccctgttgcccccacctgcagttgctgccgcttgaaacgaagagcaccaccaagttctcgattccatacaactcggatgcttgtattctgccgtgcctatattagattctctc

SEQ ID NO: 60306 - DNA, 369 bp, Zea mays
  unsure at all n locations
  Clone ID: LIB3069-031-Q1-K1-H1
agaaactcgccatattcacagcccttgcattttctcagaagctatcagggcttcctcctgagactgtgttccagccattgctcaaggataatcttgttgccaaagggatagtactttcattcattactgagtttttcaaggagtaccttgaggaaaacagcttggatgatttgattgcacttttgaagaaaggcaaaatggaggacaatctgttggacttcttcccatcagctaagagatcttctgaggctttatctgagcatttcaccaaagaaggtctgactagccttgttgagtacaacgaanagaagatgtttgaggttaaacttaaggagataaagtcaacactgactgctatgataaatgatg

SEQ ID NO: 60307 - DNA, 231 bp, Zea mays
  Clone ID: LIB3069-031-Q1-K1-H11
tctagatcgcgagggccagcctttttttttactttaatctaacctcaactcctgaaccgagcagcctgtttttttgaacgaagaataacatggggatatattacgaccttttcatttgcaatacagtttacaattggacacacccctgcaaacacacacctttttcaaccaatggatttggcaccagaggggcccctagaccctctaaaaaacagggaggatcatggtttt

SEQ ID NO: 60308 - DNA, 168 bp, Zea mays
  Clone ID: LIB3069-031-Q1-K1-H12
acggcgacatgcagcagcggtcggccttttttttttttttctccttgcgggtttataggtgaagaccacaatctgagatatgaacgcagcactgctatgtaatattgtactgcactcagcagaatgttggaagaatacttttcattaccgactcgtttggatcattgg

SEQ ID NO: 60309 - DNA, 311 bp, Zea mays
  unsure at all n locations
  Clone ID: LIB3069-031-Q1-K1-H2
gcgccatcgaccgcgaggccgtgttcacgtacgcggaggacgcggccagcgccagcctgccggtgatgcagaagctgcgcgccgtgctggtggaccacgccctcagcagcggcgacgcggagcgggagccctccgtgttctccaagatcaccaggttcgaggaggagcttcgcgcggtgctgccccaggaggtggaggccgcccgcgtggcggtcgccgagggcaccgnccccgtggcgaaccggatcgcggacagccggtcgttcccgctgtaccgcttcgtgcgccaggagctcggctgcgtgttcctg

SEQ ID NO: 60310 - DNA, 374 bp, Zea mays
  Clone ID: LIB3069-031-Q1-K1-H3
cattgagatacctactgctcttttgcaggtccgcggatgtgtgtcgccctacatgtcgacgaatgtgcttcacaagatatcagaaagggatttgaatgctggtggatgtgggcgccagcaatggcggagatagacctgggttgctgggttctgacccggagagcattaaccggactggagtttcaaggtggcagcggttgccttcagctcctaagattagatatggtaactgtgctgtgcaacttctctggcaaattagtagtcacggagatctgaatgcaacttcctggattcattgaattgaaatactataattctgtggcaagttactccctttgcttttgcctttgaattgattagtttagagaaagata

SEQ ID NO: 60311 - DNA, 213 bp, Zea mays
  Clone ID: LIB3069-031-Q1-K1-H5
aaaaaaaaaaaaaaaaatcaaaaaatcattttttaaactacacaaaacttacttcggagaggctaattactaacaatggtaaaagaaaacaactactatcaaagggataaggtcaaagaatcattactgaactatttcaagagaagcacttctggaaaacacattgaattacttgattggacttttaaaaaaaggcttcccggttgatcaaac

SEQ ID NO: 60312 - DNA, 213 bp, Zea mays
  Clone ID: LIB3069-031-Q1-K1-H6
gccccaagtctcctctgcaaaagtcttgttcaacgcagggtcatcagtgatgatgatggtttctttcaaattgcccgatgtaacctgtcacagctcaatgccaatgtacttcaatctgtctaaggcgtaaatgtatggatcatccttaaaatctgggttgacaatcataggtgcctaccatttaccctggtagttaggactcttgattttctt

SEQ ID NO: 60313 - DNA, 309 bp, Zea mays
  Clone ID: LIB3069-031-Q1-K1-H7
cccacgcgtccgggggagcttcttatgctcagcaggctgcatatcctgcatatggaacgtatgactacagccatcaaatgccacagcctgctcctcaaacagctgcctatggcgcttatccttcaacatactctgttcaagcctatacacaacaaagctacacacaacctgcagcaattccggcagcaccagtgccagcagtggtaccagcacctacaccggcgtcagcttaccctcagcaacctggggcagcttcctaaccttattatggaacaacctactactgacaagtagagtaaatcttcgatg

SEQ ID NO: 60314 - DNA, 115 bp, Zea mays
  unsure at all n locations
  Clone ID: LIB3069-031-Q1-K1-H8
tcgcccacgcgtccgcggacgcgtgggccacaaggtcagtttgagcattggtttcaaaggtcattaaatatttatcctgagtgaaaattttcacaccagaagagtnatattcttt

SEQ ID NO: 60315 - DNA, 84 bp, Zea mays
  Clone ID: LIB3069-031-Q1-K1-H9
cgtacacaacccttagctacgctccagtgtctttaccggccggctgccctgatgccgagcacggcgtttgcagtggtggagctt

SEQ ID NO: 60316 - DNA, 378 bp, Zea mays
  Clone ID: LIB3069-032-Q1-K1-A1
atttgatatccatcaataaaatcgataaattatattatggtgcaccttatcttttattttactagaacacagtgcaacttctatatattcttatttgtaacttggatatgctgcaaaaataataaatattactagatccttgcaaagagaaggagaaataataaaatctagaaaagaataatacaagggagctttgaaatgaaatattatctatatacaaaccttctatggattgaaaagaccgtttaatctggtactggatttcattatatttgattcagctcctcagtgcaggtatgtactgacttcagtatcatgtttattttatgttctgaagtacaaatgcctttgtagggccataaatactttgcttttact

SEQ ID NO: 60317 - DNA, 345 bp, Zea mays
  Clone ID: LIB3069-032-Q1-K1-A10
ggcttttgaggcatatgctagtgctgcaatgcagattgatgagctctctgcattctattcatggtgtaaagatactggagttgcaaggtcatctgagtacccaaaggtgcaagcggtcactgataagctgctggagacgctagaagagttcatgagggaccgggcaaagaggcctaagaacccaccacgggagcctgaacctgagcctggtaaagaagaacctgagccggatattaaccagctcaaagcgcttacaggaccagaagattataaggagcctgaacctgtttaagtcgaagaagaggtgaagcccgaaccaaccccacagtcacaaggggacttggt

SEQ ID NO: 60318 - DNA, 387 bp, Zea mays
  Clone ID: LIB3069-032-Q1-K1-A11
caccgactgagcagtgggtgggggatatttagcggttcttgatcctgcaagaaagggggccatggcgcgagcggctagcatgccagcggcaactgcggtcgggatcgtggtcgtgatgcttctggccgtcggcttccccctcgcggaaggtaaatcgtgcacgaacgcgttgcctggattgacctcacacacggagcgcgctgaggctcatttgcaggcagcggcgccggctacggtgctccagcccatgattcaccgacaccgacatggtcacgagcaggaccttaccccgacggacgaatacacctggatgtagctcatgccacacccggcgcttcagttcgaggaggcgttcgactggcttatgctctaccgtgagctacgggg

SEQ ID NO: 60319 - DNA, 227 bp, Zea mays
  Clone ID: LIB3069-032-Q1-K1-A12
ggatacccgggccgacccactcgttcggactgactgagcagtgtttgggggatatttatcgggtcttgatcctgcaagaaaggggggccatgttcgagcggcaagcatgccaacggccactgcggtccggatcgtggtcctgatgcttcttgccgcccgctttccgctcacagaaggtaaatcgtgcacgaacgcgtatccggggattgaccttgcacacggagcgc

SEQ ID NO: 60320 - DNA, 231 bp, Zea mays
  Clone ID: LIB3069-031-Q1-K1-G4
gctgaatgctcagaagatcactcacaagttagtgaaacgaagataccagatgctggtcgtatgggagtaatatgtgcacacactcatggcaagctctattatgacgaattactgagcctgcgctctaatcaatcgaccgcaagacgctcagcctatgatgactcccttgcggcttgaccttacatatacctacagcccaatggacattcacgagggttgccactactctta

SEQ ID NO: 60321 - DNA, 456 bp, Zea mays
  Clone ID: LIB3069-032-Q1-K1-A2
catctcatgtacgacggtaaggacgacatcttgttcgagcacttcagcgcggtggcgcagaggctgggcgtctacaccgccaaagactacgccgacatcctcgagttcctggtccagaggtggaaagtcgcggagctcacagggctgtctggagaagggagaagggcgcaggactttgtctgtaccttggcgccgaggatcaggcggctggatgatagagctcaagcgagggctaagcaagcaccggttattcctttcagttgggtttatgaccgcaaggtgcagctttaatcaagaacgctaggcaatgtgggcatgtactacgtatatcattttcagtcctggggttctctataagaaacagtctctaggttatctagcatggtagaattcaactactcgtggatctcactcggtgcaaagtattgcaaagtacgctatcttggtgtaccgtgc

SEQ ID NO: 60322 - DNA, 337 bp, Zea mays
  Clone ID: LIB3069-032-Q1-K1-A3
acgcgtacgcttgaccacagacacgagcgaattgagtctatgcgcaactgtgccgtgcagccatggcgactagggtacggctcaccaccctactcctacacttactacttgttggcacccacttcaccagccgagtagctaaaactgattcctaggaaaatgctgatgcagctgaagttggtgaatgcgctgatctaggtattgaggctgatgatacacagagttccagcgacggacctttaagccctgctactggcgtacagacagtagtatgattccccaaacatgctggcaaaatagcactagcacgtgaagaaactgaattactagttggtct

SEQ ID NO: 60323 - DNA, 463 bp, Zea mays
  Clone ID: LIB3069-032-Q1-K1-A4
gttgccacgatatggtcttgaagttggtctgaccaactatgcagctgcctactgcactggccttctgttggctcgccgtgtgctcaagacccgtggtttagataaggaatatgagggcaatgttgaggccactggtgaggatttctctgttgagccagctgatgagaggaggcctttccgtgctctcttggatgttggccttattaggactacaactgggaaccgtgtctttggtgccctcaagggagctttggatggtggcctggatattcctcacagcgagaagaggtttgctggtttcaagaaggatgacaagcagctggatgctgatatccatcgcaagtacatctatggtggccatgttgctgactacatgaggaacctcgctgaagaggagccagagaagtaccagtctcacttcagtgagtacattaagaaggggaatgaagctgatgacatggaa

SEQ ID NO: 60324 - DNA, 452 bp, Zea mays
  unsure at all n locations
  Clone ID: LIB3069-056-Q1-K1-E3
gcaagtaccagaatagcacggacctgctcatccgcaagctgcccttccagcccctcttccgggagagcgcgcaggatttcaagaccgacctccgcttncagtcctccgctgtcgccgcgctgcangaggccgccgaggcctacctcgtggggctcttcgaggacaccaacctctgcgccatccacgccaagcgcgtcaccatcatgcccaaggacatccagctcgcgcgccgcatcaggggcgagagggcttgatctcccgttgttgtcgtccacgttgttgggcctttcctctgtgtctctgcttgtagaatccttgcttctgttcggttccttctgttcgcatgatggtgttcgtagtgttaggagttgcattttctaatctgcttgttcttgcaccggtgcctctgaagtggccgttccccctatcttaatggaaatggaatgtgcctt

SEQ ID NO: 60325 - DNA, 279 bp, Zea mays
  Clone ID: LIB3069-056-Q1-K1-E4
tactgtagagtgtgcccgaggcccgttcgtcggagctctagcgcccggcctcgcccgcccctggctgccgcgcccgcccccggccccaaccaccgtgcccgccggcgcgcgttccctcgaccgcgcttgccggagctcctgcccccggccctgcccgccgtgcccatataacctgccaaaaccgagcgaaccacatcctgtcaacgttggtggcaggcgatccaaggaaagcgatgacggcgtacgaccccaaagacgacgtcaaccgcctcttcgctt

SEQ ID NO: 60326 - DNA, 274 bp, Zea mays
  Clone ID: LIB3069-056-Q1-K1-E5
tccacatcggccaggccggtatccaggggggagacgcgtgctgggagctatactgctggacaatgaggccatctacgacatctgccgccgatcccttgacattgagcgcccaacctacaccaacctcaacaggcttgtgtcccaggtcatctcatcccttactgccttcctgaggttcgatggtgctctgaacgtggatgttaacgagttccagaccaacctggtaccctacccgaggatccacttcatgctttcttcgtacgctccagtcatc

SEQ ID NO: 60327 - DNA, 390 bp, Zea mays
  Clone ID: LIB3069-056-Q1-K1-E6
cgctccttccctccctctacccgtcgccgttgctgccatggacgaagtcgtcaggcggatgttggagaagcaagtgctgtctgccgcgaaggcggtggaggacaagctcgatgaggagatcgccgcgctcgaccgtctcgatccggacgatatcgaggcgctccgcgagcgccggatccagcagatgcgccgcgccgccgagcgccgcgccaagtggcgtgcgctggggcacggggagtacaccgaggtccccgagaaggagttcttctccatcgccaaagccagcgagcggctcgtctgccacttctaccgcgacaactggcccttgcaggtcgtggacaagcacctgtcggcttttggcaaacagcacgtggagacacggttcgtgaa

SEQ ID NO: 60328 - DNA, 296 bp, Zea mays
  Clone ID: LIB3069-056-Q1-K1-E7
gaacaatgtggaccctgtagtgcataatctattgctatctctatatgccatgaagggggaggaatcccagcttttgcaatttctcgacacaaaatttggtaaatgacaaacatatggccctgacttattttactatccaaagtatgctctgcgcctatgtcttcaatagaagagaatgcctgcttgtgttcgtatttatagcatgatgtccatgcatgcggaagctgtggcacttgctttgaaggtggatttggaacttgcaaaagcctaagcttgcaaagtaaaatactatgaac

SEQ ID NO: 60329 - DNA, 205 bp, Zea mays
  Clone ID: LIB3069-056-Q1-K1-E8
tcatttatcaaattagttaaagcattacatttcaatatttctatatcacatcttgggacaggtatattacctcttaccatctctcccctcccaatccatctctctactttaactatcaccttcactcaattcactacccaccatcttacatcttcctaactcttcaaaccctgacaataccctatctactcaccttatatcacat

SEQ ID NO: 60330 - DNA, 320 bp, Zea mays
  unsure at all n locations
  Clone ID: LIB3069-056-Q1-K1-E9
gacccgggcgtcccgtccaatcgggcatacggttaaaaggcactttaaattcacaaatggacctgatcgcaangtatgggcgcctcgacggtatgacatatttgcatctccggatgtattacataccttgtactcacatcatactcaaactcacgcacattgcgcatatattatataacaagttaccgctggttatggacaccgatccacagacacatggtgtcatggcggaacccacggtgttcctgccgaaaacgcacatatgcatgccaaccgctatgaaaccccatgtgatccataagaaaccaacatatctgcta

SEQ ID NO: 60331 - DNA, 372 bp, Zea mays
  Clone ID: LIB3069-056-Q1-K1-F1
gtccgactcctcttgacccgaacgctgtctgcgcgcgacgacctctggctgcagacgcgtgtgctgcaccagcgctctctcgcttacccgacccgagttgcccaacacgagactcgtcgctactggaccgcaccgacgttcgacggacggccccagtggggctgctgggctcttggccttgcgccgttcggcttgcctgtccgacgcgcgtgctcgtcctcgtgctcgtgctcgccttctgcagctgcctcctcgactgcggtccaccaaattagttcagtttgatcttctagctagtaaccggaactagaactagcttagttttacagaaactataaattcacaccatgaaccctctgaacgcggactgga

SEQ ID NO: 60332 - DNA, 325 bp, Zea mays
  unsure at all n locations
  Clone ID: LIB3069-056-Q1-K1-F10
ctccacttcgaacgccaagtggagagccgtttccagtccggcacacctccgcgagaagtgggggcacggctgcgcgtcgctcgacgggaaggtcgttgtggtggcggaccgtggcggcttgtcctacgatccttcggcgccacctgcggaggcgtgggcaccggtgtcgccggtgcttgacatgggatggaagggccgagctgcagtggttgaaggaatcctctactcttacgattacctgngacaggtcaaggggtatgatccggacactgattcttggagcacagtggaggggttggagagggagctacccaagttcttgtgc

SEQ ID NO: 60333 - DNA, 271 bp, Zea mays
  Clone ID: LIB3069-056-Q1-K1-F11
cccacgcgtccgaacaatattttgaatatactgaaagtgtatgattcgtttcttgcggagtggggtctttgctttgggtattgcaagaaatatgctgaccatgaagcgagacttgatggtgtgagtaaagctatagaggtgtatgaacgagcagttctcgcagttacttattcagtggacatttggtataactattgtcagtttgcaatttcaacatatgatgattcagatatcatacgaagactgtttgaacgtggcttggcatatgttg

SEQ ID NO: 60334 - DNA, 368 bp, Zea mays
  Clone ID: LIB3069-056-Q1-K1-F4
cccacgcgtgcggactcacttaacgcttatctaacttcgatgcatacgtgcaaattctgagacaggtccttgacaatacccacattgatgacttcaagcttaatattgatcttaacagctaactacgaagctatcagcaagaacggatcaactggcttgcattcctacgtcggtctaagttacatggaattccatgcgacgacatcgtgctcgctaagacgctccaagcatatactatcgcctcaagtgacattgctgaaccacgtgcacagaatgatgaacaaattctcacatctctgactatctgcacttctacattaatgcaccactgtgaatatgacatagagaaatacatagacagctctatc

SEQ ID NO: 60335 - DNA, 391 bp, Zea mays
  Clone ID: LIB3069-056-Q1-K1-F6
cccacgcgtccggagctaaatatgaagctgtagaagctccagaggacaagcagtggtcaagggcgcatgattcagaagactgaacatgctcttaaagctgctgaggaggagctgatgaaggctcagttggaaacaacaacatatgtaaaacagcttatagaggttcatggagcctggttgccaccatggttagcgacacatgcagcccgctctatggaggtgatgtcaaatcactggaatgaacatgggaaacctgcctttgacagcttcttgcagaaggcatctgaaaaaacagtgcagacaaagaaatgggctgagcctcatctggaaactgctaagacaaaatggatgcctgttgctaaagaaaaatgggttaccttgaagaaacatg

SEQ ID NO: 60336 - DNA, 326 bp, Zea mays
  Clone ID: LIB3069-056-Q1-K1-F7
atcagccttctcatcgccaccaatgttcacttccgaggtccagacccctaccgtcggggcgttcgattaagcgcccgtggtggagaccccgtcttcggccgtcgtgcccgaggagtctgcccccgccgaggccgatgccgatgccgaggctgctgctcctgctgatcccgaggagcttcccgcggccgatcagcatgcagccgccgaggcggaagccgcggctcctgctggtgccgaagagcccgtcgcggtcgaaccggccgtcgaggcggaagctgctgctcctgctggtcccgaggagactcctgcggtctagcaagatgcag

SEQ ID NO: 60337 - DNA, 446 bp, Zea mays
  Clone ID: LIB3069-056-Q1-K1-F8
cccacgcgtccggtcttaaattttatgccatgattgtgtgttttaagtcgtattttgcagggttttccggcgacggctcagagaagctcagctacgtagaggagctccgctggagaggacgaccaccagagataggcgctttgttgcggtggctcatactcgctcgacgacggcggcagtgtggatctcggtcggggagtacgcgcggaggcgctctgctgcagtgctgcagattcgctcgtcggctgcggcggcggtgatgtggatctcggccggtgagtacgcgcggaagttctctgctgcagattcgctcgtcagccgcgacgtggagaaggtcgacggcagggctttgaatcctctgtggtgcgaaatcgctcggcgggacagagtcgctgttccaactagctggacgagagctgtacgaacaaggaaaatcccattttctc

SEQ ID NO: 60338 - DNA, 291 bp, Zea mays
  Clone ID: LIB3069-056-Q1-K1-F9
cccacgcctccactcacgtcgcaaagtttttgtgcccagcgataaccacaacacaacaggaagccaaaatgagaaccccggtccgcacgtagcccatgggaatggctttccttcccctattgctctccgccctcatcgtctcctgcgacacgcaatcgccggactaatcgccgtccgcgtggaatgctcctccggtcaccggctcagatccgaggagctctgtcgcgccaccgacaactgcggactctgcgccgcatggctctgtcgcaacacctacgacaactgcgggct

SEQ ID NO: 60339 - DNA, 321 bp, Zea mays
  Clone ID: LIB3069-056-Q1-K1-G1
cggacgcgtgggcggacgcgtgggtgagtgtgagcgtgtcaacactgttgaaggcgacgaggatgcgtgagcttgccccatgcgatgaaactgttacctacaatcgtaatgtaatgtgctggtattctcgaatgccatagcccatagtcagccatggcttggaataacgtagtggctgaccgatatgccagtaggcaccttatctagtacttacagaactacaaaaagtttgtactatacatatatggacaaccttataagtggctatgtgtgtacctatcctaacgcttatcccagatggtgtatcagcgtttttctgtg

SEQ ID NO: 60340 - DNA, 235 bp, Zea mays
  Clone ID: LIB3069-056-Q1-K1-E2
gggagcggcttctttcgtcagctgttcttgctttgcctgagcctcttccgcctgcttcgtggtctggacaggagccggtgacctcggacgatatcttggaggacaagatgtcgggggctgttcttgtcgccatagtcgcctccatcggcaatctattgcaagggtgggacaatgccaccatcgcagctgctgttctgtatattaaagaagaatttcaattggcaaatgagcccac

SEQ ID NO: 60341 - DNA, 269 bp, Zea mays
  unsure at all n locations
  Clone ID: LIB3069-056-Q1-K1-G10
taccgagctcaacctttcaactggtgactatatagtggtccgaaaggtgtcnaataagggaggggccgaaggtgaatgcagggggaaagctggttggttcccctacgactacatcgagaaacgggagcgtgtgcttgcaagtaaagtcgcccaagttttctaagtcttccgcggagccatgtagtatatccccggggttgtacaatgtgtgttggttatgcttgtcatcttcagagaatcagaggagatctgtaattttgctgaaagct

SEQ ID NO: 60342 - DNA, 441 bp, Zea mays
  Clone ID: LIB3069-056-Q1-K1-C5
cccacgcgttcgcccacgcgtccgcacaatgggaacctcctacttctgtgaacaccggtgtgacaccttcagcttccaccaacactgcaattgagccagtcgctcaagctgcagatatttggaactctcaaatgcagagatgtttgggctgtggtggatggggagttggtcttgtccaaccttggggatactgcaatcactgtacacagggttcaaaatcgcccttttaacagtacctattttacacatataatacgatgcacgccagtggtaacaatgctcccaaaactcagggaaatgtttcagctaagaacagatcaagctcaaagccacctttagggaaaccaaacagaatagaccaccgcaaaagaaatcgccccgaggatgatgaacttgacccaatggacccgagttcttactcaaatgctccacgcggtggct

SEQ ID NO: 60343 - DNA, 301 bp, Zea mays
  Clone ID: LIB3069-056-Q1-K1-C6
cttagacctccctccccacgaacgagatcctctaacgtacttctttcttcagaggagctaggttgcctggccggtcgcgctgcgctccatctttggtgcgcttgtcccgaggcgccgtcgcataaagcagcagccccactttcgcggcggcggcgcactcacggtccctcgtcacacggaagtcctaaaggagagagccaggattcgcccatgctcggtggccgtgatcctctggccccgttcctcgtcgcttacttgaagcgtgcggcgcgcctacgctgcggcgagcagctgcacgcgc

SEQ ID NO: 60344 - DNA, 355 bp, Zea mays
  Clone ID: LIB3069-056-Q1-K1-C7
cccacgccttcgtcgactcttgcgctttacttttaacgtaccacatctcaaacccgcggcggagtacctcagcacccaaactgcaactccacaatgaggccctcgctgatgagatccacctcccaactcctccatcgccactactactactccgcatcccttcagacccatctgaaactggccatcctatacacagagccagcatcgggcatcctctgtcgctcctcatgaagctcaacccactgatctacttcctctcactctactatatcgcttgcaccccaggagtcgctgccgacgtctcccacatcaacttcccctcactggttaaaagtttcatggctgatgagcaact

SEQ ID NO: 60345 - DNA, 444 bp, Zea mays
  unsure at all n locations
  Clone ID: LIB3069-056-Q1-K1-D10
ggcacgtagacctgctgatcctgaagaagatcttagatggatgtctcaagaagttcgtggttgtgtcgaggctgttttgaatagtctggcancaaatgttccaaaggctattgtgctttgtcaagtggagaaagcaaaggaagacatgcttaaccagctatacagctcgataagcgggcaaagcaatgctaagattgaagagctgcttcaagaggaccataatgctaagcgcagaagggagaagtaccaaaaacaatcatctctcctgtcaaaacttactcgtcaactcagtatccatgataacagggcatctgtttcctcttattctaatgacaccactgaagccgagagccctcgaacaccaacccgctcaggtgaggactggaggtcagcttttgattccgcttcaaatggtccttgtgctggaagcacaaacagtcaatc

SEQ ID NO: 60346 - DNA, 431 bp, Zea mays
  Clone ID: LIB3069-056-Q1-K1-D11
gagaccgatgattttcttaaatcccgtttttttcgctgcggctttaatccggccgtggcttctacagtattttgctgtgtgcctgtatatgatctgttgttttctaggataaatggataatagtcaacacggtggtcgaagtaaagtcgacatgagaccgaggattttcttaaatcccggcttgttcgctgcggctttaatccggccgtggcttctacagtattttgtctctctatagattgcaactgcggctgccagccagctgatgaattcctcagttagggctacctcccaatacccacataaattcctcagtagaagtttctgggacatcatattgtaaagttcatgtctatcggtaatctgaaataatatgaagaatagtatagatgtgatgaatccaaaaaaatcttaactcccctggcaccccc

SEQ ID NO: 60347 - DNA, 66 bp, Zea mays
  Clone ID: LIB3069-056-Q1-K1-D12
cccacgcgtccgcaccgaattccagtttgatttccttgcccgcctaaaaaaaaaaaaagggggaag

SEQ ID NO: 60348 - DNA, 453 bp, Zea mays
  unsure at all n locations
  Clone ID: LIB3069-056-Q1-K1-D2
cccacgcgtccgcccacgcgtccgaggatgatatttgcctgccactgatgatatcattgtggcaagtgaacggtctgcgcttgccgccttgcttgatggctttgcctgctgatctcaagactaaggtattggggtttttacctggggttgatcttgcaaaggttgagtgcacatgcaaggaaatgatgaatcttgcatcagatgatagtatctggaagaagcttgtatccaagtttgaaaattatggcgagggctctaggctggcaggcaagaatgcaaaggccatatttgtagaagcttggcaggccaataagagacggcagaagaggcccaatccaaccttttggaactatggctggggaaacagtccttatagccgtccacttaggctgccattgattggtggggactcggacagacttncttttattgggaatcatggttctgttgggc

SEQ ID NO: 60349 - DNA, 328 bp, Zea mays
  Clone ID: LIB3069-056-Q1-K1-D3
caggaccaggatgaggagatgctggttccgtatcatgatgccattgagggtctgcagaaggatgtgcttgagggtccgcagccgatggaagaatttgcatctgctgttgagaaccaaattataccagatacctccacatctagatttacatggtatattgaaaatttctccaaacgaaatgttagaaagcactactctgacaattttactgttggggggtccaaatggcaagtgctcgtcttccccagaggaattaacgtggactacctttcaatgtacctggatgttgctgattcgaacttgatgcctcccggttgaagtaggaatg

SEQ ID NO: 60350 - DNA, 425 bp, Zea mays
  Clone ID: LIB3069-056-Q1-K1-D4
ctaagctggcgaacttgctgcatgcgaaggagctctctagaaggctgaaggaagaaggaggaaacgatcacagttaacagtgtccatcctggattgatcatgaccaatttgatgaggcactcctttgttctcatgaaggtgcttcaggttgccacttacatactgtggaagaatgtaccccatggagctgcgactacttgctacgtaggactgagccctcaactcaagggagtgacaggaaagtactttgctgactgcaacgtggagaagacgagcaaactggcgaagagcgaggagttggcgaagcagctctgtgacttcagcgaggagctgatcaagtctgcgaagtgagagccgaaagagctggatcagagaaaatgttgtggtcctgcttggcatctagtggtacaagtgatgactgatta

SEQ ID NO: 60351 - DNA, 373 bp, Zea mays
  Clone ID: LIB3069-056-Q1-K1-D5
ggcctctttgttcctatggcctgaagctaatttcgatccgcaatgcaggggatcgtccaagaaatattgcttcaactatactttgtaagaccaaggaactggccaacgaattggagccgcagattcggcaacatcttctaacgcttgtggatgctgttgaagatattatcattcgagagctgcggtctcgttaggaccacgctgtcgacaggaatagctttgggggataatagacagcctctactggctcgtggatcaatgtttcactttcacattttgtacagaagcgactctatcaccgttacgcatctacggctgatttttttagtgtctggcgcgttgccagaaaagagaatcttgttcaactttatta

SEQ ID NO: 60352 - DNA, 422 bp, Zea mays
  Clone ID: LIB3069-056-Q1-K1-D6
gatattcttgattttcatttatttttaaatacttcggccagtatcggtggattgcgtatgggtccatttccctcggatcttgctttgttgtcatcttcttgattggaaccaaagagccaggatcaattcggcactgtttggataagagtccttccagaatttcatgggactactggttcaagagagtattgtactaccaagttgctctagtctatactctgactagattggtgaccaatgtttcacaggcatttcttgctttctatgtaataaatgatttagaaatgaatcaatcctccaaagcattggtacctgctattatctacatctgcagcttgatagtatctgtaatattacaagagactagatggtcaagttggcgtcttaagctttacttttcagatggagcaatgctttggata

SEQ ID NO: 60353 - DNA, 306 bp, Zea mays
  Clone ID: LIB3069-056-Q1-K1-D7
gtgagactatggcatctgggcaggctaccattgcatcgaaggcagaacctatcgaggattgcaactcagctcactccgaggccactgtacagactccacaagaacgtgttcgccttagttgtttgcgtgttctgcatcagcttgcgtctagtacaacttgtgcagaagctatggcagcaacaagtgcaggaactcctcaggttgtaccactgcttatgaaagcaattggatggcaaggtggaagtatactggcatttgagacattaaagcgtgtagttggtgctggtaatcgggctcgtgatgctc

SEQ ID NO: 60354 - DNA, 424 bp, Zea mays
  Clone ID: LIB3069-056-Q1-K1-D9
cccacgcatccgctcacactacacaatgtttatgaccaaatgcctgaccctaaatgggctcttgcaatttgcagctgttgcaacggctgtccatactaccattactcctactctgctgtacgtggatgtcaccgtatcgtcctctgtggacatctacgtgcctgggtgcccaccaactggtgacgcacttgtgtacggcgttcttcagctgcaaaagaaaatcaacacgcgtaacgatttccttcactggtggaccaagtgaagcatgcttctgctgttgctagcttgctacgtttatttgcactctacctacctgtcttatatgaaataaagacagactgtgctcggattcacaaatgtgctgtccctggaaggatgcatgcccacgttgccacgaacatataacttgtgtacttggagtcag

SEQ ID NO: 60355 - DNA, 219 bp, Zea mays
  Clone ID: LIB3069-056-Q1-K1-E1
gggcagcggtatgaggctaaggagggagtttgatgattcagtggtgtcatgctatgatgcgggacatttgctggatacaggttctctgtgcgagggtttgcagccgtggctgtacagtaacggcactggagtgacggtgcaagccgtcgatgcttagaatcgtggtttagatgagctgttgcgaagattgattaaaccaaccgtagatttgtcaagggt

SEQ ID NO: 60356 - DNA, 307 bp, Zea mays
  Clone ID: LIB3069-056-Q1-K1-E11
attaagaaagatacaactttgcaaggatatttttaaaggaaggcaaagctgtgagtgatagagtaacatgaaaccagaggcgtatctggtgacgatgagaatacaaggagatctagagcttatcactttccaaattttgatgacatcaatattagcatggtaggaaaaaatatatgcaggcacgatgtataacaaagcccgtgcagcaccaactagatgtcgtacaatcatgttgatgctctgatccttccaactgatctccacgcagcacatggtctacaaatctgtccagtccagctgtttcgcg

SEQ ID NO: 60357 - DNA, 392 bp, Zea mays
  Clone ID: LIB3069-056-Q1-K1-C4
tccaagtagttgctgtgattctcagtgctagtatttcagcgggctgattgcaaatttgtgcgggtaggactttggccgctggacggtgcactctgcgggatccccaacctcctgctgagctcccgcacagagggcgggcatggctggaaagcataccatgattctcatgcaaccatcacagaacagatcgacgaggacatttatggactacgattcagttaaccacgcgctggatggaatatgtggtctatacgaaaggaaaatcaggaacataaacccaatggtcaggaacttgactcatgatatcggtgacctgtacaacttcatcgatggcctgaccgacataagtgcactgacgtacgatgattcacttgacgctttcctgacgtatg

SEQ ID NO: 60358 - DNA, 447 bp, Zea mays
  Clone ID: LIB3069-056-Q1-K1-E12
atctgcaaagaacaaacgtttccgctgaggcttagaaatggtagcaacggaaattgtgataccggtgaaataactgtctatgactactatgcaaagaaaggaatcgatctaaagtattctggtgatttcccctgtataaatacagggaaggcaaagcgcccaacatattttccaatcgagctatgctcgcttgttccgcttcaaagatacaccaaagctttgtctacgctacaaaggtcatcccttgtggagaagtctagacagaagcctgaagaaaggatgaccgttctaaatgatgcactgcaacgcagtaactacgattctgaccccatgttgagggcatgtggtgtttcagttgctccaaaatttacccaaagttgaggaaggatccttcaagccccaaagctgaaagccggcaatggtgatgatatcttttcacgaaatgga

SEQ ID NO: 60359 - DNA, 420 bp, Zea mays
  Clone ID: LIB3069-056-Q1-K1-A9
cccacgcgtccgggcaagccttctcggcacaagatccagggcgtcgggccgggattcgtgcggaagaacctggacacctctgtcaccgacgagatcgttacggtgaccgcagaagatgcgatggcgaacgccaggaggttggccagggaagagggtctgctagtgggcatatcgtctggggcgaatctggcagcttgcctcaaggtggcgtcgagacaggagaaccgagggaagatgatcgtcaccgtgtttcctagcggtggcgagaggtacatgagctccgatctcttcgcggatgcaagggaggagtgcgtcgccatgaccttctgatcttctggacgctctgtgcggatctgcagcggcaaactgctatttctcagcgtggaatggatttttagtatcgtcgatccaatccagcag

SEQ ID NO: 60360 - DNA, 452 bp, Zea mays
  Clone ID: LIB3069-056-Q1-K1-B1
gccaggcgttctgatcgaccggcatatctgtctgatacttctgcaccagtcatcggaccaggcgggtgcgcatgtcgacgatgcctcatcacttaaacaccttgctggtctatgaccttgtgcatggtacagatccatatcggggctatagccctttgcaagcatgacgatgcatgtctcccccttgcagaacatacaacaccagggccctgctgctaaccaaaaccaacgcctgatgcctgattcatcgatggattaccctggaaatggcgtccacaaggatgtacagctcctgaacaagttctgaattcatgtccctgatatgcatgacctagttaacggcatgttcagtctccacgtaatgggcatgttcggttccccgggaatggtcgatctggaatgaatcctggccggagttcttcactaattatataagctttgatcagttggaa

SEQ ID NO: 60361 - DNA, 326 bp, Zea mays
  Clone ID: LIB3069-056-Q1-K1-B10
cgacttaccgcagttggcttaaaattgagatgatgaatgccgctgtttctcctgagatgctggcggcagaggaaaagggtcaagctgttgctgcacctaaagaaacactgaacttggcatgttcgttactacgccaggatggaagaccatggctgtatgctgtcgagagcagtccatttgaatcccccgatgttattttccttgagctgcatgcttctgcaatgctctgcctaccttctggagaatgtctgttaccagatgcaacatcatgcacagctttgacaagtgcactatattcaactgtcagtgaagatgatgtgctgcat

SEQ ID NO: 60362 - DNA, 314 bp, Zea mays
  Clone ID: LIB3069-056-Q1-K1-B11
ccttcgcctcctacggcgagatcctcgacttcaaggtcatcaccgaccgggagacggggagggctcgcggcttcagcttcgttaccttctcctccgagaactccatgctcgacgctatcgagaacatgaacggcaaggagctcgacggccgtaacatcaccgttaaccaggcccagtcccgtggcggtggcggtggcggcggtggctacggcggccgtcgcggcggcggcggctatggtggcgggcgccgtgaccgcggttatggcggcggtggcggctaccgcggtcggcacgagggtggtggcggcggctac

SEQ ID NO: 60363 - DNA, 450 bp, Zea mays
  Clone ID: LIB3069-056-Q1-K1-B12
gtcgcgctagactatgaacaagaactcgagaccgccaagagcagctcatcagttgagaagaggtacgagctgcctgatgggcaagtgatcaccataggcgcagagcgcttcagatgcccggaggtgctcttccagccatccatgatcggtatggaagctccaggaatccacgagacgacctacaactccatcatgaagtgcgacgtggacatcagaaaggacctgtacggcaacattgtcctcagcggtggatccaccatgttcccaggcatcgctgaccgcatgagcaaggagatcaccgcgctcgcgccaagcagcatgaagatcaaggtcgtcgctccgccggagaggaagtacagtgtctggattggaggatcaatcctcgcatccctgagcacattccagcagatgtggatctcaagggctgagtatgaggagtctggtccagct

SEQ ID NO: 60364 - DNA, 408 bp, Zea mays
  Clone ID: LIB3069-056-Q1-K1-B2
ctccgatcaccatacaaccgtgaccggaggtatgatcctgcactgccctcactattacgcggcgggtgcacattcccactatgcctgatcacttaaacaccttgcttatctatgaccttctgcatcgtacagatccatctcggggctatagccctttgcaagcacgacgatgcatatttcccccttgcagaacatactacaccagggccctgctactaaccaacaccaacgcctgatgactgattcattcatgtattcccctggctatgacgcccacatggatgtacagtccctggacaagttctgaatttacgtccatgatattcatgacctacttaacgtcatgttcactctcacgtaaatagtcatgttcgctttcccggaaatggttcttctggaatgaatcct

SEQ ID NO: 60365 - DNA, 261 bp, Zea mays
  Clone ID: LIB3069-056-Q1-K1-B3
ctcaggccaactctttagcgaatttccgatctgctatccacacccagattcataagcatcgtggtgatcaaggatctcgtgaacgtggacgatgaaaccctagagatcaccatggagatcaggactgtatacagtactgtctgtcctgtggccatctctgagaatgtctagggcccagtgtaccacccaattgtccacatactacttgaatatcgcatcactcatcgcactcatgtccttgaacatgatctagaaaaagct

SEQ ID NO: 60366 - DNA, 456 bp, Zea mays
  unsure at all n locations
  Clone ID: LIB3069-056-Q1-K1-B4
ggacagtctgaagaagacatgctgcagtgcttcattgattccaagtacaagaatgggcgtggcacgagtgatggcgaggtaaccgggctacttatcgcagcactcttcgctgggcagcacaccagctctatcacctcaacctggactggagcatacatgcttcggttcaagcagtacttcgcagaggctgtagaggagcagaaagatgtcatgaaacggcacggcgacaagattgatcatgacatcctcgcggagatggacgtcctctaccggtgcatcaaggaagccctacgtctacacccgtcgctaatcatgttgcttcgtcaatcacacagcgacttcaccgtgacaacaaaggaaagcaaagtgtatgacatccccaagggccacatcgtcgcgacatcaccatncttcgncaacaggctgtcccacatctacaagaaccctgactcatat

SEQ ID NO: 60367 - DNA, 375 bp, Zea mays
  Clone ID: LIB3069-056-Q1-K1-B5
gcgtgggcggactcgtgggctgacttcttgcggcgacgcctatcaccggagggtggtcaacatccacgcccacccgcggactcccttctactgggagttcctgcacgcggccaatgccgtgtagatgctgcacctgctagccttcgcgctggagccgccgtccatccacttcgatgccagacgcggtgcggagttccaccaggagtacatggagagcgtgacccgcgcgccacctcacggcggcgcggacctggtcgttgggttcgccgtcacgcccgggttccggctggggaacggagccatcgtgcgcccccggttctacctggtaccgcgtggtggccgaccgttacagacccatgcatggcgtgacagacc

SEQ ID NO: 60368 - DNA, 384 bp, Zea mays
  Clone ID: LIB3069-056-Q1-K1-B8
ccttgctcgtgctcttctgggcagaaatataccatcaggctaggagtctcccaacggacaggctaaggcctgcatacattgccgttaacgccatcatatacgttgttcagctttgcatatggatatacctcggaataaatgataatgccgcggttgagctggccagcaaaatattcgttgtagctgtctcctttgttgcgcttcttgggttttcagtatatggtggaaggttgtttgtcttgctgagacgtttccctattgaatctaaggggcggcaaaagaagctgtatgaagttgggaccgtgacagcaatttgtgttacctgctttctgataagatgtgttgtggtcacgctatctgcatttgatgctgatgtatctctcg

SEQ ID NO: 60369 - DNA, 379 bp, Zea mays
  Clone ID: LIB3069-056-Q1-K1-B9
ggaaggctttcttgcactggtacacgggcgagggcatggacgagatggagttcaccgaggccgagagcaacatgaacgacctcgtgtcggagtaccagcagtaccaggacgcgactgccgacgaggaggagtacgaggacgaggaggaggtgcaggccgatgacatgtgaggggagggctgttatcgtgtgaagccttgtggtccctagggcaagcggacctcgatgagttcggtgttccctttcgtgttgttgccatctttctactgctagcgtacccaccctcgtggcccattccgtcgcttgtgacgtatgtatttttcttgtgctatggaaccttgcttttggtacggtactatcctgctagtatgcttgggcgt

SEQ ID NO: 60370 - DNA, 400 bp, Zea mays
  Clone ID: LIB3069-056-Q1-K1-C1
cccacgcgtccgcgagaggttaacaagactatagtccagcagactgaaggaaatcgtcatggaagggatggcagagttagaagcgatctgccagaatgcacacatagaacctgatgtcagcacggcccctgaacagactgatgctttgatcgattctggttgcctcatcgacccttctgagctcctggcgaatattgagtcacacatattaaaagcgaaagaagagtctcttagtcggaaagatataatggacaggataaatagatggattgctgcttgcgatgaagaggcttggcttgaaaaatataaccaggacccaaagaggtacagtgctggaaagggtgctcatataaaccttaaacgggcagaaaaggcacggattttgggtagaaaaatccca

SEQ ID NO: 60371 - DNA, 265 bp, Zea mays
  Clone ID: LIB3069-056-Q1-K1-C10
gtacgacagttgagacttctaagtttaaacatgcgcctcccaggtctggtgttagcagggtggttccttcaccttcttctgaattgattagcaaatggggtgtatatggaaacatatgcagaattgataagccttgtgtggtagatgagatccatcttcgaagatttgatggcatgttggaacatgagggggctcataggtgtgtttttgctagtatcactgtgaaagcaccggttcgagaggtatggaatgttctcacagcata

SEQ ID NO: 60372 - DNA, 313 bp, Zea mays
  unsure at all n locations
  Clone ID: LIB3069-056-Q1-K1-C11
cccacgcgtncgagcaccttgcccatatggttgtggcggcggtgggggttataatangtctggtggaggtggtgggggatacaagccatacactggtgattatggttctggaggaggtggtggcttcgacagagatggcggagactacaattctggtgggcgtggtggtggatgcggtggcagaggaggatacaatcaaagtggtggtagtgaccgtggttatgatgaccaccgtggtggcagaggtggcagctatggaggacgagaccaatagaaccaaaagggtagtgaaggtggctacaatgcttgtggt

SEQ ID NO: 60373 - DNA, 197 bp, Zea mays
  unsure at all n locations
  Clone ID: LIB3069-056-Q1-K1-C12
acaacacattcnatacattttcctcataacttcagcctgcaagatgacttataaacagggtggggtatacactctcagatacatccaataaaacaagacacctttccctgtacacactcaatttttaaacaccataatcgctaacatcaaacctatttttactacccgcacattcacagtactcaccaaaatcctat

SEQ ID NO: 60374 - DNA, 394 bp, Zea mays
  Clone ID: LIB3069-056-Q1-K1-C2
cttatgttcatacgacaattatcatgtcaattttatctatcatatcagtcgtcaaggatttgttaggagtttcaatctctactagtgtctgtttcaaaaatattatcagtaagtcgcatgatctttattacagcacactaaaagcattaatattactaggttgatgcccttgctatcaatatagctgtcgattgatctgttacattttctaaaatatttcctattattctctgattttttatgattttttgaacaattttgtctcatgaagcgtttttagccccttggatgccaaacattggcaagtaaatacaatgcaggttatgacaactttaattctggcatttgttttaatcattatctgatctgcaattaatctatcacaagcacattc

SEQ ID NO: 60375 - DNA, 282 bp, Zea mays
  Clone ID: LIB3069-056-Q1-K1-A8
gccacgcgttcgcccacgcgtacgtgccaatcccccgctctgccgactaccgccaggcccgggcgccagcctgcaaagtgcaaacccagctagagcttagagctagcatggagtccggcgccccgtgcccgctcgcgcacgcgcaccccgtggacctgcgctggctgctctcggtcgccgtcggcggactcttcgcgctgatgctggtgcttctggccacctccccgtcgttccgggtcgcctacacctcgcccttcccgcgcctttttactcggccccgcg

SEQ ID NO: 60376 - DNA, 377 bp, Zea mays
  Clone ID: LIB3069-056-Q1-K1-C3
tgctaagggagcatacgtctgcgcttttaaactgtatcgattcagcattgatgtcaaatcgtgaggccttatagggcctagctggaactgtaaattccggcgataggattgaaagggatgtgaacctgaaacaaattattgacctcgaaacactggctgacctctgtattcaagcagggcaggcaataactttccgtcggctgttggttgaagccgtcggagcagtccttgaagagaaagtgcctctgatatattctctgctcaaaagattagccttgcagttgccagacgaggtacctgataaaaatgagataattagattgagaaaggttgcgagcagtgttggtgttggcgacaaacatgatgctgaatgggta

SEQ ID NO: 60377 - DNA, 380 bp, Zea mays
  Clone ID: LIB3069-031-Q1-K1-E8
tcgagctgcagcaggagcactaactgatccaacttctgagttcccttctggaagaaggccagctgatttagcttcagtaaatggacacaaggggattgctggttttctcgcagaatctgctttgacaagccatctgtcagcacttactattagggaatcaaatgatagcactgtagaagcgtgtgggctaccatttgctgaagatctcactggcattgattctgtccatctcgctggagagggtcctgatgctgaatcacttgaaggttctttaagtgccgtgcggaaatccactcaagctgcagctcgtatatttcaagccttcagggtggagtcattccacagaaagaaagtcgtggaatacggagatgacacctgtg

SEQ ID NO: 60378 - DNA, 375 bp, Zea mays
  Clone ID: LIB3069-031-Q1-K1-F1
cggacgcgtgggcggacgcgtgggcggacgcgtgggcggacgcgtgggtgcgcgtcgaaccccaatgtctcgtctgtgatcactggagccaccaaagaaagccagattgtggagaacatgaaggccctagatgtcatcccactgctgacgccggaggtcgtcgacaggatcgaggcggtggtccaaagcaagcccaaacgcaacgtcgagtcatacaggtgaaaattcggtgttcatccgacggagttcaggcctcctccacgaaacttcatccatgatccgtgtgtattctgggcgtggtgctgtgttcacaaacaccagtctgtcagtcctgtgttgtgtattctgctttccgatacagattttggaccaatc

SEQ ID NO: 60379 - DNA, 367 bp, Zea mays
  unsure at all n locations
  Clone ID: LIB3069-031-Q1-K1-F10
gcgatacccggttgaaattcattatacaaaagctccagaggctgattacatagatgcagcaattgtcactgttttacagatacatgttacccaatcccctggcgatatcctggtgtttctcacaggtcaggaggaaattgaaacagttgatgaaatccttaaacacagaacaaggggcttaggcaccaaaatctcagaattaattatatgtcctatttatgcaaatctgcctaccgagcttcaagctaagatatttgagccaacccctgagggtgcccgtaaggtggttctggccactaatatagcagagacttcattaaccatngatggtataaaaatatgtattgatcctggcttttgtaagatc

SEQ ID NO: 60380 - DNA, 361 bp, Zea mays
  unsure at all n locations
  Clone ID: LIB3069-031-Q1-K1-F11
cccacgcgtncgcggacgcgtgggtataaactctgataaagctgttatcgtatctgcatgtccccagtcaagagcatcactagctgcattctttggtctttctcagtcacaggttctcagaaaactgacttctttgttcaagtcgattggtgtaaaggctgtttttgacacaagctcgagtcgagatctatctcttattgaagcatgcaatgaatttgtttcacggtatcagagaagccaaccatctagaggccaagaagctggagccaatcttccactgatgtcatctgcatgtccgggttggatatgctatgctgaaaagactcttggttcatacatattaccttacatctcatctgta

SEQ ID NO: 60381 - DNA, 189 bp, Zea mays
  Clone ID: LIB3069-031-Q1-K1-F12
cccacacgttcgcggacacgttgatacaaactttgaataagctgatatcgtatctgcagctacccagtcaagagcatcactagctgcattctatggtctttctcagtcacaggttctcataacactgacttctgtgatcaaatcaattggtgtaaaagctgatcttgacacaagctgcattcgagatct

SEQ ID NO: 60382 - DNA, 214 bp, Zea mays
  Clone ID: LIB3069-031-Q1-K1-F2
actaactgttgcatcttctgactccccttctcgcatagagccgaggttatctagcttcagagcacggacaccaccaaataaatccatatctcgcagaacatgcttgcactagacatcagtcaactcttactaccagagaatcaaatcataaccctgtctaagctccaaagctaccacaaactcaacatctcactatccttgagactatccatct

SEQ ID NO: 60383 - DNA, 375 bp, Zea mays
  Clone ID: LIB3069-031-Q1-K1-F3
cctggagggcatgtccatgacgccgcctgcagccccacccacggtgacggaggcctactgcctgctcaaccttggggacagcatcaccacggaccacatctcctactcggggaagatccccgagggcacacctgcggccaagtatctgctcgagtatggcgtggagcccaagaacttcagctcctatggtggccgccgcgggaacaatgaggtggtgatgaggggagcgtttgccaatatgaggatcgtgaataagcttcttgatggcaaggctggtccctggacgatccatgttccttccggggagaagctctatgtttacgacgcggcaatgaagtacaagtcggaaggtcatgacatggtcatcattgctgg

SEQ ID NO: 60384 - DNA, 316 bp, Zea mays
  Clone ID: LIB3069-031-Q1-K1-F4
cggacgcgtgggaccgggctccgagagcatttctaaccaaggcagtgcagcggcaccaggatccatttcacagcggattctactgccactgctgctgatggtggtggtctcactggtcgtcggttacgcgatgtaggtcgaggatggagcgtcgtcccacggcaacactagactgttttttttaatccgcaggacagggtagagctgatagcttgttagggtggtgatacacttttggatatgtattgtactgctgcgtggttacgttttggcgattggtttgtgtagtgtagatgttacccggccgggtcatttt

SEQ ID NO: 60385 - DNA, 377 bp, Zea mays
  Clone ID: LIB3069-031-Q1-K1-F5
cggacgcgtgggaaaaatatgataatagttataaaaaaaagataactataaaaacgaggggtataaaaaaaaaatacaaaacgcaatatactgaagcacttattacccctaacacagagatcaagtggaaggaccgacattcccgtgacttcaatgaaagtctgtgatgaagttctggtgaggaaacagggcgccaaccgtcacactgggatagagattcaggagtttattgttgagagatgaatatggaaactctgaatgcaccagttttcacgtcattgcgaacatactaatgatgtttgattgcaacatacatctgttctgttggttaagattgtgagattccattgcagcgtaatatcgtttgggcccctttt

SEQ ID NO: 60386 - DNA, 375 bp, Zea mays
  unsure at all n locations
  Clone ID: LIB3069-031-Q1-K1-F6
gccatgtggaggagggctttagcgatggtcctgttcatggctggcgccgcgctgctcgccggggctgccggcgccggcgcgcagcagggcgtgtggagcatcatcacccggcccatgttccagagcatgctgagccaccgcggcgacagcgggtgccagggcgccttctacacctacgacgccttcatcgaggccgccagcaagttccccggcttcggcaccaccggcgacgagcagacgcgcaggcgggagctcgccgncttcttcggccagacgtcccacgaaaccaccggtggatgggcgactgctccggatggaccgtttgcctggggatacttgccggtgaaggaacagaaacagacgggcccaccctac

SEQ ID NO: 60387 - DNA, 373 bp, Zea mays
  Clone ID: LIB3069-031-Q1-K1-F7
ggtacttctggaccatgatccatcccttgggaaaacgtttggccaatcgaatgtgactcctctcataactgcggcgattagaggccacactgaggtggtgaacctactgctggagcgagtttctgggttggttgagttatcaaaagcgaatggaaagaatgccttgcactttgctgcccggcaggggcatgtggaaatcgtgaaggctttgctagatgctgatacccagcttgctcggaggactgataagaaaggccagactgctctacacatggcagtaaaaggtactaacccggaagttgatcaagcgcttgtgaatgccgatccggcaatagtcatgctacctgacagaaatggcaacttagctctgcat

SEQ ID NO: 60388 - DNA, 299 bp, Zea mays
  Clone ID: LIB3069-031-Q1-K1-F8
cccactcgtgcgccgacacgtgtgcggcgatatcacgtcgcggcaagggcatcagggggctgtgctaggtccgcgccaagcaccaccgactggtgctgcgcgacaacatgcagggcatcacgaatccggcgatccagatgctggccacgaagggcagcaataagcgcatctctggtctcatgtacgaggatacccgcagcgtgctcaatatcttacttgagaacgtcatgcgcgacgccatgacctacaccaagcacgcccagtcgtatgaccgtcaccgtcatggatgtcgactacgc

SEQ ID NO: 60389 - DNA, 342 bp, Zea mays
  Clone ID: LIB3069-031-Q1-K1-F9
tcgcccacgcgttcggttattgctgggctatccactttttactgctatgcaagagctggcagcgggggtgctattagagattgtatcaccgttgtttgttcatcacacaactcacagctgttaaccaccacacatgtatccaaagtaaaggcatttgaacgctgaagtgcaacacgcaccctaaccatgcacgatcgacctgtagacgacggcaccgactccgtcatccatgctacattcaccgatcaccctcaggacgactcgcctgagcccaatgtcaactgcagctcaaccttgacccgaacttggcattttgctggaaccattccacttggctggaac

SEQ ID NO: 60390 - DNA, 366 bp, Zea mays
  Clone ID: LIB3069-031-Q1-K1-G1
cccacgcgtccggcaccatccacgggttctaatgaagtcaagacgggagaaacttgaaagtcgcttcattttggatgtgactgttcttgatggaacactgatgacaccttctaccccgttcactaagatttggcgcatgcataacaatgggtctgttgtgtggccacggggcacacagcttgtctgggttggtggagatcagtttgcattgcagacatctgttccattagagattcctgtggatggttttcctgtggacaaagagattgatgttcctggttgatttgtggcacctacaagaccagggaggtacatatcttactggaggttggcttccctttttgtcagaaatttgtcaacgaagtt

SEQ ID NO: 60391 - DNA, 328 bp, Zea mays
  Clone ID: LIB3069-031-Q1-K1-G10
caacaattaaaccagatggcggattggagcttgttgttgggatgatgcatgcacctttgaagtttcagaatgttgtcctcaaatgcagcttgtggttgttgaacctattctacttgcttctggatttaagttatagtttattaaacatatttgatgtttaatacttgtgtcggatgatttatgcttcaattatgtggatgctagaaaaaaaaaaactacaaaagcaaactgatatatgaaagagaacatgacaaacatggagataaccctgatgcccccacctgctagtgctgtcgcttgaaacgaagaacacctccctagttcttga

SEQ ID NO: 60392 - DNA, 367 bp, Zea mays
  Clone ID: LIB3069-031-Q1-K1-G2
cctggttgaatgggcacgcccttatctgggagaaagacgcagattctataagcttgtagaccctcgtttggatgggaacttctccataaaaggcgcccagaagacggctcagctggcccatgcctgcctcagccgtgaccccaaggctaggcctctgatgagccaggtggtggaggtgctgaagcctctccagaacctcaaggacatggccagctcttcctactacttccagtccatgcaacatgagcggcgcacagcacttgccaacccatatggcagtcaaagcatgaaagcgcagagcacctttgcgccggacgggcagcagcccatgaggagcctctcgtatggccctcatgcttccccgtat

SEQ ID NO: 60393 - DNA, 375 bp, Zea mays
  Clone ID: LIB3069-031-Q1-K1-G3
gtaaaatgctcagaagatcagtcacaagtttttgaattgagggtaccggctgctggtcttatcggagtaatttctccaaacactcttggcaagctttattctcttcaagtactgagcctgcggtctaatcgattgaccggaagtcttccagctgatgtggcctcccttccgtctttacgttccatatacctacagcacaatgaactttcaggagggttgccttcttccttcagtcctaacctcagtgtaatagatttctcctacaattccttcacaggagaagtacctgcaagtttacaaaacctcactcaggtaaccgttcttaatttgcaagataactctttctctggatccatccctgacctcaagcttcac

SEQ ID NO: 60394 - DNA, 375 bp, Zea mays
  Clone ID: LIB3069-031-Q1-K1-E5
atccggagcagccgcagtcccaccgacctcgccgccggtcgccctccatctcctggccgctgcctctcgtttctcttttcaataatcaagatgagccgtggtggtagtgccggtggtggtcaaagttctctgggttatctctttggaagcggtgagccccccaaaccagcagtggcaccagctgcaagtgctccacctgttgagaaaccatctgctgcaaagactgatgcggccaagcaggttgctgctggggttaccagccaaaccaataactaccacagggctgatggtcagaacactggcaacttccttacggaccgtacttcaaccaaggtccacgctgctcctggcggtggctcttccctgggctacccc

SEQ ID NO: 60395 - DNA, 357 bp, Zea mays
  Clone ID: LIB3069-031-Q1-K1-D1
cccacgcgtccgaattgtacatggaggtgttggctatcatatggtaaactgcggtttgatactgttgaagatgttatctgaatatgttgacatcagtaaatgtttaccatcactatctttggaggtggtccaacgtgttgtggaaatattgaagcttttcaacactaggacttgccaacttgttctcggtgcacgggccatgcacgtgtctggacttaaatcaattacatctaagcatttagctctggcgagtcaaatcattagttttatacattctttaattccagatatcagacgagtgctcttcctgaaaatacctgtagcacgcaaacagttgctaatgtctgagctggatat

SEQ ID NO: 60396 - DNA, 431 bp, Zea mays
  unsure at all n locations
  Clone ID: LIB3069-031-Q1-K1-D11
cgccattattaacagctccgcggtccctcccttcctcggtcggtcggcgtcggtccctggccgtacccacccagttagtcctcagcctatcccgtgcccgcgcagagcaccggctctgctcgacccaccaccctctgtgcagagttaattaaccttgaggtttccgattgcccttaccttccgctcctctcgcccattcgcggcgagattcagcggcaaggatgcgcctgcacgcggaggtgcgggatgagatggaggacgggagcgaggtgggggctgtgacggcttcagcggggctgtcgtcaccgacactcatcggtgcggcggcgccggttccccggctagtggtggggttcgccctcacgaagaggaaagtgaagagcttnctgcagcccaagctgctcctgctggccaggaagaatggaatcagt

SEQ ID NO: 60397 - DNA, 391 bp, Zea mays
  Clone ID: LIB3069-031-Q1-K1-D12
gaggtggcgcgtggacgccacgctcgcctcagtcttagggatcgagggccctttccgtgcgcgtggctgctgctcctctcgtctctcctcccacccgtccaaggcatggagcactgctatgtgggacagccgatctcgagggccgaggcaatgcccgagaggaggtccaggttttggcagatggatgcgccccctccgtcccgggcggaggtcatctgcccccagcctcgccgcgccacccggattcccctcgccgctgtggaaaccctgaacaaagccagccccaagatgaacggtgcatttccgccgtacagatcggactccacttgcgatatacttgatcttatcctcagtaagaatgacctcgatggagattcgagcagccatgtgg

SEQ ID NO: 60398 - DNA, 358 bp, Zea mays
  Clone ID: LIB3069-031-Q1-K1-D2
cagcgacctgcttgaaggggatgcggcggcggcggcggcggcgcgccggagcttggttcagtggagcggcgccttcacggagttgtcccagagatcgagaagcaagagcaagatcttggaggctgatggcaagggaagtcggcgcggccatgcccggtggctttcggcagatatgacgagcaacggcagcggaatggaggttggtaaattctcccaagacgatgtttcaagatgtcctgagaaaacagtgaacctacaggatctgcagaacagcttgattgcatctaaggagcttgtaaaagtacttgcccacatatggggacctggagaactgaatccgtctagtgtatcactcatt

SEQ ID NO: 60399 - DNA, 361 bp, Zea mays
  Clone ID: LIB3069-031-Q1-K1-D3
cagagacctgcttgaagggcatgcagctgttgcttctgatgcgcgccacagcttgttggagcggatcaacacctccactgagttggcccacatatcgagaagcatgagctcgatcttggaggctgatggccaaggaagtctgcgcggacatgccctgtggctcactgcagatatgacgagcaacggcagcggaatggacgttggtaaattctgccaagacgatgtttcaagatgtccttataaaacagtgaacctacaggatctgcagaacaccttgattgcatctaaagagcttgtaaaagcacttgcccacatatcgggacctgcagaaccgaattcgtctagcgtatcactcatttct

SEQ ID NO: 60400 - DNA, 354 bp, Zea mays
  Clone ID: LIB3069-031-Q1-K1-D4
atgaattttagtgagaatagagacaagtggtgttgtgtaatggcacttgtaaagagagacagtacacctagggttggtccattgatgatgaacctctgtgcaaactttgtcaaggactttgcaatggaaggcttgcagagtcaacataatattttgaagatctattatgtggtctagcttgtttctaggaatacagattaagaaccagtggtagagccctacggcagttgagtcttctttttgttactcacataagtcaacattttttgctggttccattgaatagttaggactattttcagttattcaaaatcaaagaaagttgcaagttaattcatatatatgtaataaagt

SEQ ID NO: 60401 - DNA, 285 bp, Zea mays
  Clone ID: LIB3069-031-Q1-K1-D5
gcagatgagcaggtcgtccgcagtcgttgccggatgaggcgcagtggttgtggctgcataatgctccaaattccaaaggaaagaagggctcagtgagcaaactgggtgatcatgcatttgttggcatgcagtttgtatgaagagaattggaagtctgaaacgcgtagattagacggtagcaccaagccgctctagaaacattggctgattgtcagacttacactgctggttctgtttctgaaattcaaatgccacttcttaaattccattatatcctggtgggag

SEQ ID NO: 60402 - DNA, 205 bp, Zea mays
  Clone ID: LIB3069-031-Q1-K1-D6
cccacgcgtccggaaacaatcaaccagcaacactcttctcttataacatagtacagcgaaggtaactcacatggcaacttccatgggttgtctcgtcttgctctgccttggttcttctcttcttcccagtgccgtccttgggcacccatggggtggcttggtcccacaagtctattaacattcctgccccaaaggcaaaggaaat

SEQ ID NO: 60403 - DNA, 367 bp, Zea mays
  Clone ID: LIB3069-031-Q1-K1-D7
cccacgcgtccgcccacgcgtccgggcgtcttcacaaacgccggcgcatactctcgcgggagcccgacagatcttcaattccccattccgcccaccgatcgaccttcacgccagtctcggtctcttccgaaggcgtcgcgcgcggttgtttgagaggagaggaggaagatgagggagtgcatctccgtccacatcgggcaggccggcatccaagtcggcaacgcgtgctgggaactttactgcctcgagcacggcatccagcctgatggccaagtgcctggagataagaccgcgggacatcacgatgatgccttcagcacctttttcagccagactggtgctgggaaagcacggtccccgtgcaatc

SEQ ID NO: 60404 - DNA, 427 bp, Zea mays
  Clone ID: LIB3069-031-Q1-K1-D9
cggacgcgtgggcggacgcgtgggctgctgtgaataagcaactgaacgacaaagaacgtgttgcggctgcattggagaacccaaacctactggacatggtcgaagagtgcttatcaccaacatttgattgaggcctgaatatcaatatatcggtgtgacatggtgttgatgttcaggagccacacatgctcattgccaatggagttcactcctgtctttcgagaaccaaaatgccttgggtgttaagtgacgtgttgcatgatttttttcctccgccccgttcagttattatatatgctactatggcgctaccctttttggacgtttttggtgcttgtgacctcactgatcaatgcgagatgtaatcagctcttgtgctggagctttcagagtgctgtcgctgtcactgtcagtgccacgccatttt

SEQ ID NO: 60405 - DNA, 307 bp, Zea mays
  Clone ID: LIB3069-031-Q1-K1-E1
cccacgcgtccgcctgctcctcacgccgccgccgccgccgccgccgccgtcgccgccagcacatccgtagcgcccagccgccggagaagaggagggagccagcaccagccaccatgggtcgcgtgcgcaccaagaccgtgaagaagaccttcaggcaggtgatcgagaagtactacttccgcatgacccttgacttccacaccaacaagaaggtgctggaagaggtctcgatccttccctcgaagcgccttcgtaacaaggttgccggcttcaccacccacctgatgcgccgcattcagcggggccc

SEQ ID NO: 60406 - DNA, 213 bp, Zea mays
  unsure at all n locations
  Clone ID: LIB3069-031-Q1-K1-E10
tccacgcgttcgcatccaatagcagtagcagagacaaagcacacacacacacaatcgtgccaatggccgacacggccgacgccccgctcctgacaagccacgggcaggccaagcagctggccaaagcgccgtccatcgacgacaccatcgagacgtacatcggcgcgaccggttccatgcagctgctcagggccgtnctgctggcattcgcgt

SEQ ID NO: 60407 - DNA, 333 bp, Zea mays
  Clone ID: LIB3069-031-Q1-K1-E11
acacacacacacaatcgctgtctgtgttcaacacggccgacgccccgctcctgacaagccacggtcaggccaagcacctggacaacgcgccgtccatcgacaacaccatcgagacgtacatcgacgcgaccggttccatgcagctgctcaaggccttcctgctggcattcgcgtgggccttcgacgcgcagcacatgttcatctgcgtgttcacggacacggagccgcagtgtcactgcacgggcgcctcgtcgtccttcaagccggccgtacccccggcctcgccgtgcgcgctctcctacggcgcctggacgtcggacctgtcggtccaca

SEQ ID NO: 60408 - DNA, 259 bp, Zea mays
  Clone ID: LIB3069-031-Q1-K1-E12
ctgctgttgagctgaacaacaagcttcgtcaagaattggaccttctgaggcgagacatgagcaggcagcatggtggtttctcattagttttagtactggtggttgctattctgggaatactgctagggttcctcatgaagagatgagcgcatgtaatgacttatcttgtctggcttttctgaactaaacaaaattgtatgtgctctgtgtgcgcttgttgttgtacaagtcagtggtctgtttatcataggatctgatg

SEQ ID NO: 60409 - DNA, 348 bp, Zea mays
  unsure at all n locations
  Clone ID: LIB3069-031-Q1-K1-E2
gccgcagcccgcagtcgcttgcgcgcagcagcacttcgcaccgncgccccatcccatcgccggcagtgtctgctcgatccgatggctcccacgaagaagtcgaagaagagcacagagagcatcaacaacaagctgcagctggtgatgaagagcggcaagtacaccctgggctacaagaccgtcctcaagacgctgcgcaactccaagggaaagctgatcatcatcgcaaacaactgcccttcacttaggaagtctgagattgagtactacgccatgctggccaaagttagcgtgcaccatttccacggaaacaatgttgatcttggcactgcctggggcaagtactac

SEQ ID NO: 60410 - DNA, 430 bp, Zea mays
  Clone ID: LIB3069-031-Q1-K1-C9
tgacagctatgcaagttatggtggctcccaggcacctggaggaggatatgcggcttacagcggatacagtgcccgctcctctagtagtgggttatctggtcatagttctcttcactatggaaagcatcatggttattaggatttagattgcttgataaagcagccaagacattgaagtttggagcctgcttattggagccccttcccaaaccagatgaccaagagagcccaacctggaagcttaggaggactgtgtggatgccatagaccacctgatattcctcacactacattacttatgtcttcttctgggcctatgtttttagccctgccgcaaatgttctgaacctatgtatcgaaaggtcgcatttgagactgcatgtatttgcttgtttggaacctgcttcagtttagtcgtttttttgaaaaa

SEQ ID NO: 60411 - DNA, 249 bp, Zea mays
  Clone ID: LIB3069-031-Q1-K1-E3
gctgcacgccaccgtcgagcgcgcacccacggcatgggcgcagccgatatctgcagcacgatggctctactggaagcaccgctagttggatgcagaagttgccgcaaggaaagctggagcatctgcgaagcgagctgattatatcgctttagcagcgggtcacatgaacggtcgcgagctgttccaaacatgaccctgagtgttcgacaacagcttttactgagatcgtgtactgctactgaatctgca

SEQ ID NO: 60412 - DNA, 415 bp, Zea mays
  Clone ID: LIB3069-031-Q1-K1-B11
tgaagaagagggctttaaggtcctgaccttgtttaatcccattgacaagtatcctgggggtcagctcaaggagtttgagggcaagaagcttgtctctgccaccaaagagggtctgaagcttgatgagactgaggacgagaagaagaggaaggaggagctgaaggagaagtttgaggggctgtgcaaggtcatcaaggaggttctgggtgacaaagttgagaaggtggtggtgtctgatcgcgttgtggactcaccgtgctgccttgtgactggcgagtatggctggaccgtcaacatggaaaggatcatgaaggcacaggccctgtaggactcgagcatggcgggctacatgtctagcaaaaagacaatggagatcaacccaaagaaccctatcatggatgaactccgcaagcgt

SEQ ID NO: 60413 - DNA, 392 bp, Zea mays
  Clone ID: LIB3069-031-Q1-K1-B12
cccacgcgtccgtgcagaagtgtgagattatgcttaatgacttgattgactcgaatagagccaattcgaacattaaaacatctttgctgaaggcatctaaaactgttcctgggcaagaggaggcagaagtgtctcatgatgttttggatgccactataatatcatctaatttttggccaccaattcagatagaagaccttgttgttcctgcttcagttgatcagttgctatcggattacgcaaaacgatttcaccagataaaaactccacgaaagctattatggaagaaaaatcttggaacagttaagttagaactgcaatttgacggaagaagcgtgcaaattactgtagctcctgtgcatgctgcaatcataatgcggtttcaagagaaa

SEQ ID NO: 60414 - DNA, 379 bp, Zea mays
  Clone ID: LIB3069-031-Q1-K1-B2
gcctgcaggggcgaggcggcgttctgcagtctggagtgcatggagcggcacatgacgcaggaggagtggaaggacaagtgcgcggtgacgtcgatcaaggacgctgccgcgggctcggccaaggtcaagggccgccgtgccggcttcggcaaggctgggggcacggtggccgcagcatgacgacgatgctgatttgctgaacctacacctagctacctagctaccaccagcttctcctcaactagccagctgcaagctccgattattcacccgtgcaaccatctatatactaaccatgcatcatatatgatatatccccagctagctcaatcgattattaattatttgttatccggatccatcgctcatcgctgcatgc

SEQ ID NO: 60415 - DNA, 366 bp, Zea mays
  Clone ID: LIB3069-031-Q1-K1-B3
gggtttttgattttagccgccgccgctgctcatctcacatccctcgagaagacgcctggtcctggccgatcgatacgatggccgtcttctccgacctccacaccgccgacggcctcaagtccctcgaggctcacctcgccggcaaaacctatgtgtctggtgactccattactaaggatgacattaaggtcttcgccgcggtgccgtcgaagcctggcgctgagtttcctaatgccgcccgctggtacgagaccgtctctgcggctgtagcctcaagattccctggtaaggctgttggtgtaaatctgcctgcgggatcagctcctgcggcagctgctcctgcggatgaagctgaagatgatgatg

SEQ ID NO: 60416 - DNA, 378 bp, Zea mays
  Clone ID: LIB3069-031-Q1-K1-B4
agctgaagatcctacgctgcatcactcactcccacgctctgagcaacacgtagataatgatggacgcgtcggcgtacatgaaggagctgaagcagaaggtggtgaggctgaaccaggagattgcgtgcgcgcaggacgcgctgagacacaaggcatcatcctatcccacggtgaccgtggaagccctaggagtgcacgggtcgtagttcctggtgaacgtgttctacgacaagagctgcccggggctgctcgtcagcgtgctggaggccttcgacgagctgtggctcaccgtgcttcacgccaccgtggcctgcgccgacttcttccgactcgaggacgagggcggagagaacgtggcggacaacgtggacgagcacg

SEQ ID NO: 60417 - DNA, 362 bp, Zea mays
  Clone ID: LIB3069-031-Q1-K1-B5
cccacgcgtccgcccacgcgtccgcggactcgtgggcggcgcacatgctcgctggggggctcatcggcttcgtctggatccagtccggctggatgggccacgactcgggccaccaccgcatcacgggccatccgctcctggaccgcgtcgtgcaggtgctctccggaaactgcctcactggcctcagcatcgcctggtggaaatgcaaccacaacacgcaccacatcgactgcaacagcctggaccatgacccggaccttcagcacatgccgctcttcgctgtctcccccaagctgttcggcaacatatggtcctacttctaccagcggaccctggccttcgacgccgccttgaaattcctc

SEQ ID NO: 60418 - DNA, 337 bp, Zea mays
  Clone ID: LIB3069-031-Q1-K1-B8
attgccgtctcccttttgcgtgagcaaagaaagagagcgagaagagcagtcgccatgtgtggcatcatccacaagatcgaggagaagctccacatggggggcgaccacaagaaggaggatgagcaccacaagaaggccgaggagcaccacaagaaggaggagggggagcaccacaagaaggacggcggggagcataaggaaggcatcgtggagaagatcaaggacaagatcaccggcgagcacggcgacaagtccggcgaccacaaggaaaagaaggacaagaaaaagaagaaggagaagaagaagcacggccagggccacgaccacgaccacgacg

SEQ ID NO: 60419 - DNA, 375 bp, Zea mays
  Clone ID: LIB3069-031-Q1-K1-B9
gtcgcaccgcgcaagctacgtcgcgcgactccattgggcagggccgttggcccgatagagcagccaggttcatgctggatctgctgaagaatgctgagagtcacgctgatgtgaaaggcttggatgttgacaacctctatgtttcacacatccatgtgaatcaggcccagaagcagatgcgccgcacctaccgtgctcacgggcgcatcaatgcctacatgtcctcagcttgccacattgagctgatcttgtgagagaaagaagatcctgcgaagaaagaagctgacaacattgtcggatgaaggaagcagtgaagtatatcaacatgctgatcgaggccattttgacgaagcattatagccgtagctcttttat

SEQ ID NO: 60420 - DNA, 373 bp, Zea mays
  Clone ID: LIB3069-031-Q1-K1-C1
gccacctacaccgaaattcggctggaagttagtgtccgagatgggctatgatccactcggcgtgccttcgcgtggtgaaatctgcatccgggggaaatccctcttcgctgggtactacaaaagtccagaactcacaaacgaagccatcgttgatggatggtttcatacaggtgacattggagagatgaccccagacgggatcttgaaggtgattgacagaaaaaagaacatatttaagctgtcacaaggggagtatgttgcggttgagtacctggagaaagtgtatggcttccctccactcgttgaagatatctgggtatacggggacagtttcagatcaagtttagttgcagtagtcaatccacaccaagaa

SEQ ID NO: 60421 - DNA, 344 bp, Zea mays
  Clone ID: LIB3069-031-Q1-K1-C2
cacaggagcgctcgacacggggtcgccagcgccgggcgacccctctcgtcgccatcacgccccaataattcactgcccacgcccgccatcgccaccactggcgtccgcagcccgccaataataacgctcccaaagcagaggccgaaacccgcgacgcgcagcgcagggccagtggcgacctccagctccagctccagctccacacgcgggcgccaccaaggagctgagccgagcccggcactgtcggcggccatgtccgcgccgcgtcgccgcatggccactgcctccccgtcgctccgcttcctcggcctgctcaagcaacccgacgacgccagctcccagtc

SEQ ID NO: 60422 - DNA, 324 bp, Zea mays
  Clone ID: LIB3069-031-Q1-K1-C3
cacaggagcgctcgacacggtttcgccatttcctttcgacccctctcgtcgccatcacggcccgaataattcactgcccacgcccgccatcgccaccactggcgtccgcagcccgccaataataacgctcccaaagcagaggcccaaacccgcgacgcgcagcgcaaggccagtggcgacctccagctccagctccagctccacacgcgggcgccaccaaagaactgaaccgagcccggcactgtcagcggccatgtccgcgccgcgtcgccccatggccactgcctccccgtcgctccgctttctcagcctgctcaaacaacc

SEQ ID NO: 60423 - DNA, 324 bp, Zea mays
  Clone ID: LIB3069-031-Q1-K1-C4
gtagaagattctgtggatagtgatgatggaggcaagtcactaatcagagagatgccgcgatatgaagctgaaaatgcaattgctaatctggtgaaagtgtggataaaagaaagagtagacagactaaagggatgggttgaccggaatttgaagcacgagacctggaatccaggtgccaacagggataattctgctgcctcttacgtggagatgcttcgagttattggtgaaacgttggatgcatttttgcaattgcctataccaatgcatccgggtcttcttcctgatctgacagttgggctcgacagaagcctacagctttat

SEQ ID NO: 60424 - DNA, 364 bp, Zea mays
  Clone ID: LIB3069-031-Q1-K1-C5
aagaaacctatgctatcggaatacatgtttagagcagaatctagtcttcctagcataacagtgtaagaaggggcctcagaccagaatgcgccgatactgttgaaattagagataccatatttcaccgtatcatgtattcaggtcctgtatgtgaagataattgaaatgagtggttatcaggcactgctctgggttagatatatcacagtggctggtgaatatgagctgagactgatatgagttctctcttctctggctgtcggacgacttttgaagctgcaggacactaaagatacatatttgctatcgacacagcgaacagttttcattcggatgttggcctggaagtcttctgccgaccata

SEQ ID NO: 60425 - DNA, 345 bp, Zea mays
  Clone ID: LIB3069-031-Q1-K1-C7
cggcccctgggtttttttttttttttttttttttttttttatttttttttttttggtttggtttgccaaaaatctgatttaacttaaagcatcatataattatcctcaaattacaatataaacccagtctcaaaacatgctaaaatgaatcaaaaaggaccgtttacattgcctacgtttacagcaaaggacgttttcaaagggaaaccattttcccaacgagccttagccatgatgcaggaaaagcttgccattcttgtcacaaaatgcccctacttaaatctctgcctcattttccggggctttcttttgagcctccgcattcttttttttttccacttggcc

SEQ ID NO: 60426 - DNA, 375 bp, Zea mays
  Clone ID: LIB3069-031-Q1-K1-C8
cccacgcgtccgtcttgatccagccaagccagggatcgccatgtcggactcggaggaggaccacttcgaatcgaaggccgacgccggagcgtccaagacctacccgcagcaggctggcaccgtccgtaagaacggcttcatcgtcatcaagaaccgcccctgcaaggttgtggaggtttctacctcaaagactggtaagcatggccatgccaaatgccactttgttgccatagacatattcaacgggaaaaagctcgaagatattgttccttcgtcacacaactgtgatattccgcatgtgaaccgtactgagtaccagctgattgatatatcagaggatggatttgtgagcctttctacttcagatggcaacac

SEQ ID NO: 60427 - DNA, 359 bp, Zea mays
  Clone ID: LIB3069-031-Q1-K1-B10
gatggtgttggtggttgggcagatctcggtgtttatgctggactatatgctaaggagcggatgagaaattcaatgagcgctatcaaagatgagccagaagggaccattgatccaaccagagttttggaaaaggcttatattagtacgaaagcaagggggtcatctaccgcgtgtatcatcactcttaaagatcagggtatccatgctgtaaatcttggggatagtggtttcgtagtagtccgagatggccgcactgttctcaagtcacccttacagcagcatgatttcaattttacttatcagctcgagagtggaagtggcagtgatctttctagtttcgcacaagtatttcacttttc

SEQ ID NO: 60428 - DNA, 384 bp, Zea mays
  unsure at all n locations
  Clone ID: LIB3069-055-Q1-K1-H12
accggaanggaagggncgacccgagcgagcggntgctcagaactgctgggtgaagaagggttgtgcattcactggtgaaattagtgctgaaatgctggtcaaccttggcgttccctgggtcattcttggacactctgaaaggagagctctgctgggagaatcaaatgagtttgttggagacaaggttgcttttgctctgtctcagggactaaaggtcattgcatgtgttggtgagacccttgaggagagggaggctggttcaaccatggatgttgttgctgcacaaacaaaagcaattgctgagaagatcaaggactggagcaacgttgttcttgcctatgaaccagtctgggctattggaactggcaaagtcgccaccccagc

SEQ ID NO: 60429 - DNA, 443 bp, Zea mays
  unsure at all n locations
  Clone ID: LIB3069-055-Q1-K1-H3
aacaattttatctcatgggaaagaagttcacacagactattctgttactggcattcctggggatggaagatgcctgtttcgttctgtggttcacggtgcctacattaggtcaaggaagcccatacctaatgaggatcatcaaagaaggctagctgatgagttgagaacaaaggtcgcagatgaatttatcaagaggcgggcagagactgaatggtttgttgagggggacttcgacacgtacgtatctcagattaggaagccacaagtctggggaggcgagccagagctgttgatggcttcacatgttcttcagatgccaatcaccgtctacatgcatgataaagccgctggtggtctaatagcgatcgcgaaatacggccaagagcatgggacggaaagctccgtccaagttctttaccatggntatggccattatgatgcgc

SEQ ID NO: 60430 - DNA, 455 bp, Zea mays
  Clone ID: LIB3069-055-Q1-K1-H4
gacccacgcgttcgaacaatcgtatctcatggcatagaagtacacacttactatactggtactggcattactggtggtggaagatgcctgtttcgttctgtggttcacggtgcctacattaggtcaaggaagcccatacctaatgaggatcatcaaagaaggctagctgacgagttgagaacaatggtcgcagatgaatttatctagaggcgggcagagactgaatgggttgctgagggggacttatacacgtacgtatctcaaattatgaagccacatgtctggttaggcgagccagatctgttgatggcttcacatgttcttcagatgccaatcaccgtctacatgcatgataaagccgctggtggtctaatagcgatcgcgaaatactgtcaagaacatgggacggaagctcccgtacaagttctttaccatggttatgggcattatgatgc

SEQ ID NO: 60431 - DNA, 454 bp, Zea mays
  Clone ID: LIB3069-055-Q1-K1-H5
cccacgcgtccggcaaaagcaacaaggcagcagcacaagcaagaaccacacctcctcggtgcgcctgtgatcatgtcgtcttgctgcggcggcaagtgcgggtgcggctccagctgctcctgcggcagcggatgcaacggctgcggtatgtaccctgacgtggagaccgccgccaccagcagcgtcaagaccacggtcctcgccgcgccgaccaccaaggccagcgccggcggcttcgaggcggccaccgagggcggcggctgcgactgcaacacctgcaagtgcggcaccagctgcggctgctcctgctgcagctgcaactgagccggcccggctcggcgatggcgcacgagagtcgagaggacgacgacgaggaggcgtataataaatataatagcggcgtccagtaaataagatcctgtcaactgcacccgccattatccatggtcgctcg

SEQ ID NO: 60432 - DNA, 381 bp, Zea mays
  Clone ID: LIB3069-055-Q1-K1-H6
gggaatattcttggtttttcagctggagctagtggcgaatggcacaagtggtttccattgctaacgacaagagcatgctgtgaagcttgcggtaattcgaaagtagctttcttagttgcatgagtatttctttcgttatgtatgtctgttaccctgtacttcgctgaagagagcccactagatccaaaagatacacactgactatcagattctgctactctagtgaacggttctagaaatgctgcccatgcatcaaatgatccaaatgatgcaagattttctaatggcccatgtggtttaaacaatggtgcggctaacaacaacactgacgaatttaccaatgtgaatttcaactcagagaatggacgagtcttcaatgat

SEQ ID NO: 60433 - DNA, 413 bp, Zea mays
  Clone ID: LIB3069-055-Q1-K1-H7
cggacgcgtgggcggacgcgtgggcggactcgtgggctccgccgccgacaacagcgtggggtagtgtagttccggagagggttggcgagagtagtagtgatccgcaatgtcgacggaggaggctgttgtggctgaggtcccggtgaccgaggtgccagcggaggtcccggcggcccaggtggccgaggcgcccaaggcgaagaaggcgcccaaggagaagaaggcgcctaaggagaagaagctttccgcggcgaagaagccggcggcgcaccctccctacgctgagatgattgtagaggcgatcgctgccctcaaggagaggaaggggtcgagctcggtggccatcagcaagtacgtcgaggggaagcatggcggcaagcttcccaccaacttccgcaagcagctcactgtgc

SEQ ID NO: 60434 - DNA, 309 bp, Zea mays
  Clone ID: LIB3069-055-Q1-K1-H8
ggacgaattttctaagttccaaaactttttttcatccaaatttcggggaaactgagttaggctgcttgagtgacgcctaggtatctactctggaacgtgtccttgtaaatgccttaatggtcaatctgagttttttttccccttgattattcttcgctcatgtatgtttccaaattccaaggtagcggtctgcgagagttgatgattctaccttgacatatcgaacccaatttgtaaataaggcgagcagcttgtacttcgttcaactgactggatcttccgagttttacccacagaccgagccccgta

SEQ ID NO: 60435 - DNA, 407 bp, Zea mays
  Clone ID: LIB3069-055-Q1-K1-H9
atcctgagccagagatcaaacaaaccagatgttagctaagcatggcggcaggcttgcaggtgtggggggagccggcgtctactgatgtctgcagggttctgacatgcctgtttgagaagaaactggagttcgatcttgtccgcatcgatacgttcaagacgcatcacaagcttcccgagttcatcaggcttcgggatcctaatgggcaagtgaccttgaagcacggcgacaaaactctcgttgattcgagggacatctgccggtacgtctgcacccagtttccaaacgatggaaacaagagcctttacggatccggcgctctagaacgggcgtcgatagaacagtggcttcaggcggaggctcagaacttcgggccccccagctccgcgctcgtctttcagctggcg

SEQ ID NO: 60436 - DNA, 364 bp, Zea mays
  unsure at all n locations
  Clone ID: LIB3069-056-Q1-K1-A10
cggacgcgtgggctgcattctcaagctgggatgcttttaaatctcactacattttgcggatgggttgggcgctcgctatatcacgcactcgtcgttttcttcattacgatatgcgcctactcagatgagaaaagtgagatgcacgaactgtcaatggtagcactgtccggttgcatttggttacaggcttttgttgtgacaatggatacaaactcattcacttgcccgcanatccttctcatctggggaaactttgtggccttctacatgatcaacttaatactcagtaccgtcccaagtctccaactgtacacaatcacgttccgcctgtgtagccaaccttcctactgnatctccatggctc

SEQ ID NO: 60437 - DNA, 428 bp, Zea mays
  unsure at all n locations
  Clone ID: LIB3069-056-Q1-K1-A11
tttgtgttttcatgtgcttcaaggtgttaggtaagaatgcagacgaggaaaccatagggacggcctacagccaagttctatcaccctgatggcccanaactcatgttttgctaagtcttctccacctaagtcctcaaaaatttgaacaaggccatattatcagataaaagcagatgtagctttcataggacttagttccagcaaagcaaaggttgacattgcaccaaacaatagcgtctatacttcattcttatggcttggagaagcctatgcaacatgacaagccagatgacatgtagatgagaaggttctgcatcaagagaaaccaaagcaaaatctttgcatcaagagagcaccgatgaaaagctgatgtagaggccagntgacaaacttatggaagaccagctgaccaaataattgaaaatcta

SEQ ID NO: 60438 - DNA, 231 bp, Zea mays
  Clone ID: LIB3069-056-Q1-K1-A12
gtcgtgtccgttcgcgatcgggcaaatctgcaaccctttcctcttcgtccccccgctcggtcggtgccccaagccggagtacggagtacggcaatcgcacccccgtcgtcccgttccttgctcgccccaacttcgccgccgcgtacccctcggcttctagtgatgtctggtggtaacgcgtgggcgccgctcccttcgcacggatttgaatccgactccggcggcatgggg

SEQ ID NO: 60439 - DNA, 455 bp, Zea mays
  Clone ID: LIB3069-056-Q1-K1-A2
gtcggcgcgtgagcagcggtgggcgccgttcgggacgcactttcaccagttcgtggtgccggccaggatcggcttccggcgggactgcacctacggcaagctggccgccatgaggctgcccaaggacgtgcagggcctcagctcctgcgagtacacgatggagcgcggggtggtgcacgcgtgccacgccggcggcgtggtgcacttcctggaaggctggggccaccacgaggtgggcgccatcgacgtcgaccggatcgacgtcgtctggaaggcggcgctcaagcacgggctggcgccggtgtgatcatatcgcatcgtcgagccgcaccgcgcgcgcggtttgttttgcagcggctacctacctagctgcatatgcttgccaggccggtgtccagccgtcgcggttctgtgtgcatgcatgcaacagcccagcagaccacgggctaccgtgc

SEQ ID NO: 60440 - DNA, 450 bp, Zea mays
  unsure at all n locations
  Clone ID: LIB3069-056-Q1-K1-A3
cggacgcgtggtcggacgcgtgggcctggattgtcacagatggcaggtatattgatcaagagtggtgagctattctaaggaagcttgtgaacaatatacctgctgtcctggagtgtcacagatggcaaagatttgcgcttagggaaggaggaagaatggtcggtgctggagtcgtctccaaagttcttagctgatcagtttctactttcttctccgtagtctggttgcaactgttgatggttagcacattctttatcttcaattattggaagaaacatttttgcgccaattacatgaaagtggttgcagttttaagggtctgttcaatccctctccaagatattgtaagtgtatgaaatcttctaagcaaactgttaaatacattgcacccgatcaggtatataagcanagactgtattctctcattactagacaaaaaaaatgaaagga

SEQ ID NO: 60441 - DNA, 305 bp, Zea mays
  Clone ID: LIB3069-056-Q1-K1-A4
ccactcgtcctcccacgcgttctcccactcttgctcctacatattctcagatggcatgcatattgatcaacagtcgggttctattctaacgaagcttgtcaacaatatacctgctatcctctagtgttacagatggcaaagatttccccttaatgaatgaggaataatagtccgtgctctactcgtcttcaaagttcttagctgatcaacttctactttcttcttcgtagtcatgttgcaactgttgatgcttagcacattctttatcttcaattattgtaacaaacattcttgctccaattaca

SEQ ID NO: 60442 - DNA, 318 bp, Zea mays
  Clone ID: LIB3069-056-Q1-K1-A5
atccggcgcaatacaatttcttgacatgactggaatgctaaatctggagtctacgcgcagggcagcaagatacacctgaatcgaagtgaacactccgatactggacgcattactcacgctcatgtgcctacatcaacatcctcaacggatatacaactgggtgcttctacgtcgatgggagcagcacgacattttaacgattacgaagacatattgcaaaaatggcacatattaacctaactactggattcacatgaaggatgcagtgatccttcttaaactggactgaattgcacaatatgccctgtgaaatctaaa

SEQ ID NO: 60443 - DNA, 265 bp, Zea mays
  Clone ID: LIB3069-056-Q1-K1-A6
ctgacgcgtgggcggactcgtgggcttacgtttagtccgacgcctgggctgactcggggggtcgatcgccaataatggagtttccgtaccaccaccactaccacagccatcgccgatactactacgaatacgaccgcataggcccgcctcccccggtctactgcggctacggccagccaccgacacccgacccgtacggtcgcgcgcccgttgaccccgatccgtacggtcgacctccgacccagtccgtgtacatgagggccgg

SEQ ID NO: 60444 - DNA, 249 bp, Zea mays
  Clone ID: LIB3069-056-Q1-K1-A7
gagctctgcgcgagcaacccgaggttgtcttcgttctcggtgctcatggtgacgtgtctggtgttcatcgcggcgacggtgtgtgccttctacgcgctgtgcctccgcgaccagctgagctactccttcactggcggcgaggtcctggcgcgcgccgtgtccgacctctggccgctcctctgcgacacactcgtcctcaacggcctacatgcagtcctatccgacgtcctcatgccctactcatggcag

SEQ ID NO: 60445 - DNA, 297 bp, Zea mays
  Clone ID: LIB3069-055-Q1-K1-H11
gggccgcactgcgcaacgagcgggcgccggtcggtcgacgaagcggcgaggcagtcactcgggagagatgtcgggcggcaggaggagggggcttgtgtggagcctccccgtggcgaggtcggatgcgctcggaaaactgggccctgccttcggcatcggcgccggctgcggcgtgggtcttggcttcggcctcatcggaggtgcaggcatcggagctggattccctgggttacaattggggtttggagctggagctggatgtggaatatgaataagttttggttacggctttggaaa

SEQ ID NO: 60446 - DNA, 133 bp, Zea mays
  Clone ID: LIB3069-055-Q1-K1-F5
cccacgcgtccgcccacgcgtccgcccactcgtccggtgttactgtatgatggcaaggacgttttgctgccgaaggttatgttttgaagttcatgctaccttttaaagtacggattaccttgtgcctatgttc

SEQ ID NO: 60447 - DNA, 433 bp, Zea mays
  unsure at all n locations
  Clone ID: LIB3069-055-Q1-K1-F6
cccacgcgtccgcccacgcgtccgcccactcgtccggccacgcgttctgcggattctgcgggagatcaagcttatgagactcctaagacatccagatatcgttgagagcacacatattatggtgcctacatcaagacgggaattcaaagatatttatgttgttgatgaacttatggagcctgatcttgaccacgttatcatggctaatgatgacctgacactggaacattatcagttctctctgtaccaactgatccgtgctgtgaaatacatgcacacagctaacgtatatcaccgggacctgaagccaaagaatatattagcaaattctaactgcaaactgaaaatttgcgattttggactagcacgagttgcattcaatgataccgccacaaccattttctcgacagattatgttgcaacangatggtac

SEQ ID NO: 60448 - DNA, 432 bp, Zea mays
  Clone ID: LIB3069-055-Q1-K1-F7
cgcacgcgtgcgttcgaggagggcacccgttatcgtccctatggccactgcctcgtcgcggggggcgtcaagtacccaaagaaggtgatccgcaaggactccgccaagaagactgcgaagaagtcgcgcgtcaagtgcttcatcaagctcgtcaacttcactcacctcatgcccacccgctacaccctcgacgtcgatttcaaggatgtcgccaccggtgggcccgacgcactctctacccacgacaagaaggtcgccgcctgcaagacggccaaagcgcgccttgaggagaggttcaagaccggcaagaacaggtggttctttaccaagctccgcttctagatgctcggccttccgaatagtcctgctttagctgtcgatttgtttgatcgggcacactccatctctgttttcgtttaccatgaatatttc

SEQ ID NO: 60449 - DNA, 455 bp, Zea mays
  unsure at all n locations
  Clone ID: LIB3069-055-Q1-K1-F8
cccacgcgtccggaagaatctttactgggttgacagtggtgatttagtaacaattgcaagggatacgtcattctacattttgaaatataatagggatgtagtttcatctcatttagacggagggggttcagctgctgaggaaggtgtggaagatgcctttgaactgcttcatgagatcaatgaacgtgtccggactgggctatgggttggtgattgttttatctacaacaattcttcgtggcggcttaattactgcgtangaagagaggttacaaccttatttcacttggatcggccaatgtatttactaagatatcttgcaaaccaaagccgtgtctatcttattgataagcaatttaatgttgtggggtatactttactccttagtttgatcgagtataaaacacttgtaatgcgtggggattttgatcgtgcaaatgatgttttatcatcta

SEQ ID NO: 60450 - DNA, 348 bp, Zea mays
  unsure at all n locations
  Clone ID: LIB3069-055-Q1-K1-F9
gacccagcgtccgcccacgcgtgcgcnnacacgtttatgcaggtttattccgtcagtgttgagactgttctcatgggaagatatattcaagtcatggaccatgactccttgacagntgtcaaacttaagatgacactgtgagctgatgacaatagtgataccagccactacaacgttgaaactaccataaaacctcaatgcctgcatcaagtttaatctgtggcattctttcaaactccacatcttactgcatgaaagcatccaaagctggtgtgtctatgccgctatatgccacaatcatgtgagacggaaagaacaagacaaagcaaggaacagattgaaacaaat

SEQ ID NO: 60451 - DNA, 304 bp, Zea mays
  Clone ID: LIB3069-055-Q1-K1-G1
cggacgcgtgggcggacgcatgggcggacttcgttggcggactcgtgggcggacgcgtgggcgagatgtgtcgttcgttgtatcatgtatgggtgtttatggctttcggtctactagatttttgtgagaaaaaaaaagcttaataaaacacaaaaaattcactcacctaatacccacccgatacaccctagacgttaaaatactatgatgtcatcaccggagggcccaaaaacactctctacccacgacaagaatgtcgacgcctgcacgacggccaaagcgcgccttgatgagatgttcaatg

SEQ ID NO: 60452 - DNA, 416 bp, Zea mays
  unsure at all n locations
  Clone ID: LIB3069-055-Q1-K1-G10
tcgtccacgcnnncnnncacgcgtncgnccacgcgtccgtccacgcgtccgcttttgttgagtttgttcgtgctgagggtgccatcatggctctgaattgcagcgggatgattttgggaactctgcctgtcagggtgagtccttctaagactccggtgaagccacgtgtaaatcgaatgggatctaactgactctgcctaagctcaaccggaaggcatggccataagctgaaggcttccgtggtcctgtgcatcatgatgcatttgcttacattcttacaaacactctgtttgtacccttttgcaaacctgttgngagggaacttggtaggtcaggcccttttgccttgcattttaaacatgatggaaccattgagaatgactattccgcaattaaccatcaaaagtacttctgtc

SEQ ID NO: 60453 - DNA, 262 bp, Zea mays
  Clone ID: LIB3069-055-Q1-K1-G11
cactgccaggagagcttgctgcacggtctgatacgcgtggatgagctgtaccgttcttacaaagtctgtacacgcgggatggacttcaatccgggagcatcctaccagacaacttatcacccgtctagtagtgtttatggtgaaggcattcagaggccagttttggcaaggggtaatggcccaagtgtgcctgtgtccagccgttattcctttaatggcccaccagcatattgatggattgcctagatgcaagcactcaaat

SEQ ID NO: 60454 - DNA, 419 bp, Zea mays
  unsure at all n locations
  Clone ID: LIB3069-055-Q1-K1-G12
cggaatggaangggncggagcccgacgccgtccgcacttgnnagtgagcatgccanncannggagcctgtcttagcttatgcctnnagtacaggtngnngagtggaagtgtggtggtggggatgtgtcaaaccccaaatcagaaccgaanaaaaaagaaaagcagcagctagaagaaagaagaacacccactctaccagcagcaagcaggcaatcaagcaaccagcanntaacgaaatgtcgatccaagtacctgcgaccagcacaanggaccctgcgagcggcagcgtctgtaccgtcgcttctgcgccgccctggtgggcgtcatcgtgctcgtcctcctcatcgtgctcatcgtctggctcgtcctccgccccaccaagcctcgcttcttcctcaacgacgtgagcatcgtgtgca

SEQ ID NO: 60455 - DNA, 183 bp, Zea mays
  Clone ID: LIB3069-055-Q1-K1-G2
cggacgcgtggggttttgcgtggtcagattcttatcgcatcactggtagaaaacattcggctgtgggactaaaaaaattaactagaagacagcagagacaattgtagcactagcataccaacgacagattgcataatatcataagtggtaagacccacagaacagacccgatgtattctctct

SEQ ID NO: 60456 - DNA, 387 bp, Zea mays
  unsure at all n locations
  Clone ID: LIB3069-055-Q1-K1-G3
aagttttgagggtagagcagttgggtgattacgacgaagagagatgggcctcctcgacaagctgtgggacgacaccgtcgcaggcccgcgcccggacaccgggctcggccgcctccgcaagcagcctgtgcgtcccgccgccgtcaagatcagtgatccggccggggacgctgcggcgttcgtgccgccctcgccggcttcgggtagcgaggagacgccggtgaaggtgacgcgcagcatcatgatcaagcgccccgcggggtacccgtcgtcgccgaggagcgcggcaagcacgccgtcggcctcgccactggggactacngccgccatctcgccgtttgccggcgccggtggtcgcttcagaaggaaatcatcgtccgacgcata

SEQ ID NO: 60457 - DNA, 112 bp, Zea mays
  Clone ID: LIB3069-055-Q1-K1-G4
aaagacggccgaccgcggagaaaagtttagtgcacttctagacacgacttgtgagctacatagtcaggcccatgagttcaagaaacagggggtgtagattcgtcggaagaca

SEQ ID NO: 60458 - DNA, 456 bp, Zea mays
  Clone ID: LIB3069-055-Q1-K1-G6
cggacgcgtgggtaaaacgttaaaagtgcttgcccaagtttcagaagttaaaaatatgaggttaaacaacatagaaaagactttggaccgcggagaaaagttgagtgaactccaagacaagacttctgatctacatagtcaggcccaggagttcaagaaacagggggtgaagattcgtcggaagacatggctgcagaacgtgaaaattaagctggtgattcttggaatccttttgctccttgtgatcatagtctgggtatctggttgtcaaggctttgactgcaccaagcatgaaacatagtagtaataagaatggtgcaacacgactgtggcagagctgcgatggatgtgagtttgtgctggtgaagtcaagtgtgtacccacatatgctttggctctcaagttcgattccaccagacaagtatcacggtacaaatgtaagtccgagctggtctt

SEQ ID NO: 60459 - DNA, 452 bp, Zea mays
  Clone ID: LIB3069-055-Q1-K1-G7
gaaacaataacttaggtcatctgcgaccactctgagcctgggagtcaagactggcctgccagacatctggcacagcaaggctagcaaccccttcgttaacttgaagaaggaatacaagggcatcttctggcaggaggacatcatccccttcttccagaacgtgaccatccccaaggactgcgacaccgtccaaaagtgctacatctacctctctggacaagtgaaggagaagctgggcacgattgacccctactttgtcaagctcggtgacgccatggtcacctggatcgaggcctgggatgagctgaacccgtcgacccctgccgccgcaaatggcaaggccaagtagatgtgccatcacttcggcactggagtgaaaaagaaagtatgattgggtcctgcctaggccccatagatatagctcttttttgagaaggaagagagattaattc

SEQ ID NO: 60460 - DNA, 459 bp, Zea mays
  Clone ID: LIB3069-055-Q1-K1-G8
cccacgcgtccgtccacgcgtccgagtcctactaccgactaagaccgactcagctggggggaccctcaaaccgcaccagccatggacgggccgcgttggacggaagaggtggacgacctggtcgacgccggcgacgtcgacggcgccatcgtcctccttgagtccgtcgtctacgatttgtcaacctccgctgctccccctgccactgaccttcgactcgccacggcgctcggcgacctcgcggacctgcacgccgtccggtgagacaccctccgagccgacgagctccgtgcccgcgccatccgccttcggtcccgcgccacggtccctgggactgggaccctagggtttggttccccccctcgtagtccttggtgctcttggaaatcgttggtggaagcccttcgctcaggcctcatgtttcaactgcttagttattgctctattgggctattatta

SEQ ID NO: 60461 - DNA, 259 bp, Zea mays
  unsure at all n locations
  Clone ID: LIB3069-055-Q1-K1-G9
acaccttggctacctgatcatggggagtttatcttttagatagcagggtagtctcaccaccgccagctgtacattcctctgtgcctagtttccttgnanagatgtatctggttaataactgataaattcgtcattgatttgatgtagtgaattttccccataggaacgctccttcttctgtttcatgtaaatgcaaaacaattccaatcttgaattcagaaatgggttacaggcttgttgcaaaaaacaaaaaccctaa

SEQ ID NO: 60462 - DNA, 350 bp, Zea mays
  unsure at all n locations
  Clone ID: LIB3069-055-Q1-K1-H10
cccacgcgtccgcggactcgtgggcggacttttgtttgaacagattatcccacaactgatgggacgggcataatagattatattgatgtcacanatttagttgatgctcatgtgaaagcactcaacaaggcagagcctagaaaagtcagcatttacaatgttggaacaggaagaggtcgctcggttaatgagttcgtcgatgcctgcaagaaggcaactggggttaacatcaaaattgagtacctcagcagaaagccaggagattatgcagaagtatatagcgacccaacaaaaatcaacaaggagctcaactggacagctcgatatactgatctttaagagagtctgtc

SEQ ID NO: 60463 - DNA, 432 bp, Zea mays
  Clone ID: LIB3069-055-Q1-K1-F3
cggacgcgtgggttcgaggagggcacccgagaccggccctatggccactgcctcgtcagcaggccttgccaagtacccaaagatggtgatccgcacggactccgccaagacgactgcgaagaactcgcgcgtcaagtgcttcatcaagctcgtcaacttcactcacctcatgcccacccgctacaccctcgacctcgatttcaaggatgtcgtcaccggtgggcccgacacactctctacccacgacaagaacggcggcgcctgcaagacggtcaaagcgcgccttgaggagaggttcaagaccggcaagaacaggtggttctttaccaagctccgcttttagatgctcggtcttccgaatagtcctgctttaactgtcgatttgctggatcggacacacttcatctctgatttccgattaccatgaatatt

SEQ ID NO: 60464 - DNA, 141 bp, Zea mays
  Clone ID: LIB3069-055-Q1-K1-D4
accactcgaccgagtactctcaataccacttgtttcagggccaaccacctcatccttgtggcggccttctagtgctgcgggggatcccaggtcaaggacatggtggtaatagccgcctgctgcttctgatagcagcaaagc

SEQ ID NO: 60465 - DNA, 450 bp, Zea mays
  unsure at all n locations
  Clone ID: LIB3069-055-Q1-K1-D5
accattttgacattgacctaaacatacctgcagcaccaatagacgacggcccagtggagggtaacagaattgcagtgtgtcctagtgttgttatcaaggtacaaacagagaaaccatatgaaatagatacaaacaaggtaaactcaaatgtgatggagacaactgaagaacatgatccatccagtgcacccacacaaaaggttatccctgattttaacatggcagacttgaacacaatggatgaatctaaacttcgcacaatcctcgagcatacatcatcattgttgcaagcacttgctgaagtaaaaaatggggagtccaacaactgtgaacaggctaagtcaagctttgaagataagaaagtaaacatggcatactctgacggngccaccaaatctgagtgcgattagcagtagcttgcaagatattgatgtttatacgctaaactgg

SEQ ID NO: 60466 - DNA, 433 bp, Zea mays
  Clone ID: LIB3069-055-Q1-K1-D6
gagctctgagctggttgctgccgccaggattggaggagtgcgcgcgcgcgcaagtgagcggtcactgagctgtggacgtgaattgcgatcatccgttctcgctttctggggctcggctgctgtggccatggcgccggcgccgtcgccgtacgcgcgggtgatggaggacatggtcaagggccgggagtacgccacgcagctgaaggcgctgctccgggagtcgcccgaggccagccgcctcgtggaccggatcttgcacgccatatccctcaccatccagacggcctctcgggcgtggcgcacttggggtacgacgacacgttcgatctggaagacattgtgttcggctccatcaccggcggcatgtatgctgctgagtactgacggccggacgacgactgctcgacctgctgtgtgttggaggagagtagga

SEQ ID NO: 60467 - DNA, 407 bp, Zea mays
  Clone ID: LIB3069-055-Q1-K1-D7
gccacgcgtacggccatgtggaggagggctttagcgatggtcctgttcatggctggggcggcgctgctcgccggggctgccggcgccggcgcgcagcagggcgtgtggagcatcatcacccggcccatgttccagagcatgctgagccaccgcggcgacagcgggtgccagggcgccttctacacctacgacgccttcatcgaggccgccagctagttccccggcttcggcaccaccggcgacgagcagacgcgcaggcgggagctcgccgacttcttcggccagacgtcccacgaaaccaccggtggatgggcgactgctccggatggaccgttcgcctggggatactgccgggtgaaggaacagaaacagacggacccaccctactatggacgaggacccataca

SEQ ID NO: 60468 - DNA, 427 bp, Zea mays
  Clone ID: LIB3069-055-Q1-K1-D8
cccaatctcccctacaccagaaaaattcctagttctttggtccgcgtcagagaggcggcggcgatgtctgggcgcggcaagggcggcaagggtctgggcaagggcggcgcgaagcgccaccggaaggtgctccgcgacaacatccagggcatcaccaagccggcgatccggaggctggctaggaggggtggcgtgaagcgcatctcggggctcatctacgaggagacccgcggcgtgctcaagatctttctcgagaacgtcatccgcgacgccgtcacctacaccgagcacgcgcgccgcaagaccgtgaccgccatggacgtcgtctacgcgctcaagcgccaaggacgcaccctctacggcttcggaggctaggctaggcgcctcttcatagtcggggactggttaggggacatgtctctgtgtg

SEQ ID NO: 60469 - DNA, 148 bp, Zea mays
  unsure at all n locations
  Clone ID: LIB3069-055-Q1-K1-D9
ggggaaggaaatacataactntaacttactcattaatttttacacacgcaattacttataatctgccttgcggatttacaacattttgcatccttcccaaccntgctcttaataatacaacacttaatacctatcacaaccaattctt

SEQ ID NO: 60470 - DNA, 366 bp, Zea mays
  Clone ID: LIB3069-055-Q1-K1-E1
tcggagaagtattcggtcttgaagcgacctccttgattctaatatttgagatgccatcaagaagctgttgcagtggtctatatgtcattgacctgtcaaatgtttgtttgagttaacttgcaaatggaattgtgggatcctacattggctaaaggaattaagattttcttagcaacatcaactccactctttggacacgtagctactaattacaccgtgaactaccagaaggccgctattcagttgagctgcagtggcaatggatatggaatgcatgcaggcccttcgccaccacgcagagcagaagccagcaaatttgatgatgatgttaatccacgttacactcatggatatcaagggggtggt

SEQ ID NO: 60471 - DNA, 157 bp, Zea mays
  unsure at all n locations
  Clone ID: LIB3069-055-Q1-K1-E10
cccacgcgtccgcccacgcgtncgatgccgtttgcgtaagatctcgccacaaggaggtgttgagctgttgatggtaaattaaaattcaaatgttgcaaaaaatgttttaacaatctgtgctatttatttgtgaatagaacgcacatttgttactact

SEQ ID NO: 60472 - DNA, 313 bp, Zea mays
  Clone ID: LIB3069-055-Q1-K1-E11
accacgcatacgactaaaacgaactcttaatccacaaatggaccttaacaccatgtatgggcggcctgacgctctgacaaacttccatctcggatgtttcacatgccttgtcgtcagatttttctcaaactcactcacattctgcatatattgtataacaactaacagatggctctggccacagatacacagacacatggtgtcatggcggtacccacggtcttcctgttgaaaacgcacatatgcatgccaaccgttctggtaccccatgtgatccaaaggaaaccacaatatctgctaccgtgcctgatgg

SEQ ID NO: 60473 - DNA, 299 bp, Zea mays
  Clone ID: LIB3069-055-Q1-K1-E12
cacgaaggccaccacccaccatcacccccactaaaaaagcgaaccgagggagaggaaggatcggcgcgttccggccggagatgaggggcggatccagaccggccccggtcgtcctgtttctcctcgctgcgtccgggatctgcgcccagttcaccgcagtgctagctggtgatccccaaacatccaacgatgataagaaggctgaagctcagccaaagggccataccggcaaaacagttttgttcgtcctcctaggagtgggggctgtcattctgttgtcatttgttattatcaagtat

SEQ ID NO: 60474 - DNA, 351 bp, Zea mays
  Clone ID: LIB3069-055-Q1-K1-E3
cccacgcgtccgcggacgcgtgggtgcagccttcttgattttgttctaatctcaaaggcgggtgataactcttccaagcctactccagacttcgaactactttctcatcacacatgtcattgcagtgctctaagccagaaccctatatggtggcttatggaagggcctcggacaattagtcatgatttctcaaagtcttattgtgaggctaacctccaattggtcattcacaattcagaagctcataagattttggtgagagtggtcacttttgatgtaattccagagaaaactgttcatcctcatgactcaaccagtgctcaaggtggatggtatgatgtatcactggaa

SEQ ID NO: 60475 - DNA, 195 bp, Zea mays
  Clone ID: LIB3069-055-Q1-K1-E4
cgcgtccgcccacgcgttcgcagacacacctacacatgcttttttacagtattccatacaatacacggcgactactttgccatgcctactccccacttataactactcaccaaacacacataccagtctacccctctatgccagatccctttatggccccaaatctattgatcatcaccaaacagacatgagttt

SEQ ID NO: 60476 - DNA, 430 bp, Zea mays
  Clone ID: LIB3069-055-Q1-K1-E5
gcaagacatctatttggtgctgtagagatgcgatgggttgacacttacttcccatttgccggcccatcctttgagctcgaaatatactttcaggatgattggttggaggttttggggtgtggagtcaccgagcaggaaattttgaaaagaaatggcaggagggaccatgtggcttgggcctttggattgggcttggagcgccttgcaatggtcctttttgacattccagatattcgactcttctggtcgaatgataaacggttcacgtcccagttctcagaaggcaagcttggtgtcaagttcaagccattttcaaagtttcctccttgttacaaggatatgagtttctggatcaatgatgcatttacagagaacaacttatgtgaggttgtcagaggaattgctggtgatcttgttgaggaggtaaaac

SEQ ID NO: 60477 - DNA, 430 bp, Zea mays
  Clone ID: LIB3069-055-Q1-K1-E6
ggtcaagcaaaatgtacattggaaagctgtcgacgaatctactcggcacaaagattgcaagatatgatacccaggccccatgcaatgcagcagaacccgggaaaacaagccgtcggttctactcccggaaggtgtcgacaaaggtctcctacatcacctacaacataacgcaggtttcatatgagctgaatgtcttgagtactcggggccctaggcggatgaactgtgatatgcactacattcctacctcgtgccttgacgctggaggcactgttcccagccagctggacagcatgcttgctcgctctactgatgagtcatttggcagcatttccttgttcaagtcatctggagcggaccggcctatgcgtttcaccagctcaagattcttcgacatctcaatgagcagcatccgcatgattggagacac

SEQ ID NO: 60478 - DNA, 384 bp, Zea mays
  Clone ID: LIB3069-055-Q1-K1-E8
cttatctgttgttgagaaggcctgtctgatcaccaacagctgtacagtctccctgacagaggagagctttgggaaggatttatgccctggagtcaccaaaacactcgccatcgaagcggaatgttcttagtgacctacggagtacgaagtgtctcggtgtgcatctaggttccactgcaagtatgcccgtcaaaattctaaaactgtagtgcttgttgcacggcaatgctattgtaacctggatttgaatgtatccatctgagctaggttatgtttcaggagctttcttaaactaacgttgttgctgagcagcatgaaatctgattagcgcaaaaaaaaaaaataataaaaaaaataaaatttatatgtattttaatataaaaa

SEQ ID NO: 60479 - DNA, 338 bp, Zea mays
  unsure at all n locations
  Clone ID: LIB3069-055-Q1-K1-F10
ggaataatctcnttcttcactctcactaacaccagtctagctaactctttctctcctgcaataatggggcgcgcgctcctcctcctcccagccgcagctggtcgcggcggcggcggtcctggcagcggcgctgctgctgctggcggcggnggccgggacggcgtcngcggcggtgagctgcggcgaggtgacgtcgtcggtggcgccgtgcctcgggtacgcgatgggcagcgcggcgtcgccctccgcggcgtgctgcagcggngtgcgctcgctcaacagccgcgcgtcgtcggcggcggaccggcaggccacctgcaactgcctcaagagcatga

SEQ ID NO: 60480 - DNA, 301 bp, Zea mays
  unsure at all n locations
  Clone ID: LIB3069-055-Q1-K1-F12
cccacgcgtccgcccacgcgtccgcgctcgttatcgtcgtcaagcccattatctataacacgagcaggtacatcaagggggagctcgacgagctcgagcgcgaggacttcttcaggctcaagaagatccagggctacaagaaaagggagatcgagcgccagatggccgccgccaggctatttgcggaggaacagcttgccgaggatctcgcgcttaagaggggtatctccgtgggggctgcggcaaacctgctggttgctggtggngagaaggacgacgacatcatcttctgaccactcct

SEQ ID NO: 60481 - DNA, 390 bp, Zea mays
  Clone ID: LIB3069-055-Q1-K1-F2
tgaaaatataagaaatgaattaaaaaaaagatcttggctgccaactggaccgcttcgagggcgactggccgagcagcccagctagcaagccagccagctgtcgtaaggaccgtgggatcgtgcggccaggagggagctgagagatagacccgcacacgcaagttgtgagagagggagagaaggagctgaagctgaacggcggcggcgggctgaacagactctccgagatcttcggcgagattagtctgggctgatgctcatccggttggctcctccccttctcagctccttaaaggcatggcgcgtgtaccagagtcggctcctctcggtttttctttctccagtttgctgttccagtcacaagttgatcgatccgttcggtccctgtgt

SEQ ID NO: 60482 - DNA, 395 bp, Zea mays
  Clone ID: LIB3069-055-Q1-K1-D3
acaacctgaacaactggcgagaagagtttttaattcaggctagcccatcagatcctgatgagtgcccttttgttctgttgggtaacaaagttgatgtagatggtggcaacagccgcgtggtatctgagaaaaaggcaaaggcatggtgtgcttccaaagggaacatcccgtactttgagacgtctgctaaggacggaacgaacgtggaagacgccttccagtgtatcgtgaagaacgctctgaagaatgagccagaggaagaactgtatgtgccagataccgtggacgtggtgggtggcaaccgggcccagagatcatctggttgctgttaaggcacgaggcatcacgaggcgttgtgatcatcatcgtcgggtatgcagtgaccaaacaatacc

SEQ ID NO: 60483 - DNA, 419 bp, Zea mays
  Clone ID: LIB3069-033-Q1-K1-D9
gagaagcagcacaagcacaagcagcacctcggcgaggccggcgccatcgccgtcggcgcgttcgcgctctacgagaagcacgaggcgaagaaggacccggagcacgcgcaccgacacaagatcgaggaggaggtcgcggcggcggcggccgtcggctccggcggcttcggcttccacgagcaccacgagaagaagaaggaccacaaggaggccgaggaggtcggcagctagaagaagcaccaattcttcggctagctgactgatcctcccatatcgatcgtcgtgcctgcccgcttgctacacctgcgtgtgagagtgatctcgagcgccggccggcctgcacacgcgacgtgttgggcgtacgtacggacggatacatgtatgtatgtatatgcgcacgtgtgatgcacgaataagcg

SEQ ID NO: 60484 - DNA, 363 bp, Zea mays
  unsure at all n locations
  Clone ID: LIB3069-033-Q1-K1-E1
cggacgcgtgggtccgctagggtttctcccaaaatcgccgccgcagccgccgccgccatcagccatggccgctgacacttcgaagcccttcttccccgcggcgccgcactcggctctccgcccctccaggagcgccgnctcgcgcgcgttccctgagagctcctactggcgcgccttccgctcctcggagctcttgtccgacgccggcttccccgtcaccgatctcaccttcgcctcctctgtggaagacagagctgcccctaccctcgccgcttcctggtccacctacgtgcacgtcttcttcttcgaccccctcgagaagctccgtaggatctctgtcgcgggcgatctagccttcttccc

SEQ ID NO: 60485 - DNA, 180 bp, Zea mays
  Clone ID: LIB3069-033-Q1-K1-E11
ctcctcaacctccagcccaacctccagcccggaatcgagagcaatggcgctcgccaaggccaaggagatcgttgccttcgctcccctcgtcctcttcagcaaaacttcctgccctttctgcgtccgcgtgaaacacatgttcgagaaactctgagcaagctacaaagccatttagattgg

SEQ ID NO: 60486 - DNA, 395 bp, Zea mays
  Clone ID: LIB3069-033-Q1-K1-E12
gaggaggaggagggcagacgccggcgccgcggcggtggcgcctggcggacgagcggtgtgacctgcgcgccatggagacggactacgtgcggcggtttcaccggcacgagccccgcgaacaccagtgctcctccgccgtcgccaagcacatcaaggcgcccgtccacctcgtctggtctctagtgaggcggtttgatcaaccacagcttttcaagccctttgtgagccggtgtgaaatgaagggcaacattgagattggcagtgtcagggaggttaatgtaaagtctgggctgccagccacaagaagcacggagaggctggaactgttagatgacaatgagcacatactcagcgtcagatttgttggaagtgatcacaggctgcagaactactca

SEQ ID NO: 60487 - DNA, 429 bp, Zea mays
  Clone ID: LIB3069-033-Q1-K1-E2
cggacgcgtgggagcctccaaaacctcgcaacaaccccgtgacacccacacccatccgcgctgcccctcctcgcgctccccaccaaccccgacgagcggcgatgaccggcacggtgtccaagctggcggcgccccggcctgcggcgccaccgctccggccggcgtccctccgcgccgccgcaatcgccttcgccccctccccgcgccgggtccgcgtctccgtcgccgggcgggccaggatcccctccgtcattgcgatggcttctgccaaggaaggaaatggtgcaccgaccaagaaaacctcgcttcacgatctctacgagctccagggcctctccccgtggtatgacaacctctgccgacctgtcaccgacttgcttgcccttatcggcagcggtgttcgtggagtcaccagcaaccctacaattt

SEQ ID NO: 60488 - DNA, 448 bp, Zea mays
  unsure at all n locations
  Clone ID: LIB3069-033-Q1-K1-E3
ctcgcatactccccacgccgccgccgctcgacggagccaggctcgcagccgctccgccgcaaggtgtcagcacccatcgtggtcaactctatcttcgtctccccatgcgtgctcgccagatccccctctgtctccagtccaccaccgtggtcgggcccgctcgcctcctccgtcgacctcatccgctggctcccttcctcctcgtcgtcgccgtcatcagccacggccccacctccggccccttcgtctctcacatcctcctccccttctccgaccccgtcttccggctcgcctccgtcccgctcccgttcgtgagcgagagggcaacttatgtgttatttcaggcagtgtaaatttgtcagttccgatgtgggaaaagaatttttcaacggatgctngtgctatcccctgggctaaactgtgtgagaccaaaggattgatgtctctg

SEQ ID NO: 60489 - DNA, 415 bp, Zea mays
  Clone ID: LIB3069-033-Q1-K1-E4
ctctcatcggcacacccgagctcgcgccctccttccacgtcgaggtccgagtcctgctgtgatggcgaccgacgtgactgagactcccgcgccgttggtggatgcggccccagaggcgcccgccgacgccccggcggcgcctgctgccgacgcgaagccggccaaggccaagaaggccaccgcgccgaagaagcgcgccagcccgacccacccgccgtacgccgagatggtctcggaggcgatcacgtcgctcaaggagaggacggggtccagcagctacgcgattgccaagttcgtggaggacaagcacaaggccaagctcccgcccaacttccgcaagcttctgaacgttcagctcaagaagctcgtcgccggcggcaagctgaccaaggtgaagaactcgtacaagctgtcg

SEQ ID NO: 60490 - DNA, 409 bp, Zea mays
  Clone ID: LIB3069-033-Q1-K1-E5
gacatgaccgtcggcggcgccccggcgggccggatcgtgatggagctgtacgccaacgaggtgcccaagaccgcggagaactttcgcgcgctgtgcacgggcgagaagggcgtgggcaagtccgggaagccgctccactacaagggctccaccttccaccgcgtcatccccgagttcatgtgccagggctgcgacttcacccgcggcaacggcaccggcggcgagtccatctacggcgagaagttccccgacgagaagttcgtgcgcaagcacaccgcccccggtgtgctctccatggccaacgccgggcccaacaccaacggctcccagttcttcatctgcaccgtcgcgaccccttggctcgacggcaagcacgtcgtcttcggccaggtcgtcgaaggcatggacg

SEQ ID NO: 60491 - DNA, 448 bp, Zea mays
  Clone ID: LIB3069-033-Q1-K1-E6
cagctcgccaagtcccacgcaaccgtgctgctccctcgtcgtcgtccgttcctactttgccccgtcctatgccgcctcgctttgatgtgtgtcgtcatctttaatcccagtaactcttccgatacgcgtcttgtcatgtttcacctcgtggtcagccccatctgggtcatgggggcggaagatctcaacactgcttcatatggctgttttagatgttgtttgcggggtagagaaagttattgtgataaatgattttcgccctctcatcacattcgcaatcctcgtcaatcatcgctggtttgagagaaattaccataagatatggagaagaaagtgaagccgcaccacaccgtcaggtgttcaacgacatgctcgagccaggatttatcagcattcttgtgagtagtgagtcatgtttgatgctgggtagttgaatttatttttctta

SEQ ID NO: 60492 - DNA, 344 bp, Zea mays
  unsure at all n locations
  Clone ID: LIB3069-033-Q1-K1-E7
agcattttcccaatttcccaaattccttcttggttggtggaccagcagattactttgtaattgaactcgctgatcagcttcaaaagctaaaaattgagccagtactactacactacctctcccgcatgagcatacttcaagggttggaactgaggttgagtacaagcaccagactaaaggcctgcctctacagcttcacttctcctggtggccctacctacccaacacgggctgttcgangnncannnnnntnnagcnnganagcnccancnncagatgcagatgcagcaattgcaacttatgcatcagagacatgctcaactttaacgaactaacgcgaatca

SEQ ID NO: 60493 - DNA, 122 bp, Zea mays
  Clone ID: LIB3069-033-Q1-K1-E8
tcgtaggtagaccacgtgctcgcaaccttgtttttctctaggtccgagtcctgctgggatggcgacccacatgactgatacttctgctccgtttgtggatgcttaatcacaggagctcttct

SEQ ID NO: 60494 - DNA, 364 bp, Zea mays
  Clone ID: LIB3069-033-Q1-K1-E9
cccacgcgtccgcaagcttgtcgtatcaacttcctgctcgctcatgcacaccgctgtggatcttgtgaacgagactaagcttgacagcgagattaagtcttggcttgcttttgctgcccagaaggttgttgaggttgatgctcttgctaaggcattggctggtcaaaaggatgaggcttacttcgcagcaaatgctgctgctcaggcctcgaggaaatcctcaccccgtgtgaccaatgaagaagtccagaaggctgctgctgctctcaagggctctgaccaccgccgtgggaccaacgttagtgctagattggatgcccagcagaagaagcttaacctccccatccttcccaccactacaatc

SEQ ID NO: 60495 - DNA, 453 bp, Zea mays
  Clone ID: LIB3069-033-Q1-K1-F1
gcagaatggcgcagagcaactgggaagcggataagatgctcgacgtgtatatctatgactacctgctgaagaggaacctgcagacgacggccaaggctttcatgaccgagggaaaggttgctgctgatccagttgcaattgatgctcctggagggtttctctttgagtggtggtctgtcttttgggatatattcatcgcaaggacaaatgaaaagcattctgaagttgcagcggcatatctagaggcacagcaaataaaagcaagagagcaccagcagcagatgcagatgcagcaattgcaacttatgcatcaaagacatgctcaacttcagcgaactaacgcgaatcatccttcacttaatggtccaataaatgctttaaattctgagggcattttggggccatcaacagctagtgtcttagctgccaagatgtatgaagagcgattgaagc

SEQ ID NO: 60496 - DNA, 444 bp, Zea mays
  unsure at all n locations
  Clone ID: LIB3069-033-Q1-K1-F10
cggacgcgtgggcggacgcgtgggcggacgcgtgggcggacgcgtgggcggacgcgtgggcttggctccccaagcctcgacgcccggctagggttttgcctccttcccgccgccgctgtttcagcgagcgagaccgaggggtagagaaagagcggtgcttagccacccatgtcgctgcgtccgagcgagcgggtcgaggtacggcggaaccgctacaaggtggcggttgacgcggaggaggggcggcggcggcgcgaggacaatatggtggagatccgcaagagccgccgtgaggagagcctnctcaagaggcgccgtgaggggctccaggcccaggtccctgcccctccctccggngttgagaagaagcttgaaagcctcccagctatggttagtggggtttattcggatgataataaccttcagcttgaggccaccacacag

SEQ ID NO: 60497 - DNA, 422 bp, Zea mays
  Clone ID: LIB3069-033-Q1-K1-F3
gtgatatggttcttgcttctgcctactcgcatgagttgccacgatatggtcttgaagttggtctgaccaactatgcagctgcctactgcactggccttctgttggctcgccgtgtgctcaagatccgtggtttggatcaggagtacgagggcaatgttgaggccactggtgaggacttctctgttgagccagctgatgagaggaggcctttccgtgctctcttggatgttggccttatcaggactacaacagggaaccgtgtctttggtgccctcaagggagcattggatggaggcctggatattcctcacagcgagaagaggtttgctggattcaagaaggacgacaagcagttggatgctgatacccaccgcaggtacatctatggtggccatgttgctgactacatgaagaaccttgct

SEQ ID NO: 60498 - DNA, 439 bp, Zea mays
  Clone ID: LIB3069-033-Q1-K1-F4
ctgcggggcaacatcggcgcgatccggtgcatccgctactcctccgatgggcggttcctggtgttctcggagcctgccgacttcgtccatgtgtacagtgtggctgcggactacaagaaacggcaggagatcgacttctttggtgaggtgtccgggatcacgctgagcccggacgacgagtccctgttcatcggagtgtgcgaccgcgtctatgccagcctgttgcagtacaggatgatccgcggattcgactatcttgactcatacgtgtgaagaactgagctttggtgaccggtgttgtgctaggtgctggctgaaggttctgatgcgcggttcagggaatatatctgcctgctcttagttcatggcgaatgatggttcggtgggactcgacgccagcgaatctgccgtgtaaatagtttagaatttgaagcgtaat

SEQ ID NO: 60499 - DNA, 269 bp, Zea mays
  Clone ID: LIB3069-033-Q1-K1-D8
ggatcttcaaaaaaccaaggataaggcctccaagaactaggcgatataggcatcttccacaatgtttaagtcccttagaatttgtttcagcaagaaattttctcgtgggtttggggaatcctgatacttacacaagatatgcgagatgatatggtttaaattttgaacggaagttgcggatccttttattttttaaaatctcggtgcaatgtttatcaaaaaaaaaaaaaagaaaatacatgtacgagtgcactttcaaaagaaataaa

SEQ ID NO: 60500 - DNA, 457 bp, Zea mays
  Clone ID: LIB3069-033-Q1-K1-C4
cccacgcgtccgtgttgtttctcaatatggacagcagatcctagatcttttgctagctgagacacaaccagcgaagatctgttctcaggttggtctgtgcacttttgatggcacccatggtgtcagcgctggaattcggagcgtagtggatgatgaagctgggaaatcaaatggtggtctcaagagtgatccaatgtgcaatgcttgtgagatggctgtggtatggatgcagaaccaacttgcccagaacaagacacaggagctcatcctgaactacattaatcagctttgcgagcgtcttccgagtccgatgggagaatcagccgtggactgtggcagtcttgcgtccatgcctgacattgcgttcaccattggaggcaagaagttcaagctgaaaccagagcagtacattctgaaggttggtgaaggacaggctgcccagtgcatcagcggattc

SEQ ID NO: 60501 - DNA, 441 bp, Zea mays
  unsure at all n locations
  Clone ID: LIB3069-033-Q1-K1-C5
caagaagaagatcgaggacgccatcgacgcggccatcagctggctggacgccaaccagctcgccgaggcggacgagttcgatgacaagatgaaggagctggagagcctttgcaaccccatcatcgccaagatgtaccagggcgcgggtgccgacatgggtggcgccggcggcatggacgaggacgctccggctggaagcggtggccctggccccaagatcgaggaggtggactaagcggattgtgtcagtctcgtgtgtctgctgcagtggctggctggcccagtcgctgctcgatttatcgtcgtcgtcgcggtgtatccgcgttagaaccttttgttggtgaacaatattatcgtggcacgcgttttaagtaatacggtattctggttcggtttaaaaaaaaaaaaanaaaaaaaaaatttaaaaaataatttaatatt

SEQ ID NO: 60502 - DNA, 453 bp, Zea mays
  Clone ID: LIB3069-033-Q1-K1-C6
gcaccagtttggctcgtctcggcctcggcgcgtgcccccgacccgttgctgaccccgctccccggtgatctgatgtcggcggcggcacgcgcgccaccgccgccgcgcgcactctacgcgccgtcgagaagagtccctttcggtgccgtgatcctatccgcgccgcgacccggggctagggttcgcgcggcgcggcctcgcgaggggaatgttcataaccattgcctgttgacatcgtctagtctgaattcaagttctttgctatgccctccatgcaattgtgctcaaatggctttggccgacacaagaattgcttaccagcctgaagttgacaagcatgctggagttctggcctatgaactggttcaagggaatcttgttcagtggaattcatttatggacaaatcaatacctgatccaccaacagctgttcttcttcatggcatccttggg

SEQ ID NO: 60503 - DNA, 456 bp, Zea mays
  Clone ID: LIB3069-033-Q1-K1-C7
cccacgcgtccggtctgcacggatgggccttcaccctcactaactttgcaaagatgtatgcatctaagtttggagttgatgaaactaagatgatggagaggctatggggtgagaacttctttgaccctgccacaaagaagtggaccaccaagaacacaggttctcctacctgcaagagaggatttgttcagttctgctatgagccaatcaagcaaatcatcaagacctgcatgaatgaccagaaggagaaattatggcccatgctgcaaaagctcaatgttaccatgaaggctgatgagaaggagttgattggcaaagctttgatgaagcgtgttatgcaaacgtggcttccagctagcactgctctgcttgagatgatgatattccaccttccttccccagcaaaggctcaaaagtatcgtgtggagaacttgtacgagggaccccttgatgatg

SEQ ID NO: 60504 - DNA, 336 bp, Zea mays
  Clone ID: LIB3069-033-Q1-K1-C8
aaaaaaaaaaaaaaaaaaaaaaaaaaaaaaaaaaaaaaaaaaaaaaaaaaaaaaagaaaaggaaagaaaaacgaatttgaagtcacctagattccgtacacttgcatacgaggtcatggcttttgtgttgggaaacctgaacgcaattgaataggccgcttgtttacaacaaccggggtgtcaaaagttatactgtgcgcaatgcatgttccatggctgacatatggattcacaacgaagtcgcccataccaaagcgccctgagcccaatctccattgccttcattagctctgcccgcatggtgcatggcccatggccgattccggcgctttctgc

SEQ ID NO: 60505 - DNA, 433 bp, Zea mays
  Clone ID: LIB3069-033-Q1-K1-C9
cccacgcgtccgctcaatgacccatcgataagagagatggctgagcaaattgcaagtgaccctgtgttcaaccagatggctgaacagcttcagaaaagtgctcagggtgctggagaacagggtattcctgcattggatcctcaacagtatatggaaacaatgcaacaagtcatgcaaaaccctcagtttgtgtcaatggcagagcgtcttgggaatgcccttatgcaggatcctgctatgtccagtatgcttgagaacttgaccagtccagctcataaggagcagcttgaggagaggatggcccgtatcaaggaagatccatccttgaagccaattcttgatgagatagagaatgggggtccatctgcaatggtgaagtattggaatgaccctgaggttcttcaaaagattggccaggcaatgggtgttaacc

SEQ ID NO: 60506 - DNA, 442 bp, Zea mays
  Clone ID: LIB3069-033-Q1-K1-D1
gttcgttcttgattcttggacgaggtgggatttggagagccaagggcggcgcggcagcggcgggtttctcggtcggactagattgtttccatcgagatggtgccatggtgggcggcggagggcattcgtcgatggaccaccctggcgccaaggacgatggagacggggaagaaagccagtacttctcggacgcggaggaccggtcgtggccgtcgcactcgcgccacgactccaccgcctacgaggactacgtctcgctgtgcgtgtccgcccgcgcgagctccgtcgacgccgacgccgatgccgacggcgaggccgtcagacaacactgcaggaagtcgtcgtgcgtgtcagagggctcgctggacgacgttgacctggaggccggactgagcgagatcatcaaggccagccctgagaaggccgaacagaactgtcgcat

SEQ ID NO: 60507 - DNA, 385 bp, Zea mays
  Clone ID: LIB3069-033-Q1-K1-D10
gggaggggttgataggactcatgcgcctaattcttgtagtggaattcaaccaattgattgctatttgggactgccgatttgtgatcctgttaccacagtcttcttgcgggccagaaacgcgaatcacgatggttccaggaatcgcccccaagacggcggcgcgaccggtggcctgggcacctcagcctcggaacatgttcgtgttcggcgcaggtttcgtcggccgctacgtttcggagcgcctcctcgcgcaaggctggcaggtctccgggacgtgcaccactgtcaccacgaagagggagctagagatgctgggcatgaatgcttccgttttcgatggcacagaagacagcctggaaaatattcacagtttacgacaagcaac

SEQ ID NO: 60508 - DNA, 439 bp, Zea mays
  Clone ID: LIB3069-033-Q1-K1-D11
cccacgcgtccgggccccctcctcggcgagacgtctactttctcgaggcgtacagtgaccgctcacctctcgggcgtgcctagctcgtcatcggtctccaatgccacgttcgtgctactactccaatcgttgctgacccgtgtgatctccactgacttccgcaaggagtgcgggcaccttcggtcccatccgatgttaaggcttacctcgcttatggtgttccacagagtgacatgaaactgtaatcacttatgcaaaagttgctagaccagcggcagagcatgaacatatggcgctttgtacatacaatgaatactgttgggaccatgcttcgtcgccgaaggtcctgcaaaaagaaacagcttcggctgaaggtgcttgaacatgctgccgaagacacagttcacgaagcttcggaactacaacatatccaaagacg

SEQ ID NO: 60509 - DNA, 272 bp, Zea mays
  Clone ID: LIB3069-033-Q1-K1-D12
cattattgccgtctcccttttgcgtgagcaaagaaagagagcgagaagagcagtcgccatgtctggcatcatccacatgatcgaggagaagctccacatggggggcgaccacaagaaggaggatgagcaccacaagaaggccgaggagcaccacaagaaggaggagggggagcaccacaagaaggacggcggggagcataaggaaggcatcgtggagaagatcaaggacaagatcaccggcgagcacggcgacaagtccggcgaccacaagg

SEQ ID NO: 60510 - DNA, 426 bp, Zea mays
  Clone ID: LIB3069-033-Q1-K1-D3
gagatcctgaggaagaaggggcactcctactctgagatcatcaacgagagcgtgattgagtcggtggactcgctgaacccgttcatgcacgcccgtggggtcgccttcatggtggacaactgctccacaacggctcgcctgggatccaggaagtgggcgcctcgcttcgactacatcctgacgcagcaggcctttgtggcggtggacaaggacgccccgatcaaccaggacctcatcagcaacttcttgtcggaccctgtccatggtgccattgaagtctgcgccgagctgaagcccaccgtcgacatctctgtgcctgccaacgccgactttgtgcgcccggagctccggcagtcttcctagattgaagcaatgagcggagagggagagggagagagaaagagaggatttcgtgtcccgagttag

SEQ ID NO: 60511 - DNA, 330 bp, Zea mays
  Clone ID: LIB3069-033-Q1-K1-D4
cccacgcgtccggcatcgaaacatggtagataaataaaggacttgacgatttgtaacgcagtagctggtgcgtgcgtggtgtggtggtaagaaattcttctgctgcctgtgttcttgtagcctcctcgtcctcgcccaccctgttggtacgtgtacggtgtacgtagtctgccgccgcgcgctgttcgtgttcgtcgtgtctcgtgtctgtattatactcgtcctccccatcaaaaaaaaagttgttccatgtacgtgtgcactgtcgagtgatgtttggctggacgtgatcgtgattactcctggaaactatccggcgcgtgcagatcg

SEQ ID NO: 60512 - DNA, 403 bp, Zea mays
  Clone ID: LIB3069-033-Q1-K1-D5
cgggcgtgcggccctcggtcggcatgggcgcgcggcggccatgacggctcgaacgcggtagccacggccccgacgtctcccgtcccggcgcgtcaccccgtggtgcggcggcccccggcctcaacggctcggaggcgcgactccctgcgacgcgcggcctcttggccccagcggctcgggcgtgggtgcccacggcgcgcggccccccggcccctgcggcacgggcgcgactgcctgcgacgcgcggccccccctgccccggcggctcgggcgagggcccccgacgcgcactggtgaggcgcggcagcctgcggcgcttgggcactgtggccggccaggcgggccacagccagcgcgggcgcgcagccccgcggccttagagccggccccgcttatacacggg

SEQ ID NO: 60513 - DNA, 145 bp, Zea mays
  Clone ID: LIB3069-033-Q1-K1-D6
cagtgacacgcacggctacttttgcggacttccatacgtctgacccgcgggggccacttccaaccttgccgtgacccgaatggccccagatggaaacttggcagcaacttccagcttgcctgaaaggctgatagtgcatatacgc

SEQ ID NO: 60514 - DNA, 436 bp, Zea mays
  Clone ID: LIB3069-033-Q1-K1-D7
cccacgcgtccgcgtttgcaaacattaggatcgtgaacaagtttttgaacggagaagttggacccaagaccattcatgttcctactggggagaagctttctgtttttgatgcggccatgagatacaaatctgagggccatgctactataatcctcgctggtgctgagtatggaagcggcagttctcgtgattgggctgctaagggtccgatgctcctgggagttaaagctgtaattgccaagagctttgagcgtatccacagaagcaacttggtggggatgggaatcattcctctgtgcttcaaagctggtgaggatgctgattcgcttggcctcactggacatgagcggtacagcatcgatctccctaccaacctcagtgagatccgtcccggccaggatgtgactgttactaccgacaatgggaaatctttcac

SEQ ID NO: 60515 - DNA, 455 bp, Zea mays
  Clone ID: LIB3069-033-Q1-K1-C3
gaaaatctcggtgaagttcttcgtggagatcgcattgaaaactctccctatacgtttgaaatgagggagcctcagatgtgtcaagtagtctgcaagatatctgttggggagaaagaagcaaagcttctcaaggagaagattgaagatgaataccgtgttaacatgattcttgacaacctacctttagtcgttcctattcaaagagtggatcaagaaggtgcatatttctatcaacatggattccatgttggggccaaaggaaaatattcagggagcaaagatgaaaaatacttcatccacaaccatctatcttttacggtgaaatatcacagggatgagcaaagggatgtttccaggattgtggcctttgaagtgaaaccatacagcgttaagcatgaatatgaagggcaatggaatgataagaagacccggctgacaacgtgtgaccctcatgc

SEQ ID NO: 60516 - DNA, 446 bp, Zea mays
  unsure at all n locations
  Clone ID: LIB3069-033-Q1-K1-B1
cggacgcgtgggcaatggcagcaacggcgagcacatctccacccgcccgccgccgaccccgtcgcccctccgcttctccaagttcttccaggctaacctgcggatcctggtcactggtggggcgggcttcatcggctcgcacctcgtggacaggctcatggagaacgagaagcacgaggtcattgttgctgataactttttcaccggttcaaaagataacctgaagaagtggatcggacacccaagatttgagctcatccgccatgatgtcactgagccacttcttgtggaggttgaccagatctatcaccttgcttgccctgcttcaccaatcttctacaagcacaatcctgttaagaccatcaagacaaatgttattggtaccctgaacatgctgggacttgcaaagagagttggagctaggatttntgtgacatcaacatctg

SEQ ID NO: 60517 - DNA, 452 bp, Zea mays
  unsure at all n locations
  Clone ID: LIB3069-033-Q1-K1-B10
cccacgcgtccgcccacgcgtccgcccacgcgtccgcccacgcgtccgcccacgcgtccgcccacgcgtccgcccacgcgtccgcggacgcgtgggatcgtcttcctcccctcacatcctctggcctctggtcctccaccgtcctgctagccagagctgctcttgtacgcgcagctggcctctgtgcatatcaccagcacaccgcgcaggggaaggaaattaacaagagaaaaggcaaggagagcaggcaggcaaggaagctgcagaagccaaggaaggagaaggaggatcatcaatgagcatctcggtgaacgggcagtcgtgcgtgccgccggggttccgcttccaccccacggaggaggagctgctcaactactacctncgcaagaaggtggcctcccaggagatcgacctcgacgtcatccgcgacgtcgacctcaacaagctcgagc

SEQ ID NO: 60518 - DNA, 429 bp, Zea mays
  unsure at all n locations
  Clone ID: LIB3069-033-Q1-K1-B11
gatccatctcactctccgctggtcgctcactcttgcagctccacccttcactcagtcttagtctcttattagctctaggctctagctagccgcgccactccttcgtgtagccatcagccttctcatcgccaccaatggccactgccgaggtccagaccccgaccgtcgtggcggccgaggaagcgcccgtggtggagaccccgccgccggccgtcgtgcccgaggagtctgcccccgccgaggccgaggccgaggccgaggctgctgctcctgctgatcccgaggagcttcccgcggccgagcagcaggcagccgccgaggcggaggccgcggctcctgctggtgccgaggagcccgtcgcggccgaaccggccgncgaggcggaggctgctgctcctgctggtcccgaggagactcctgcggtcgagc

SEQ ID NO: 60519 - DNA, 348 bp, Zea mays
  Clone ID: LIB3069-033-Q1-K1-B12
cggacgcgtgggaaaaaaaaaaaaaaaaaataaaaaaaaaaaaaaaaaaaaaaaagaaaagggatataaaaaaactcaaaattaaaaaaaaaaaaatacaaaaaataaaaatataaataaaaataacaaaaaaaaaggtttaccgttttacagtttccaagtttacgactggaaaaacccaggtgttacctattttattgggcacccaaaaaaaaatccttttgccagttttttaaaaaactcaaaagggcaaaacctttggcttttccaaataattcgctattctgaatattcatttttaccccccttttaaagtaccataaaagccccaagcaatggcttttccaa

SEQ ID NO: 60520 - DNA, 280 bp, Zea mays
  Clone ID: LIB3069-033-Q1-K1-B2
ttcccgctcgaccacgcgtccgtttttcgtccactttattactgatcgcatgcatctgagcacggctgctaccagaaagggcaggttcgatcggtctagtgtgaactcggctttgaataactagtctgtggacaagggctagttcggtgatgtgtatggaacggtcgtcactgagtcatgcacgatttggtatccacgtgattatggtcgacggtttgaggaactctctgatccatcatgacacaaagttgatgctgcgcgaacgaccggatatcattct

SEQ ID NO: 60521 - DNA, 462 bp, Zea mays
  Clone ID: LIB3069-033-Q1-K1-B3
cccacgcgtccgcaagtttctaccaggcattgtgtcagttaggaatggtccatcctgatagactaaaatcagaagaaattgaggagttgtggagtgaagctgaccgtgatggcgatggtgttattaactacaaagaatttcagtgcatctggagcccaaactgctgtagtcaagaggaggaggatactgaaattgacatcactgatgaaagtctggacacttttgaggcaaacaacgaagccttcggcttcaccgtgaaggaagctgttctctttcccccagaagtagagaagggcatgtggccagaaaactacagcctctcagatcatgctcccctcactgtggtattctcccctattagaatgccttgctctccacgcaatcgtggggagctctagctatctaatgtcaatgatctcatgtatacatatacatgccccacgaaatcggtgttagatttgg

SEQ ID NO: 60522 - DNA, 454 bp, Zea mays
  Clone ID: LIB3069-033-Q1-K1-B5
cccacgcgtccgcggacgcgtgggctgatgatgatgggatcacaaaagcttgcagctgtcctttgcttccactgaaaactcatatcaagggcccggcaccagcctctgaccctgataaagcggacattgttgatgaagccataactttctttcgagccaatgttttcttcaaaaatttccatgtgaaaagctcagcagacaagttattgatctatctgacgttttatatcaatattgccttaaaaagactagacggttgccggacactagctgttgggactaaagcaatcattaatctgggattggagaaagttcctgtacctggggaaccagggtttcctttccctggacttttcactcttccccagtcccaggaggaagcagaattgttgaggaattatttgaagcagataacggaggaaacaagtggaagattgctcaactgtgcatacag

SEQ ID NO: 60523 - DNA, 455 bp, Zea mays
  Clone ID: LIB3069-033-Q1-K1-B7
cccacgcgtccgaccaagcagaccacaacaagaagaagcgtagtcgtcgccggaaggaaaggcgcggagcaagatgtcgtggcaggcgtacgtcgacgagcacctgatgtgcgagatcgaaggacagcatctcagcgccgccgccatcgtcggtcacgacggcagcgtttgggcgcagtccgagagcttccccgagttaaagcctgaggaggttgctggtatcataaaggactttgatgaacctggtactcttgcaccaactggtcttttcgttggaggtacaaagtacatggtgatccaaggtgaacctggagttgtcatccgaggaaagaagggcactgggggcattactatcaagaaaaccggcatgtccttgattattggtgtctacgacgagccaatgactccagggcaatgcaacatggtggtggaaaggctcggcgattacctgatcg

SEQ ID NO: 60524 - DNA, 454 bp, Zea mays
  Clone ID: LIB3069-033-Q1-K1-B8
gccagctactgcacggtgtacaaggcgaagctggcgagcggcggcagcagcatcgagctgcgcctgctgcgggaaggcagctgcaaggacgccgcgtcgtgcgcgcccgttgtgcggcgcatcggccgcgcgcgccacgagaacctggtcccgcttagggccttctaccaggggaggcgcggcgagaagctgctggtgtacgactacttcccgcgcagccggacgctgcaggagctgctgcacggtggcagcgagcccgcggcggggcggccggcgctcacctgggggcggcggcacaagatcgcgctgggcgcggcgcgcgcgctggcgtatctgcacgcgggccagggcgaggcgcacgggaacgtgcgctcgtccatcgtggtggtggacgacctcttcgtgccgcgcctggcagagtacgcggtggaccggctgctggtgcccgcggcgg

SEQ ID NO: 60525 - DNA, 395 bp, Zea mays
  Clone ID: LIB3069-033-Q1-K1-B9
aaagaattttgctctactcgagaagcaagttttacaagattgtgtgaagtcgctgagcacagaagagcatataagtccagagtttgaaccacttcttggttgtatgaaggcttacattcatgagatgaaggatgaggacactgatcctatgagcgataaagatgggaactgacatgtctgcaaagattgctcttaatgtgcaaccgctgcagtattgctgccttgccggcattagtgcttgtgcaagccattgctcgcttgcctgttcagagtgccctctgtgctcgacaagaatagcagacaggataatcacattgacatgaacggtgtgctagcttcaagctattctgaagcatggcgcactcttgtaaaatggtcagcggtatatgttacta

SEQ ID NO: 60526 - DNA, 324 bp, Zea mays
  Clone ID: LIB3069-033-Q1-K1-C1
ctgacgcgtccggcagtcaccactcccaagccagttccgagtcctacgagcagtcgcacgcacgtgtcaagagacgagacggtcgacatggctcgcacgcaatctggcgtagcggtcgccgtggtggccgcggtgctgctgctggcagctggggcgacaaccgttgatgcctgcatcacctgcgggcaggcgagctgcgacatcgcgccctgcctctgctacacccgctgaacggagtccggccgcttcgggtactgctgtagcggcgtcaggaacctctagagcgccgccagctccgacaccgacaggcgcgccgcctgcaac

SEQ ID NO: 60527 - DNA, 342 bp, Zea mays
  unsure at all n locations
  Clone ID: LIB3069-033-Q1-K1-C10
ccaacccagctcgctcgtcccagctgatcaggtcgagcacctagtagcgacctgctcgatcatcagtgtagagtgtcggtaggtgtctgtctctcttggtggctggttgcaacggtcatggcgacgtcgtctcgtcgggtgcccttgctgctgctgtgcctgggcgtgctggtgtcctgctccttcgcggcgggcagcttggaccaggagctggacatcacgtggggcgacgggcggggcaaggtccttgacaacgggcggctgctgacgctgtcgctggaccgcacgtncggcttcgggttccagtcccggcacgagtacctgttcggcaagatcgacatg

SEQ ID NO: 60528 - DNA, 249 bp, Zea mays
  Clone ID: LIB3069-033-Q1-K1-C11
gagcggccgagatcaggctgttccagcggatggcgttcggcagccaagatttcacgacggatttcagccagtccagctggaacaacagccagagcagaggtcttgatgcctctggttcaaggccattgtaatcctcctcctcgttgtcgtcgtaaatttcgtagatctaactagctagggtgtttcgtgatgatttttttacctcgtgtaattctttctgagtggatcaatagtgattgttctttcgcc

SEQ ID NO: 60529 - DNA, 447 bp, Zea mays
  Clone ID: LIB3069-033-Q1-K1-C12
cccacgcgtccgcccacgcgtccgcccacgcgtccgcccacgcgtccgcggacgcgtgggttcacacttgatggacatcaaaagggtgtcaattgtgttgactacttcactggtggtgacaggccctatttgattactggttctgatgactccactgcaaaggtctgggattaccagacgaaaagctgtgttcagacacttgaagggcatacacataacatttctgctgtttgtttccatcctgagctccctataatcattactggatccgaagatggtacagttcgtatatggcattcaacaacttacagacttgagaacacactaaactatggccttgagagagtctgggctgttggatacatgaagggatcaagaaagatggtgattggttatgacgagggggccattatgataaaaatgggccgtgaagtacctatagcaagt

SEQ ID NO: 60530 - DNA, 326 bp, Zea mays
  Clone ID: LIB3069-033-Q1-K1-C2
aaagaacttgggcccgcctctcgtctcttaccgcacatgcgcgtcggaccgcgtctacatagctgcttgccgtcgacacccgcagccgcaatggccgtcgcccacgcgccgacgagccagggcgtgctaccgctcctgctcgtcgccgcgctcgtggcggcgttgtcggccagctgcgccgcgggcaggagctagaagctgtacacggccatgttgagcttcagagactcgctctgcgacgccggctacctcatcgggaacggcacgcccaaggcgcttaccagcgcgcgcgctacctacgggatgaccttgttacgaagcccacc

SEQ ID NO: 60531 - DNA, 453 bp, Zea mays
  Clone ID: LIB3069-033-Q1-K1-A8
cggacgcgtggggccgtgacaccatccttcacatacaagacaagcctgctctgttcagaagcttcttcaaatggctaaagcccggtggcaaagtcctaatcagcgactactgtaagaatcctggaaaaccatcagaagaatttgctgcgtacattaagcagagaggctatgaccttcacgacgtgaaggcttatggacagatgctgaaggatgctggttttcataatgtcatcgcggaagatcgcactgagcagttcttgaatgttctacagagggagctaggtgaagttgaaaagaacaaagacgctttcctggcagacttcacccaggaggactatgacgacattgtgaatggctggaacgcgaagctgaaacggagctctgccggcgagcagaggtgggggttgttcattgccaccaagtgatttggcctggcagcaagagggctcttcg

SEQ ID NO: 60532 - DNA, 131 bp, Zea mays
  Clone ID: LIB3069-055-Q1-K1-B3
aacacacgccttgcaggattgttgttcacttgattttacttgtaccgcggctttggagttgcgcaaatgactttgttcaagaacttcttctctcacaggaaataacatgagtgcagtccgtgcttttatct

SEQ ID NO: 60533 - DNA, 440 bp, Zea mays
  Clone ID: LIB3069-055-Q1-K1-B4
ggccctgcagctcgcggagggccacgcgtgctctgaccgagcagtgcccgtccgtggaggccgagggcgcgcactgcgagggcctggcgttcgacgtgcacctgcgggtgcggaacgcgggcgagaggtccggcgggcacacggtgttcctgttctcgtcgccgccggcggtgcacaacgcgccggcgaagcacctgctgggcttcgagaaggtgtctctggagcccgggcaggcgggcgtggtggcgttcaaggtggacgtgtgcaaggacctcagcgtcgtggacgagctgggcaacaggaaggtggcgctcggcagccacacgctgcacgtcggggacctcaagcacacgctcaacttgggagtctgatggccgaaaggggaatggctaccaagtaccaacgtgaaagcagttggaatttggagggctggattggtc

SEQ ID NO: 60534 - DNA, 262 bp, Zea mays
  Clone ID: LIB3069-055-Q1-K1-B5
cccacgcgtccgcccacgcgtccgcccacttgttcggacgcagaggaactaaatgctggtgcgatccattggattgtgtcatgcctcgctgcacattggaagatctgaaaggatgcgatccatcgcttaatgcaaaagttctccaagatgttcttgctggccaaatgggttcgattgcagatgcccttgttctaaatgccgtggcatccctacttgtcattggtaaagtgaaaaattacatgactgtgttgctttagcacat

SEQ ID NO: 60535 - DNA, 158 bp, Zea mays
  Clone ID: LIB3069-055-Q1-K1-B6
atagcatgctatgattctaacactgttttattgttatgttaattctggacatttttcacagaaccatctttgtagcatttccctttttttatcctcgctaacaaatgtaaaaatacggatcttgtgatgctgtcttagttatttgatctggtgagctg

SEQ ID NO: 60536 - DNA, 332 bp, Zea mays
  Clone ID: LIB3069-055-Q1-K1-B7
attctcaccaaagtacctctatgcctgcgctgcaacagtgtgcacatatgtcggagggtcgatcatagctatgactgcattatacagttgtgctgttttcaagttcagggcgagaagctacagggataaatccctgtaatcagactaatgattagctgttctgatttaatggacatttgtaagaattcagaaagggagggtatcttggcctattctctcgttgtacaacatcgtactcacatgtttccagaccatgcaatccctgcaagggcctttacacattaaaaaaaagaatgaaaaaaccctgacgttacccaaccttaaaaagcctt

SEQ ID NO: 60537 - DNA, 446 bp, Zea mays
  Clone ID: LIB3069-055-Q1-K1-B8
cggacgcgtgggcggactcgtgggcggtctcgtgggggcgacgccgagcaccggagggtggtcaacgccggcgcccacccgcggacgcccttctacggggagttcctgcgcgcggccaaggccgtgtggatgctgcacctgctagccttcgcgctggagccgccgcccagccacttcgatgccggacgcggtgcggagttccaccaggagtacatggagagcgtgaccggcgcgccaccgcacggcggcgcgggcctggtcgtcgggttcgccgtcgcgcccgggttccggctggggaacggcgccgtcgtgcgcgcccgggtctacctggtgccgcgtggtggccgaccgtgacagacccatgcatggcgtgacagaccgcgtggtagcgttgcatagcgccgtgggccacggatcacctccgagagttgttggtgggtgcccat

SEQ ID NO: 60538 - DNA, 407 bp, Zea mays
  Clone ID: LIB3069-055-Q1-K1-B9
gggacactccatgggaggggctttagcttcgttttgtgcccttgatctatctgttaaatttggatcgcaggaggttgaactcatgacctttggacagcctcggataggcaatcctgcatttgctgtatactttggtgaacaagtcccaagaacaatccgtgtgacccatcagaatgatattgtgccgcatttaccaccgtattattattacctaggtgaatggacataccaccactttgctagagaggtatggcttcatgagagcatagatggaaatgtagttaccagaaacgagacggtatgtgatgattctggtgaagacccgacctgtagcaggtcggtctatgggatgagcgtagcagatcatcttgagtactatggtgtcacactacatgcttgatcagggg

SEQ ID NO: 60539 - DNA, 420 bp, Zea mays
  unsure at all n locations
  Clone ID: LIB3069-055-Q1-K1-C11
ggtcctagtacaattttgttggccgcatcctttgtccaagaggaaattccttgaagcggatggaggcgaatacagattgccgcgtgctaataaaaagtcgtggcancataaaagatccagcacgggaggaaatgatgcgagggaagccaggatatgagcatctgaatgaacctctccatatattggttgaggcagagctacctgttgacatcattgatgctcggctgatgcaagcccgcgagatccttcaagatctgctaaagcctgtggatgaatcccaggacttcttcaagaagcagcagctccgggagctcgcgatgcttaatggcaccctgcgtgaggaaaggatgcagaggttcggttcagcgtccccttttcacaacagcctttgaatgaagagagccaagacagggggtgatg

SEQ ID NO: 60540 - DNA, 257 bp, Zea mays
  unsure at all n locations
  Clone ID: LIB3069-055-Q1-K1-C12
cccacgcgtccgcccacgcgtccgcccacgctttcgcccacgcgtncgctcgggaacgtagagcttgctgatcccactatcaagaaagtggaggaaagtgctaccgacttcttggttgataaggtctcgcgatttcctggagaggtctctgtgctcgccttgggtcctctgacaaacatagcattggccatcaagaaggatccctcattcgtgaaaaacgttaagaagatcgttgtgctgggtggagcgttctttgc

SEQ ID NO: 60541 - DNA, 284 bp, Zea mays
  Clone ID: LIB3069-055-Q1-K1-C3
ctcagccaaacacaccagatttgccagatgtattgaagctatttattccttttgcatctgcgccgccagttgttgctactccattggaaaaaactgagacagttccctcaccttcaatgtcttctccagtgaagccaactgagccaaaaatctccacatagcgggttgatgaatctgccacaccagtacctgccactgattatacgttcacataacaaccagaacaagctcggacaatctcattcgaaagtgaggcacgtatcgacttggaccatgttctatct

SEQ ID NO: 60542 - DNA, 344 bp, Zea mays
  Clone ID: LIB3069-055-Q1-K1-C4
ctcagacgaacacacctgattttccacatttcttgaacctatttattcctatcgcatctggaggggcagttcctgctacatacatgggatacaaccgatacagttccctcaccttcaatgtctactccagagcacccaacatagccaaaaacctccacattgcgaattgatgaaacgcccacaccagtacctgccactgataatacgtccacttaacagccagaccacgctcggataatctcatccgagagtaaggcacatatctactaagaccaccgtacatctgccgctgatacaggcgctcaattagctcatcgagcatcctgcggacccaataccgttca

SEQ ID NO: 60543 - DNA, 441 bp, Zea mays
  Clone ID: LIB3069-055-Q1-K1-C5
cccacgcgtccgcccacgcgtccgcccactcgtccggtccagattccaattccagtccgagcgtgagctcagctcagctccgctagtcctctccccgcacgcaccaccaccagcagcagtccagcaccatgggcggcgccctgctcctcacgctgctcctcgcggccgtgcccctctccttgggcggcggcggcggcgcgcacccgggctactccgacgacgacgagagcgcgtgcacggtggacgcgggcgcggagctgctgcggcggatggaggagcgcgggcccggcgggcgcatcatcatcgacatcacgcacgcggtcgtgccggacctgccggcgttcgccacggtggcggtcgcggtgcccatgctgcgcctcaaggagtccatggcggacgggtccgagtacaacctgtcggagctgcggatggagtgccaca

SEQ ID NO: 60544 - DNA, 420 bp, Zea mays
  Clone ID: LIB3069-055-Q1-K1-C6
cccacgcgtccgagcgcgacaagattctggctgtaaccatgatcgtgcttgctgtcctgtgaaattctgtcgccctatacagtgacgcgatgaacatcttccgtaagaaggaagtggcctgatctcagatttcaaaagtagtcagtgctggatgaagaatggtctcgcaattcaagactcgatggtacgaaggaaaacgatgcgcttggattccgtgaaggaacgatttctttgtcagcacctcagaatttggccacttgaaagaatctgatgcttgaagtttcctggttctgtgtacacaagtcggctcaatgtcagaattgagccgcttgaaatatatttagttatattctatgcggagagtaggtcttggaaacagccttttccacaataatgtacagaaattggcataatacgcga

SEQ ID NO: 60545 - DNA, 455 bp, Zea mays
  Clone ID: LIB3069-055-Q1-K1-C8
atctaactgacctggatgcagctgaatactatgaatcaccagctataccattcagcgttggtgcgcaagacatcgatgtcgcattgggacgcagccagagtgcagaaatcctagacgacatggtcacgagaagccggggtgagatcaaacgcctgaacagcccgaagatcaccagctcaggtggcacgcctgtggcagaactgaaaggcatccgcagcccatccatttctgaaaaagcatacagccctcgtctcactgagctccagcatgagcgcagccctctgggagggagaagcaggcctaggacgccatccaagttgggtgaaggctcggcaccaaagtgaataaagcaatgatgcattgcttaagctatgcaactactgggttactggccatcaattatataagtgattttaaagtggtttcagtgttagtatccaagatgtcctctgatg

SEQ ID NO: 60546 - DNA, 157 bp, Zea mays
  unsure at all n locations
  Clone ID: LIB3069-055-Q1-K1-C9
atcaccgaccggnatacaaaaacggctcgctttttaagttttnttaccttctcctcccaaaactccatgctcgacgctatcgagaacatgaacagcaaggaactcgactgcctaaacatcaccgttaaccaggcccagtcccgtggcggtggcaata

SEQ ID NO: 60547 - DNA, 291 bp, Zea mays
  Clone ID: LIB3069-055-Q1-K1-D1
cccacgcgtccgcccacgcgtccgacggcgaccatcacgttccggggcacggtgatgggcgcgtccccggcgccgtccgtggccttcttctcgtcgcgcgggccgaacaaggcgagcccgggcattctgaagccggacatcaccgggcccggaatgaacatcctggcggcgtgggcgcccagcgagatgcacccggagttcgcggacgacgtgagcctgcccttcttcatggagtccgggacgtccatgtcgacgccggacctgagcggcatcgcggtcatcatcaagagc

SEQ ID NO: 60548 - DNA, 293 bp, Zea mays
  unsure at all n locations
  Clone ID: LIB3069-055-Q1-K1-D10
acccacgcgtgccgcagaaaacccatggaagggtcactttgtgcctcgcttcatgatagtctggttgcgaaagggtatacccctccagcgtgttggcgcggactctnntttcggcccctgaagcggagtttcttggcaagcccctgtggcttttgggggtccctcgagcccccggatggagaaaagtacccgtcaagggtcaaaggtccccgaggctnaagcggagccgacccgnngctgcaggaggggtggtcccggaccctgctcaagaaacccatcctgctcgtgatgaa

SEQ ID NO: 60549 - DNA, 131 bp, Zea mays
  Clone ID: LIB3069-055-Q1-K1-B2
aacacatgccttgcaggattgttgttcagtagattttacttgtaccgcggctttggagttggcggaaggactttgttcaagaacttcttctctcacaggaaataacatgagtgcagtccgtgcttttatct

SEQ ID NO: 60550 - DNA, 377 bp, Zea mays
  unsure at all n locations
  Clone ID: LIB3069-055-Q1-K1-D11
atcgctgactctggagggtgtggtatatgttgttgatagtggattttccaagcagaaatggggtggtccgatttcggacatagagagtttagttgtcgcaccaatatccaaggcatctgcaagacaacgagcaggcagagctggaagggtgcgacctgngaagtgctttaggatctatacagaggaatattatcttaatgaaatgcagtcagaaggaattccagaaatgcaaaggtccaacctggtctcctgcataatacagttaaaagccctaggcatagacaacatcctgngctttgattggccagcttctccatctccagaggcaatgattcgggctcttgaagttctattcttcctaggtatnctcgatgaag

SEQ ID NO: 60551 - DNA, 423 bp, Zea mays
  Clone ID: LIB3069-055-Q1-K1-D2
ggagctgcaggcggcgatgtcgatgccactggcttccgtgccaacgacgtcgttgttgccgccgcctactactgctccggcggcttccgtgtcaatgacgtcgtcgtcatcgttgccgcctgctactgctagcagtagcgctgctccggccgccggcgacaagggacttcttgacgacatggtgccgtcggcgatgaggcacgggcggtagttgactaattactcggctagctaattagtacaatgatgacgaagcatacgatggagctgcccatcagattatttggagctctattattaatctctgattaattggacagagacaggaagaattgattgtaacatatgcatatacatacatattaattatctatatatagctacggactaagcgagcgagcttctacagaatgggcgccgggt

SEQ ID NO: 60552 - DNA, 388 bp, Zea mays
  Clone ID: LIB3069-001-Q1-K1-D9
acactgtccgtggtggtcagcgctacgctactggtcttttgtacttaactgatgtaccagaaagaggggaaacggttttccccttggctgaggagcccgatgatgctaaagatgcaaccttgtcagaatgtgctcagaaaggcattgcagtgagaccacggaaaggtgacgccctccttttcttcaaccttaacccagacggcaccaccgactcggtgagcctccatggtggttgcccggtcataaaaggcgagaaatggtcggctacgaagtggatccgtgtggcctcgttcgataaggtccatcacccacagggcaactgcaccgacgagaacgagagctgcgcgaaatgggcggccctaggggagtgcataaagaacccagagta

SEQ ID NO: 60553 - DNA, 237 bp, Zea mays
  Clone ID: LIB3069-001-Q1-K1-E1
gcgttcgtgtgtgctgtagcatgtcggcatcctacagtgctttagagtttatagatagatggcctaccgttattaatacgagatgttgatcagaaaaaaaaaaaaaaaaaaaaaaaaaaaaaaaaaaaaaaaaaaaaaaaaaaaaaaaaaaaaaaaaaaaagtaaaaaaaaaaaaaaaaaaaagaagaaaaataaagaaagaaaaaaaataaaatacacagtgcatgcaaaaacaaa

SEQ ID NO: 60554 - DNA, 437 bp, Zea mays
  Clone ID: LIB3069-001-Q1-K1-E10
agataatcctgatttgagggacagagcttacatatattggcgacttctgtctactgatcctgaggctgcgaaagatgttgttttggcggagaaacctgtgatcagtgatgactctaaccagcttgactcatcacttcttgatgagctgctagcaaacatttctactctttcatcagtttatcataagcccccagaatcatttgtcagccgtgttaaggctgctcctagggccgatgatgaagagtttgctgatacagctgaaacagggtactcggagtccccatcccagggtgttgatggggcatcaccttcatctagtgctggtacttcttctaatgtacccgtgaagcagctggcggttgcatccccacctgcaatgccagaccttttaggtgatttgatgggtatagataatgctattgttcctgttgatgaac

SEQ ID NO: 60555 - DNA, 430 bp, Zea mays
  Clone ID: LIB3069-001-Q1-K1-E11
cccaacgaatggaggaatggcagagagatcttctttcgtgctttctggtgtttctcgcaatgcgtagaggccttcaggcattgtcgtcccgtgttgtctattgatggtacttttctgcttgggaagtataagggcacattgttggttgccatatcatgtgacgcggacaacacattggttcctttggcatttgctttggtggagagggagaacagagagagttgggcttggttcttgcgacttgttcggatccatgtcgtgggccctggtcgcgaggttggtgtcatatctgacagacatcagggtattcttaatgcagtgcaagagcagattcctggctacgcacccatgcaccacagatggtgcactcgacatctagcagaaaatcttcttcgaaaggatcgtagcaaggctaatttccccctttttg

SEQ ID NO: 60556 - DNA, 398 bp, Zea mays
  unsure at all n locations
  Clone ID: LIB3069-001-Q1-K1-E12
cggacgcgtgggttgtcttggtgctaatcagcctttagaagttaccatcaagacatctttggacacttggatctaacacttagagctttgccttcgcatataggctctaggtttgggttttcgttttctgctagctttcttctactctaccactgtaagttttcagtctgatcggtccaaaatttggtgtgtattggttacgctgtccttcatcagccttcactttgcatgggttgaccttagagaagacgtgttcaagattttgttgtcgcaaaagcatgggaatagcatacatagctntgagaggagtctccagtgactttggtgttgtaacatccaaagacactcctggtatacatatatgagtcctggtttttactatacaactgttctgaaat

SEQ ID NO: 60557 - DNA, 402 bp, Zea mays
  Clone ID: LIB3069-001-Q1-K1-E3
cttggttcgttcttgattcttggacgaggtgggatttggagagccaagggcggcgcggcagcggcgggtttctcggtcggactagattgtttccatcgagatggtgccatggtgggcggcggagggcattcgtcgatggaccaccctggcgccaaggacgatggagacggggaagaaagccagtacttctcggacgcggaggaccggtcgtggccgtcgcactcgcgccacgactccaccgtctacgaggactacgtctcgctgtgcgtgtccgcccgcgcgagctccgtcgacgccgacgccgatgccgacggcgaggccgtcagacaacactgcaggaagtcgtcgtgcgtgtcagagggctcgctggacgacgttgacctggaggccggactgagcgag

SEQ ID NO: 60558 - DNA, 408 bp, Zea mays
  Clone ID: LIB3069-001-Q1-K1-E4
ctgacatcaccggtgggggctggggaggagagggagagccttctttaagatcagtaggtcagcacaccctcacccgtcctcattgcccccctctcacacacgcacacacactctctctctccccattgtgtcactgtaactagcaattgagctcttaaaattttggttgaggtgcagtagcaaggcacactactacgatctacaaacaagatgatcagttgatgcccggtgtcttcaggatcttttcaggttcgcgaggtcccattttgcttctccccccgggcttgcagttgcgtttgagtgcacctctgaggctttggttggccctcgcgctgcgtacttaagctctccgccccgtccacggcgttgcatctctcatggcactcggtgtctcctgatagctgctgg

SEQ ID NO: 60559 - DNA, 154 bp, Zea mays
  Clone ID: LIB3069-001-Q1-K1-E5
tcgcccactcgtccgcccacgcgttcgcatgatttggctccttattttctgttgttgttacagcccaattctttggaggaataaagtttctggtgtattgagaggtgtctttctgaaatagggagcatatcagatgcacacgtgtctttcgtgt

SEQ ID NO: 60560 - DNA, 402 bp, Zea mays
  Clone ID: LIB3069-001-Q1-K1-E6
ctcaggcctatgaggtcctcagtgatcctgaaaagcgagagatttatgatcaatatggtgaggatgccctcaaggagggaatgggaggtggtggagggatgcacgatccctttgacatattccagtcattctttggtggtggaagcccttttggaggtggtggcagcagtaggggcagaaggcagcgaaggggagaggatgtggttcatcctctgaaggtttctctggaggatttgtacaatggcacatcgaagaagctctctctgtcccgcagtgttctctgctccaagtgcagtgttaagggtacaaagtctgaacctatatagaggtgcgctggttgccaaggttctggctttaaggtccaaatccggcatttggcgcctggaatgatccatcatatgc

SEQ ID NO: 60561 - DNA, 386 bp, Zea mays
  Clone ID: LIB3069-001-Q1-K1-E8
gtggaatcttctgcaacaacaggagcaaataaacaaacaagtgaagatgacacaaagagtccatattcgaatccttcagcacctgcagcagaaagcaatcagctgcctagggatactgatccatcacctgggcagcctttgcaacctggaatgtcatcatctggtgttggtgttatcggccgaagaagtgtatctgatcttggtgcaatcggagataaccttactggaacttctgctagttctggtcatgatcagctttataacctgcaaatgctagaagctgcattccacaagcttccacaaccaaaggactctgagcgtgctaaaacttacattccgcggcaccctgcagttacccctgctagctatccccaagttcagccatc

SEQ ID NO: 60562 - DNA, 216 bp, Zea mays
  Clone ID: LIB3069-001-Q1-K1-E9
ctgaggcaagttcgacatgcctgaacgcatgtagtgaggctcaagaacaagaatccgcaccttcgtgcccctgaaccaatacttatggtatttgggtaccatctgatgtcataaccaaagagcaacatgttaacagatgctttgaaaaactgtaccgtaactgtcggattcttttaagtacattatagtaaagacttgagcgttagctcaaaatga

SEQ ID NO: 60563 - DNA, 327 bp, Zea mays
  unsure at all n locations
  Clone ID: LIB3069-001-Q1-K1-F10
cttttccagctcgtcactgtgccgctcgtgtccttcactcccggtccgnccaaccaatggtccgtcgatccatccaccaccaccaccccgctgcggcgatgtgcggcggcgccatcctctcgggtttcatcccgccgtccggggtggcggcggcggcggcggcggcggccaagaagaagcagcagcagcggtgccgtgtgactgcggacctgctatggccggggcccggcagtaagggagctccccaggacaaggaggaggacttcgaggccgacttccgcgagttcgagcgcggcctcggcgaggatgacgtggacagcgccggcg

SEQ ID NO: 60564 - DNA, 430 bp, Zea mays
  Clone ID: LIB3069-001-Q1-K1-F11
ctttaggaacatttttggggatagggactttagattacgagatgttaaggttgcactcgaactatcatttatggaagcagttcaagggtgcagcaaaacggtcaccttccaaacgtctgtaacatgtgaaatctgtggtggagccggtgtgcctcctggaaccacacctgaaacatgtctatcttgcaggggttcaggatttatattcatgcaaaccgggcccttcaagatgcaatcaaacttgacaaaatgtggtggttctgggaaaactgtgaaggaattctgcaaggcatgcagaggaaacaaagttgtgcctggaaggaaatcagtccgccttgacatactgcctggtttggataatgaggataccataaaggtggttcgatcaggtggagaagacccagatggccgtccaggtgatctttatgtg

SEQ ID NO: 60565 - DNA, 438 bp, Zea mays
  unsure at all n locations
  Clone ID: LIB3069-001-Q1-K1-F12
cggacgcgtgggcggacgcgtgggcaagcccgcatgcaatcaggagccggggagatgtggagacgccggcgacgaggcgaagaagaaggaggcggcgcttgcatcaagcaggctcctcgacccggcgttcaagccctccaaactatcccaggaccggctcgacaagtttaaggaattacacaagaaacggttacagataactgaaaagccgaagtataaaagaaaactgaaaggaaccgctgggagaagtaccaaagtaaccagtgattacaaattcactaatacggatgcatctgctgatagttctccaagagatgtacatcatacgtcatcaattacaggaatccaaagggatcctgcatcaggcctgtcctcgaggaacaaaagaaagctacattgggggctggatattaaaggacgatggngaaggaaggcaaa

SEQ ID NO: 60566 - DNA, 285 bp, Zea mays
  Clone ID: LIB3069-001-Q1-K1-F2
tcgggcggaggctgctgctcctgctggtcccgaggagactcctgcggtcgagcaggacgcagccgccgaggaggaggctgctgctgctcctactgctggtgccgaggagcccgccgcggccgagcctgtcgccgaggcagaggctgctgctcccgaggagctcgccgcggacgagccggaggctcctgctcctgctcctgctggtccccaggagccggccgacgaggcggaagctgctgctcctgaggagcccgagaaggccagccagtgatgccgtgcgcacgc

SEQ ID NO: 60567 - DNA, 388 bp, Zea mays
  Clone ID: LIB3069-001-Q1-K1-F3
tcgcggacgcgtgggcggacgcgtggggactgcggcaaggagcaggccatcgacatggtgctcacggactactgcatgccagagatgaccggctacgacctgctcaaggccatcaaggcgctgaacccgctgaagccgatccctgtcatcgtcatgtcgtcagaagacgagccccagaggatcagccgatgcctgaacgcctgcgccgaggacttcatcgtgaagcccctgcagagcaaggacgtgcagcgcctacggaactgcttcacagtccggaggcccagcaacaatggcggcgccacgttgccgtgcgaggagaacgccgtggccaagtggagtaacaacaagctggcgccctccgccggcgcctgcgccggcgccagcgcca

SEQ ID NO: 60568 - DNA, 373 bp, Zea mays
  Clone ID: LIB3069-001-Q1-K1-D8
agaacctgcgcatccgcaaactcatatttaccaacggagacatggtccactccgggagagccctcaagagggtgggcctggaggactgcttctaggggatcatctgcttctagaccctgtacccgccgtgcccgtcgcatggagaccaggatcccgagatcttcgacatcgccggcacacttcgtccgctccggcaccgtcgactagctgaccaagaccctccgtcctgtgcaagcctaacgtggacgccatggatgaggcgctcatgatcgccaacgtcaacccgcacaatgcgatcttcttcgacgacagcgttacgcaacatccatgccggtaagcagattggccttcacacggtgctggtgggcaaatc

SEQ ID NO: 60569 - DNA, 436 bp, Zea mays
  Clone ID: LIB3069-001-Q1-K1-C12
ctcaagcttcagtcgtccatggctcagcagcaaacaaatcctgaagaggtggtcctcgggcaggaggtcggggccgcgagggtggccactctcaaccgcccgcgccagctcaacggcatctccgacagagtggtgtacctcctcgcacagttcctggagaaatgggagaaggatgagaacgccaaattcgtcatctttaagggtgctgggcgtgcattttctgctggtggggacctaaagatgttttatgaagggaaatcaaatgattcctgcctcgaggttgtgtatagaatgtattggctttgctaccacattcacacgtacaagaaaaccatggttgctcttgttaatgggcttgtcatgggtggtggcgctgcaatggttgcgccactaaagtttgcagttgtcacagagaaaacaatctttgctactcctg

SEQ ID NO: 60570 - DNA, 293 bp, Zea mays
  Clone ID: LIB3069-001-Q1-K1-C3
gaccgacataagtgcactggtgtacgatgattcacttcacgctttcctgccgtatgaccgcgagtggataaaacagaagctgtttcagcacctgaagcggatggcgcagcagtagggtatccagcaccgctggcttttgacctgcatctggttaccggttcgggcttggattcaaatgcccgggatgtgtgtatagaaataagacctgtatcccgtgtttgatgtagaacatgtggacatggtgttgcttctgaagacgattttggctcaacaatgcagatttcatgtttgtc

SEQ ID NO: 60571 - DNA, 212 bp, Zea mays
  Clone ID: LIB3069-001-Q1-K1-C4
gactcgcgtacgtagctcatcaagtatcttctcagggagatccttcgggagatcatacagatgctcaaatgacttgagtcatgacgtgagacctgaggtcatagattgtgtctgcgatattggaggcgacatactctatgacgttcgctatactactgcagattgcatagttcaatgcaacttacattacgacttgtctcattaacttgcgc

SEQ ID NO: 60572 - DNA, 401 bp, Zea mays
  Clone ID: LIB3069-001-Q1-K1-C5
cgttcaagaagctcgaggaggtgtatgggagctttgacgcgccgtctcagaagaagaagggctttgttctgccgaggcccaagatggccaacgctgacctgggcaggattatcaactctgacgaggtgcagtctgtggttaagccactcaacaaggaggtgaagcgcatggagaagaggaagaacccgctcacgaacatggctgctgtgctcaagctcaacccctacctcggcactgcccggaagatggccacccttgctgaggctgcccgagtcaaggcccggaaggagaagcttgattccaagaggaccaagcttacctcggagactgccaaggtcaaggctgccggcaaggcgtggtacaagaccatggtctcggacagtgactacaccgagtttgag

SEQ ID NO: 60573 - DNA, 263 bp, Zea mays
  Clone ID: LIB3069-001-Q1-K1-C6
gacgaataatctcttcttcacctcactaacaccagctagcaactctttctctcctgcaataatggccgctcgctcctcctcctcccagccgcagctggtcgcggcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccggggggtgctgcaacgggg

SEQ ID NO: 60574 - DNA, 126 bp, Zea mays
  Clone ID: LIB3069-001-Q1-K1-C7
cccggtcgcccactcgtccgacaaaaaccctgactcaccttataaactaatcgcacctctttctatcggagggctttctatggctactcctactacacaccattcttgccaggattataactgtca

SEQ ID NO: 60575 - DNA, 343 bp, Zea mays
  Clone ID: LIB3069-001-Q1-K1-C8
cgacgagctccggcggtaccggagggtgcaggcgctgctcaagaggctcaacaagccggcgctgcggagcatccaggcacagccccgacggcgacctcatcgactgcgtgccggcgcacctgcagccggccttcgaccacccgaggctgcgaggccagaggccactggcgggcccgccgccggcgaggcccaaggggaaccgcctccgcgacccgataaggaatgacaccgcggaggccgtcggcgtccagcagctgtgggcggcgtccggggagtcgtgcccggaagggtccgtgcccatcaggcgtgtcacggaatcggacgttgctccggccagcttcgt

SEQ ID NO: 60576 - DNA, 360 bp, Zea mays
  Clone ID: LIB3069-001-Q1-K1-C9
ctcccccatccggcgccgccggctcctcctctagctccctccttaccccgagctttaagctcgtgctacctgcctacctatccgtagggagagagagagagaggggagaaggttcggtcggtcggtcgggggctctcggatctcgccgctgcctccccgtttcttcgttgggatctcgctcgcttcgcgccatggccgccgtcgcgacgccaccggcccccgcgcccgccgcgccggcaccggcaccggcaccggctgctgctccggctcccgtcaccgtcgcccctgccgcggaccaaaccacggatctgctgcagaagttgtcgctggattcgcagcccaaggcggcgggtgcgacag

SEQ ID NO: 60577 - DNA, 404 bp, Zea mays
  Clone ID: LIB3069-001-Q1-K1-D1
agagaatccaagaactgaaactacattgtttggagatagttcatcggaaatccttgatgagcctcagatggtgatgtctgctgaacctttccatgcacctgcttatttgaacttggaggctggaaattcaagcccaacggttcatgtcgagctaacaaattccgatgagaaactggccaatcttgcagaagacaagaatcggcgactttcagatgcaagccagttaagaacaggttcaaacccaatggttgatgttgagctaacaaatttcgatgagaaactggccaatcttgcagaaggcaagaatcagcgactttcagatgcaagccagttaagaacaggttcaaacccaatggttgatgttgagctaacaaatttcgatgagaaactggccaatcttgcag

SEQ ID NO: 60578 - DNA, 438 bp, Zea mays
  unsure at all n locations
  Clone ID: LIB3069-001-Q1-K1-D10
nncgccacgcgtgcgggtgcgctcatcttggtatctgttccagcgctcgcttctccccgtccggcgcgtccttcctttccttgtctagccgaaggccgaagccactgtgcgcgcgagcgcgacgcgagaggtagctgctgctgtgcccggcgcgcgcgtgcgtgcgacgatgtcgtcggcggtggaggccgtctcctgccccaaggtcgacgtccccgccggcccggagccgggggagccggccaaggaagcggcgccgnccgcggagcactgcgacacggcgcccaacggcaagtgcgcgccgcgttgccacggngaggaggaggacgacgacgacgaggaggaggaggaggaggagaaggcccccaaggccatcgacctcggccccatggtcagcatcaaggagcagctcgagaaggacaaggacgacgagagcct

SEQ ID NO: 60579 - DNA, 283 bp, Zea mays
  Clone ID: LIB3069-001-Q1-K1-D11
atgtccttgattatcggtatctatgatgagccaatgtactccagggcaatgcaatatggtggtggagaggctcggcgattacctgatcgaacagggcttctaagtttgtcataatgctattttggtcattgggcacttaagtttgcacctcatttggttctgtaatatgtgggcttgtgcatgtgcttggcgtattgcatgcagtgaataatttatcttcgcgttgggttggtgacaatgttgggaacggatttgaattggggtttatgcttgccatctcctc

SEQ ID NO: 60580 - DNA, 369 bp, Zea mays
  Clone ID: LIB3069-001-Q1-K1-D2
agttactggtaatggcaaccacaatctctcctatgcagggagagatcttcaactgcaagagacctacttaaaggtgcttcttggaaatagcagtcgaagcagcagtaccaatgcatcaagtacagtcaccgattcactgctaccctcactagttttaaatttatcatcaccagaagtagaagacgcatcaaagttttcagctcctgctgtggtggaaacataattggtttaaacgatcactgccttcaaaaacttgtgaattaagaacatgtgatttcaccctcagtcatgaaaagagggagcgtatgaggaggagagctgctgtgagatcagctattgtccagcatctccttgtcaccaccatttttg

SEQ ID NO: 60581 - DNA, 404 bp, Zea mays
  Clone ID: LIB3069-001-Q1-K1-D3
agttactggtaatggcaaccacaatctctcctatgcagggagagatcttcaactgcaggagacctacttaaaggtgcttcttggaaatagcagtcgaagcagcagtaccaatgcatcaagtacagtcaccgattcactgctaccctcactagttttaaatttatcatcaccagaagtagaagacgcatcaaagttttcagctcctgctgtggtggaaaataattggtttaaacgatcactgccttcaaaaacttggaaattaagaactgttgattccacccttagtcatgaagagagggagcgtaggaggaggagagctgctgggagatcagcttttgtccaacatatccttgtcaccaccatttttgaagactagcagatcaagcacagttcatgcaaaggaa

SEQ ID NO: 60582 - DNA, 371 bp, Zea mays
  Clone ID: LIB3069-001-Q1-K1-D4
cccacgcgtccgcccacgcgtccgtccacgcgtccgagaaggacggccggccagtttagcctagccacgctcgctgtacgtcctcaatcctgattagcttcaaaccgccatggccatggggctccccggcctccgctgccaccgcctcctcgctcgcgggtcactccctccactcggtcccgccctctatcgcaggcccctggagcgaacctcggctctccgctactcctccctccaagctcaagctggggacagtattggggaggaggccctgcgcatgttccttgaggagaggcaactgcacggcgatttcgtcaccaaggtctctgacatggtctggaggaggaatggcgccaatgttggtgcggctg

SEQ ID NO: 60583 - DNA, 375 bp, Zea mays
  Clone ID: LIB3069-001-Q1-K1-D6
ctttcttgaatgtcagtttgggactttgggtacctctagctggtcatgtttgggcttttggttacctgcaccgatgtgatatgttgcatccatttacatacacaagcaactatgcacgctggtggtgaggtgtattgaactgtccttgattattgaggcctagtgtacgttgtgcagttgtttgtccagcctatggtgggttgtctacatctccatgaaatgagatggagagctgatggataaaggataatgttggttggacatatggtcataattacataagtttgattaggctcacagagtcacagtgatttgaactaccgtgacttgattgacatatcttcgggtatgtgattcccaaagtagccattgggt

SEQ ID NO: 60584 - DNA, 430 bp, Zea mays
  Clone ID: LIB3069-001-Q1-K1-C11
gtgctcggcctgtcagatggctgtcgtgtggatttagaaccagctccgcgaaaacaagaccaaggagctcatactgcagtacgctaaccagctgtgtgagcgtctgccgagccccaacggagagtcaacagtcagctgccaggagatctccaagatgcccagccttgcgttcaccatcgcaaacaagaccttcaccctaacacccgagcagtacattgtgaagctggagcaaggaggccaaaccgtctgcatcagtgggttcatggcgtatgacctgccaacggcgcgtggtcctctctggattcttggggacgtcttcatgggagcttaccacacggtgttcgacttcggcaacgacaggattggcttcgcggaatctgcatgagtgtggagaccactctgctcttcatgcataaagataccctatgta

SEQ ID NO: 60585 - DNA, 400 bp, Zea mays
  Clone ID: LIB3069-001-Q1-K1-D7
agaacctgcgcatccgcaaactcatattcaccaacggtgacatggtccacgccgtgagagccctcaagaggctgggcctggaggactgcttcgaggggatcatctgcttcgagaccctgaacccgccgtgcccgccgcagggagaccaggagcccgagatcttcgacatcgccggccacttcgcccgctccggcaccgccgacgagctgcccaagacccccgtcctgtgcaagcctaacgtggacgccatggaggaggcgctcaggatcgccaacgtcaacccgcacaaggcgatcttcttcgacgacagcgtacgcaacatccaggccgggaagcagattggcctccacacggtgctggtgggcaaatcgcagcgggtgaaaggcgcggaccacgcgct

SEQ ID NO: 60586 - DNA, 398 bp, Zea mays
  Clone ID: LIB3069-001-Q1-K1-A6
aagggcatggacagctgaagagaacagacatggtgacctccttaacaagtacatgtaccttactggacgggttgacatgaaacaaattgagaagaccatacaatatctgattggttccggaatggatcctggaactgagaacaacccctacttgggtttcctctacacatcattccaagaaagggcaacatttgtgtcgcatgggaatactgcaaggcatgccaaggagtatggtgatctcaagctggcccagatatgtggcacgatagcagccgatgagaagcgccacgaaacagcctacaccaagatagtcgagaagctcttcgagatggaccctgattacacagtgcttgcgtttgctgacatgatgaggaagaagatcacgatgccagcccatc

SEQ ID NO: 60587 - DNA, 379 bp, Zea mays
  Clone ID: LIB3069-001-Q1-K1-A7
gaggctcgtccatcgtacaaacatactacgtaataacaccggtcgatctcttcagttgcctgcgtgttcgtaggcaagggcggcgtcggtggaggcagcagcggcaagaagcccggcggcaccacggtgggagttgggaaagggggagtgggcgttaacgttaaccctaccaaacccggcggcgccggtacaaccgttggcgttggcaaaggtggcgtctgcgtcggcgtcaatcccgggtacggcaagccgggtggcaccacggtgggcgttggcaagggcggggttggcgtccacgtgaacccgggcaagaagcccgtccacgtccccgttggccctttccaatacgagtacgccgcatcggatacgcagttgcacg

SEQ ID NO: 60588 - DNA, 396 bp, Zea mays
  Clone ID: LIB3069-001-Q1-K1-A8
cccactcgtccgtgcagaaacttggattgcaaccaacaagttatacatatgacggttttattaaaaccgtgatagctgggaaaggaattgcatatgccagcatagtgattaacgccatggagagaaggggcattgaaccttacagtgatacacttgctgctctctcagagggtcatagcaatagtttacagttggatttggctgaggagtttttggaaagaatttcagagataaaaccaaagcatataggttcctttaatgctttgctttctggatgtgcgattatgaatgaaccagaaagagctgtccgcatactagctaaaatgaaacatgtgaacatgaagccaactctcaggacatatgaacttttgttttctctgtttggaaatgtaaatg

SEQ ID NO: 60589 - DNA, 362 bp, Zea mays
  Clone ID: LIB3069-001-Q1-K1-A9
gttgctcagctctcccgtccgctgctgccctccgtgcgggtccagatcccggcaccaaccgatccggcgccctacagcatggccggggcgaaggcggcggcagccctggctcttgcgctcgtgcttgcgctcgcggtggccaactccgagggcgactccctctgcgagctgcgccggagcctgagggaccaccggcggcgttctgcagagctgggaccacacgctcgtcaacccgtgcacctggttccacgtcagctgcgaccgcgactaccgcgtcaaccgcctagatcttggcaattagaacttgtctggtcatctggtgcctgagcttgtgaaactggatcatcttcagtatctggaac

SEQ ID NO: 60590 - DNA, 88 bp, Zea mays
  Clone ID: LIB3069-001-Q1-K1-B1
tcgaaaaaaaatatatgcaaaaaaaaaaaaatacataataaaaaactaaaaaaaaataaaaagggaggctagttctaaaccgcaagct

SEQ ID NO: 60591 - DNA, 437 bp, Zea mays
  Clone ID: LIB3069-001-Q1-K1-B10
cccacgcgtgcgagtttataaattgtcaatcacatttattaaaagagactaaaagtaaggtttcaggttctatttctatccatctttaattaagggctgaaacgatactgtcttgattcctaattcacctaatattcctagaccaagaacgactcgggttaatggtcagggatgccaaattgtttcagtaaaactaatgaagctcgtatgatgattatgtacctacttgagaacaaattgtctaaaacatatctgctactacacttcaatagaacaattggtcacacacaagaagttcaaatcagaaaatgccagcttgcggtaactccggtaggttcttcgatggtttccggtaagggctgaccatggagaagagcacagtggtggtcagtgtccctgttgttgtcatggccgagactgctgagaccgactacaac

SEQ ID NO: 60592 - DNA, 432 bp, Zea mays
  Clone ID: LIB3069-001-Q1-K1-B11
cgctaagctccgagaagaatctagaaggaggagcttccttccgagccaaggcggcgaggcggataagggtctgtcgagggggcacaagagcatgcggctgcaggacacgaaccagagccacgtgcacgccgaggaatcgctgcccgttgtggccgaaaacggggtgacaatggcggggaacgacggcgactcgcggctgttcgtcgacctggagcccgttccggccatcagcaagcggcacggcggcagcgtcggcggcgaccacgcggcgccgtgcgccagggctaggaccatgtccaccagcttcaaagagccgccttgtgtcgccgaacaacctcctctctctggccccgtgcagctcgcggcgtccaccggcttctcctgggccaagaagccccggcccgacgccacgacggcggcggtaactgtgac

SEQ ID NO: 60593 - DNA, 395 bp, Zea mays
  Clone ID: LIB3069-001-Q1-K1-B2
cccagctcgctcgtcccagctgatcaggtcgagcacctagtagcgacctgctcgatcatcagtgtagagtgtcggtaggtgtctgtctctcttggtggctggttgcaacggtcatggcgacgtcgtctcgtcgggtgcccttgctgctgctgtgcctgggcgtgctggtgtcctgctccttcgcggcgggcagcttggaccaggagctggacatcacgtggggcgacgggcggtgcaaggtccttgacaacgggcggctgctgacgctgtcgctggaccgcacgtccggctccgggttccagtcccggcacgagtacctgttcggcaagatcgacatgcagctgcggctggtgccgggcaactccgtcggcaccgtcaccgtctactacctgtcg

SEQ ID NO: 60594 - DNA, 381 bp, Zea mays
  Clone ID: LIB3069-001-Q1-K1-B3
tcgcggacgcgtgggccaacccagctcgctcgtcccagctgatcaggtcgagcacctagtagcgacctgctcgatcatcagtgtagagtgtcggtaggtgtctgtctctcttggtggctggttgcaacggtcatggcgacgtcgtctcgtcgggtgcccttgctgctgctgtgcctgggcgtgctggtgtcctgctccttcgcggcgggcagcttggaccaggagctggacatcacgtggggcgacgggcggggcaaggtccttgacaacgggcggctgctgacgctgtcgctggaccgcacgtccggctccgggttccagtcccggcacgagtacctgttcggcaagatcgacatgcagctgcggctggtgccgggcaac

SEQ ID NO: 60595 - DNA, 387 bp, Zea mays
  Clone ID: LIB3069-001-Q1-K1-B4
cggacgcgtgggcggacgcgtgggcggacgcgtgggcggacgcgtgggcttgcagctgcacccttcactcagtcttagtctcttattagctctaggctctagctagccgcgccactccttcgtgtagccatcagccttctcatcgccaccaatggccactgccgaggtccagaccccgaccgtcgtggcggccgaggaagcgcccgtggtggagaccccgccgccggccgtcgtgcccgaggagtctgcccccgccgaggccgaggccgaggccgaggctgctgctcctgctgatcccgaggagcttcccgcggccgagcagcaggcagccgccgaggcggaggccgcggctcctgctggtgccgaggagcccgtcgcggccgaacc

SEQ ID NO: 60596 - DNA, 397 bp, Zea mays
  Clone ID: LIB3069-001-Q1-K1-B5
gggttttggcctcgccgcgcacgcctcctgaagcttctagacgttcgaggaggaggagaggctcccgccgacgtcgcagccatggcgtccaccaaggtgcagcgtatgatgacccagcccatgaacctgatcttccgtttcctccagagcaaatcgcgcatccagatctggctcttcgatcataaggacctcctgattgagggtcgcatcatccgattcgatgagtacatgaacttggtcctcgaagatgctgaggaaatcaacgtccagaaaaacactaggaagacactgggccggatacttcttaaaggtgacaacataactctgatgatgaacagtggcaagtggaaattcttatggcaagaacgatgtttggagctcgcggtgaatatttctg

SEQ ID NO: 60597 - DNA, 393 bp, Zea mays
  Clone ID: LIB3069-001-Q1-K1-B7
cccacgcgtccgcccacgcgtccgcggacgcgtgggtgcgattactataacatcaagccagatctagtttcactggccaaggctctttcaaacgcctacgtacccatcggggcaactcttgttagcccagagatatcagatgtgatccattcccagagcaataagcttggttcatttgctcatggattcacgtactccggccatccagttgcctgtgctgtggccattgaagctctgaaactttatcgcgaaagggacattcccggccatgtcaagcaaatcgccccaaagttccaggacgggattagggcgctggcagacagtccgattataggggagatacgtggcttggggatgattatgggtaccgaattcacaaacaacaagtcaccg

SEQ ID NO: 60598 - DNA, 376 bp, Zea mays
  Clone ID: LIB3069-001-Q1-K1-B9
gcgagagggaagagatggcggcgtcggacgttgagtaccgttgcttcgttggcggcctcgcctgggccaccgacgaccactccctcaacaacgccttcagcacctacggcgaggtcctcgagtcgaagatcatcctggatcgggagacgcagaggtcccgcggcttcggcttcgtcaccttctccacggaggacgcgatgcgcagcgccatcgagggcatgaacggcaaggagctcgacggccgcaacatcaccgttaacgaggcccagtcccgcggcggccgtggaagcggcggtggcggatacggtggcgggcgccgtgatggaggcggctacggcggtggcggtggaagctacggcggtggtcgtggaggcta

SEQ ID NO: 60599 - DNA, 378 bp, Zea mays
  Clone ID: LIB3069-001-Q1-K1-C1
tcgtccactcgttcgcagactcgtgggttttttttttttttttttttttttttttttttttgtttgggtttttttttttttttgttttttttttttttttttttttttttttttttttttttttttttttaaaaaaaacggggttaaaaaaatttttttaaaaaaaaccttttaatgggggggcatttttttcccacaaaaccaaaaaaagggggaaaataaaaaaaaaaaatttcagggggacggttttatttcccatccgtgatttccacccgtcaaaaaacctgatggggaatgttttttttttaaaaacccgggggccctccaaaatttcaagggggggcccttcaccgttttatttcggataaaaaatttttt

SEQ ID NO: 60600 - DNA, 387 bp, Zea mays
  Clone ID: LIB3069-001-Q1-K1-A4
gccgcggccaacgcggcgctgccgccgggcgcaaagcccttctccacgttccagtccgtgggggcgcacatctggcgcgccgtctcccgcgcccggggcctcggccccggcgacatcaccgtcttcgccgtcttcgccgactggcgcgcccggcttgacccggcccttccggcggcctacttcggcaacctcattcaggcggtgttcacgggcgtgcccgcggggatgctcctgggcgggccccccgagctgtccgcgggcctgctgcagaaggccatcgacgagcacgacgccgtcgcggtcaccaggaggctggaggagtacgaggcggcgcccaagctgttccactacagcgacgccggccccaactgcgtggccgtcggcagc

SEQ ID NO: 60601 - DNA, 434 bp, Zea mays
  unsure at all n locations
  Clone ID: LIB3069-001-Q1-K1-C10
cccacgcgtccggtactactatccccgctaccgctagccgccgcgctgctcatctggtggcggctcgcctccctccccccatccgccgccgccggctcctcctctagctccctccttaccccgagctttaagctcgtgctacctgcctacctatccgtagggagagagagagagaggggagaaggttcggtcggtcggtcgggggctctcggatctcgccgctgcctccccgtttcttcgttgggatctcgctcgcttcgcgccatggccgccgtcgcgacgccaccggcccccgcgcccggcgggcccggaaccggcaccggcaccggctgctgctccggctcccgtcaccgtcgcccctgccgcggaccaaaccacggatctgctgcagaagttgtcgctggattcgcagcccaaggcggcnggtgcgacag

SEQ ID NO: 60602 - DNA, 347 bp, Zea mays
  Clone ID: LIB3069-006-Q1-K1-G12
ccgcctacacctacatacatgtattctaatgccagagcacaaactacattagcttgctatccttgaacattacccccagccatttaaacacctccactaccccacccataattcacgtaaactcctcaaccttctactccctataatgccatccctgaataatacataccaaaatctctccactctaacagaactacatatctatactgacctaccaatgttcctcatactctcccttaacacctacgacacaatcatttccagactcttaatgaactatctacatcatgcatcaccccttctctacattccacttgttataaacatactcttactatactcttcat

SEQ ID NO: 60603 - DNA, 314 bp, Zea mays
  unsure at all n locations
  Clone ID: LIB3069-006-Q1-K1-G2
ggtttctcctcgtggtcgcggtcgtgtccccgttttcccgtgcgccaacgccaagtgaaggcaggctaccagtantgccctcgtcctccaatcgtcaatgagcaccgacgccgcacccctcctacactctacccgcacagcgcccctcgccctcacaccccaacccaaccattcgctccttgtcgccttccgacgctgagtttgctggtgtcgatttgcaccggcggatgctcgatctggtagctgcatgtgccgacctactcgtcgaatccggttgttgtcatgacacatgcatatgggaacagaactggaat

SEQ ID NO: 60604 - DNA, 253 bp, Zea mays
  Clone ID: LIB3069-006-Q1-K1-G3
acccacgcgtccggggatctctggcttctccccgtcccgttcctgcttaccttccttgtatagccgaatagcgaaacgactgctctcgcgagctcgacgctagatgtaccttctgctgcgcccactgcccgcttgtgtactataatgtcacagcgcccctgagccgccacctgacccaaactatacgttcccttcggcccttagacgctgaagccgctcaagtaaacttcacccaccggatactacttctaca

SEQ ID NO: 60605 - DNA, 256 bp, Zea mays
  Clone ID: LIB3069-006-Q1-K1-G4
ggacgcgtgcgcccacgcgtccggctatgagctttacttgttggttggattctctggagtctggcagctagtccagttaagtttcagacacacatggggagcattggcagaggcacggccaactgcgccaccgtgccgcagccgccgtcgtcgacagggaagctcatcacgatcctgagcatcgatggcggcggcatccgcggccttatcccggcgaccatcattgcgtacctcgaggccaagctccaggagctgg

SEQ ID NO: 60606 - DNA, 435 bp, Zea mays
  unsure at all n locations
  Clone ID: LIB3069-006-Q1-K1-G5
cggacgcgtgggcgctcgccaacgtgttgagtaaggaagcagctagctaggaggccagccgtccactgaccggccggtcatggcgaggatccacctttacgtcgtcgccgcggcctgcgccgtcgccctcgcgctcgccgtcccggccctcgccggcgacccggacatgctccaggacgtctgcgtggctgactacgcttccccggtcaagctgaacgggttcccgtgcaaggcgaacatctcggcggacgacttcttcttcgacgggctgaggagcccgggcaacaccaacaacccggcgggctccgcggtgacggcggccaacgtggacaagttcccgggggtgaacacgctgggcgtctccatggcgcgcatcgactacgccccgggcggccagaacccgncgtacacgcacccgcgcgccaccgagatcat

SEQ ID NO: 60607 - DNA, 393 bp, Zea mays
  Clone ID: LIB3069-006-Q1-K1-G6
agatgaggaaggtataatttagaatgttaacatcttgatacatctggtgggtatagagcacttaaagatgggatgaagctttatatttcagacaacaaagtgatcttgacagaaggttttggttttgatggcgttgtccctgtgaaatactttgaaagaatcgaaacatggccaggacgagctccaataccgttccaaagataacaggccatgtttcagcattgctagttcgtacgtactgaaaaatgatttgtcatgatgtatcccggagaaccattttttttggtaattcacatacactattttggggggttggcttttttttttttggggggggggggagtcactatgattgtgttgggacctctcagatattcgtttgatgatttttgc

SEQ ID NO: 60608 - DNA, 411 bp, Zea mays
  Clone ID: LIB3069-006-Q1-K1-G7
cggacacgtccgccttaatttctatatgaccctctgctccccatcaactctggacctgtcccaacgatccccaattcctccttcagatttcacattcaatgcaactcaagacagcaaagaaagcagacatatacgaatggggctcgtgtttatgaagctcttcagccatctcttcgtcgataaggatatgcatatccttatggtcagcatcgataccactggtaaaaccaccatcctctacaagctcaagcttgacgagatcgtcatggtcacctttagaggaacacattggacaaggactcggacactgttgcataccgatgatacagatctaaagtaagatggggatgtcgtgtgcttgagacgacaaggatggaaatcttttcaagtaatggctactctttttatcat

SEQ ID NO: 60609 - DNA, 431 bp, Zea mays
  Clone ID: LIB3069-006-Q1-K1-G8
gggagtcgtctccctgtactgctgcctgcccgctgcgctcaccggtgacggctcctgctcgcgccgccggagcccatcccaccgcacgctgcaccgtcgtccgcctctgcaatttgcgccgccggtccccgtcaatgtcgattgccgtctgcctcgctatccatgcggcctgactccatcccgtcggttgctgctcccattcccccacaccgtgcgccctgctactccgcacgtttgacaactccgaactccatctgctcattcatcgtctcgtccattcctacaggtatgaacactcttcgaaatgtgcctactcggtattagggatatcttgggtctagcgaggaagatgacgaaaggttcctctcgccaatacctacggtttcggccgcagatcgagccagtggccccaacttgtgcgcgagcgaacg

SEQ ID NO: 60610 - DNA, 421 bp, Zea mays
  Clone ID: LIB3069-006-Q1-K1-G9
taactgccgctgggcaccatttcttgcactgtatacatctgacacattccttaccatgttggggctgctatccaagtacagaatgaagagccttccagttgtagaagtgggaggagataagattgagaacattatcacacaatcctctgtcgtacacatgcttgcagagtgtgttgggctctcctggtttgagaactggggaactaagaaactctctgaactggggcttcctgtcatgaaaccatcgaaacttgtcaaggtaagcgaagatcagccagttctgaaagctttccaactgatgagggaaaagggagttggtggcttgccagtcatggacacaagtggagcaaatgccattggtaatattagcatcagagatgtccagtatcttttaactgctcccaagatatacaaagagcac

SEQ ID NO: 60611 - DNA, 373 bp, Zea mays
  Clone ID: LIB3069-006-Q1-K1-H1
gacccactcgtccgtgctttcagagatggtcgctgaagcgttcaggtttatcaaccaagcctgctagcacggaacacgcttatgttggcttagaggaaagatcagcagccctcaaggcactttcattggctgtcggtcctatgcgtggatcatctgcactgagatcaggagcttatccacaaagcattcagcataagtctacagtgtttgctcctaagatgccagaactaagatctgcagtaaccccttcaccggcaccagcagtgccagtcccagttgctattcctttgcgtgtggcagctcaagtacaggcttcggctcatcaagggcattaagcttctgcccatgcttcaccacccaaatttgtaaatgc

SEQ ID NO: 60612 - DNA, 351 bp, Zea mays
  Clone ID: LIB3069-006-Q1-K1-H10
aagccttacatcaatatgatcagaactgtgtattcagtttcatttgaggaatacaattgctgagtattctttatacaagtgtctgataagaggtaaacagccttggcataactgtacatgtaataaaatgaataaggttctgccaactctcggtctcggttatgccaattaataaccataattcgttgtttcagaccacggtactttttgatcagccggctgctgctgtgagccgataacaatgtagctcattgtgcacctccatattgtactcttgataagtgtactactcatcactgccaagcaacgatgagatagagtaattggtctgtttcccgcaaaaatacttac

SEQ ID NO: 60613 - DNA, 463 bp, Zea mays
  unsure at all n locations
  Clone ID: LIB3069-006-Q1-K1-H11
cccaggcgtccggttgagtataagaacatgtgcttcactgtttgggatgttggtggccagggcaagatcatgcccctgtggaggcactactttcagaacacacagggacttatttttgttgtagacagcaacgacagggaacgtgttgttgaggctagagatgagctccacaggatgctgaatgaggatgagctgcgtgacgctgtgctgcttgtatttgcaaacaaacaagatcttcccaatgctatgaatgctgctgaaattactgacaagcttggtctgcattccctgcgacagcggcactggtacatccagagcacttgtgctacatctggtgaaaggttgtatgaggggcttgactggctttccagcaacatctncagcaagtcttgaagcttttcggcagggctcctagcgagaggatgtctgaacaacttatggctgctttttttacatattatac

SEQ ID NO: 60614 - DNA, 150 bp, Zea mays
  Clone ID: LIB3069-006-Q1-K1-H12
gcgctgactcgtgcggtcattttaactaatgactgcttataattcaaattggatgagatcaattaataagtaatgccggatatccaatcaaggcctttgggtcacaagtacagaaaagagaattctgaagctgataaagttgagcaggtc

SEQ ID NO: 60615 - DNA, 189 bp, Zea mays
  Clone ID: LIB3069-006-Q1-K1-H3
ggggcttggcctccgctcgatgttcagctaccttacagaccgtcctcggctaggttacgttacttgcaggatagtatcaacgaaccaggagaaagaaatcgcgactaaagaacttggcagctgctctatgagtacaccacgtgctcatcgcttcgccacaacgtcgttcaagcagctcgtgacatcgac

SEQ ID NO: 60616 - DNA, 343 bp, Zea mays
  Clone ID: LIB3069-006-Q1-K1-H6
gacccacgcgtccgagcactcgtccggattgttgtcacctttatcctagtctacaccgtcttctgcaccagcgatgccaaaaggaatgccagccactcccatgttcctatccttgccccactgacaattgacttcgcgatattcctggttcaccttgccaccatccccattactggcactgacatcaacccaactaggatccttggcgctgccatcatctacaacagggatcacgcctgtaacgaccattggatcttctgggtcaagcccttcattggcactgctctggctgccatctaccaccaggtgatcatcatagccatcccgttcaaaaacaagtctt

SEQ ID NO: 60617 - DNA, 175 bp, Zea mays
  Clone ID: LIB3069-006-Q1-K1-H8
cgcacacgagcgcacacaattccagtttcccgagacgagcgcgacggcggacacagggcatatcaaaagcacccagaccacacacatggagccagccaaggagcacgagcgcatcaaggccaccggcaagaacgccgagatgtggccctacgtaccctacacgctcaccacctac

SEQ ID NO: 60618 - DNA, 455 bp, Zea mays
  Clone ID: LIB3069-006-Q1-K1-G11
tcccaggcgttcgcccacgcgtccgcccacgttgcctatgttttgtgttcgttccacgtgtcgattgacatgcctagatctggaaccgctctctggagccctggcggccggcaacgccgtggtggtgaagccgtcggagctcgcgcctgccacctcggcgttcctcgcggccaacatacccaagtacctggactccaaggccgtgaatgtggtggatggcgggccggaggtgggggagaagctcatggagcaccgatgggacaaggttctcttcactggtaatgaactacgtacgtaatgcatgagcgtgtatctgcgttaccacctggtgtctctctcactctcaggcagcagccgcgttgggcgccttatcatggcccaggccgacaagcacctcaccccggtggcgctggagctcggctccaaatgcccctgcatcgtccactggcttgaca

SEQ ID NO: 60619 - DNA, 362 bp, Zea mays
  Clone ID: LIB3069-006-Q1-K1-H9
tgtcgaacctccactgagcacaatgttcccctgtattgctgatcggatgagcaaggagatcggttcgcttgcaccaaacagcatgaagatcaaggtcgtctcgccacctgagcggaagtacagtgtctggataggagggtcgatcctagcctcgctcagcactttccaacagatgtggatatcaaaggaggagtacgatgagtctggcccggcaattgttcacaggaagtgcttctaggtttctgccaagttcgtcaagtgcttttagggtttgccatgttcatcatcgctacctagtcttaagttatgcccccttcatttgctgagatatgtgtggcaaatttgcattcgtttggtatttc

SEQ ID NO: 60620 - DNA, 425 bp, Zea mays
  Clone ID: LIB3069-007-Q1-K1-A10
cctaaacttcttaaaccaatactttcaccacctcctaaaattcattatacgccggatctctttaacatattttccatccatttaacaacacataaaaaatcatcttcatcttcaaacgaccataatttctttaatagcttccactcttcacaaccaatacctatttcatataaaaaacatttctccaaaccatcataaatcaatacccattctacatctttaatttaatacttatttaaagactcaccaactcttccattatcctcaactccagctctttcccaactaaactctaataatgatatcattaatttattttataatctatgtttttcactccaatattgtattacctttctcttcccatcaacaacatctttcgctcatctctcatcagcaaactcttctaattactctctcaaact

SEQ ID NO: 60621 - DNA, 291 bp, Zea mays
  Clone ID: LIB3069-006-Q1-K1-E1
ccgcccacgcgtccgcataccctttttctcccaaaaactactcacatgtcgcctgcccaacgtatcaccctttctcgacggccggcctcttctcttcacggactcgcaggtcatcgagatgtcatctgccgaagccaatgccgcaacgaaggccgtcccacagtctgtgctgcgcaagcgcaagcccgaggagcagtgggcaacggacaagaaagagaacgccctcgcatacaagaaggaagcgcttgacaaccgcaagatcatatttgctcgctccaagcaatactccca

SEQ ID NO: 60622 - DNA, 367 bp, Zea mays
  Clone ID: LIB3069-006-Q1-K1-E10
tcgcaaaggactttcttggtgtttgttatggactgttttctaggtcctccacctcatacttggggaaggctagactgcaagataatgcactgaggctgttgcaggatgctgccacaacagcgaagtataatcctgaaataatgtatagcctatcttgggaaaatgcgatgcagcgcaaactcaatgcagctgttgaaagtgcaacagaatgtcttgagatggtgatgggtggttctgttagtgcctggaagttactaactgtatgattatctgcacagtataaatttcaagaagctcatgcagcagcagaattttgctatgcactacgttgataaaaatgatgctatgcatatcttgagactgaagc

SEQ ID NO: 60623 - DNA, 434 bp, Zea mays
  unsure at all n locations
  Clone ID: LIB3069-006-Q1-K1-E11
catattacctcaacccaacgaatantttatagctctcacatttcatcataatggatgcatttcttgaaaacttactcatcactcctcacgctctattcatccacaatttcatattatattactttcttattctatcttccctcatactattcaacaaatcttcattacaactatctaactcctactccaacatcctattgcagatcaaaatcgaccatatcaaaatatcacttccctagacattcccatgcattaaactttacattaaacctcctaaatcatcttcattaaataatcatcaaaattcatcacacacataataataatccccattatttcataaaccgacacttatctaataccttacttccattgaactttgaatttatcgtcattaaataatcaaagcattatttattcatactcaataatat

SEQ ID NO: 60624 - DNA, 210 bp, Zea mays
  Clone ID: LIB3069-006-Q1-K1-E3
ccactcatcctaaaaaacaaacaaaaaaacaaaaaaaataaaaaatttaaaaaaaaaaacaaacaaaacagcaaaaagcaaaattcaaaaaaaccaaacccacaccaaaaaacaacaaaacaaaaaaacacaaaaactcaccaaaaacccataaaaatacccaaaaaaaaaaacccaacacaacacaaaaaacacctacaaaccccacat

SEQ ID NO: 60625 - DNA, 408 bp, Zea mays
  Clone ID: LIB3069-006-Q1-K1-E4
ccggctcgacccccgcgtccgaggaaccttggcccgacaccatgctctctaaggttgtccaccccaccaccacgccgggcttgtcgccgcgctcccgcgtctcgccgcacaggcctcccatctcctccctggcggacccctcgtacttccccggccatcgcatcgtcagtttcaaaagcaggacgctgccacttcgctctctccacatcgccgctgccgctgccgccggggcagacgaagaagaggcgcaactaggtggaagtgtgaacgcggtcgaccaggaagaagcggagaataaggtggtggtgcccgagagacaagacccgatgctggtactcaagttcatctggatggagaagaacatccgcatagcactcgaccagctggttcctggctatggcagcatcc

SEQ ID NO: 60626 - DNA, 416 bp, Zea mays
  Clone ID: LIB3069-006-Q1-K1-E5
cggacgcgtccgcccacgctttcgcttctcgcgccgccgccgccgccgccgccatgtgtaagcgttggaggggagggacggcggggaacaagttccgcatgtcgctgggtctccccgtcgcagcgaccgtgaactgcgcggacaatacaggcgccaagaacctctacatcatctccgtcaagggcatcaagggtaggctcaaccgcctgccgtccgcctgcgtcggcgacatggtcatggccaccgtcaagaagggtaagcccgacctcaggaagaaggtcatgcccgccgtcatcgtccgccagcgcaagctgtggcgccgcaaggacggagtctacatgtacttcgaagataatgctggagtcattgtgaaccccaagggcgagatgaaaggatctgctatcactggacctatt

SEQ ID NO: 60627 - DNA, 178 bp, Zea mays
  Clone ID: LIB3069-006-Q1-K1-E6
agcaaaagcaacaaggctttagcacattcaagaaccacacctcctcccggagcctagaatcatttacacatgctgcggccgcaagtgcagatgcggctccagctgctcctgcggcaactgatgcaacggctgcggtatgtaccctgacatggagaccgtcgccaccagcagcgtcaag

SEQ ID NO: 60628 - DNA, 424 bp, Zea mays
  Clone ID: LIB3069-006-Q1-K1-E7
agagtaagaacatgcccagttagcacatttgtggcacttggaaagagtatgggatactgtaccgttcaacagagcagagaccaatttgtggcccattgaagctagaaaacagacatgtctgggattgcacaaagaagatatcagctggaaaccagaagtgtaataatcataaggattacctatctttcgtaagaggtgcagtgccacgcagccacgcagcaagcactccaaatggtttagaaaaggaggcggctaattcaaataaatccgctgacaacggaagtcccgtaaggccaatcttgccagagttattgctttcttgtcatgacatcaatagccaagagaggtccccatcatctagtgctcatcaatcatacttccctgctgcaaatgatcgaccactggagactatagagtttggatc

SEQ ID NO: 60629 - DNA, 323 bp, Zea mays
  Clone ID: LIB3069-006-Q1-K1-E8
gctggtcaggacctcactttctcgcttatgaaaattctcactgagaggggttattcgttcacatcctccgccgagcgagaaattgtaagggacatcaaggagaagcttgcgtatatagctcttgactacgagcaagagttggagactgccaagaacagctcctcagttgaaaagagctatgagctacctgatggccaagtaatcaccatcggtgcagagagattcaggtgccccgaggtcctcttccaaccatccatgattggtatggaagctgcttggatccatgagacaacatacaattcaatcatgaaatgtgatgtgga

SEQ ID NO: 60630 - DNA, 342 bp, Zea mays
  Clone ID: LIB3069-006-Q1-K1-E9
gaccacgcgtcctcacagacatacagtgaccctacctatcggctgagttccacgaagagcacggcaaccatagggaagggttgattcataaacttcaccggcgacccatactactacttctgactgtagttcaacgagtgcattatcctcttccaccagccctccaactgcagcctactccgctaatactatctcgagatcctccaccactccaatgaattccatcccacgaacatgatctacaaatatgatcaacttcagatcataacttcttctcttaatgccaacgaataaacttatgctaccccttctgctgcatcacaccattagtcttcctgtcta

SEQ ID NO: 60631 - DNA, 302 bp, Zea mays
  unsure at all n locations
  Clone ID: LIB3069-006-Q1-K1-F1
ccactcgtccggggctacaagagattcaccacagttcttgcacactatatactaagagtagactgtatgatcnatggtaaagacataagcttcggtcacactccttacgacacgtgttgcatggcacatcactcagtgctgagcactgagctcaagctcagtggaagtggagggcttcttactgggcgcgttacgacagctgtcgccgacgtactcgtcgtccgcgtccttgccgaagagcttcacggtgtcctacaggctcctgcccatggtcttcgacaagaagaagtacatgaacaccc

SEQ ID NO: 60632 - DNA, 440 bp, Zea mays
  Clone ID: LIB3069-006-Q1-K1-F12
gaccgacgggttcgattgggttattcgtggacaagatcaccgtttatgctggctgcgtcaatggcactaagaaagcatgcatgaaacatatagcctactgaacagtcttattcagaggaaaaccgtccaggttgtgcgtgtgttgctgtgccaagagtactcttaccagaagatgcaacggaaccaacaactggcatcaagttccccactgtactcgaagacaattccaatctgactacagaggtccttgttggaatgggttttagaagcatgcgaataatgagggtcaaaaatctgaatctttatgcctttggattatatatacaacctgattctgtctgcaagaagctgggtccaaagtacgcttatattccagatgctgagttaaaggatcacccagatttctatgaagatcttctgagggaaaatattgacatgac

SEQ ID NO: 60633 - DNA, 211 bp, Zea mays
  unsure at all n locations
  Clone ID: LIB3069-006-Q1-K1-F2
cgctcgagccacgcgtccgggcctacttgcttttcttcccagatgtctacttttacacactcatatgcaacgtgacganatttgcgcaacatcacaagcaaccaccacctgcattacaacacctgtgacaacccaccgaaccaactccctcactacttcactctcgtcgacttcaacggcatgcttaacactaacgccccctctacaagga

SEQ ID NO: 60634 - DNA, 410 bp, Zea mays
  Clone ID: LIB3069-006-Q1-K1-F3
tggacgcttggtctgacgcgtggggattgatattttactctttatatacgcctaccagtatttgggtacttcacatgttatcaaagtcatgcttcaaatgcatcttgctgcgcaaagaggaaacttacttacaatggtacttaaagtcacagcacctacaggtttcatatttcacacttcttctgatgttaaattcatttcctagttatatgtctattgtgaaatatgttatggaacaatatttacacaaatggttgaaagggaacggactcattcactctacctgtgacttgcaccagcgttgacgagagctgttgtctatggtggccttcgctattaactgtatgagcccttcaagcatgcctgcagttattccatttggttcaacatactttgcttttaaatttgca

SEQ ID NO: 60635 - DNA, 232 bp, Zea mays
  Clone ID: LIB3069-006-Q1-K1-F6
ccacgcgtcgcgcacctccgatctgttatcctttccttcgacatcgctactacagattagttgatatctgacctgtggccggaggcggtactactgaagatcatgattgctttcttttcttttgttgtgtgattctcttggtgggtcactggtctcatgcatgcgatctctgtataaattcaccgactctttaggaactgattactattggctattcgctattatgagtata

SEQ ID NO: 60636 - DNA, 352 bp, Zea mays
  Clone ID: LIB3069-006-Q1-K1-D9
tcccacgcgtccgcttaccttatcctccctctacgtttctcattcagcttcttgaaattctgcggggttcttattaacaagttatcggatctacatatcctcatcacatgtttattaccgctgcttcatcaactgcctcacctctaccacttactaccactctcttcacaacaccttcagcacctacttctagatcctctaatccaatatcatcctctattcttatacccatatctccctcaacttcagcttcatcaccttctccactgaggatgcaatacttaacgccatctaatgcattaactgcaaataactttacttcctcaacatcaccatcaactatgcccaatcc

SEQ ID NO: 60637 - DNA, 189 bp, Zea mays
  Clone ID: LIB3069-006-Q1-K1-F7
gattcccgctcgactccacgcgtccgcccactcatcccaccacacttacctataaactaatcataccatactcacagagaccagtgacatttcaaatccaaccaacaactaaaactacctacatcacaactcatgaaaaccattctactatcaaccaacaacacatcacaacatactctaaccacatcc

SEQ ID NO: 60638 - DNA, 149 bp, Zea mays
  Clone ID: LIB3069-006-Q1-K1-G1
cccactcatcctaacatacatactattactctcacacctttaccactacacactcaaatccaaccatcagatcattgttaaaatcacaatcttctaccaccatcattacaacaccttctacaacctaccttactaactccctcactcct

SEQ ID NO: 60639 - DNA, 348 bp, Zea mays
  unsure at all n locations
  Clone ID: LIB3069-006-Q1-K1-G10
aaaagccataacagattcttttgtttccactgacattatcatttctgcaagcatacatataaaaagtatactgcctcttacactatttataatctttcnacactcaatattgaactttcccccaaatgtatacccatttctcatgattgtcaaatatttgttgtctttataatgattcaaacatgatttattattgctcataaactatttcttacattgcattatgaaacaaattgttatcgtattccacatctttttcatatattattgtaatatccttattcctaacaaaaaaaaaaatctcatttaaagcatattcattccaaaaaaaacaaattcctattatta

SEQ ID NO: 60640 - DNA, 348 bp, Zea mays
  Clone ID: LIB3069-006-Q1-K1-C10
cccactcgtactacacacgcctcctcacaaactatcactgtgctcaataacaaagaaaatataacctataacacgaacgttttccttctaaatcaaactgctccttctactcctccctgcactcctcctactcctacaccaatctcaaccaatactataacgcaccttctatacttcttcaatccactacaaatccctactcccctcccctctccattcttccttccctccacattttcttctccgcctctgttgatgacccacatatcacatccactgtctaataccttttcactgactcagacatctcctaccaacactacaacccctacctccaccaccaccacc

SEQ ID NO: 60641 - DNA, 396 bp, Zea mays
  unsure at all n locations
  Clone ID: LIB3069-006-Q1-K1-C11
aagatgaagagtcagggcgtatgttctgcaagtcaagacgatgtaagcacgcnagctttatataggaagtcaatcgggatgtggctacgcacaccttgtacttactgctaacaattcgtaaaaaaatggttttgttcacgatcttgatgatgagtctggtgggatgcgaggatcatgctgcagaggtactaagcgcagccgcaccgctgaagtgcacaatttgtccgaaaggaggagaagggacaggatcaatgagaaaatgcgcgccctgcaagagctcatccccaactgcaacaagattgacaaagcctccatgctggatgaagcgattgagtacctcaaaaccctacagcttcaagttcacatgatggccatgggaagtggactgtgcatttc

SEQ ID NO: 60642 - DNA, 246 bp, Zea mays
  Clone ID: LIB3069-006-Q1-K1-C2
cccactcgtcctcggacctattaaaatacgcccactcgttgtcacttctcctccctcctcccatccatagcatcttgtccctcttcaacattcatctcttcaccttttcctcccccacattgatccttgaccctcgtactcctttcttgattcctactccgattaatctcttaccaagattaaccttccccttctccacgctcgcactctcactctcacatacattcttcttaccacatctttaaa

SEQ ID NO: 60643 - DNA, 450 bp, Zea mays
  Clone ID: LIB3069-006-Q1-K1-C4
cggcctatccccatcaacaacgcaaatttctaaactgctcgctctggtccatccagagggacagtgtccatcttccacacctctcgtcgtcgtctccgtgcaccactcggcccccactgtcggccgcgcctcccagccacctcgtgccgctctgccaccccgcccgtcctccactgcccctatggctgccatgggcgagcgctgcccgagtagccgaccgccctttccccgccgtcttcagctgccgcgcgctgccccgcctccccggcaggcctccactgcccacttctacggcggctacagcggaaggcaaggagaaggacagcgggcagcggtagctggatctagcaagcacagggcgtcttctccatccgccacctctcggcgcatcatcagctgagagtttcaggcatttgctcaggtggtttcatttcataatatagctactac

SEQ ID NO: 60644 - DNA, 420 bp, Zea mays
  Clone ID: LIB3069-006-Q1-K1-C5
cggacgcgtgggcggacgctttggcttcaatcggctggacggcactatccgtcctgggctagtcaagctgggaagcctccttgagctacggctgagcaacaactgccttacaggcattgttcctgcaagtaatgattccgacgtggaatccgccagcagctctgatcaaattggattgtgtcagctatctcaactaaccaatattgatctctcgtataacttcttggttggagatgtccccgcatgcttacagcaaatccaaagatcaagcttggtagggaattgcttccagaacaacacatcaaaccgcccactacaacaatgtgaaactaatcaggacagaggcaaagacaatgatgctgatgagaatgtgcagaaaggcctgccagagccactttggcttctcattctggaagtcat

SEQ ID NO: 60645 - DNA, 418 bp, Zea mays
  Clone ID: LIB3069-006-Q1-K1-C6
gggaggtttcacaagatgatttcatttttgttgacagatccatagagttcgcatatggagaactttctgatgctacaaacaactttagtatggaccataagattgggcaagggggttttggttctgtttattatgctgagcttagaggcgagaaagctgccataaagaaaatggatacaaaggcatctcaagaattcctcaatgaattgaagattttgacacgcgtccatcacacaaatctggtgcgcttaattggttattgtgttgagagttgcttatttcttgtttatgaatttattgagaacggaaacctaatccagcatctgcatgggacgggttatgaacctctctcatggaccagtatagtgcaaattgcccttgattcaacaaggggtctagagtttatacatgagcacac

SEQ ID NO: 60646 - DNA, 281 bp, Zea mays
  Clone ID: LIB3069-006-Q1-K1-C7
ccgacccctaccacgagctttatccttttgtcatatcgacccctacaaatagcctccaggtcatctaccagatgtcttgttaatctttctttatggccaatcgatgtctctatcgcaaacctcaacacccaagcacgccttacacagcttcatgagtaccttcttactcacaactacatcactggctaccaagcaatcaaggatgacttggatgactacacatacgtttcatctgctacctcatccaagcatatcaacgtatcaaggtggcagaatcacat

SEQ ID NO: 60647 - DNA, 392 bp, Zea mays
  unsure at all n locations
  Clone ID: LIB3069-006-Q1-K1-C8
cggacgcgtgggccacgatttcgctgtatagattgtgatctgcgaccgcggcattaggcnctctttgcagaacggtcaggttgtcaagaacgccggtgccgcgggcatgatactcgccaacacaccggcaaacggcgaggagcttgtcgccgacagccacctcctgccagcagtggccgttgggcagtctgaaggcattgccgccaagaagtacagcaaaaccgccccgaaaccaacggccacgctcagcttcgacgggacgaagctcgggatccgcccatcgccagtcgtagccgcgttctcgtcccggtgaccaaacttcctgaccctggagatcctcaagccggatgtcatcgcgcccggcgtgaacatcttggcggcatggagcggcg

SEQ ID NO: 60648 - DNA, 372 bp, Zea mays
  Clone ID: LIB3069-006-Q1-K1-C9
tgcaagccctctttgttcagtattactggagtgcataaccgcaaaactatcatatgtttctgtaaggcttcctgtgtaaatttgacttaggtctgtcaagtctattctattgctggtagctcacatttttgtattccatggccagattgatctccatgaagctcgtcaaagcattgaacagcatgaatccccagagaatatcttccgcgctgtccttgaaactgctgctcaggcccatggtgaagataacagcattcagggcatggtcgaagaacttgccactgatcaagagcttgccgatgactacatgaaacttttgatggaacaagttctgcagaggatacagtcagagtcgcagtcggggaccaagcc

SEQ ID NO: 60649 - DNA, 392 bp, Zea mays
  Clone ID: LIB3069-006-Q1-K1-D10
acctacttacataagaactgaattatagatttgaatattcatgtttctgggatgatcttataataacatactcggtttacttaattaataaccaaattctttgttatttcacattaaataatgattaacactcctactcatacacttattttctgtgaacatgaaagcattttctaaacagtccttttctgtatccactgaacttgcaatattttgttatgctcaatgttttttcaatatgatgccctttttcatagttatgtttaaattcacaaacacatgaatttttttttcttaaacgcgcacgatagctgcacatcattaaattaagacaagaaatcagtccaaaatgtaccaaattacaatgccaatatctgcaaaacacataacac

SEQ ID NO: 60650 - DNA, 275 bp, Zea mays
  Clone ID: LIB3069-006-Q1-K1-D11
actccccgccctcaaaaatctctcctacaccttactatcctccctctcttccaactctccacccatccacaagctctctatttcgtcctgcaccttctcacccactgcattcatctccttgctccagtcatcccccctcctctaaaacctctccctcaatctcctcctcatcatatcacacacttccctatcctccagttccatttctcaacatatcaaatttccacctactatgtccctactattctcttacctcaaagatctatataacactc

SEQ ID NO: 60651 - DNA, 366 bp, Zea mays
  Clone ID: LIB3069-006-Q1-K1-D2
gcggggcccgctgctccccaaattccccctaaacctttctagctggagggccgatccgcagctcccgggcgcctgatccgagcagtctcctcggcccagccggggatccaagcgggatggggtacttgagctccgtgatcggccaccccaccgatggatcctacgtcagcggcggcggcctcagccagaatggtagatttagctatggctatgcaagctcccctggtaaaagggcatccatggaagacttctatgagacaaatattgattgtgttgatggtcacatagttggtctttttggagtttttgatggtcatggtggtgctaaggtagcagagtatgttaaagaaaacctgttcaacaatc

SEQ ID NO: 60652 - DNA, 279 bp, Zea mays
  Clone ID: LIB3069-006-Q1-K1-D3
aggcatctcactctccgctggtcgctttctcgttttacttcacccttcactcagtctgagtctcgtattatctctaggctctagctagccgcgccactccttcatgtagccatcagccttctcatcgccaccaatggccactgccgaagtccagaccccgaccgtcgtggcagccgatgaagcgcccgtggtggagaccccgccgccggccgacgtgcccgaggagtctgcccccgccgaggccgaggccgaggccgaagctgctgctcctgctgatcc

SEQ ID NO: 60653 - DNA, 308 bp, Zea mays
  unsure at all n locations
  Clone ID: LIB3069-006-Q1-K1-D4
cgcacgcgtgcgtcttcttccgccgctgccgctttcgtcttcgtccgtagagcagcagatcatgtagnctttaggaagaaaaaccgatcgatggcgtccaactacgtggacacgacgggcgaggagggacggttccacggccctcacagccacagcaccagcacgaccccgacgggcggcgcggcagcggctgcggcatcgccgcgcaacttccggcgcagcttctccttcgcgtcctccgcgggccacagccactgcggcagcngcagggccaagtgcgtgtgcgcgcccgcgacccacgccgggtc

SEQ ID NO: 60654 - DNA, 429 bp, Zea mays
  unsure at all n locations
  Clone ID: LIB3069-006-Q1-K1-D5
cggacgcgtgggcggacgcttgggcttacgcgtggagtcgacacgtacgggaccggggcgatcttcgacaaggagatcctcaagattgtcaaggagaacttctatttcaggcctggcatgatcatcatcaaccttgacctcaagaaaggcggcaacgggcgctacctcaagacggcggcctacggccactttggaagggacgaccctgacttcacctgggaggtggtgaagccactcaagtcggagaaaccttctgcctaaagcggccttttttttcagtaagaagctnttggtggtctgctgtgcttaatcatgcttttatatggcttctacatgttgtggatctttcttgatctgcaccgcgcttatcgtttgtgttgtactgccctaataagtggtgcttatgaggactgcttctggttttgctgc

SEQ ID NO: 60655 - DNA, 397 bp, Zea mays
  Clone ID: LIB3069-006-Q1-K1-D6
cggacgcgtgggcggacgcttggggttcttgggcgaatcatagctgagagggggaagaaggagcatccaagttgcaaagtttatggccagaccgcaagcaaaaatcatcacaacgagttaacagatcttggcatcatcccctcattgaaaggcaccactattcatcagaaggttccacatgttattttctgcgctcccccgtctggttcagatgattactctagggatgtcagattggcagcatcaaattggactggtgaaggatctttcctgtttacatcaagtacagctctgtatgattgcagtgacaacagcatgtgcaacgaggattgtctgtcagtgccaattggcaggagccctcgtactgatattcttctaaaagtggaaaatgttgttc

SEQ ID NO: 60656 - DNA, 395 bp, Zea mays
  Clone ID: LIB3069-006-Q1-K1-D7
cccacgcgtccgggcggctttcaaggtggttgatggtgaatttgccagaggcatcaagtaggatatagattcttagtgtaatactagccaaggaagatttggcagacgatgttgatctagaagctatagctaacttgacagaagggtactcgggtagtgatctcaagaatctttgtgttactgctgctcatcgtcctattagggagattcttgaaaaggagaagaaggagagagcttcagcagaaacagaaaataggccattgcctctgtcgcacactagcaatgatgtccgtgcattaagaataagtgatttcatacatgcgcatgaacaggtgtgtgcaagtgtttcctcagattccagtaacatgaacgagcttgtgcaatggaatgatctc

SEQ ID NO: 60657 - DNA, 252 bp, Zea mays
  Clone ID: LIB3069-006-Q1-K1-C1
gcacatgcaaatagaatttagatcttcctgcttcactttcatgtgtatttatctttcaaatgctatatggatccgttccacatgcaattagccttgcatccaattctcattataaaaaacccaattatgtccactgctaatacaactcatattattcacatgatttctactaccaatcataataaaatattttaaatcataacttcattcaatcaatcataatctgtttctatcaaacaaaacatacacact

SEQ ID NO: 60658 - DNA, 464 bp, Zea mays
  Clone ID: LIB3069-010-Q1-K1-E9
gactgttatacaatatgtcctcacacaatatctaattcgacgttgaaaaagacgtcggggagtaatacttattcaaaagagcaatgtatcttgaacaagaacgagttcaaaatgaaaaactcgttgttgaggttaggcaacaagacgtccaactgcataagcaaaggcatgaggataggattatgaccatggatctgactgtactgccagaagaacaaaagaaatactacttatctttactgtctaagatcatgagccaactacctagtgtttgacatatgtgtgccattttcaaagcacttcaatatgtttctcgtgttcatgtcagtgtttcacatcatgttttgtccaaacaggcgtaagtggttttatctcaaatagtttgtgtcattgcttccatggtatctattgttttaatatctgttaggcgtccatgtttgtcaaatcataggtgtcattgatac

SEQ ID NO: 60659 - DNA, 460 bp, Zea mays
  Clone ID: LIB3069-010-Q1-K1-F11
cccgggtacgactgacgcggccccctcgccttccttgtggaccccgtgcatgttatcggcagcgatttcttaaacgcgcaccaactcttcttcgttgtgttcgacaccgactggctcaagggctccactctcgtcaccaatggcgtgataactgccgggtctgacgagtgggcgatctaccgcggtacctgtgtgcttgccatggcgaggcgcgtcataaggagaaggtatctcttcgacagggccggcgggaacactgatgatctcaacatggatgtcttctgcctgccgtctggctcacaatcacagctgcaagataagatgcacgtgcatctgcaggggcaaggctctagcgtcaccaagattggactatggagtggaccgctagggtctgcacaggacatcacggcagatctgccaccgcagcgtcttcacagcgtcaccgttcgtgctggcgttg

SEQ ID NO: 60660 - DNA, 357 bp, Zea mays
  Clone ID: LIB3069-010-Q1-K1-F12
actcgtccgcacggacacacatacaactggttcctaaatccaactatctgtactatcaaccacctggctcgagcctttgcacgcatacatcatgtctgatgagaagcaccaccacttcttcaaccaccacaataaacaccactatcacccctcctgctaatacggctactccgataccgaggtgattaccgacaccgactaaggccagtaccagaggtacatgaatgtggagaacgatcacaatcacaagcatcacctcggccaggccgtcgccatcgtcgtccacgccttcgcactctactagaagcacgaggcgaataaggatcccctacactcgcacaggcacaagatcactga

SEQ ID NO: 60661 - DNA, 343 bp, Zea mays
  Clone ID: LIB3069-010-Q1-K1-F5
ggtgcattcaaatctgctgatttgcataccgagctcttaccgagatgaatgggaaaagtttttttagcaagcccctttatgtatctcttgcacagtgtaaagatgactgaaagttaaagctacaggcacagttttcacaaatgcgtcctgttgcaatggcaccttcagtatgtactctcatgcccatgtttccacctagtgttcctggagttggtcagcagttgttgtatggacagccacctccagccttcatcaaccctcaggctggatatgctttccagcaacttatgatgcctggtatgaagcctgttggttcaatgctcaactttatgatgcctattgt

SEQ ID NO: 60662 - DNA, 369 bp, Zea mays
  Clone ID: LIB3069-010-Q1-K1-F6
aggaaaaggaaattcctctcatcatcatcagaccacgacctccctgccgagctgcctcgctctccgttggtgatggcatctcagagctccaagaccgcggacaccgccgtgccttcgacggaggttgcagccaccggagaggcggctccgggcgcggcttcttcaacaccggcacaaaaccctaacgctgctgcaaccgcagtggccggggccacggatctagagaagaagatgcgccgcgcggagcggtttgggatgccagtactgatgtcagaggaggaaaagcgcagcagtcgcgccgagagatttgggactggctcttcaagtgtaaaggaggaagagaagaagaagtccagggctgagaggttt

SEQ ID NO: 60663 - DNA, 370 bp, Zea mays
  Clone ID: LIB3069-010-Q1-K1-F7
ctgccaaggaggctgccagctttaccttccaggtcatcatcatgaaccaccctgggcagattggctacggctatgccccagtgctggactgccacacctgccacatcgctgtcaagtttgctgagctcattaccaagatcgacaggcggtctggcaaggagcttgagaaggagccaaagttcctgaagaacggtgatgctggtatggtgaagatgatacccaccaagcccatggtggtggagacattctcagcgtatcctccccttggtaggtttgctgtccgtgacatgaggcagacggttgctgttggagttatcaagagtgtggagaagaaagacccaaccggcgctcaggtgaccaatgctgctgc

SEQ ID NO: 60664 - DNA, 196 bp, Zea mays
  Clone ID: LIB3069-010-Q1-K1-F9
ccaacgctttcttcaactcgtacactagcttaacttattcatgcactcacatctagggtgcggcactttaaacatctaacccacaacttcactattgataaccaacatcaatactccaacatttcactacatctatacgcatcatacctatctaactgcagacatagcatcaactttctacctgaaccatatcatc

SEQ ID NO: 60665 - DNA, 54 bp, Zea mays
  Clone ID: LIB3069-010-Q1-K1-G1
gcgacacgaacgaccacgcagaataaattacaatcaaaacagcagacgctagac

SEQ ID NO: 60666 - DNA, 339 bp, Zea mays
  Clone ID: LIB3069-010-Q1-K1-G11
cccaggcgtccggttattaagctatgggctttataccttgcatatggctgtgcaaaatgaggttctgcactgtagactgtactggtcacgtggtgaagtttgaaataagagatcggatgagtaacgttgctagagatagccttactgacgataagtcattcttatgtcttgttttcttctgcgcaaggacgtattggccagaaatgtttcatagaccgggaatacagtttacaggagaaagcatgaatgcgttatgcatccatgcgccgttctcctgactagtggactgaaaccgaatgagttttcagtggcatagaaataccaaggccatattattca

SEQ ID NO: 60667 - DNA, 483 bp, Zea mays
  Clone ID: LIB3069-010-Q1-K1-G12
acccactcgtccgccagttcttgcgagcactttggtcttgtgtacttctctctcgtatcgctgttggggggttgcgtaatttcagcaaaggactgatgcagtgctgatgtgccttccgctggctgctaacgcttatgaggcagcttccaccaatcagtgcaccctcatcttcaaaggctgttccaacagcatggaaaaagtctacgccatcagcagtcctagtcagaaaagaaaatcacagcatgatctgagtgatccaaagttgctaccacttaaatgcaagtttcgcaaactgttatattgccaggatgatgagtctgcaaccacagaaagtttatgatatgatggtattttcatgaacaagactcttgggacggacatggtcagcatacctgaagaaatggactctcgtgagaacactataagcctgttttgtggatgcatagaagttgactcaaaaaatggaattcacgaacaatcttt

SEQ ID NO: 60668 - DNA, 372 bp, Zea mays
  Clone ID: LIB3069-010-Q1-K1-G2
gcgctattatcgatgttgctgacacgatatcgttgttcaacaagctgcaagagctatcgatgtgcaagctttgccctgatatttccagtaatcacctaccaagccatgcaatgagctctgtgatattggctatggcatcaaatctggcacgtgccgatcttgaagaccgtagtccaagcacactttagcacaggagtatgacgtccattttgctggtggattgtgaccatattagcttgtggcctactgacaattcagatgatcgagtttgagaaagattgaccatgtcacattcattgtactctgcttgctcgcttagtgcatttggttcacgaatgcatgcatcatgctgaacgctgtggtttgaacgaa

SEQ ID NO: 60669 - DNA, 326 bp, Zea mays
  Clone ID: LIB3069-010-Q1-K1-G4
cggacgcttgagcttcctcgcccgatttatatctacatcttcccgagcaaatactagggtaaccgctaccttttcagaccacctccaaggctcttaatgtatcttaacactctcaccaatcaaattttcatgtctgatctcgacattcatatcccaactaccttcaatcccttcgcttagaccaatgctctggactctggtgcgtcatcagggtcaaaggactacgtacacgttcgcatccagcagcttaatgttctcaagagccttaccaccgtccattgattgaataataagttcatctacagcaagatcctcaaagatctcaa

SEQ ID NO: 60670 - DNA, 364 bp, Zea mays
  Clone ID: LIB3069-010-Q1-K1-G5
cccacgcgtgcgccgacgcgtccgcccacgctctggactagggaaagctaaaggagaacgtgagcaacgcggtgctgttcgaccaggctacctacgacaagctgctctctatcgtgcccaagtacaagcagatcaccccctccatcctatccagagcgcctcaagatcaatggctccctggctcggaaggctatcaaggacctgatggcgcgtggcctcatccggttggtctctgttcactcaagccagcagatctacaccagggcaacaaatacctaaggatggtattcccttgatcgccctctctggaggagctcgtcttctttagaacagatgccatctctgtcaagagcttgctaatgct

SEQ ID NO: 60671 - DNA, 384 bp, Zea mays
  Clone ID: LIB3069-010-Q1-K1-G7
cacgcgtccggtggttcgagacggtggactctttgagtttcttccgggcgaagaactacgacggccccggcgagttctactgggcgccgatgctggccgagtccaacttcgacgacgccgtagtgcactccgccgacgaccgtctcatccgcggcgcgcccatggacaggcactccagcttctggaagggcgccgacgtcctcgtctttaactcctacctctggtgggtcgccggggacaaaatccagatcctgaggggcgccgacaacgacccgagcaaggacatcgtggagattaagtcggatgaggcctaccggctggtgctgcaccaagtggtccggtggctggagcgcaacgtggaccccggcaagtcgcgggtgttct

SEQ ID NO: 60672 - DNA, 375 bp, Zea mays
  Clone ID: LIB3069-010-Q1-K1-G8
aggaggcgccgggatcattcttcagtttcggaccttcgcctccactccctggttgatggagtggtttggatatgtggcggtggcagcagactctcctccgccggctcccgccgcctatggcggtggcacaggctccggcgtcctgggcggccgaccgtctggtatgctactacgggtctacgccggaggcgagggagggaaaggcggcgcctttgcaggcgcggggcatggtctacaggttccagatgcgcgccaagggcggcgacggcggcaatggctgcgtcagcctccggcgctctaagtccaaccgccacggcatgcctgacggtggtaatggacggaagggtggtgatgtaattcttgagtgctcacgtt

SEQ ID NO: 60673 - DNA, 323 bp, Zea mays
  Clone ID: LIB3069-010-Q1-K1-E8
tgataataataataataatattatcattttcaacaatcggcagctcccctcaggcaacgaccacttcttcaccatgagcacctacgaccctctcacaccacactccccaaccgccagcttctacccactgtccatcaccaacttccccacggcaatgcaacagggctcctactgctactttccgctccgacaactaccacctctgcaactacggcagcggcggcttcaacgtggtctcggacgccgccacggcgtacagcgccccctacacagtcagcatcgtcaacatttacaacttcagcaacaacaacggcacctgcacc

SEQ ID NO: 60674 - DNA, 350 bp, Zea mays
  Clone ID: LIB3069-010-Q1-K1-G9
gccactcgttcacaaacccactgacttcattaactcctccaaacactgaaccaactaggcaggcctaattacaaatgctcctaccactaacataaaggcacctacaactcctaaaaaggacgcaaccccaaacaatgctgactctgctaccctcccagacaccaaactctattccaccaacgccaataactactctccctgccttcacactagccaaaaccccccctcaataccacctatacaaacccctattccatccatactgatccaatcacaataccctcagtagctctatattcgcccatagctccatcattaatctcaacgctacctctacacctgcaaaaact

SEQ ID NO: 60675 - DNA, 444 bp, Zea mays
  Clone ID: LIB3069-010-Q1-K1-D10
ctcgtgggcatcatttgttaaagaggtcttccctcaaattgcagcggatgaacagctctatgcaatggtccttcctggtttttggatggatgttggtcagccaagagactacattactggattgcgtctttatctagactcgcttaggaagaaatcggctgccaggctagctgctggagcacatgttgttggcaacgtgctggtgcatgagagcgccaagattggagaaggttgcctgatcggtcctgatgtcgcaattggacctggatgtgtcgtggaagatggcgtgaggctttcccgctgcactgtcatgcgtggtgtgcgtatcaagaagcatgcctgcatctcgaacagcattatcgggtggcactcaactgttggacaatgggcacggatagagaatatgaccatcctgggcgaagatgttcatgtgtgtgacgaggt

SEQ ID NO: 60676 - DNA, 426 bp, Zea mays
  Clone ID: LIB3069-010-Q1-K1-D11
cgcacgcgttctccgactcgtgcgcttacttgtgatcccatacgctcagagacactcggctgcgttctttcctatctccgcgactcaaagcttcttccatttcctaccgccacccctgcagctgcaccccattccgtctacaccatgacgtagtgcatctagatccacatctgccaagccactatccatgtctcaaacgcgtgctgcgagctctactgcctcaagcatagcattcatgctgatggtcacatgcccagagacaacaccattgaggctggtcatgatgctttcaacaccttcttcagtgatactgatgctgggaagcacgtcactcgtactgtatttgttgaccttgaaccaactgtcatcgattacgtgaggactgtcacctaccgacagctcttccaccctgagcactttatcaat

SEQ ID NO: 60677 - DNA, 472 bp, Zea mays
  unsure at all n locations
  Clone ID: LIB3069-010-Q1-K1-D12
gaccgacgcgtccgcggaggcgtggggtcctcggacaagtgccttatttacgcgctgaagctcggcgcgtgcgtngcagtctcggtaacgaggtgcacatcggcgacgccaacgtcaagtgctgcccgctcgtgaagggcatcgccgggctctccgcggcggcgtgcctgtgcaccgccatcaaggccaaggtgctggacatctccgtctacgtgcccatcgcgctggaggtgctcgtcaactgcggctgcgaggtcccgccaggctacaaatgcacttaaacgactccattccatttcatcccatctcaccatgcgtgcacagcgaggtctccttttgccctcccgaatgcaaagtttgaaaggctcgtcgacggatttgggtctccttttgcccacccgaatgcaaagtttcgaaaggctcgtcgacggattgtgctcttcggctactgcattcttccttatttcatttg

SEQ ID NO: 60678 - DNA, 205 bp, Zea mays
  Clone ID: LIB3069-010-Q1-K1-D3
cggacgcgtgcggtcttcgcttacacttaccactttccccgcctgcttcctgcagtcgcgtacgggtatccatgcgcccacggagaagatggcctactctactccaatctgccttagctcaagctctggtcgaggaggcagaggccggtgccagctggcggactgagaggtaggtagcagcttgcggttgcggaagggaagctgc

SEQ ID NO: 60679 - DNA, 222 bp, Zea mays
  unsure at all n locations
  Clone ID: LIB3069-010-Q1-K1-D4
atgagcatgtgatcgctcactcttgcatctcgattattctntagctgctctagctctggcctctgtccctatctaataactagccactctgtcgtgtactcatcaaccttctgatcgtcaaccatggccactgcctagatccatacccccaccctcgtggcgacctaagaagcaccagtaatgtagaccccagctccgcccgccgtcttgcccgacgaggct

SEQ ID NO: 60680 - DNA, 375 bp, Zea mays
  Clone ID: LIB3069-010-Q1-K1-D5
gggcctcctttcccacgacttttgagctctctgcgtgtggcgcgcggcatcgtggcgagtgcgaacttgagcagcaaggggtcgttcgaggttcccaatgtggaggtcaggttcatcaagctcttcatcgacggcaagttcgtcgacgccgtctacggcaagacgttcgagaccctaggaccctcgcaccggcgaggtgatcgccagcatcgcggagggaggcaaggcctacgtctacctcgccgtcaaggccgaccgggaggccttcgacaacgggccctggcccattatgactgtatactagcgtggtccgatcctgcacaggttcgcggacctgatcgacgagcacgtggaggagctggcggcgcttgacac

SEQ ID NO: 60681 - DNA, 413 bp, Zea mays
  Clone ID: LIB3069-010-Q1-K1-D7
agacaggtcactagcaccactttcaaatctttgcgttgcgcgatacaccactggcagtgcactaatttcaaagaaagaatcaaacgatattattgctagtctttcgaacaaaaaaagaaggaatcaaaagatatgtatataaaaaacacaagttgcaagagttgtcttttaacagcatatatatgatgctctatatatgatcaacgggagagagagaaaactaacaatccttcctggttttgaaattctgaaccaggtgcctggatgaaggagctgacgagttctttctaaaacctgtgcggctatcagacatgaacaagctcaagccccacatactgaaaagcagatgcaaccaggaacagcaccagcaaagtgacaattgcattggctaacgcatgaaccccacaatcagc

SEQ ID NO: 60682 - DNA, 378 bp, Zea mays
  Clone ID: LIB3069-010-Q1-K1-D8
aggacgcgtacgaccacgcgttcgcttttggtaagttgctcgatacaccggtggcaacgtactattttcaaagatagaagcccacgacatgatcgctcgtctttcgaacaaagaatgatggaatcaaaagatatgtatataaaatacacaagttgcaagagttgtcttttaacagcatatatatgatgctctatatatgatcaacgggagagagagaaaactaacaatccttcctggttttgaaattctgaaccaggtgcctggaggaaggagctgacgagttcttgctaaaacctgggcggctatcagacatgaacaagctcaagccccacatactgaaaagcagatgcaaccaggaacagcaccagcaaagtgaca

SEQ ID NO: 60683 - DNA, 460 bp, Zea mays
  unsure at all n locations
  Clone ID: LIB3069-010-Q1-K1-D9
cccacgcgtgcggcaattccatcgctactgtataatccactacaatctgaagtccaggagtgtcttgctagacacgaatggtgagcccagggttggtgattatggtcttgtaaacctgctgccgatgctggatcgctatgtgctcagcagtaagatccatagcgtgctgagatacatggcacctgatttcacttgcacaactgtcaatgtcacggataattgcgacatatacagcttcggagtgctagtccttgagattttgtcaggcagaaggcccgtagaatatctgcaagatagtgtggctgtgctttctgatcttgtcactgatgcactcgatgatgacaggctggaggactgcatggatccacggctactaggtgagttctcgacggtggatgccacactgatcatcaagctgggcctggtctgtgcatctgangtgccttctcaacgaccggac

SEQ ID NO: 60684 - DNA, 260 bp, Zea mays
  Clone ID: LIB3069-010-Q1-K1-E1
gacaggccgacacctctatagcactgctgcgaattctgcacacgatctaaccatatgggcataggtaacttttcaacagataaacaatattgcttcctcaacaatacaatgtctagaagaatatacacaatctagaactcccgatagttacaatcaactgttctcggcatttcaaccacatgaatgtgaaggatgcacataatccacttcgtccttttcctaataaaatatctgagactcgctcaagtacctgggtcaca

SEQ ID NO: 60685 - DNA, 448 bp, Zea mays
  Clone ID: LIB3069-010-Q1-K1-E10
aatcagagctctgaggttgcttacatcaggccaccaccaacccctcacgtcggcgtttgcttcgtcggcgaaggcagagatggcgtccgtggccgcggcggaggtcgcggcggcggcgctccggtcggtgctgtcgcgcgcgcagcatgcggcggctcgggcggggcgcgcgccggggtccgtgcgcgtggtggcggtgagcaagaccaagccggtgcctgtcatccggggcgtctacgacgcgggccaccgctgcttcggcgagaactacgtccaggagctcatcgacaaggcgcctcagcttcctgaggatattgagtggcacttcattgggaatctgcaaagcaacaaagccagagccctacttgctggcgtgccaaaccttgatatggttgagagtgtcgatgatgagaagattgctaaccgtcttgatcgagtggtagctgac

SEQ ID NO: 60686 - DNA, 462 bp, Zea mays
  Clone ID: LIB3069-010-Q1-K1-E11
gctggctccattagatggcatggttcggctctacaatcacctgcgcattgcacagtaggatggtcatcttgcggacaagctggatctggacatgccggctctggcttacatgatgaaggaataccctgggaccgaagaagagaagatgcgagctgctgttggcaggtttggcctatcaggaaaggcgcaggtgatgccaatgaggaatctttctgatgggcaaaggagccgtgtcatctttgcatggttggcatataggcagccgcaactgctactgctcgatgagccgacaaatcatttggacattgagaccattgactccctggcggaggcactgaatgagtgggatggtggtttggtcttggtgagccatgatttcaggctgatcaaccaggttgctcaagagatttgggtgtgtgagaatcaggcggtgacaaggtgggaaagtgatatcatggattt

SEQ ID NO: 60687 - DNA, 469 bp, Zea mays
  Clone ID: LIB3069-010-Q1-K1-E12
tcgaatccccctgtcccgctaggattccccccttctttcccccaaaaccccagagcggataagggcggatgatgttcggcttcgggcaccacggccaccacggccagaacccgtcggcgcacggcggcgtgcaccagcccaccttcaagatcttctgcaaggccgacgaggggtactgcctcaccgtccgcgacggcaacgtggtgctggcccccgccaacccgcgcgacgagcaccagcactggtacaaggacatgcgcttcagcacccaggtcaaggacgaggagggcaaccctgcgttcgccctggtcaacaaggccactgggctcgccatcaagcactccctcggccagtcccacccggtgaagctggtgccgttcaacccggagtaccaggactagtcggtgctgtggacggagagcggcgacgtgggcaaaggctttcgctgcatccgcatggtgaacaacat

SEQ ID NO: 60688 - DNA, 345 bp, Zea mays
  Clone ID: LIB3069-010-Q1-K1-E4
ccgacgcggccgcttctccttagaatatgagcattacgagccacccagcaactacttgatcaggttcttcagctctctctctgtccgtcgacacaccaagctagccatgcaggaggagtatgggtacaaccgtagaagagagagagagagagagagagctaacaccacccaccactgtccctagctagcttatttacaggcgttcgtgatcaccaacagcttctcgtgagaaagagtgcaacgggccggccgggcagaagaggtagctgggagctagagagaaaaaaagggtgcaccgagctacccacgccagggaggaagggaggagtgagccatcagtcgacc

SEQ ID NO: 60689 - DNA, 267 bp, Zea mays
  Clone ID: LIB3069-010-Q1-K1-E6
cggacgcgtgggcgcccttattttctatatttttttttttttttttgactcacgaaccgttgttttatttatttccaagtccaaatttctttaaagaataacattactatctgattcactacaacaagccaccagttccattccatcccattctttcagactcacactgcacacacaacatttacaggcaccataacgattaccatgcaacaacatatcttgtccacttcttaggacagacttataaaggcaccttttcaccttaca

SEQ ID NO: 60690 - DNA, 288 bp, Zea mays
  Clone ID: LIB3069-010-Q1-K1-D1
cggactcaagtgcttaaacagtacgcttttcagtttgaaaattaagctctcttgctagagtacatgtatgtttatactattcaaactctactgtattagacttgcatctggaattcattactccgtatctgctatcaggttataaggtataagctgtgacaatcattgatatgaccattagcatcatgaatgataacatataggcttctctgactgcgcatgacaaagtatgcattctatcaactttgcatgcgaactgacacagaattgcaatggttgatgattgaa

SEQ ID NO: 60691 - DNA, 380 bp, Zea mays
  Clone ID: LIB3069-010-Q1-K1-E7
ccgacgcgtccgctccgacgagtcccttctccacgctatcgacgaggcgcgggaggatgtgccgtctccggagaagctcgtcgcggcgaccgacgacgaccccgacgacggtgccgctgccgggtgcgtgctctacagccccagcccctacgtgaggaagctcttcaccttcaataacatgaagggcgggcactacaacaggtccttcccggtgacccgccccgacgagtacgcgctcttcttcgccaactgcgccccggggtcgctcgtctccatgaccgtccgtaccgagatgtacaacgtcggcgccgacggctccaaggactacctccccgtcgggcaggcgcctgttgccgtcatccacggcgtcttcgcgctct

SEQ ID NO: 60692 - DNA, 480 bp, Zea mays
  Clone ID: LIB3069-010-Q1-K1-B12
ggtcgaccgcacgcgtccgcagggttacaggaaaatcaggctccgtgctttaattgtgcaaggcaggaatgtgctcacaagctcgggtgcatgaattttaccaccgataagctcagatctctagtaaagaagtggcagacattgattgaagcccatgttgatgtcaagacaaccgacaactacatgctgcgtttgttctgcattggttttaccaagaggcgcccaaaccaggtcaagagaacctgctatgctcaggcatcccagattcggcagattcgccgcaagatggttgagattatgatcaaccaggcttctacatgtgaccttaaagaacttgtttctaagttcattccggaagttattggcaaagagattgagaagtctaccttcagcatcttcccacttcaaaacgtcttcatccgcaaggtgaagatactcaaagcccccaagtttgatctcgggaagttgatggaggttcat

SEQ ID NO: 60693 - DNA, 287 bp, Zea mays
  Clone ID: LIB3069-010-Q1-K1-B2
ccgacgcgtgcgcccagcatccgagatttctcctttggccaggtccccatcgccgcggggctttgcccacctatcccccgcccggtagtagcctatacgccgttgcctagatggagttcatagacttcgtcggtagggtgctcttcgtcgccgctttcctcctatacgcctaccaggagtttaatgaattcggtgctgatggtggaccagcagctaaggcccttcggtccaaattcaacgtgtttgtcaaaaatgtatctgctcatctgggagtagctatgccacac

SEQ ID NO: 60694 - DNA, 246 bp, Zea mays
  unsure at all n locations
  Clone ID: LIB3069-010-Q1-K1-B3
gcgaccgtcgccaccgtccgcctgncttggcccgccactactccgtggtactgttaattccggcgctctcccactgtgaccggccgctagcgacgacagagctgctctattcttaaacaaatggcaccgtccagtacccaaaccttttgaacaacctgcacgaaagccgtattgtcaaactcagtgggtatgagtcaagggttatcttgcttctgggactcatatataatctacacttgccaacac

SEQ ID NO: 60695 - DNA, 371 bp, Zea mays
  Clone ID: LIB3069-010-Q1-K1-B5
ctgatttctgcggccgagaacttgctttctgaagtaactaaggatgccaagggggcaggttatccaaattactgtaaagtcttgagttcaacattaagctcaataatggtctggacagagaaaagacttctggcatatcatgaaaccttcaatacatgtaatatcgagtctatgcaaggcattgactccattggagtgtcagctgcaagaatccttgttgaatatatatctcacgaataccgccgtacaagaaaagaatagactgatgtagcccgaagcatggtatagacatacataacgtcttcactaaggacagcttttgctcaaagaatggaagaagcagattcataacggtcatcaagaaaccctac

SEQ ID NO: 60696 - DNA, 266 bp, Zea mays
  Clone ID: LIB3069-010-Q1-K1-B6
agggaacatagcactgaagcttatcgattgatctgtccggccaaaccctcacggccgcgtccacaatgccgcgccatctcgcgctgctcctgcccctgctactgctggcctcgccagcggccacgcgcctggcgttcgccggctgcccgggctacaagttcccggcagggcatgcatacccttcgtgccaggacctgccgaagctgggcgcgtctctgcactggactgtacgacgcgttcaagagctccctgtcagtggcgttcgt

SEQ ID NO: 60697 - DNA, 418 bp, Zea mays
  unsure at all n locations
  Clone ID: LIB3069-010-Q1-K1-B7
cggtcccaagccagccattggttggtatcaagccaagctaatcaagttagctgtanatgcccgctcccgctcttcttccctccgacgaaggcagctgacgacacagcaggctagcttcggagttcggagcactcagccatggccattgccggcgctctcctcctcctgctcggactcctcgcgcgggaggccgctgccggcgggtggcagagcgcgcacgccacgttctacggcggcggtgacgcgtccggcacaatgggcggcgcttgcgggtacggcaacctgtacagcacggagtacggcacgagcacggcggcgctgagcacggcgctgttcaacgactgcgcggcgtgccggtcctgctacgagctgcggtgcgacaacgacgggcggtggtgcctgccgggcaccattaccg

SEQ ID NO: 60698 - DNA, 372 bp, Zea mays
  Clone ID: LIB3069-010-Q1-K1-B8
ccgacgcgtccggcaaagcatttggaattctctgcgatttctctagatctcggctaccgcccactagttttggttcctcctttcgttcgagagagcgattctggtggcaatggcgaagagcgagggtccggcgatcgggatcgacctcggcaccacctactcgtgcgtcggcgtgtggcagcacgaccgggtggagattatcgccaacgaccaggggaaccgcaccacgccgtcctatgtcggcttcaccgacaccgagcggctcatcggcgacgctgccaagaaccaggtcgccatgaaccccaccaacaccgtcttcgatgccaagcggttgatcggcaagaggttctctgatccgtcagtgcagagtga

SEQ ID NO: 60699 - DNA, 457 bp, Zea mays
  Clone ID: LIB3069-010-Q1-K1-B9
ccgcactgatacaaaacatatgaattcaacgactgcttatcgggcagataactgggatgaggttgctttggataagataggcaaccatccatgttttgatccaagaaaggatctagtgcttccggcatggaatgaacctaacccaggggccatatggttaaaactgtgggcaaggccaaggaacaaccgtacaacacttttttatttcaacggtaatctatgttcagcatacgaaagaggccgtccagaagacacgtatagcatggggattcggcaaaagctagcagctgaatttggttccacaccaaacaagcaaggaagccttggactgcaacatgcggccgatgtgacagttacctatttacgaactgagaaatattatgaagaactagcaagctctgatttttgtggtgtcctgccaggggatggctggaatggccgtatggaagatagcatg

SEQ ID NO: 60700 - DNA, 189 bp, Zea mays
  unsure at all n locations
  Clone ID: LIB3069-010-Q1-K1-C1
cacccactcgtccgggacacgtcgtgttcgcatcactgtttaccatataacaacanggcataaataaatagtaaagtccaacattcccataagtaaaaccaacaaaaacaactaaacacacaaaaaactacaaaaaaacaaaaaaaaaaaaaatccaaaaaaaataacaaaaacaaaaaaaaagctcca

SEQ ID NO: 60701 - DNA, 413 bp, Zea mays
  Clone ID: LIB3069-010-Q1-K1-C10
tcatggctgtagctttcttgccctctttctgtttgtcatatgatgatttcaccactcagtaggccttcgtctaaaaggcctctctggttcatcgtgttggttgcatttgtctgtgcagtagccattggagcctacctttatactccacggcattacacagcatgttatctggtaccatcagaagcctgcaattctcggcctcctccagaacctgctagggtatacactgatgatgagatcgctgctcgtgctatcatgagagacatcatccgggcacggccagtgcagtcaaagaatccaaaaattgctttcatgttcttgacgcccagttcattgccatttgagaaactgtgggaaaaattcttcatgggacatgaagaccgattcaccatatatgtgcatgcatcaagaga

SEQ ID NO: 60702 - DNA, 373 bp, Zea mays
  Clone ID: LIB3069-010-Q1-K1-C11
cctacttccacgcatcctttcctactgctttggtacatctccaccgcgaccacatgtaggagctctgctagaactcccgcatgtagacaatgtactgctcgacgtacgagctggtcgacgtgcgcgtattccccgcacgcgagagcggactgcacggcagagcctgcgccgactacatggtcgtcgccacaagccgctccgattggcacattcgtaacatcgcgcatgcgctcctctacaagataaaccaaaagcagaaggtctctgatagaatattgatgccaagtgtaaaacgtcagcaagcgggaaaatgagctgtcattgattctggaagcataatcatccatgcacttgaagaatgggcaagatagta

SEQ ID NO: 60703 - DNA, 431 bp, Zea mays
  Clone ID: LIB3069-010-Q1-K1-C12
gaccgactcgtccgcccaggcgtgctctgactcgtgggctcatttactttcgtcttcgtactcgcctatcttctcggccgatttcgttcccccttctgccattcttctctcatttctcaccaccgccgccgctaccccctttctacaacaccatgagggagtgcatctcgatccacatcggccaggccggtatccacgtcggaaacgcgtgctgggagctgtactgcctcgagcatggcattcaggctgatggtcagatgcccggtgacaagaccattgtgggaggtgatgatgctttcaacaccttcttcagtgagactggcgctgggaagcacgttccccgtgctgtttttgttgaccttgagcccactgtcatcgatgaagtgaagactggcacctatcgccagctcttccatcctgagcagctcatc

SEQ ID NO: 60704 - DNA, 189 bp, Zea mays
  Clone ID: LIB3069-010-Q1-K1-C3
gacccactcgtccgggactcgtccgagcgatcccactccctttcagtttctgatcgctcactcttgcatctggatcagtctttatctgctctagctctagcctctatccctatctagtatctagccactcggtcgagtagtcatcagccttctgatcgtcacccatggccactgccgaagtccagaccc

SEQ ID NO: 60705 - DNA, 369 bp, Zea mays
  Clone ID: LIB3069-010-Q1-K1-C5
cccacgcgtccggccagattgtttccttgacaggaatgactacaaggacaacgggttcgtacagatcatctccaacgccctcggtatgaagctcatggacatcctcaacaagctcaaatagatcagtcccttgttggatttcatttctagcctacccgatggtgagagcaagtgaacgcatgcgcacttggaggagacaacgtcacatgataaggttgttcaaggcgttgatcaagtggacgtagcggcttatcgacaagcatgttttggtcctgtagagctactacatgaaagtttttttcgctcagatacatctccattttgttctgaagctcatatttgggaatacataagaatcgaaaggggaaa

SEQ ID NO: 60706 - DNA, 399 bp, Zea mays
  Clone ID: LIB3069-010-Q1-K1-C7
gggagatggtcaacaagacttttgatatgttaaaccaagttggtatggtcatatatcagaaaccattggacaatatttgctatgagaaaagatctgaaaacagcccgccattgtgcaaggaatctgatgatgcagatgctgcttggaatgtaccgttggaagcatgcatgcacaaactgcctggtggctcaaaagtccgaggatcaaaatggccagagttatggccgcaaaggcttgagaagacccctttctggattgatggttccaaggttggtgtctatggaaagcctgcaaatgaagattttgaggcagataatgcccactggaaacgggttgtaagtaaatcgtatgtgaatggcatgggaattgactggtccaaagtgagaaatgtcatggaca

SEQ ID NO: 60707 - DNA, 427 bp, Zea mays
  Clone ID: LIB3069-010-Q1-K1-C8
aaaaaaaaaaaaaaaaaaaaaaaaaaaaaaaaaaaaaaaaaaaaaaaaaaaaaaaaaaaagaaaaaaaaaaaaaaaaaaaaaacaaaaacaaaaaaaaaaaaaaaaaaaaaaaaaaaaaaaaaaaaaaaaaaaaaaaaaaaacaaaaaaaaaaaaaaaaaaaccaaccccccaaaaaaaacacaaatcaacaaacccaacaaacccaaaaccaacaccttcaaaaagacaccccaaaacaaaaaacccgccccctctttaaaaaccaacataccgaaaaaaaccctgcttcaaccaaaaaaaaatacctcaaaaaaaacccccttaaacccaacaaacaaaaaacaaaaaacccccacccaaaaccccctccaaaaaaatacccaaaaaaaaaaacaaaaaacacccccccaccaaaccaccaaaaa

SEQ ID NO: 60708 - DNA, 461 bp, Zea mays
  Clone ID: LIB3069-010-Q1-K1-C9
aagagaaaggctgatgagagtctacatagctgtcatactgtattgtatgggataaaaggaagtaaccattttttgaagagaaacatatctcaattttccgggtttgtttggacagacaatcaagaaaagcacaggaccaaaataaaggaaaagcttgagaaatttaacaaggagaagttgctagatttttgtgaaattctggacgttattgtaaaagtaactacaaagaatgaagaagtttctgccaagctcttggaatttttagagtctccttgtgttaccagggatgttattctcactgataaaaagaaggggaagaaacgcggaaggaaatctaaagtaagtcatgaggtaacttctgaaggtgcttctgcagagaagaaaaggaaaagagttcagaaacaagcagctgaagatggtaaagagaatgatgatggggatgatgctgatcttgctggttc

SEQ ID NO: 60709 - DNA, 455 bp, Zea mays
  Clone ID: LIB3069-010-Q1-K1-B11
atcggttacatgttacagggatccatttacttataaacaaacttgtttcgggcttagggcagatttacccaaaactgaacttttgcaaattacttcaaattcttccacaccacttgtagagctccaaatatgaaattttttcacttttacaagctccacaactttgatatatggacttttcacaaattctcaatggattttaaattccacttttgagactaatttatactttcaaatgtgactactatttctccaaaccacctctcaactttgatccaccactaaaagcaaagttactacttaatcaaagatccaacttcggtactcacaacttatggccaaaaaggcccttatttatggacttgctttgattatgcaccatttcactcttgggctcaatttatggttttgaagtccatccctctccttaagcgatcctttcacttgatttacac

SEQ ID NO: 60710 - DNA, 433 bp, Zea mays
  Clone ID: LIB3069-008-Q1-K1-E10
cccacgcgtccgaccataatgactatatacttggatcttgtaaagccatccccattacctgagatctggaagttggctgaaattttcacaactggagttgtccttggtggatatcaggcaatgatgactgtcatcttcttttgggctgcatacaagacaaactttttcccaaaaatatttcatgtggaaagccttgagaagacagctcaagatgatttccaaaagcttgcatctgctgtttacctgcaagttagcaccatcagccaggccctcatcttcgtgacaaggtcccggagctggtcatttgtcgagcgcccagggtttctattggtctttgctttcttggttgcgcagctgattgccacactgattgctgtgtacgccgactgggcgttcacttcgatcaaaagcattgggtggggctgggctggca

SEQ ID NO: 60711 - DNA, 206 bp, Zea mays
  Clone ID: LIB3069-008-Q1-K1-E11
cccacgcgtccgcccacgcttccgggccgattccggtttgaaaaccaagccgttgaaaacggggagggggctgttgaagaaaaccttaacaattaagccaaagccgaaggccctaccaaccttgccctcggggttctacaacgccttcgtcctgaggggaatccgcgtcgtccaggccctccagcccggaacactcctctgccact

SEQ ID NO: 60712 - DNA, 432 bp, Zea mays
  Clone ID: LIB3069-008-Q1-K1-E12
ggaagaccccatggattgtcaatccagagttttaggattacccagacctatatgttctgaggcctttgcagtatgtggggattgaagtatggcaggtcaaagctggttcagtttttgacaacattttgatttgcgatgacccagactatgcaagacatgttgtagatgaaacttttgctgcaaataaggaggctgaaaaggaggcctttgaaggagctgaaaagaagaggaaggctagagaagaagaggaagcacggagggcacgggaggaaggggagagacgaatgcgggagagggatagggaccgcggcagggaccgatacaaggatagatataagcgtcatatgcactacgactaccatgacgagctatagatcctgtattcttttgaaatctgcacgatattggatgtctgtctacggagagcgcacg

SEQ ID NO: 60713 - DNA, 343 bp, Zea mays
  unsure at all n locations
  Clone ID: LIB3069-008-Q1-K1-E2
cccacgcgtccgcccaatttactatgttataccctttggcttccgatgaggtggccgaggcgtgaggctgacggttgtgctggtagtccgcaaggaaccggatttggacgcgtctctccttggcactaagtttggcttcaaaagggataagtcatcaaatctcctgagacagtacttcagcaactgcacgatcaactgagtacacgtncttttttcacagtcagggtggcaaagaaatggcttgaattttagaatgagacggcatgggcaatatggtgaagcggatattaactccatggtcgttgcgagttgcatcactaccaggcacaacaaagggttcaga

SEQ ID NO: 60714 - DNA, 142 bp, Zea mays
  Clone ID: LIB3069-008-Q1-K1-E3
gacctgttcaaggccgctgcggtcgactgttccgtttccctcttttgcaaggtgcctccggcccggcttcctcggaagaacttcccgaaccaattaaggaccttattcctgaataccggtccgccgttaccaaaccggcccc

SEQ ID NO: 60715 - DNA, 350 bp, Zea mays
  unsure at all n locations
  Clone ID: LIB3069-008-Q1-K1-E4
cccacgcgtgcgccgtcacaactcacaactcgagttccccaaacccgaagcagcacgagcgccggtgaccttgctccggctccgatcaaggaaaaggaagatgagctactacggccagcagccccccgtcggcgtcccgccgcagcaaggctacccggggaaggacggctacccgccagcggggtacccgccggccggctaccccccgccggcgcagggctacccgtcgcagggctacccgcagcagggttacccacagcagggctacccgccgcagtacgcgcagccgcctncacagcagcagcagagcagcgggccttccttcatggaaagatgcttggcctgcctct

SEQ ID NO: 60716 - DNA, 448 bp, Zea mays
  Clone ID: LIB3069-008-Q1-K1-E5
caagcagcaagtcgatcgtgagcatctagttcttccctgctcatcgtcgccagctggtccgagggatgaggaagaagagatagatggacgacgtcggcggtgctgctgctggtggtggcgattcaaagcagctcttggttgaagcagatgggaacacacgcacgcttattttgaacaggccgaaccagctgaatgtactctcctctgcaatgattaagggactcctgagctgtttcactgcttttgtgaaagatgatggagttaaattgttgattatgaacggttctggaagagcattttgtgctggaggtgatgttgttgctggtgtccagtcaataaataatggatggaaatggggcgctgatttcttccgagatcaatattctttaaactacataattgcaacatgtatcaaacctcacgtttctcttcttactggaattgtcat

SEQ ID NO: 60717 - DNA, 338 bp, Zea mays
  Clone ID: LIB3069-008-Q1-K1-E6
gtggaaggaggatgcatccaacatcttttttcgtggtcactacaccattggcaaggagagtgttgacctgtgccttgatcgcatcaggaagcttgccgacaactgcactggtctccagggcttcctcgtcttcaacgctgttggtggaggaacgggctctggccttggttccctcctcctagagcgcctgtctgttgactacggcaagaaatccaagcttgggttcactgtgtacccttccccccaagtttctacttcggtagttgagccatacaacagtgtactgtccacccactcccttctcgagcacactgatgtggctatactgctggacaatg

SEQ ID NO: 60718 - DNA, 267 bp, Zea mays
  Clone ID: LIB3069-008-Q1-K1-E7
ggagcgggtatggccggtacccctttagtttatatggttctgttcaaacatctggggttggccaaatgtaatcggctcacatttcattagctgtagctggtgcatcggcagttgcggttcttagcactgccgttaatgctgcctcatgttcttttatttcagatgaggcttattgaatttttagctacatgtcgtttctaggggtagctcgattcgatgtagcgaaaaaaagttagattatgtctatatgcatgtgaaattttagag

SEQ ID NO: 60719 - DNA, 430 bp, Zea mays
  Clone ID: LIB3069-008-Q1-K1-E8
cccgcgcgtccgctcccttcaacttcccgttggattttctctttgaaagatgtcgtgggggaacaatggaatgaacatgtcagctcgttatcaattctgccagaagcagaccatgttcagacacttgttgccaccctccgaactggccatgcagttgcaggtgtacaatctgtgatacctgcagcagacaatacaggattaccagagtgtaggggagaaatacttggcaagctaataaggattgggctattacagctcatcagcagcatggagggtgtagaaagggaatcggttcctgagacctttatgttgaattggttgaagctgcggtctgttcagagtaaggttcaacaagtgattgtgatagccacaagcatgctttgtttgcatcacgtgttagcgagtgagaacccaaagatcacttcttctg

SEQ ID NO: 60720 - DNA, 438 bp, Zea mays
  Clone ID: LIB3069-008-Q1-K1-E9
gtgttgaatcagtatcttgaggagaagactgtcctatatagagttattaatagagataaacggacaggagcacgtacaaagttatcccgagtaaaaattcttcatgagtgtcgactgctgcgggagcggctacaagactgcagtgctaaatttctagcagaagaacaagacaactttactattgatccatcatccttgcctgatgcattagatcttctagcatcatcagacaatagaatacgcctactcgttgctgaggctcaacttctagcacgagatgatgaacaaggctcttctgatggtggcgacgattctgatagtagatcctcattaactatgagcagtgaagatgcaaaagttaccgatgaagatactactaaaatgctttctgatctgctcattgacaatgcgcatctgagactacgccttaatgctgtc

SEQ ID NO: 60721 - DNA, 442 bp, Zea mays
  Clone ID: LIB3069-008-Q1-K1-F1
cccacgcgtccgcggactcgtgggcttctttatagtttatgctacttcaagtctgcattggatggagaatccaagttgcagatactcaatggcaattatcgtatccctgagcaacccaagtatagcactgctgtcacagggttgatcaaagatatgctggaagcctctccaaattccagaccagacatcacacaggtctggtttcgtgttaatgagctactgccgcttgagttacaaaaaagtttacctgacggaccttcgccagccgtttccttgaagttgcaagatgaaggtgctcataaaagggcacatgttatgcctaaaatgaacccttcttcatcttcaagagagcaatctaatagttctctatcgcatggaaactcaaaagcaagagatgcacccttaggtgcattttgggcaacacaacatgcacaaagtgctc

SEQ ID NO: 60722 - DNA, 388 bp, Zea mays
  Clone ID: LIB3069-008-Q1-K1-F10
gcacaggctgagtcttgacttgcctctacattatgcgcttttgctggttatagtcggtacgggtaaccgttttttatcctagtcctataaggctataacataaggcgcgtgtgtcatctctagacatgcgtacatcgatgtagtagtataaagagaattaaatatattcctcagtctttgaactaaaggtggttatgccttatatacttatatactgggactgagggagtatatttctgcagacaatatgttagctatgatcaaaccttgaatctcatgtctaattgaaagcatctcttaaccaggaaaaggatgctagggacattgaaattcctaatatcagatgggacgtctttgaactcatgatgagatttatctatacagggtc

SEQ ID NO: 60723 - DNA, 428 bp, Zea mays
  Clone ID: LIB3069-008-Q1-K1-F11
atggagatgatggatctgcatcagacatttgttcatgtggtgtcattctctatgttttaatggctggttaccttccctttgaggagaatgaccttccaagtttgtatgaaaagataactgcagctaagtactcatgcccatactggttctctccaggagctaagtcattgatccagagattacttgatccaaatccaagaactcgtatcactattggagaaataagagcagacccatggtttgagaagaactatgtagctattagacgcggtgaagatgagaatgttagcctggatgatgttcaagctgtttttgacaatattgaggacaagtacgtatctgaggaattaactcacaaggatggtggtcctcttatgatgaatgcctctgagatgattacgctatcttaaggtttggatctctcaacg

SEQ ID NO: 60724 - DNA, 430 bp, Zea mays
  Clone ID: LIB3069-008-Q1-K1-F12
cggacgcgtgggcggacgcgtgggcggactcgtgggcggacgcgtggggtctcctgaaacattgcagcaattaatttcattccagcagtctttgatgtcacaacttggccaacaacaaactggacaggagcggacacaatcagcctctggtgcaggcaatgtgaacctcaacaccttgatgaacatgttcagtgggcttggtgctggtggtggcctaggtgttccaaatgctcctaatgtgccaccagaagaactgtatgcaacacaattagctcagctccaagaaatgggtttttttgacacacaggagaacatccgagccttggccgccactgctggaaatgttcatgctgcagtggagcgacttcttggaaacatgggccaatagaatatgatgacgaacataactgtgttctgatccatgcgatct

SEQ ID NO: 60725 - DNA, 344 bp, Zea mays
  Clone ID: LIB3069-008-Q1-K1-F2
cggacgcgtgggctgattctgtagctacaattgactcagactcagatgaagttaacgggagagggaatggctgcaacggtgtgggaaaagaaatagattaagatagcgctgctattggacaggactggaccaggaaaagcatggatcagtgcactattgcgtacacatagaaggaactaacgattaatattgaacgtgtagtgaaacgcaaaatcacatgggtatcaagaggcacgctaggtgaaacatgtgtgtcaaatggctgtcttgtcacaaagatacagatgaagaagtgctaactcactggagaaataactgcgtatgaggaattcttaatcaccata

SEQ ID NO: 60726 - DNA, 316 bp, Zea mays
  Clone ID: LIB3069-008-Q1-K1-F6
gtgatttccaagaagcacttttctggcttttgctgcctcaagctcttcgccacttcctgggtaaatcaacaagtagatcaagagagaagatctcacaatcaagtttacatcctgattctgaacaaagctccagatttaatcggatagcttcaagagagagatctgcttctgaaaagttcacgaaaaatgctgcgaattatggccaattaagctcaatggcatttaatcaagagcaactatggttcaatgcaagtgaaaggataccttggcatgacaagctcgatggtgaagatgctttgcaaaagcatgttcatga

SEQ ID NO: 60727 - DNA, 455 bp, Zea mays
  Clone ID: LIB3069-008-Q1-K1-E1
cttcgacagggacccagaggaagcaaaggatctaggtttaggaagtttctgccgcccctgagtttggggcaatcactgattaccaaggagctgatcagtggggtggtgaccagtggacctctgatgtgactgcgccgcctgttgctcctactggtgctgattggggtgctgctccagctccggttcctaccggtgatggctgggatcaagctggggcccctgcacctgtggtggacggcactgtacctcctctggttgctcctactggttgggaccaagcagccccgacaccgactgcccaaagctgggagtaggcgttgtccactctgagacctgtcttttgcgggttaaagttcagtatttttctgtgggctgaatggtcaaatttcgggggcatcttctttagccttgctttgttttgctttgaacacttgtgttttacgggtttctagctg

SEQ ID NO: 60728 - DNA, 436 bp, Zea mays
  Clone ID: LIB3069-008-Q1-K1-B8
cccacgcgtgcgcccacacgtcctctttctgtttaggaaaatggagtacttgagggagcgcgctaactgtgcctcgctggtattctggagtctggacgaagctacagacgcaagagtcatctgttgatgttgactaatgtgagtgaactagacgagactgactttggtatatagtggcctcgcagtattgaatcagcaccttctacgtaggacgtacatacagcctgtagttacctctcttctgggaaatccaatggcaggttattagtttgacccatagcgccacactgatcaggaatcgattcgtatatagtgaccagcgtgatcaagaactaacacggatgccgttctgaatacaataatacgtacaacccattcgtgctacctgcaatataattggataagtcctgccagtctggttcactactgtaacata

SEQ ID NO: 60729 - DNA, 439 bp, Zea mays
  Clone ID: LIB3069-008-Q1-K1-B9
ctctggcatcgggccagtgttttgagaagctggtcggttctcctagatcccttcgcctctggctcgtgcgaagctaggtagccgccaccatgagccgctcggggcagcctccggatctcaagaagtacatggacaagaagcttcagattaagctgaatgcaaaccgtgttgttattggcacacttcggggattcgaccagttcatgaatctggtgatcgacaacactgtggaggtcaatggaaatgacaagacagatattggaatggtggttatcatgggaaacagtgttgtcatgatcgaggcactggagccagttgccaagtcgcagtgaatccttatttttcagctgatatagtcgcagcatgaaaactgatgtaaatgctatgagtgaaccctgttgtacttcggactcgtgcttttgcacagcaacataactcg

SEQ ID NO: 60730 - DNA, 429 bp, Zea mays
  Clone ID: LIB3069-008-Q1-K1-C10
cccacgcgtccgccacttcaaggcgtgcatgtctgcggagatgcagctgtgcgacgtgggcgcgcgcgtcatcttcgccgtacaactacaaccacttcaaggcgtgcatgtcggcggagatgcagctgtgcgacgtgggcacgcgcttcatcagctgggacggcgtgcacttcacggaggccgccaacgccatcgtcgccgccaaggtgctcaccggcgactactccacgcccagggtcaccatcgccaaactcgtcaactccacgctgcccaacgacgactagctggctggccgatcgatcgatcgatcgtcgtcgtcgtcattctgataaacatactgcaggctgcaggcttcatcgatccatatccaattgtccgtagaaatctacgactagctcattggagatctgtaatgtgggctaagagatg

SEQ ID NO: 60731 - DNA, 328 bp, Zea mays
  unsure at all n locations
  Clone ID: LIB3069-008-Q1-K1-C11
aggaggatctggctaagatcgagaaagaacttgaattggagattgccaaaagtgacctgagggaactgaanaaggaatgtgttgaggcaatggagactcaactcaagagggaggagttccaagatgaggagatgcctgatgtcaggaaactggacatccgaaacttcctgtaggcctgatcgacgataacctttgaggcattgcaaatcacccagcccacctgtgattnttcttcttttggttttggtttcaagttgatccgtgctgtaagctacacctatgaatgctgctccttcctttttttgaataaaaaaaactgcaccgaggt

SEQ ID NO: 60732 - DNA, 260 bp, Zea mays
  unsure at all n locations
  Clone ID: LIB3069-008-Q1-K1-C12
cccacgcgtccgcccacgctttcgcaagaatttatcgataagaatgctgttacgatttcaaaggtggcgctacatatgcatctgcagctatggagtanggatttgttctagccactattgcccttatttttcaatatgtggaaaggtgtgagttacaaaggggaaactgcttccacgaaagagcccacgttctctgagagctcttcagtgatctcaaaacctgtgccttttaacgcccatatcaaccagatcattcccga

SEQ ID NO: 60733 - DNA, 253 bp, Zea mays
  Clone ID: LIB3069-008-Q1-K1-C2
cccacgcgttcgcccactcgtccgcagagtctcctttatctgctggccccaaaaccctaggttagtgggagccgccgccggcgccgtgggtgctgatccttctccctcggaggctgccgctacaccagccagagaagatcaacagcactacgccgccgtcgcgactggcggagtttcgggcgaatcgtgctatgcagcggcgcctcctgctggtggaggcggcgcagacgatgccgtggagcccgtggtcatc

SEQ ID NO: 60734 - DNA, 323 bp, Zea mays
  Clone ID: LIB3069-008-Q1-K1-C3
cccgcgttgtcgccgacgcgtgggtggacttctactacgcgggtgaaggcacggaccacagcggcgttccaacaaaattggtcacaacaaactgttctctgcacatagctgtctacaaccctgccacaatgtttggaattcatgtcacttctggccccatccacctgatgtattcagagatcccaatagcagtcggtcaggttcggaggtattaccaaccgaggaagagccaccggatggtgacggcggtcatccacggcgagaaggtgccgctgtacggcgccgggggcagcctgatgctgtcgacgagcacgggcggggcg

SEQ ID NO: 60735 - DNA, 243 bp, Zea mays
  Clone ID: LIB3069-008-Q1-K1-C6
atttaattccttgctttggttatttagactcatctactcatgaccaagatgtaggtgccgtgtatcctgatgaaagaccatgcaatggttctcaagaagctttagctcgatacagagagattgtacctcatcttcgcctttcgggtcctacgtcattcgccccaattattgaccttggccccacccattgtggagcaaagtggtggccaataccatgttttaagcaattattgcttacgggca

SEQ ID NO: 60736 - DNA, 246 bp, Zea mays
  Clone ID: LIB3069-008-Q1-K1-C7
gtccgcctggttccacttccaccactgcgatcactagcgctacaccgaagccacgttttgtgtggtccttcaatacgcctactccgggcttcggattcggcacaacgtttgccccttgctcccggaaatctttgcaaaccggcgccgttactgtccggcaaggcaaccccgtttttcggccggcgttgatctggagatgctcttttcacggtgtttttttttggttacactcccccttccgtcctg

SEQ ID NO: 60737 - DNA, 224 bp, Zea mays
  Clone ID: LIB3069-008-Q1-K1-C8
cccgcacttcctgcactcgcactttagaatgcactactcatccgcccgacgacgggctcggtcatactgatgatacaccggcgcccatgtttaaaaacgtcactaactttagccagatactaggcgcatcatccacaagcgacgagcacacacgaattactggccaatacatgacattgctcatgtcctttgccgagcaccctcctttaccataccttattgaa

SEQ ID NO: 60738 - DNA, 464 bp, Zea mays
  unsure at all n locations
  Clone ID: LIB3069-008-Q1-K1-C9
aatttccggtcgaccacgcgtacgcccacgcgttcgcctggatgatgagcagccttcactgaatctnaaggataccggaaccaagggtccggttgaccttattctaaagccatctgaagatgacctcaagtgctggccacattgttttgagttccgtctgagggcctctctttcaaaggatggggacttgtcattgatatcacgcatcaggaatgtcaatggcaagccattcagtttctcatttgcttatcacacatatctttctgtttctgacatcagtgaggtcaggattgaaggtctggagacacttgattatcttgacaaccttagccacaaagaacggtttacggaacatggagatgccataacatttgagtcagaggtcgaccgagtctacgttagctccccaaatgtaataacagttattgaccatgagaagaaacactcgtttgtcataagaaagg

SEQ ID NO: 60739 - DNA, 285 bp, Zea mays
  Clone ID: LIB3069-008-Q1-K1-D1
gctgtctggttcaagaccggcgcgctgcttctggactgcaacaccctcaactacttcgggaacagcgtccccatcaacctggtggtggccgtgatcgcggaggtcatcctcgtcggcggcgccgagtactaccggatcaccaacggactggaccttgaggacaagctgcaccccggtgggcccttcgaccccttgggccttgccagcgatcccgaccaggccgccatcctaaaggtgaaggagatcaagaacgggccggttgcccatgttctcaatgttcgcctt

SEQ ID NO: 60740 - DNA, 357 bp, Zea mays
  Clone ID: LIB3069-008-Q1-K1-D10
caccagctcaagtgagggggtgaccccccattctccttcctagcgctcctcaccgccatgctgccaagaatgcagagcatcttccacctcggggaggagggtggcgccgccgccgtgcaccaccgcgtcagcgtcgtctgcgcggcgtcgtcgtccatggccatgggcggcggcggcggcggccggcgtgctcgcgagcgtgagcgcctcgtcgtggggctccagatcctggtgcaccaccaccaccacggcctgcacggtcactggcacgcgcacgctgcgaacgtagtcctgaagcagatggtgaggccgcgcgccgtcgcttgctcgcgccacggccactgcagccacgccttc

SEQ ID NO: 60741 - DNA, 387 bp, Zea mays
  Clone ID: LIB3069-008-Q1-K1-D12
cccacgcgtccgctctccacaagtccagatcttccattcacacacactcgcgcgcgcacagagacctggacgcgcagccaaagcatccacccatggcgcctctcctcctgctcttcctcctcggcggcctctgcgccctcttgtcgctcgccacttcctcacgcgccagcgccaagaagtgcgatgacgtcaagagcaacggcaattgcggggactccggcgaggaggcaagatgcagggacgactgcgcgccagaggagacgcagcagcaggggaagatgcatgcgcggcccgacccggagaaagacctgggcatcgtattctccacgttcgaccacgacggcgacgggttcatcacggcggtcgagctcgaagagtcgctgcgcc

SEQ ID NO: 60742 - DNA, 339 bp, Zea mays
  unsure at all n locations
  Clone ID: LIB3069-008-Q1-K1-D2
gtggacttgcacagaattggcagagctggtcgcttttgccggaaaggtgctgtgttcaagttgctgtgtggtcaaaccgataatgttgtgatgaagaagatcgaggactatttccagcacagtgtgcctgaggttcggaattggcaacttgaagaagattttgaggctgctctcaaggatgcatgtttactttaaagtaaccaccgaaacttgtggtgttttttgctgagcctgctgcacaacgttattgagctctttctgctcttcctgtggcagcactgattnttaccggtgatttttttttcgctgaacgtgctggacaagcgtgctgtgctctta

SEQ ID NO: 60743 - DNA, 222 bp, Zea mays
  Clone ID: LIB3069-008-Q1-K1-D3
acgtgaatacgattgattcacagacactttgatgctcttaagtcctggaccaaccacaggtgatcggtctagatgataccggactgcctgagacagcataccattcaagcatgaagagccacgtagatctcatgaaacacctatacctgaccatactgctcagtggatgatcaactgtcttcccaataatctcactgcgtctcagcacagagatcacttgcc

SEQ ID NO: 60744 - DNA, 256 bp, Zea mays
  Clone ID: LIB3069-008-Q1-K1-D4
cccacgcgtccgcccacgcgtccggctgatccttttccagatcaaccaccgcaacgtggggaagctgcttggctgttgcctcgaggtcgaggtgcccatgctggtctacgagtacgtcccgaacggcagcctccacgcgtacatccacggcgatggcgactgctgctgcagcggtggcgaggccaagctgaatctggcacccggcgcgcgccttcgcatcgcggccgagtccgcggacgcgctcgcgtacatgcac

SEQ ID NO: 60745 - DNA, 154 bp, Zea mays
  Clone ID: LIB3069-008-Q1-K1-D7
gtccgcacacggccacaccacacttagctttccccatcgcgcgcacactctctcggtctggccctcccagtcccagcgtttgcggtccagtccagagagctcgagcagccatggcggctcccctgttcctcctcctcctgctgctggctatgtt

SEQ ID NO: 60746 - DNA, 425 bp, Zea mays
  Clone ID: LIB3069-008-Q1-K1-B7
gaccaacctggttccttacccgatgatcctcttcatgctctcctcctacgcaccggtgatctcttctgcgaaggccttccacgagcagctgtctgtggcggagatcaccagcagcgcgttcgagccggcttccatgatggtcaagtgcgacccacggcacggcaagtacatggcttgctgcctgatgtaccgcggcgacgtggtgcccaaggacgtgaacgccgcggtggccaccatcaagacgaagcgcaccattcagttcgtggactgttgcccgacggggttcaagtgcggcatcaactaccaggcgcccacagttggtgccgggttgccgacctcgccaaggtgcaacgtgccgtgtgcatgatctccaactccacccagcgtctcgaggtgttctcccggataaacagcaagttctacct

SEQ ID NO: 60747 - DNA, 256 bp, Zea mays
  Clone ID: LIB3069-008-Q1-K1-D9
caaagttatcccgagtaaaaattcttcatgagtgtcgactgctgctgtagcggctacaagactgcagtgctaaatttctatcactaaaacatgacaactctactatcgatccatcatccttgcctgatgcattagatcttctatcaacatcagacaatagaatacgcctactcgttgctgaggctcaacttctagcacgagatgatgaacaaagctcttctgatggtggcgacgattctcatagtacatcctcatt

SEQ ID NO: 60748 - DNA, 255 bp, Zea mays
  Clone ID: LIB3069-007-Q1-K1-A12
acattcacttactcttttaacttctttccaatatcaacatttatatactaaaatatcctctttattcatttttttctattttcatactttaacaaactctaacaaatacttaatcttaatcaccccacacactttcctaatactatatatctctttcaccttctttattctcatccttctaattaaccaacactattctccataaattatcatatttttcatatacaattttatcctatattttcttaatttctt

SEQ ID NO: 60749 - DNA, 253 bp, Zea mays
  Clone ID: LIB3069-007-Q1-K1-F10
tactcttaccacatatatccaacattaaccaacaactaacatctaattccccactatactctaatacaattccaatctcactacacaagtcctcttatcaataccctttaaaatcatcctaataatcaatctcaaaaatcttaatctttatacccttttcattatatatacaacctcattctctctacaacacacttcttccaaactacacttatattccacatacttacttaacacatcacccacatttcta

SEQ ID NO: 60750 - DNA, 348 bp, Zea mays
  unsure at all n locations
  Clone ID: LIB3069-007-Q1-K1-H11
ttcaccacctcctaanaataattatgggacggatctttttaaaatattatcagcccatttaacaacacacaaatactcaacttcatcttcaaactactataatttctcttataacttccactcttcacaaccattacctcattcacataaaaaatattcttccaaaccatcataaatcaatacccattctacatctctaatataatacttatttaaatactcaccatctctaccattatcctcatctccatctttttcccaatttaactctaataattatatcatcactttctttcataatctatttttttcactccaatattttatcacctttcnctacccatcaac

SEQ ID NO: 60751 - DNA, 452 bp, Zea mays
  Clone ID: LIB3069-008-Q1-K1-A1
ccaggcgtccgcccacgcgtccgacctgttttgtttaccccccgaaaatttgccgtctggtcgtctcgctcctctccctgcgcagcccccagatccggcaccgcccgctcctcgatccccgcaccccacgcccgcaggccgggaccggcggggtcgcgcgccgggtaggaggaggagaagaggaagggcggtatggcggcgccgccggcgagggcccgggccgactacgactaccttatcaagctgctcctcattggagacagcggtgttggcaagagttgcctcctgttgcggttctctgatggttccttcactacaagctttattaccacaattggtattgactttaagatacgaacgatagaattggatggcaagcgtataaagctacagatttgggatacggcgggccaagaacgcttccggactattaccaacgcgtactaccgagg

SEQ ID NO: 60752 - DNA, 266 bp, Zea mays
  unsure at all n locations
  Clone ID: LIB3069-008-Q1-K1-A11
cgcatggtttgttgtgtggatcgcaccagatttacaatttccccaggacttcatgtttttgtgacnatggttgatgtgtcgattaggccctctcgccgcggatcctccttgccagctgaatgtcctttggcatgatggtcacacgcttagcatggatggcgcacaggttggtgtcctcaaacaggccaccaaggcttgccgtaagtctgccctcaacactggtcgactgaagaatcctcaccggtaccgccctgtaactgttgccc

SEQ ID NO: 60753 - DNA, 348 bp, Zea mays
  unsure at all n locations
  Clone ID: LIB3069-008-Q1-K1-A12
cgagagaatcgtgagcagatcgtgtgacctgtctcttattggcgtcttccgtaggcggttgcgganacggttgctgtggcctgggccggggccgttgctggctgtttgttcgttgcccatcgatacactcctcccttgccttacccgcatgcaatccgtgtgtgtgtgtgctctgcctctgctcgccggcgttggtttcgtgtgtcgcctgcctgtcgtcctcaccgcaacgctactcgttaccagctatcaactagcattgccttctccttccgctacaagaatctgacgagcccccctccctaccgtaccgcgctgttcccagctcgctcctttccaaagtgtact

SEQ ID NO: 60754 - DNA, 255 bp, Zea mays
  Clone ID: LIB3069-008-Q1-K1-A2
gtcctcccacgcgtccgcttactcgtggggcggctccccttttttcttcttttaaaaataacatcgtctcatatgccacactctcgatcaacaacaacagatcagttcatcttcaccatcacatcctcctccctctaccacaaaaaaaggaagggggaaaaatgaaatcatctcaacgcctgtacaaaaaatgccgccttttccacagttgtccttgccatgtcctacgccgtaccgttttctatactgctgtga

SEQ ID NO: 60755 - DNA, 307 bp, Zea mays
  Clone ID: LIB3069-008-Q1-K1-A3
atcggctcgtttggattcattgccatctctatttgtaaagcgttcagtgaatgttcaaggagaacatcactgatagacgtattaatgcattctactcatctaaatgttacaggaatatatgccttatcttgtactacttccgatcttatgcatgaacttgaacagaaaatcgtgaaattgccttctttaaaagttaggactgcatgtgacgatgtttctgaaaaaaaggatctattatgcacgctgtctacaatctgcttacagcttatacacatttagaatagaaagcttatcccatgggaaacct

SEQ ID NO: 60756 - DNA, 188 bp, Zea mays
  Clone ID: LIB3069-008-Q1-K1-A4
acgcactgaacaggtatccaagatggatgagtttatctttgagatccaacaggatttccaggagtctaggaaggatctgactggtcttcgtggaacactgaaaacggtgattgaagacagggacctgtcgtgtcaagaggtgaagtagctgagacgaaacatcatcatcatgctagaacgaggatttt

SEQ ID NO: 60757 - DNA, 415 bp, Zea mays
  Clone ID: LIB3069-008-Q1-K1-A5
cgcgtgcggagagggggaggtcgacgagacatatagtgttggccaagaggcttcctctcccgagtccggccttccgtgccctagccgagccagccgcgaggaaggaggcatcccgccgtctcgcctggcgcccgcccgtcggccgaccttctgccgcagcttccaattgtaaaaagatcatacatttttgtgcaagagcgagtggatatggaaccatccgctcagcctatgggtgtcgctgccggtgggtcacaagtgtatcctgcctctgcctatccgcctgcagcaacagtagctcctgcttctgttgtatctgctggtttacagtcagggcagccattcccagccaatcctggtcatatgagtgctcagcaccagattgtctaccaactagctcaacagttcccaccacagc

SEQ ID NO: 60758 - DNA, 126 bp, Zea mays
  Clone ID: LIB3069-008-Q1-K1-A6
cacccactcgtccgcccacgcgtccgaaaacaaaactttaaattttataaaaaataaaaaaacacaaaaagatacagaaaaaattaaacaaaaacaaaaccaaacactaaacacaatcttcaaaaa

SEQ ID NO: 60759 - DNA, 169 bp, Zea mays
  Clone ID: LIB3069-008-Q1-K1-A7
gacccacgcgtccgaaaagaaaaaaaaaaaaataaaaattaaattataaaaaaaaaaaaaacgacaaccgggtcaggccgactttgcattagtccaggcccatgcgaagtaataactatccaatcgaatcacctaaatccaactcactgtccgtccttttacaacacct

SEQ ID NO: 60760 - DNA, 207 bp, Zea mays
  Clone ID: LIB3069-008-Q1-K1-A8
accactcgtcctaagactgaacatttggttgagctcactgacgaggagcgtaacgtactggctgttgcatacaagaatgtgatcgctgctcgccgcgcttcatggcgcattgaaccttccattgaacaaaaggaggactcccataagaacaacaagcatgtgaaccttatcaaagaatatcgtgccaagatcgaagctttactgaac

SEQ ID NO: 60761 - DNA, 190 bp, Zea mays
  Clone ID: LIB3069-008-Q1-K1-A9
cccacgcgtccgcccactcttccgcagacttttaaacttacgcgtgcactgacaaggatgagccactcgatctacctcctcaccactggtgccacgaacagctctttcatgaacatcaaaaccattgctgagtgccttgcagatgacttgatcaactctgccaaaggctcttccaacagctactccatca

SEQ ID NO: 60762 - DNA, 132 bp, Zea mays
  Clone ID: LIB3069-008-Q1-K1-B1
caaagaaccaagcagcctcaggaaggggattaggcttgtaacatttgatttttaccctccgacatgtgagctcatgatacttaagatgcccctgtgtaccattactttctatagaagaaaaatacttgagag

SEQ ID NO: 60763 - DNA, 353 bp, Zea mays
  unsure at all n locations
  Clone ID: LIB3069-008-Q1-K1-B10
ctcttgcatctcgccagtgttttgagaagcttancagctctcctagatccccncacctatcgcgcntgttaaactatgtagccgccaccataaaccgctctgcgcagcctccggatctcaagaagtacatggacaaaaagcttcacattaagctgaatgcaaaccgtgttgttattggcacacttcagagattcgaccagctcatgaatctggtgatcgacaacactgtgcaagtcaattgaaatgacaagacagatattgtaatggtggttatcatgggaaaccttgttatcatgatcgatgcactagaaccagtttccaattccaatgaaatcttaattttcaacttattt

SEQ ID NO: 60764 - DNA, 351 bp, Zea mays
  Clone ID: LIB3069-008-Q1-K1-B12
cggacgcgtgggcggactcttgggtgctagttggtatctaaagctctctccctcctctcttgtcatatactcacatgctgctattttcttttcagattgaggagatgcatcgtgaactttgcagcttggtaatatgctttattccaccaatgtctacgcctcagcctccaggctctgtatttaggtcctttgtacaaagtttggtgctcaaagctagaggtggagatcataggatggttgtcaatgggactttcaacaacactgtgcttatttcattgtacacagtaatcctacatttgttgtcaaaaaaaaaaaaaaaaaatttatatttaaaattataaattaataatt

SEQ ID NO: 60765 - DNA, 127 bp, Zea mays
  Clone ID: LIB3069-008-Q1-K1-B2
cccacgcgtccggtggaaggcggcggggcttaggctctggcccttggagcggatgaggaagtccgggcactgctgctgctgatcggcggctgcctccatcttggcgccagcgagcgcagcagcgtcg

SEQ ID NO: 60766 - DNA, 315 bp, Zea mays
  Clone ID: LIB3069-007-Q1-K1-A11
ccaccccacccacacacccccccccccacccccccccccaccaccccccaccccaccccacccccccccaccacccacaacccacccccacccacccccaccccacacccatccccccccaccaccccacctccccaccccccccacccccccccccccccccaccacccacccccccacaccccccacccccccccacccacaaccccccccccaccccccccacccccccccccccccccccccccaccaacccccccccaccaaccacacccaccccccccacaccccccacccccccaccccccccccccc

SEQ ID NO: 60767 - DNA, 377 bp, Zea mays
  Clone ID: LIB3069-008-Q1-K1-B3
cccaggcgttcgcaaactaatgcttgctgttttgcttccatcgcatgcaatgcttgagaggggcggtgacacaatgaaagaaaatgcctccattcatgcttatgcgcatgaattactggaagctcatgaatgctggttgaaatatcacgctacacgagaggatgctgagctaactaaggcctgcgatttgcattaccatgttttcagaagaatcgcctcacagcttacaagtcttaccaccctcgatctgcactctgactagcctgagctactcaaatgtcaaaagttggaacttgctgtgccaggaacttatgctgcatattcaccactcgtgacgaatgagtattatggtccccaattgattgttataacgttca

SEQ ID NO: 60768 - DNA, 361 bp, Zea mays
  Clone ID: LIB3069-008-Q1-K1-B4
atgaggactcagcatataagaatactgtttagagtttcactggaattatatttaaaactggttcgaagaatggtatgcttgaagtgtataactctctgactgaagaaggaaagaagcagtttattgaggcctatagtgcagcatattacccatgcatggacatattgtatgagtgctatgaagacgtctcttttggaagtgagattagaagtgtggtgttggctgtgaggagatttcatgagaaggaagggctccctgcttttccctatgggaaaaattgatcaaaccacgtatgttgaaggggggtgaaagggtcccttcaaccaggccacaatgtgatcttggcccaatggatcccttt

SEQ ID NO: 60769 - DNA, 272 bp, Zea mays
  Clone ID: LIB3069-008-Q1-K1-B5
cggacgcgtggtcggactcgtggtttgacttttgggttatttattttttttttgggaccgtgcgagtcgaggcctcgaggtttataatcagtttgaagtgttgaactccggttactgtcaccctacaatggtagctctaatcaagaaccctaatcatatatcagatcacattacatgacagtcgacacttgacacgggcacacacacacaccagcgctgtccatggatcatacctgcaagtcagctccgcggcgcatccggttgcgcctacc

SEQ ID NO: 60770 - DNA, 227 bp, Zea mays
  Clone ID: LIB3069-005-Q1-K1-D2
gccacgcgtcgcccacctccgaaaattttattttaacaaaaaaaaaaaaaaagaaaggttaaaaaaaaaaaaataaaaaaaaagtgctgacggcttcttccccctaaccacgcgaggcagaaccctgctcccagggagggggcctgcggctgtccccaaggagttcctgccgctggctaccacccactctccgggctttctggcgcctccatgggcaaggacggttt

SEQ ID NO: 60771 - DNA, 341 bp, Zea mays
  Clone ID: LIB3069-005-Q1-K1-D4
gctgcgcgtcggagcacagcaacgtgtgctacgctgtgccgttcgtcatcggccccggggtgcggcgcgacggcaccacccggttccgggacgcgcgggggagcccgctgcacgacctcctcgccgtctccagcttcagcgagtacaccgtcgtggacgtgaaccaggtggtcaaggtcgaccccgccgtgccgcccaagctcgcctgcctcctcagctgcggcgccggcaccggggtaggagcagcgtggaggtctgccaaggtggagccaggatccactgttgcaatctttggccttggatctgtcggtttggcggtgggccaaagcgcgaaaatgtgt

SEQ ID NO: 60772 - DNA, 336 bp, Zea mays
  Clone ID: LIB3069-005-Q1-K1-D5
ccggcccgacccacgcgtccggattctggcacgggtgaggcacaagtagccttttaagcttgcgcggatattgtgctgaaggccaggaacgcttgatagtctatgattatatgccaaacctgagcatacacgcccaacttcatggacagcacgcagcagagtgcaatctcagttgggaaagaaggatgaagatcgccgtcgattccgcagaagggatcgcttatctgcatcaccatgcgacgccacacatcattcatagagatgtcaaggctagcaacgttctcctggattcgaatttccaagctcgggttgctgactttgggttcgccaagctag

SEQ ID NO: 60773 - DNA, 132 bp, Zea mays
  Clone ID: LIB3069-005-Q1-K1-D7
ggagcccgtcgcggccgaaccggccgccgtggcggaggctgctgctcctgctggtcccgaggagactcctgcggtcgagcaggaggcagccgccgaggaggaggctgctgctgctcctcctgctggtgccga

SEQ ID NO: 60774 - DNA, 355 bp, Zea mays
  Clone ID: LIB3069-005-Q1-K1-D9
cccaggcgtccgcccacgcgtccggtggattttgttttcccgtacctgttgcagttcatgggtgagtacactagcaaggtggacgatttagtgaaggacaaaatcgagtcacagaatgaagaaagagccaaagagaaggaggagaaagatcttgtggctcagcagaacatgtatgcgcaactgcttcctcttgctctgcctgctccgccaatgcccggcatgggtggcccttcacctccgatgggcggaatgggcatgcctccgatgggcgggatgggcatgccgccgatgggccctggtccgatgccagcattcgggatgccaccaatgggaagctactgagatgagatgtttt

SEQ ID NO: 60775 - DNA, 396 bp, Zea mays
  Clone ID: LIB3069-005-Q1-K1-E1
cacagtccacagcccaaagcggcggtcgcttttcgtttaaacccttaagcccgcacaccgacgaggcgaacggaccagagtcggcgagcccccaggaggcgccgactccgcctccggctctgaccggtctttagaccccccctgccccaggcgacgacgaaaccagcagcgctgcgcagcgccgaccactccgggaacctcacgatccaggggagatgctggtcgccgccgccgcctcgccgtcgcagcctggaaccgtgtttcccagggcggaaggacttgggctcagattcggcggatcttgggctggtctcgtgcattcgagccgctgcaagccttttggtaacccggttttttcgagggaaagggaacctaaactggttgggccactttggg

SEQ ID NO: 60776 - DNA, 442 bp, Zea mays
  Clone ID: LIB3069-005-Q1-K1-E10
gttggacccaagaccattcatgtttctactggggagaagctttctgtttttgatgcggcggtgagatacaaatctgagggccatgctactataatcctcgctggtgctgagtatggaagcggcagttctcgtgattgggctgctaagggtccgatgctcctgggagttaaagctgtaattgccaagagctttgagcgtatccacagaagcaacttggtggggatgggaatcattcctctgtgcttcaaagctggtgaggatgctgattcgcttggcctcactggacatgagcggtacagcatcgatctccctaccaacctcagtgagatccgtcccggccaggatgtgactgttactaccgacaatgggaaatctttcacttgcatcgttcgctttgacactgaggtggagctggcgtacttcaaccatggaggcatcctcc

SEQ ID NO: 60777 - DNA, 407 bp, Zea mays
  Clone ID: LIB3069-005-Q1-K1-E11
cccaggcgtccgaggcgcgccagatctttttcagtttcggcaaccctacagtcgaggtcggcgtggtttgctcagatggaacctttgcaagggcagctgttcccagtggagcatcaactggtgtatatgaagctctggagttgagggatggtggctctgactatttggggaagggtgtctccaaggctgtgaacaatgtgaattctgttattggacctgctctgattggcaaggaccctacagcacagactgagattgataacttcatggttcaacaacttgatgggaccaaaaatgagtggggatggtgcaagcaaaagcttggtgctaatgcgattcttgctgtgtcattagcttgttgcaaagctggggctagcatcaagaggatttctttataccagcacatt

SEQ ID NO: 60778 - DNA, 371 bp, Zea mays
  Clone ID: LIB3069-005-Q1-K1-E12
gtggaccatcagggaaacgatgtttgccctatacctggaacaacaaaaatcgagaacttggaccagaacgtgggggcgctttctgtgaagttgacaccagatgagatggccgaactcgagtcctgtgctgctgcaggtgaaatcttgggtgaccgttatcctcaaatggccaacacctggaaggactctgagaccccgccattgtcttcttggaaatctgagtagccaatctggtgtctcttcaattctgccaccgtcacattggtgtatctccaaattgtcggactgcagaagatactcaggtgcactttgcaaaagcgtccatatgatgtgcttgccttttgcaagctatgatgtttggtacttggtgt

SEQ ID NO: 60779 - DNA, 341 bp, Zea mays
  Clone ID: LIB3069-005-Q1-K1-E3
cccagtcgcacatcgggtcgtggcaagctttcgactcggaagcgccaccgctcccctgtcggtctgcgtccacctcctgtgccggctgcctgcctgcctaccacatcaatcagtgtgaccatccagcacattcccatgacgtgccacgccagcctgctgctgccggcgctcgccgccgtcctgctctgctgccccctcgcgcaatgcgggcagcagaactacacctccatgttcagcttcggcgactcggtcaccggcaccggcaacctgctcgtgtccagcccgctctccaaccacatcgtcggccgctacccctacggcatcacctaacttcaccggcc

SEQ ID NO: 60780 - DNA, 399 bp, Zea mays
  Clone ID: LIB3069-005-Q1-K1-E4
cccgggcgtccgagaatgttgatggcaacatcacttcagatgatgatgatgatgatgacggtgagttgagtgatgatatcagtgatgactatgattctgacgcaagtgagaaaagttttgagactcgaaaaacgaacaagtggttcaaagagttctttgaagtattgaatacattgagtttggaacaaattaatgaacaaactcggcaatggcattgcccggcatgcaaaaatggacctggggcgattgactggacataaggctgcagcctttagtgagtcatgctagaacaaagggttctacaagggttaaactttacagggaattggctgcattgctggagaggagctttctcgcaggggaacttagtggtactcagcggtgaacaatttgggaaat

SEQ ID NO: 60781 - DNA, 411 bp, Zea mays
  Clone ID: LIB3069-005-Q1-K1-E5
cccacgcgtccgagctgtcctagcattttctgctggtgattctggcgaagtggttgtggaggaggttgcccgtatcgaggcagagaaaatagctgaagcagctgtaaatgcacatgctgcattggttgctcaggtcgagaaagatcttaatgcaagttttgaaagggagcttaaggaggaaagagaaagggtagagacccttgaaaaagtagctgaagaagctatgttggagctagataggttgatggcaaaaagagaggaagagaagaatattctggtcaggggcagagctgctgttgagtctgaaatggaagttctgttgaagttgaggagtgaggtataggaacagctgcagaacgtactgagcaagaaagtggaggtgtcgttcgagaagagtaggattgagaaact

SEQ ID NO: 60782 - DNA, 442 bp, Zea mays
  Clone ID: LIB3069-005-Q1-K1-E6
aaagagctgtcgtcgaaagatggccttaatacaaaaaagatctttgtgggtggtatcccagcatctcttactgaagataaattaaaggagcacttctcatcgtacgggaaggtggttgagcatcagattatgcttgatcatagcactggacgttcacggggctttggatttgtcacatttgaaagcgaggatgctgttgaaagggttatgtcagaggggagaatgcatgatcttggagggaagcatgttggaattaagaaagctgaaccaaagaaacctggcgctggtgattcaagctcaaacggaagacacagccgtggtggtggtcatcgtgattcataccgtggtagtggtggttctgtgaacagccgtggcggctatggatattggggtggttaccgatcagctgctgcagcatattatggcagcacagcatatggtg

SEQ ID NO: 60783 - DNA, 462 bp, Zea mays
  Clone ID: LIB3069-005-Q1-K1-E7
cccacgcgtccgcacatacaaagggtatttttgttgctactccagttttctttgctgatacgcaagaccctgaactgaggaaagttgagacttcctttctccttggaccactcttagtctgtgcaagcactttacctaataaaggagctcatgaatatgcacataagttaccgaagggcatatggttgtcttttgattttgcggatgcacaccctgatctgccggtgctgtatctacaaggtggatcaattctttctgtaagtcttcctattaagcatgttggtgaagcaagtttggaggatgacctgtcactaattatcgcattgaatgaaaatggtaaagctgaaggtgttctctttgaagatgcgggagatggatatgcattcacacagggagactatcttttgacatattatattgctgaactccactcatcagtgggtactgtcaaaatcgtaaaat

SEQ ID NO: 60784 - DNA, 360 bp, Zea mays
  Clone ID: LIB3069-005-Q1-K1-E8
cttggcgctggcccaccctttttctgcatttaaggtagcaaaacttttcttggataatatctataagcttcatggtatgccggacaatatagtatctgatcgggatagagtgttcacaagtctgttctggcagcaattattcactctcagtggcacccaattatgcatgagttcggcttatcacccacaatccgatggccagacggagcgcgtaaactagtgcattgaaacttatttgcgatgctttgtgcacgcctgtcccagcaaatggtaccaatggttagctgttgcagagttctggtataataccaactttcattcagctctgaattggtctccatttgaggtgttatatggaca

SEQ ID NO: 60785 - DNA, 414 bp, Zea mays
  Clone ID: LIB3069-005-Q1-K1-E9
gatcgaccacgcgtccgcagggctgaacttcgtcagcatgggtttttagattctccaggttctggcttgaggcagcgtttggcatctgaaaggaaatgggcccttggtcttcagtctcgagcacatccacgagaaataataagtgaagtgcttaaagctctgcaagaactgaatgtttactggaaaaagattggacactacaacatgaaatgcagatggagtcctggctgccttgagagtatgatgcataacagtgatagcttcagtgcggagtctgctataattgaaactgatgttttcatggagaaatcaaccccgacagtgaagtttgagattcagctttacaaaacgagggatgagaagtaccttcttgacctgcaaagggtcagtggatcacatcttctctttctggac

SEQ ID NO: 60786 - DNA, 448 bp, Zea mays
  Clone ID: LIB3069-005-Q1-K1-D12
cccgcgcgtccgcccacgcgtccgttcactcgtccgcccacgcgtccgggctcggggggggtctccccctccgctccgcatccacagccccgtcggcggccagggcccagcctctcccctccgccgccgcgccacgccgcatcccagcgcgactttcggttgccgcgggcgggggcgagcagcagctcgtcaccgcgcaggaaccggcgcacgaacctgattatggagttgtcagcattcaccatgtcgggatcctgtgcgagaatcttgagaggtcactggcgttctacaaggacctactgggtctgagggtgaatccagctcggccaaacgacaagctcccgtacaggggcgcttggctctgggtgggttctgagatgatccacctgatggagctgccgaatcctgatccgttgaccggacgccccgagcacggcggacgtgatcg

SEQ ID NO: 60787 - DNA, 391 bp, Zea mays
  Clone ID: LIB3069-005-Q1-K1-F1
acggttaggatagtgcatagaaaacgattaaattatcgttcgatatgtgaataatggtaaaggggcaggcgattttaggtgatctgtacatggatgcttcactgctgaaagagtgttttaaagataatttacatgtgccgatttaatttatcattggacaatatatactctttgacaaaacccttgattcatcaaaattcttgggtttttatctctggcatattctaaaatattaaacggatattttaacttatgtattgtctatttaatattgatagaaatcaaccgttttattccaaaaactttgcctttgctttttttcattaccttcctatatagatgcacaatatgcatctaaactttctataattttacatctatagctttattg

SEQ ID NO: 60788 - DNA, 426 bp, Zea mays
  unsure at all n locations
  Clone ID: LIB3069-005-Q1-K1-B8
cccaggcgttcgaaagaagatatagtagtgtgagtagtataggagaaacaaaacatcgcagcgtagttcctttttttttactttgtttgtttgtttgtttttttaccatgaaaccaaaggtcagcagatggcagcagcaagcaacagattatagcgcttgctctcctattacattacattacatgatgcatttagcactaattagtagtagttactattaccagcccatctaggtagctgcttcttcatgaccatgatatgcacagcagtactaggggggaggaggggtgtgtgatgcacaagaagatgctgctgctacccacatgggactacactggatgcagacagacgtgacagaccagctggtccagcgtgaagatctcacaggattagaagaaacanacgagtcccggtcccaccagtgta

SEQ ID NO: 60789 - DNA, 419 bp, Zea mays
  Clone ID: LIB3069-005-Q1-K1-C1
ccgggccgacccacgcgttcgcggacgcgtgggcggcaggcgccggaggttttgctttccgggctacatggccaacacggaggcgtggcgcgccaaggcgcggtcccagagcgcgccccgccagcgcaccgacgcgctggagcggctgcccagccgcaggaagcaggggacgccgcccagggccgtcgccaggatgcacttgcagcgctcgtcgtcgctggccggcaactactcctccccgtggtcgtcgtcggctgccaggctcgacgtctccgctagttgtcgctcaaggacagcgagtgcggctccaccagcttcgtgctcaccgccgtcaccctctacagccggacgcggtcgctcgtcggctccgaggtgcgccgtggcctgtactgagaggagctagctcgtgttcctggcga

SEQ ID NO: 60790 - DNA, 396 bp, Zea mays
  Clone ID: LIB3069-005-Q1-K1-C10
gacccacgcgtccgcccacgcgtccgatctagtttcgcttcactttgccgccgcattttaatttataccgaaagtatctaccttcacctcacaaatatgtgtgtctaccactttctgggtctggagatagtatggtacacacacttctatttgacatggtgttagagtgttaaagcaaccataagagacataagagactagacaaatcattttgtaaaggtaaatttggttattatcagaaaaaaacatctccaaccgactttgtaatagctcttcaaatttagtagctctctatctcttcaccttcacctttactttctaatctacttcacttgctgctattcagtttgttggtttacagagtctcggttagattagtctactttttttttttga

SEQ ID NO: 60791 - DNA, 363 bp, Zea mays
  Clone ID: LIB3069-005-Q1-K1-C11
cgaccccgcgtccgttcagttcatggtgttgtatacagcattcttgaattcataaagttcataaaagcttcttgggccggtgaagagaagttgctgagattgctctgcagctggagattcccagtaccaagaccctctgtctggatgttacaacccagtggaacaccacctatctgatgctgctggctgctttggattataagcagactttcactacactagaaacatgtgatgataactacaatgaagctccatcagcagaggattggaagaaagttgaggctgcctgtaattacctgaaactgctatacgattctgcacatagtatcatggcggcagcaaacccaactggcaacatctttt

SEQ ID NO: 60792 - DNA, 343 bp, Zea mays
  Clone ID: LIB3069-005-Q1-K1-C12
gatccactcgtggcgccgcttgcctcttgcgccttgcctgctttcttgcctccctgctccctcctcctgcctggttctcatcgcttctctgattcttcctggcctttgccggagcaaggctaggcgcgaggagagggtgctgtgctcaaccagaggtcatctgcgctacgcgagcgcactgcctgttgtgctgcactgccggagtatcaggggaaaaccctgaaatcatggaaatcaccttattgcatgatgaatctgatgcatgaagcaccattttgctaccgccattgttgtcatatggtccaagaacaatggttccaatacaagtaccatcgtcatcaga

SEQ ID NO: 60793 - DNA, 244 bp, Zea mays
  Clone ID: LIB3069-005-Q1-K1-C2
actgcctcagacatgcttaaagcctaccactgttttcttgcagcaagcccatttaagagactttcgcattttctttccaatcaaacaatcttgagtttgactaaaaatgcatcaaaggtgcatatcattgacttcggcatttattttggattccaatggccatgcctaatcaggcgtctttccaagagggaaggtggtccacctgttctgcgcatcactggaatcgacgtacctcagccaggtt

SEQ ID NO: 60794 - DNA, 449 bp, Zea mays
  unsure at all n locations
  Clone ID: LIB3069-005-Q1-K1-C3
gctgccaatcgccgacctgctgttcgtttgccgcacatnngggggcgtacnaagtatggtggtcggatactatggaggacggaaggctagtcggaccgtgatgccgcttcgtggccagcgcgtggcgctgcatgggagtacangtngcagcagccgtccaatcgtccggcctcaccatggcccaacccgccccgacaagggcccgtcgtctcggctacaaggccaagcagggatatgttgtctaccgtgtccgtgtgaagcgtggtggcaggaagaggcctgtgcccaagggtattgtctatggcaagcccaagcaccagggtatcacccagctcaagttccagaggaacaagaagtctgtcgctgaggagagagctggacgtaagcttggtggactgagggttcttaactcctactgggtgaatgaagatagttcctacaagtacttt

SEQ ID NO: 60795 - DNA, 344 bp, Zea mays
  unsure at all n locations
  Clone ID: LIB3069-005-Q1-K1-C4
tttggctcttttaggaaatccacgtgccagtgattctcagtgccgtggcattgaattgagtgtaaatgtttttttgtacaaaaggatcaaagaaacagataagaggacagttatgaggaagtcacggtgttagatccctgagcatgaagttctcggtcgaagatccatgttgctgtagtaacgatgctgttccaacttcctttcctgataaaatgacaatgtagaaatagttctgaagtttatgttgatttgttgacaggtgggtcaattgtgatcctgtacgattgttatgaatccctcttgttttgttttgatgttatatntgctcttaatttaaagcttat

SEQ ID NO: 60796 - DNA, 437 bp, Zea mays
  Clone ID: LIB3069-005-Q1-K1-C5
atccactcgtccggcgggcgcggtgatgctcacggactttgttttctggttcatcatcttcccgttccgtgacggagaaggactacagcctcaacttcctgttgatcgggatgcattcggtgaacgcagtcttcctgctgggcgaggccgccctgaatagcttgaggttcccgtggttccgggtcgcctacttcttcctctggaccgcgctctacgtcgtcttccagtggatcgtccacgcagctacgccgatgtggtggtctttcccgttcctcgacctgacatcgaacctggcacctctgtggtacctggcggtggcggcgctgcagctgacgtgctacgtggtgttctggctgctgatcaaagtggaacaccacctgcttgccaggtgcttttcggtctcgtacgtacgctagctaggggctatggcacaagcc

SEQ ID NO: 60797 - DNA, 326 bp, Zea mays
  Clone ID: LIB3069-005-Q1-K1-C6
ggaacggagagctggaaaaggcatgtaagtcccggcttttgaccccaagtaccctgttgagggcaatggcggccacctccgaggaggcaatcaagcagttctcggcgctcatggagcagctagaggagccgctaaagagcacattccagaatgtgcatcaaggaaatctgagagggactttgatgcgttttctgaaggctagagaatggagtgtgcctaaagcttataaaatgctaatggattgcttaaactggagagtacagaatgagattgacatcgtgttagctaaacccattctgccatctgatatatatagaggtattcgg

SEQ ID NO: 60798 - DNA, 458 bp, Zea mays
  Clone ID: LIB3069-005-Q1-K1-C7
gacccactcgtccgcccacgcgtccgaagatatccatgcttattttcagacatgcaatatctgccaacaggccggaccggacaggaccagctatcccgggctgctcgcgcctctacctgttcccccgcatgcatggcattctatatcaatggacttcattgaagggttaccgaagtccggaacaatggattgcattctggtggtggtagatcgattctcaaaatatggtcatttcttggcgctggcccaccctttttctgcagcaaaggtagcaaaacttttcttggataatatctataagcttcatggtatgccggacaatatagtatctgatcgggatagagtgttcacaagtctgttctggcagcaattattcactctcagtggcacccaattatgcatgagttcggcttatcacccacaatccgatggccatacggagcgcgtaaactagtgca

SEQ ID NO: 60799 - DNA, 392 bp, Zea mays
  Clone ID: LIB3069-005-Q1-K1-C8
gtctgctgttttggtctcgctggtttaggtcacagcctcctacaaagccgctgctcggcgggcgagtgcgactccacctccggctcacatcctcagcagaggcattgggtggcagggaatcggcatcctccttgacgggctctttggaacggggactggctccactgtctcagtggagaacgtcgggttgcttgggtcgacaaggatcgggagccgacgggtcatacagatctcagctggcttcatgaagcttgttctccatgctggggaaatttggagccttgttcgcttccatcccgttcaccatctttgcggccgtgtcctgcgtcctgttcgggctaagtgctgcggtggggctgtccttcctacagttaactaacatgacctccatg

SEQ ID NO: 60800 - DNA, 369 bp, Zea mays
  Clone ID: LIB3069-005-Q1-K1-C9
agccgaacgtaaagcatcagtgctgtcgtttcaattcctgaggtcgagcaaatctggtggggtgaagaaggtgaaagtgacccagcaacccagcaaccaagggaagcagaggaaaactgatgaaactggagcaactgctggcaaagctaagcgacccgctgtggctgcaagaaaagcaaagcagctggccaagaaacgcaaggtggatgcatcaacccctgagaatacacacaggagcaagaaaccaaagaagtaagttgtccattgcgctggtcatttgcccttgcttcgcattgtaacaggagtttcactaaatcaaattctggacgatcttgtcagatgattggtgtactaggtagaggcaatgtg

SEQ ID NO: 60801 - DNA, 368 bp, Zea mays
  Clone ID: LIB3069-005-Q1-K1-D10
cccgcccttccgcgtggtgtgctctctgtttccctttacgccgtttcctctcccgactcggtcctcgccggcgacgccgcggagtaggtgcaacagaaactgctcgaggcggaggcggagcctgcggctgcacagacatgggtgatcacgaggcgcgcggtgatgacttcgagaagaaggcggagaagaagctctcgggctggggcctcttcggctccaagtacgaggacgccgccgacctcttcgacaaggctgcgaactccttcaagctcgccaagaactggagcagagctgcatcagtttacatcaagattgctaactgtcatttgaagggagatagcaagcatgaggcttgcctagcgtacgtc

SEQ ID NO: 60802 - DNA, 445 bp, Zea mays
  Clone ID: LIB3069-005-Q1-K1-B7
cgctgttggccggtagccgctccttctcttccggcaccgagagggacttgtgacccaagggtctgttcccgggggatgtggtgtttgcgctcgtcgatgatctcaggctcaaccactccaaggacccataggccatggggttatgcaatccaaagaaggaaattcctgcttgagccaattacagaaggccctgatatttgtcaaattgatggttgtagtgttaaattggaatacaagaggaggcaagtcaaatatggtttgtgtgacagcacgttactaacttactctactatatctgcatgagaaaggatgaaccctgtttgcatgtatactaattaatctacggattcattaatgggtgaataagattttatttaattatgacagcaaacgtgacatgccattacaatattcgttatgccaaaaaagtagttgcttatagtta

SEQ ID NO: 60803 - DNA, 156 bp, Zea mays
  Clone ID: LIB3069-005-Q1-K1-A12
ctagagaaacgtttcaaagattggttgacttctcaatggctggtataactatacatcacagtgaatttctgaaatcgatctggccttctctatctgatgtcattactctagttagggttgcaccacgctgaagtatgattgtgctaataacttcac

SEQ ID NO: 60804 - DNA, 411 bp, Zea mays
  Clone ID: LIB3069-005-Q1-K1-A2
cccagcgcgtccgggagatcctgcggctggttacttcaacctgagcggcgagattccccaggagctgtgcgggctggagaacctcctggccgtgaacatctcgcacaaccgcctcgtcgggcggcttccggcgtcgggcgtgttccagagcctggacgcgagcgcgctggagggcaacctgggcatctgcagcccgctggtggcggagcggtgcatgatgaacgtgcccaagccgctggtgctggaccacatcgagtacacgcacggcggcggcggcgacaacaacaacatggagacgaacggcggtggcgtgggcgcgccgaggaagcggcggttcctgagcgtgtccggcatggtggccatctgcgcggcggtcgcgatccgtcttggcgtcaatcgtgatcacgctgc

SEQ ID NO: 60805 - DNA, 397 bp, Zea mays
  Clone ID: LIB3069-005-Q1-K1-A4
cccagcgcgtccgcttgtaacatcccttaaatctgtttctgaggcaactcaagaggcaccagtaggttcactatatcttctaaggcaaccttggtcagctggcccagctgaagtatttaaagcacaatcagccgctgcaatcgaggctattcctctacttcagtacttgatacagtctggcccaccgcgggttcaagaaaaggcagaattgcttcttcagtgcttgcctgggactcttactgttacgataaaacgttgcaacaatctaaagcaatcagttggaaaccctagtgccttctgcaagcttactcctggaaacaattcgccaaggctgacaaagattgtctcgactggtgcaacacctgaatgggatgaagcctttgcatgggcatttgac

SEQ ID NO: 60806 - DNA, 381 bp, Zea mays
  Clone ID: LIB3069-005-Q1-K1-A5
gcgtgggttttttacccttttccttttgctcgtggtttccattcatatggactgggcagacgcgacttctgttcaaccaggcgttcagcagaggtttggagatatctctgatccttgctggcaacaatccaaatgctgggatctgatggtggcagttccggccttgcttcattaatctgtggacctttcgtacttgaattaatcctcacttctcaagttaacagtagcgatgtacatatctgatatgatggatgtgcaccggagttgtttgccgtgtgtataaatatcaacggctattattctagagtttactggcttgtcccttgatttttttaacgggatgaacttttgtatgggccctttctttgacattgacatatg

SEQ ID NO: 60807 - DNA, 461 bp, Zea mays
  Clone ID: LIB3069-005-Q1-K1-A6
acccactcgtccggccacgcgtccgaccaaatcagctcttgtgtggttagtttacaggaatgttcttgtgtggggctcatgttgagttttccattttatttatgtagccaaagtagatgtattatgcatgtcgtcgtttggaaacttgacaaaccgattatacttgtttaggttgcttcagaaaagatgcttgagaaactgaaacataaatctggaagatgtgagcctgctttagaaaaggctattgtggaactggagcatggtataaacggtttgaagtattttgtttgccttgatccacggttgtaggtttgttctgccactgataccaggtgaagcttcacccttcagatccctgtcgtgacgaatggttcgtgggtgctggggagggattggatccgttggattcatgagatgtgtggattgttcctgccagatatcgtgacatgtgtttagatcta

SEQ ID NO: 60808 - DNA, 304 bp, Zea mays
  Clone ID: LIB3069-005-Q1-K1-B10
cccgcgcgtccgccgcgctagctgaggactttacagcggcacagaggtgcgacgtgacgaggacgactacgcaggcgccacacatggcatcccagctctccgccgccgtgccccggttccacggcctccggggctacgccgcgcccaggtccgcggtggcggcgctgccgtccgtgagggtgggcaggaagaggtcgtcgtcgcagggcatccgctgcgactacatcggctccgccaccaacctgatcatggtgacgacgacgacgctgatgctgttcgcggggcggttcgggctggcgccgtc

SEQ ID NO: 60809 - DNA, 349 bp, Zea mays
  unsure at all n locations
  Clone ID: LIB3069-005-Q1-K1-B11
cccaggcgttcgcggactcgtgggcgcgtttgncttttacccctccccgaccagatcgcggcgaggacgccttcgatccgacccaggccgacgccgacgacccctctcgccgccggcggccatggcgtacggcgaccgcgtcaccaccttcgaggactccgagaaggagagcgagtacggctatgtccgcaaggtctctggacctgtggttgtggctgatggaatgggtggtgctgccatgtatgaacttgttcgtgtcggacatgataacctcattggggaaattatccgtcttgagggcgattcaacttcaatccaagtttatgaagaaaccgctggactgatggtt

SEQ ID NO: 60810 - DNA, 382 bp, Zea mays
  Clone ID: LIB3069-005-Q1-K1-B12
gtgggatgttcttctctttgagggtaacctattgatgctgatccggacagctctggcagggatggagttgaatggtcctgcacttgtgacaacaaaagatgctggggatgcagtaacccttttgcagtctttagctggttccacttttgacagtagccagcttgttttaacagcttgcatgggatatcaagctgtaggtgaagcaagactgcaagaattgagaaataaacaccgaccatctgctatctcctcaatggaacagagagcaaaaggtcttcgtgtctggagggatacgaacaggcttgcatctaggctatataattttaagcgtgacactgaaccattggtgtcgttatcagaagaacagtcaaatgacttgaca

SEQ ID NO: 60811 - DNA, 215 bp, Zea mays
  Clone ID: LIB3069-005-Q1-K1-B2
agaacgcatatgaacactcatgcgaacgattcgatttacgaatggtccctagataccatgaggaggtggaatctcagcatagagcagcacgcatatgatagggccaacaagatctaggagggcaacagggacgatagggatgcaaagcgatcgggataagacggcaaggtcagaagctcgcagatgagaccatgatcaagcatgtcgagacgagt

SEQ ID NO: 60812 - DNA, 389 bp, Zea mays
  Clone ID: LIB3069-005-Q1-K1-B3
cgacccactcgtccgcccacgcgttcgcccacgcgtccgagccgttcatttcgacgagccattactccccgtttgcgcaagttccaccacgcaggcagtcaggcacccgcattgtttcaaaattctcgaatcggcccctggttctggcagggcagccgccgccggcggacggagggccctctttgcgggtgaggcaaggcgaggcctgctttgcctcgctgtaagctcgccggaggaggggaccgttgaggggaaaggacgcgcgtaatttgtggagtggatgtgccaatgctgaaggaggcgcgccgccgtccatggacgccgcgcggtgggtcgcgtgcctgctcgtgacggtcatctgcttggcctgcgccgtcgacgtcgctacc

SEQ ID NO: 60813 - DNA, 286 bp, Zea mays
  Clone ID: LIB3069-005-Q1-K1-B4
cccaggcgtccgcggacgcgtgggtccggtgcgttaggcatctcctctcccgccccgccgcgagcaacgcccgctaggctgctgctacccgcagtccccatccaccctacccgcagtccccaccgcaaccgccgcctcggcccgggctgtgttgacccccgttgacctccgccagcccggccgtcatggacctgcgcttcccgccgacggcgccgtcgtcctgcttcggcggaggcggagtgctcccggcaacgtggcaccaccgccgagcgcaatcggagacgtt

SEQ ID NO: 60814 - DNA, 314 bp, Zea mays
  unsure at all n locations
  Clone ID: LIB3069-005-Q1-K1-B5
gcgagaccgaaagagaggcagagcttggctatggagctcccgtggggaatgctgctgccggtgctgctggtcctctccgtctcgtcctcgtcatcgtcgtcggctgctgccacgctcgccgtcagcgctccgcccccactgcctgttcctcctcctcgtcatgctcaagacgccgaaggcatgctcatcaacggcaacttcgagacggcgccgcggaagctgaacaagaccctgatcgtggggcgccactcgctcccggtgtggacggtgcatggccacgtggagtacgtctcgggcggtccncagccccgggg

SEQ ID NO: 60815 - DNA, 379 bp, Zea mays
  Clone ID: LIB3069-005-Q1-K1-B6
actcattaaacctacatctggtactgcttatgtccacggaatggatataaatatggacatgggtgacatatatacaaatatgggagtgtgcccacaacagaacttgctttgggaaacactgactggaaaagaacatcttttcttttatggtaggttgaagaatcttaaaggttctgcattaatgaaggctgttgaccactctctgaagagtgtaaatctatctcatggtaatgttggtgataagcaagtgaagaaatacagcggaggcatgaaaagaaagctcagcgtggcaatctcattgattggggaccctaaaagtgtcttcatggatgagccaagcacaggaatggacccagcatcaagaaataacctatggaat

SEQ ID NO: 60816 - DNA, 445 bp, Zea mays
  Clone ID: LIB3069-005-Q1-K1-A10
gcaggtgctgtgagatacagtttgtcaggtgagccttttcaattgcaccagatgccccggaaatgttgtagcttgactatcccagtcaccagcgacgccttctaccacttctagcaaaagtatgtctgatgagcagtgctggcaattttatgaaaaatatgtatgtaaagagaactcctgaaatgagcaaagacatacacatttactctagtgctctgaaggcgacactaacttggcagaatatgattacgattcaggagtgtcgcgaggcctgtggaggtcaaggtctaaagactgagaaccgcataggaattttcaaatctgaatttgatgttcagtccacatttgagggtgataacaatgtgctaatgcagcatgtcagcaaagcgctttatgctgaatttttgcgtgcacaaaagaagcagcatccattcaagggattggg

SEQ ID NO: 60817 - DNA, 428 bp, Zea mays
  Clone ID: LIB3069-002-Q1-K1-G10
gaggaaaagggccgtggtcgttgatgatgatgatgatgatgaaacggaggatcaggacagggtcgtgaatggtggtgggtcgctcagcttgataatagggggtagtgctgctggtgctggagcgatggagaacggcgatgtaaatgaggatgagagaaatggaaagaagatcagggtgcaaggaggcggctcaagtgggccggcatgccaagttgagggctgcggagcagatctgactgcagcaaaggattatcaccgtcgggcacaggtctgcgagatgcatgctaaggccaacaccgccggggtcggaaacactgtccagaggttctgcccacaatgcagtagatttcaccttcttcaagaatttgatgaagggaagcgaagttgccggcgacgcttagcaggccacaataaacggaggaggaaaa

SEQ ID NO: 60818 - DNA, 437 bp, Zea mays
  unsure at all n locations
  Clone ID: LIB3069-002-Q1-K1-G11
cagccagtcagccacatcactagctatctgtgcagaggcaatggcgtccaaggttgagctggtggtggaggtcaagtccccggctgacaagctgtgggcggcgctgcgtgactcgacggagctgttccccaagatcttccccgagcagtacaagagcatcgagaccgtcgagggcgacggcaagtcggccggcaccgtccgcctcctcaagtacaccgaggcggtgccgatgctgacgttcgccaaggagaagcttgagacggcggacgacgagaacaaggtggtgtcgtacagcgtggtggacggcgagctggcggacttctacaagaacttcaagatcacgctgaaggtgactccggccaaggcgganggcgagggcggcgccgtcgtcagctgggccatggagttcgacagggtcaacgaccaggtgcctgacc

SEQ ID NO: 60819 - DNA, 114 bp, Zea mays
  Clone ID: LIB3069-002-Q1-K1-G12
cccacgcgtccgcacgagttcagaaccgactcgtgcttgtatccagacctgttttaaggctgtctgaactctaccgttgcccgttggtgtcattttagcgccctttttttggtc

SEQ ID NO: 60820 - DNA, 51 bp, Zea mays
  Clone ID: LIB3069-002-Q1-K1-G3
ccagcgttcgccacgctcggaaaagggaacaaaaagaaacacttcttctgg

SEQ ID NO: 60821 - DNA, 427 bp, Zea mays
  Clone ID: LIB3069-002-Q1-K1-G5
acggtcatgaccttggggcaaagggtgccatttgaatttcatggaacaaactatgtattcaatgtcaatcaagctttgctagagggtcaggagagttctacaccattggatagaggattcttgtcaagtgatacatacatcatatttgaggctgctcctaattcaggaattaaggtgatcaaccaaaaggaagctgctagcagcaaacttttcaaacataaagagtttaacctggaaaaattggggataggtgggttaagtgctgaattcactgacatatttcgtagggcattcgcttcaagagtctttcctcctcaagttgtcagtaaattgggcatcaaacatgtaaaaggtatactgctatatggacctcctggtactggcaagactcttatggcacgacaaatgggaaaattattgaacggaa

SEQ ID NO: 60822 - DNA, 357 bp, Zea mays
  Clone ID: LIB3069-002-Q1-K1-G6
catttgtgataatagatgagtgggttgtgactaacatatgtcggtgattcacattgcatacgagaatctacttaggatcaaaggtactttttatcagctgatcatcgctttgactccaactcaaataacgcgtgacgccatgtgggagcaaagttgggaaaatggatattggtggtggtccataggtactgaagcaattgaaggacaaagcactaaagagagcgtggctgactgaagaaacattgcaagagcagattgagcagagaaactgtgcaaggaagaataaacagtttgagatatctgatggaatcaggaaaaaccttgctaccaagggcatcggcctgatggatgaaccct

SEQ ID NO: 60823 - DNA, 410 bp, Zea mays
  unsure at all n locations
  Clone ID: LIB3069-002-Q1-K1-G7
acggttctagctagctagcaaagggggggaaaatggctccgcttctcgctgctgccatgaaccacgctgcagcccatcctggccttaggagccacctagtaggacccaacaatgagagtttctcacggcaccacctgccgtcttcttctccacagagcagcaagcgaaggtgtaaccttagctntactacacgatctgcaagagtaggcagccaaaatggagtccaaatgttgagcccctcggaaatcccacaaagggactgggtcccctctgacttcaccttcagtgccgacacttcagcggaccaaattgaaggtgcttggaatgaagatggaaagggggaaagcaactgggatcacttctggcacaatcattcggaaaggatactggacgggagcaattcaaacatt

SEQ ID NO: 60824 - DNA, 296 bp, Zea mays
  Clone ID: LIB3069-002-Q1-K1-G8
cccgcacaccgcaccagctcagctcagctcagctcaccaagacaatcaatcatggctcgtgcgcgcagtgtcgctgccgctgcccccctcctcctgctgctgctcgccgccgccgcagcggggctcgtgtccgccgcgtcgccggcagccagcgacttcgtccgcaagtcgtgccgcacgacgcagtacccgtcggtgtgcgagcagagcctggcgtcgtacggcgggtcgccgtcggcgcggagcccgcgggaactggcgcgcgccgcgctggcggtgagcgcggaccgcgcgcg

SEQ ID NO: 60825 - DNA, 369 bp, Zea mays
  Clone ID: LIB3069-002-Q1-K1-G9
gaggcctacgacccacgcgtacgcgtgacgcagggaaccactgcaggatatttcactaatgaagttcaaggattgatgggggatcgaaatccaaagctcgcattaaggcaaagataacacatgacagtgttgtgatgcagacaaaatgaaaacattctatgaaggacattcgtagtcttgctgataacagtaaggagttccttgcataagaagaaagccagataccaatacatgaagtgatttgctacaggtattatcataatgttaccaatgttaaagtgaaacacaaaccgaacgaatattaagaatggatagaagatgtgtacgatgaggaattagaaaagatgatggacacatttgaagatgata

SEQ ID NO: 60826 - DNA, 253 bp, Zea mays
  Clone ID: LIB3069-002-Q1-K1-H1
tcgcacaaacagcaaacaatgacttgtgtttctggggtgaccagaatgctatgtacgggaatccaagtgaccaacaacagggtttcaactttggacaaaacccatcaagttggttgaaccagccattttcccaggttgaacagccacgagtggtcaggcctcatgcaacggttgctccatttgatctggagaagactagagaaggaagtggcttcaagatttttgggttccaagttgatacaaccagtccatc

SEQ ID NO: 60827 - DNA, 387 bp, Zea mays
  unsure at all n locations
  Clone ID: LIB3069-002-Q1-K1-H10
aaatttcatctcctggagggttgctttgcttgctcctggaatcttcagaaccgaaggccaccgcgccaaccgcccaattaccgaaccaaaccctaccggtcgcggctcctccatagtccatactctcgcgcgcctaaaccctagccatcctcctcgccgccggcgaccgccgccatgagccgctacgacggccgcgctgcggacgcgggctcctaccgcgaccgncgcagcgagggggcgttcggaggcgggtcgagggcgttctcggcgcccgaacaaggcggacgctcccggggcggcctcggagctagatgggctgccgagcttcgagaagaacttctacgtggagtcacccgcggtggccggcatgacggaagaagaggtgga

SEQ ID NO: 60828 - DNA, 439 bp, Zea mays
  unsure at all n locations
  Clone ID: LIB3069-002-Q1-K1-H11
cgaataatctcttcttcacctcactaacaccagctagcaactctttctctcctgcaataatggccgctcgctcctcctcctcccagccgcagctggtcgcggcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaggccacctgcaactgcctcaagagcatgacgggcccggctcgccggcggcgtcagcatggccaacgccgncaacatccccggcaagtgcggcgtctccgtcggcgtgcccatcagccccaccgtcgactgcacca

SEQ ID NO: 60829 - DNA, 400 bp, Zea mays
  Clone ID: LIB3069-002-Q1-K1-H12
gaaacttctttccagttgcttggaagttttggagaattggaggatttgcttgcacctttcagtcaagacatccaggaaaatatatgtagaaagaaatttacactaccagaaacttctttccagttggcacccccgaatcccctgcgtacagcacctcatccaaccatcccgttctgtaggttcaaagaagtaaaaaacggacgtcattcgtcagttgtggaaatgaagcactacgacttgtgcacaatgaatttgaatgaagtgttgtcgagagtagaagagatgtcacaagaagaagcatctgtttgcggtcttatggatatggatgagcctagtcctcccagttgtgatgattcagttgaggttgatgacgacagttgctatgaaggtttaactgatg

SEQ ID NO: 60830 - DNA, 360 bp, Zea mays
  Clone ID: LIB3069-002-Q1-K1-H2
ccaaatcgccccctctcccaaaccctcttcatccccctcccgtgctcgacccagatcgagggctcgatccgtcggccatggcgctggagtgggtggtgctgggctacgcggcgggcgcggaggcgatcatgctgctgctgctgacgctgccggggctcgacggcctgcgccggggcatgatctccgtggtgcggagcgcgctgaagcccatgatgtcggtggtgcccttctgcctcttcctgctcatggacatctactggaagtacgagacgcgccccacctgcgacgacgagcacgcctggaccccctgcgagcacctgcggcaccagaagtccatcatgaagtcgcagcggaacgcgc

SEQ ID NO: 60831 - DNA, 435 bp, Zea mays
  Clone ID: LIB3069-002-Q1-K1-H3
cccacgcgtccggcccccggccgatatccacaagatagagcatactctttggtggtattgatgatgaaggtttgggctgcatacgagaccaaaccggtgcgaaggttgtcggtactttatcgaagagtatcggcttcccgaagcttgaagcggatatcagccgctaccgtcgacaacatattgtcagcagtttattctattctaatttcaaggtaaacattttgagtctaactcttatttcctttggtacgaaaatattttctaacgaaggctatttgtccacagaacatgcttttgagcaaggcattaaaaatgcaacaagatttagaggataaaaggcaagaagttataattgaaaatttagaaaacaaaatataggagcaaactgctgctattgagaagaaagacctcgagctacaaacaggcaaagggtta

SEQ ID NO: 60832 - DNA, 355 bp, Zea mays
  Clone ID: LIB3069-002-Q1-K1-H5
acgaccgaagtccggaacaatggattgcattctggtggtggtagatcgattctcaaaatatgggcatttcttggcgctggcccaccctttttctgcagcaaaggtagcaaaacttttcttggataatatctataagcttcatggtatgccggacaatatagtatctgatcgggatagagtgttcacaagtctgttctggcagcaattattcactctcagtggcacccaattatgcatgagttcggcttatcacccacaatccgatggccagacggagcgcgtaaactagtgcattgaaacttatttgcgatgctctgtgcacgcctgtcccagcaaatggtaccaatggttagct

SEQ ID NO: 60833 - DNA, 366 bp, Zea mays
  Clone ID: LIB3069-002-Q1-K1-H6
cttaagatccttcaaaaggtgaaagcaacatatgaccttccgatagtcactgatgtgcacgaaagccaccagtgtgaagctgttggaagagttgctgacatcatacagattccagccttcctctgtcgccagactgatcttctagtggctgctgctaagactggaaaaattatcaatatcaagaaaggacaattctgtgcgccttctgttatggtgaactctacagagaaagtaaggcttgctgggaatccaaatgtgatggtctgtgagcgtggtaccatgtttggctacaatgatctatttgttgacccaaggaaccttgagtggctgagggaaagcaactgcccagttgtagctgatgtaaca

SEQ ID NO: 60834 - DNA, 346 bp, Zea mays
  Clone ID: LIB3069-002-Q1-K1-G1
atttattcctctgcgtgcatgaggtgtccagcgcccgatagggcgcttccttttctagtaggtttggaattttttttaggcagaggaggccctggattgtaaccaggactcgaggggccaggaacgaatcccatgcgggcgatgagaagacgtgcggcggcagcgcaagcgagaagacaaggtgtcgatgagcagggatcgtgacgacgacatccttcccgccgtcggcaacctccactacgctgtcaagcttctatccagttggtctctctctcttttgttagctagggtacttgagttgagccatttagtggtcctagtgttcatggtagtggactagaggcgt

SEQ ID NO: 60835 - DNA, 419 bp, Zea mays
  Clone ID: LIB3069-002-Q1-K1-E12
cgggttcgtgaggttctccggggttcggtttcgtgggtgagcggatcgagatggcggggtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgaaggcatgaacggcaaggagctggacggccgcaacatcaccgtcaacgaggcccagtcccgcggcggccgtggaagcggcggcggcggcgggtacggtggtggccgtggaggcggcggctacggcggttggcggcgccgtgatggcgggcgcggctacggcggtggcggc

SEQ ID NO: 60836 - DNA, 384 bp, Zea mays
  Clone ID: LIB3069-002-Q1-K1-E2
agcaccttcccaaaaaaatcccccattttcttcgaggcgaggagagcgtgaaagacagggcaccggcagcgacgatgtcggggcgcggcaagggcggcaaaggtctgggcaagggcggagcatatcgccaccgtaaggtgctccgtgacaacatccagggcatcaccaagcccgcgatccgtaggctggctcggaggggcggcgtgaagcgcatttcggggcttatctacgaggagacccgcggcgttctcaagatcttactcgagaacgtcatccgtgacgccgtcacttacaccgagcacgcacgccgcaagactgttaccgtcatggacgtcgtctacgcgctcaagcgccagggccgaaccctttacggcttcggaggct

SEQ ID NO: 60837 - DNA, 198 bp, Zea mays
  Clone ID: LIB3069-002-Q1-K1-E3
tgcacgcctgcgaacataggttcactgtttgcgatccactcgggaatgatatagatcgaggtactcatatgcctattataaccgatgcgtacccatgcatgaattgaagctatcatgtgagcgaaagcacactgagggctaggttggaacaatcacagcttgtgaataataatttgctaagaaatcgaaatgaataac

SEQ ID NO: 60838 - DNA, 271 bp, Zea mays
  Clone ID: LIB3069-002-Q1-K1-E4
tgaacgacggcgtgaagaggttcaccgtcaacgcggtgttagggatcgatattgacctgaagacgctggaagcgtttgcggacgacaagttcgatagcacgggctgtcagatctggggaaggaaacgactttcagggactgtttggttgagatcaggcagctcacgaatctcctgctcagcagccagcctgagaacttcatgaacccggtgatcaggcagagaaactacgggtctctggactacaagaagctggccatcatttgtgaaaag

SEQ ID NO: 60839 - DNA, 421 bp, Zea mays
  Clone ID: LIB3069-002-Q1-K1-E5
aaacaaatatggtttcagtgatatccgtccatatttgattcgattacatccctaatccaactcgtcgggccacaaccgcggtggcggaggcagtgctctggtcatctagcggacgatgcgggatgtcggaggcggagcaccataccctatggtcactcgcaccatctacgacaaccgggttgtgatgatgaaggtcatgatggaggcgcgtggactgtgggaggcagttgacaccaggaacgtcgagcgcaacgaggattggtgggctatggaggcgatcctacgagcggttcctgcagagatgcatcagtccttgggggcgaaaacgacggcaaaggaggcctgtgacaacctgaagactatgcgaaccggctcagggctagtaaagcggtcaagatacaacaactgcggcaggagtacg

SEQ ID NO: 60840 - DNA, 171 bp, Zea mays
  unsure at all n locations
  Clone ID: LIB3069-002-Q1-K1-E6
gtgaacatgggtgtgggggagctacatgcaggtatcggtcgttgaagagagatctcctgagaggagtatctgcttcgcgttccagctgaaaaagcacgccggaagagaagagagtacaacggncggtcgatcagctaacgatggatcgatcattttttgcccatatttatt

SEQ ID NO: 60841 - DNA, 259 bp, Zea mays
  Clone ID: LIB3069-002-Q1-K1-E7
acgcccacgcgtacggccgcggaccaccgtggtagagagccccggctgcccgccgctccgcgcgctcaccaccgacatcctcggcctcgtcaaagtcgtcgaggcccacgcgaggccggcgggcgccggcaaggtcgtcgagacgtggggcgcgcctgacgcttgccgtgccatcgttgctggctagctagccgatcgtgccgccgaacccggcttggctggggcgaggaggaacagcgtggttgagctgctgaaaacc

SEQ ID NO: 60842 - DNA, 257 bp, Zea mays
  Clone ID: LIB3069-002-Q1-K1-E8
tcgcccacgcgtccggataaggtatcttttgaaagacgacgaggaagcaaggatccagctgggctcaaatggctttgccgaggcactggttgagttcttgaggaatgctgtgaatgatgggaatgagaaggcacaagaagttggtgcaatggctcttttcaatcttgcagtcaacaacaacagaaacaaggggctcctgttatctgctggagtcaccgatctacttgagcaaatgatatcgaatccacgggtatctg

SEQ ID NO: 60843 - DNA, 423 bp, Zea mays
  Clone ID: LIB3069-002-Q1-K1-E9
gcctcccgcgctctattctctctatctaccactactactacccagcagcagcaggccggcacacaatacacacactctaatctctccacacagccaacacagatacggacaggacaggaggatgaagctgggagcaaaaggcctcggcctcctgctcctccttgtcctgcttgcgctttgctccaccattgaagtcggcgaggcaagaagagaccggcattggaggtcgtcgaggacctcctcctctcagctgctgaagaaaggcaaaggaaagaagaccagctcccgccgccaatacggcagcaaccggccaagtccgaagccaccggccagctcgacaccgagctctggtgccggcggcaaaggaaaccagactccgtaccaaccaagcccgaatgcccctcacattccgaggccaagccc

SEQ ID NO: 60844 - DNA, 350 bp, Zea mays
  Clone ID: LIB3069-002-Q1-K1-F1
cccacgcgtccgtttcggttgggccagattgtcatactcagcgtcctgcctcggggtcaggcccaagtgtactgaaagccagctcttgcccgcatctacacggccccattttcagcttgcccctccagaaccggtgcatgaacagttgcatctgatcctaagtcgttgcttcctttcccttctttcttagatctagctagccaccgtgtcgactggcggatgatacagtatctccacatgctggttggtgagtgatgaccgtaccttgccagatctgcagcaaactatcctatgctagctcctcacatccgcacaaaacaacaccttttagcaaaaaaagtttttttttg

SEQ ID NO: 60845 - DNA, 158 bp, Zea mays
  Clone ID: LIB3069-002-Q1-K1-F10
aattactctcttttactggttcattcaataattcaatttgatgcttggaaaccactggataataaatacaaatgctatggtatgattttgtgaattctgatcgctcaaaaaaaaaacaaataaaaaaaataataataaaaaaaataaaaaaaaaagaa

SEQ ID NO: 60846 - DNA, 422 bp, Zea mays
  Clone ID: LIB3069-002-Q1-K1-F11
aataagagagcagttgcagaatccggtggtgtccaggtcctgctggatcttatcagttcaagcaatcctgacacttctgttcaggcagcaatgtttgtcaaacttctattcaataatcacactatccaggaatatgcgaccagtgaaacagtcagagttataactgcttctattgaaaaggatatatggtcttctggaagtgctaacgaagaatatctcaaagcacttaatgctttgcttagtaacttccctcgtttgagggtcactgaacctgccacattgtgcattcctcatcttgtaacatcccttaaaacctgttctgaggcaactcaagaagcagcgctagattcactatatcttctcaggcaagcttggtcagcttgcccagctgaagtatttaaagcacaatcagtggctgcatc

SEQ ID NO: 60847 - DNA, 354 bp, Zea mays
  Clone ID: LIB3069-002-Q1-K1-F12
acgcgacccactgacagcacattagcagacttagatggagagcatgtgcatcatggacatagaacagctacccagcttgctaatgatgctgatgcgaaatggatagacttacaattaagcactgcacatatctatttcaatcatccctaatgcactcaagcagttataaccaaaatggtttcaagtggcccgtaacctgggcgcaatcaagtgcggacccctaatgtgtattagcatctgacgcgggggctgtgccctaatacagatggaagatgaacctaccagtcacttacagaatagctcataacgtggcattctaaaatggagtatcatttgtgattagttagacgtgaa

SEQ ID NO: 60848 - DNA, 358 bp, Zea mays
  Clone ID: LIB3069-002-Q1-K1-F2
cccacgcgtccgggcaaacgctgctctgttcccgggtgcaccaagagtgcccgcggtcgctctgattgctgtgtgaagcacggtggtggcaagcgttgcaggttcgatgggtgtgacaagagcgcacaggggagcactgacttctgcaaggctcatggagggggcaagcgatgcgcttggagcaccggctgcgacaagttcgctaggggaaggagtggcctatgcgcagcgcatacgaccctgatggcttccaaggtagtgcaccatcctggacatgcacgaagcatggtcgggccttgccactttagcggcggcgtctctggttcgtcagcagctgatagcaacatggatcatgcca

SEQ ID NO: 60849 - DNA, 431 bp, Zea mays
  Clone ID: LIB3069-002-Q1-K1-F3
cccacgcgtccgggagcattcgagaagcttcacatggggggcgaccacaagaaggaggatgagcaccacaagaaggccgaggagcaccacaagaaggaggagggggagcaccacaagaaggacggcggagagcataaggaaggcatcgtggagaagatcaaggacaagatcaccggcgagcacggcgacaagtccggcgaccacaaggaaaagaaggacaagaaaaagaagaaggagaagaagaagcacggcgagggccacgaccacgaccacgacggcggccacagtagcagcagcaacgacagcgactgagatctggtgttgcagcacaggtgcaacacaagtatgcttgctggatggaagattcataccagctgatggctgatgaagtgtttcactggtggcatgcatgcatgtatcgtgctattata

SEQ ID NO: 60850 - DNA, 203 bp, Zea mays
  Clone ID: LIB3069-002-Q1-K1-F4
cccacgcgtgcgggagcattcgagaagcttcacatggggggcgaccacacgaaggatgaggaccaccacaagagggacgacgatcaccacaagaaggatgatggctagcaccacaagaaggacgggcgtgagcataaagaaagcatggaggataagatcagggacacgatcaccgtcgagcaccacaacatggccggcgacca

SEQ ID NO: 60851 - DNA, 354 bp, Zea mays
  Clone ID: LIB3069-002-Q1-K1-F5
acgaccacggaccggcctgctcagatccgccaggcagaggcggcgcttggcggcacggagcaggacctcggagagcagcacggatgactcccaatccccgaaacaagagaaggcgccgttcgggtacacgaggaaagacgtgctgctgatcggcctcggcgtcaccgccttcggcgtcggcctcaagtacgggctcgagctcctgggagttgaccccttgcaggccggcaacgtcgtgcagctgctggtggtgctcgggatgacggtggagtggatctacacctacatgttccgggtgagcaacaaggacatgacctactcgcaccagctcagggactacgagaagcaagtcat

SEQ ID NO: 60852 - DNA, 286 bp, Zea mays
  Clone ID: LIB3069-002-Q1-K1-E11
ggctgccgtcaagaagatgtatgacatccaggcaaagaaggtcaacaccttgatcaggcctgatgggaagaagaaggcttacgtgaagctgactcccgactatgatgctcttgatgtggccaacaaaatcggcatcatctaagtgctgcattaggcatcctagttcatctgttgtgtcctagttctatgtgaaaccagagttttgtagctatggctctcaatcgttccattaccatgtgttatgcacacttctgaatttgatatcatccaagtgaccttttgaact

SEQ ID NO: 60853 - DNA, 356 bp, Zea mays
  Clone ID: LIB3069-002-Q1-K1-F7
cgaaaccgaaagagaggcagagcttggcaatggagctcccgtggggaatgctgctgccggtgctgctggtcctctccgtctcgtcctcgtcatcgtcgtcggctgctgccacgctcgccgtcagcgctccgcccccactgcctgttcctcctcctcgtcatgctcaagacgccgaaggcatgctcatcaacggcaacttcgagacggcgccgcggaagctgaacaagaccctgatcgtggggcgccactcgctgccggtggggacggtgcaaggccacgtggagtacgtctcgggcggtccccagcccgggggcatgttcttcgcggagccgcacggcgtgcacgcgctgcgcctc

SEQ ID NO: 60854 - DNA, 371 bp, Zea mays
  Clone ID: LIB3069-002-Q1-K1-F9
cggacgcgtgggcggacgcgtgggtgttgagggaaggaaacctcgaggaggcagcaatggtggatgtttggatcgaggtggaggctaaccagtacaccgctgcactgaatcccatcctcttccaggtcctcatcagtcctatgcttgggggaaccaccgaccagaaagttgcggatgagaaccttgagaagctgaagaaggtgctagaggtgtacgaggcacgcctgaccaagtgcaagtaccttgctggagacttcctcagcctcgccgacctgaaccatgtgtctgtcactctctgcctgttcgctacgccctacgcatctgtgctcgacgcctacccgcatgtgaaggcctaggtggtctggtctgat

SEQ ID NO: 60855 - DNA, 248 bp, Zea mays
  Clone ID: LIB3069-002-Q1-K1-C5
cggacgcgtgggcggacgcgtgggtgcttagctcggtggtctaatgccgttcgggtattactatcgacaactgctaaaacagagtggtcctatcctgtataaggagcactctggtgtaaatattggatttagaccgatggctgatgaacctacaagcttcttatatgcctcatatacatatttcttgatacacacaagtgcgtctaaatgtcacataaccttgcacccttactaggtcttaccgcttt

SEQ ID NO: 60856 - DNA, 358 bp, Zea mays
  Clone ID: LIB3069-002-Q1-K1-C6
acgcccacgcgtgcgaatttaatgagacagcagcttggatttatgcaaaaagcatggaggggagaccttacgggtatcacaatatgatatttagctggattgacaccatcagtcataattatccaccaccattagatgctcatgtggttgcttctgttatgactgtatggagcaagcttcaaccagagtatgctgctaatatgtggaaagaagcccttaacaaacggcttggaactaagggtcttgacctttctgaaatcatagtggaatcagagaaacgtgggataacatttgacaagtgtctaactgttcctgagaacgatagctgggtctatgaagatggtcagtcagcatcttg

SEQ ID NO: 60857 - DNA, 452 bp, Zea mays
  Clone ID: LIB3069-002-Q1-K1-C7
ctcggatgaatgaacatgaggagaattcacctaaccctcttctagacaccattaatttcgaaataaagaagtcagtatttcatttggtaaatatatattggcaaagtgtagtatttcaatagacaatttacagatgtagccccatcacatgccagtggtggagggtcgaattgatgaatctgttaacttgtataaacttagttaaaaataagttaagtatataagtaaaaaaagtttattgtagagtaaaattgttaatctgaatgtttatgccactttgatttgattttaacgtaggggaatcttctgattttgcggggagtaaaccactaaaggtttcattgtttgattttccattatatgtggcatagaaatatcttctctttgatgaaacaaccaagggagttctattttttttgacatcagacgaaaatgccttttcacctttcctg

SEQ ID NO: 60858 - DNA, 402 bp, Zea mays
  Clone ID: LIB3069-002-Q1-K1-C8
cttctatctgttatctaggctcctgagggagttagatttgcaggaaaatgatgtggaggaccgtgggcccagatggctttccttccctgattcctgcacttcgctggtctccttgaatttcgcttgcatcaaaggggaggtgaattctggtgcgttggagagacttgttgctaggtctccaaatctacgcagtttgaggttgaatcgttctgtttcagtatacacactctcaaagatactattgcgagccccaaatttggaagacttggggacaggtaatctgacagatgagttccaagctgagtcctattccaagcttactagtgctctggagaaatgcaaaaagctgagaagtctgtctggattttgggatgcttcttctatttgggttccggatatcta

SEQ ID NO: 60859 - DNA, 404 bp, Zea mays
  Clone ID: LIB3069-002-Q1-K1-C9
caccaacagcctcggggctcaactggcacgggatttgtggagagctgcgtatgacagcaccatgttgatcctgaaattacctaccttcaaaactacgaaagtcacttcaccgtacctttcaatttcaagcgccggagaagagagtactgagaggcgacaagaagatcactagacaccactgttcggtctaggctatcttgagaaaggcttcttggtgggctaaatgaccaaagactatatgcaggactgagtggtcattcgaacatcaactgagctatccagtagccaggttgtaagtgtgttgtaatgcttcaatgcgtatcattctccaaagacctgagcttcgcttgtgatttgttccgaactgtacggtgtcgattttgtgtatataatataatataacg

SEQ ID NO: 60860 - DNA, 170 bp, Zea mays
  Clone ID: LIB3069-002-Q1-K1-D1
atgaacatgacgagaagtcacctaaccctattctagacacaaattaaagtgggagtgaagtaagtgagtgggtcatttagtaactgtatattggcaaaatgaagtaaaacaatagacaaagtacagatgtagccccatcacgtgccattggtagagggtcgaattgatga

SEQ ID NO: 60861 - DNA, 382 bp, Zea mays
  Clone ID: LIB3069-002-Q1-K1-D10
ctagttctagaggcgatgcatgcgcggcggcggctgcacggcgtgctgtgcgacatggtgcgggagcgtcgtggccaggcccaggcgggcaccaccggcctgctgggctgcctgatgcggtcccggggcgacgacggcgcgccgctgctgagcgacgagcagatcgccgacaacgtcatcggcgtgctgttcgcggcgcaggacacgacggccagcgcgctcacctggatcgtcaagtaccttcacgaccaccccaagctcctcgaggccgtccgggcggagcaggcggcggtccgcgaggccaccggccgcgggaggccaccgctggcgtgtgcgcacaccaagaacatggcgcttacgcatagggtgattttggagagct

SEQ ID NO: 60862 - DNA, 441 bp, Zea mays
  Clone ID: LIB3069-002-Q1-K1-D11
caaaactgtattctgcttgcagcaagattcagatcttgaatattttggagtcgacatgcgtgccattcaagattattctctacaattcaaagatattgtgcactgccgtgcggaaattagggattttgatgcttttgatttgcgattgaggcttcctgctgtggttagcaaattgcacaaacttatcaactgtaatggtggtgtaacatatatacattgtactgctggacttggaagagctcctgctgttgcagtgattcattgcagttgataccgcctttgtggaatgttcaacaatcagcacttctgtttgtttgaagataagataatatacctattatctgtgcacccgaaaaccaacatctaatgattgcctgcttgtgggaattttgatggtcccccgcatctgttctctatagtccatttatgttgggatacggg

SEQ ID NO: 60863 - DNA, 422 bp, Zea mays
  Clone ID: LIB3069-002-Q1-K1-D12
cccacgcgtccgctgagtcaatgaagatggattctgtctgcctgaggtacaccagagtattttggaacttgatcattgcgccttggaagtttttgtttgcttttgtgcccccataccacattgcacatggctggattgcttttatatgctcactggtcttcataagtggtattgcttatggtgttactaagcttacagatcagataagctgcgtcacaggagtaagtccatatgttatcgcattcacagcactggccgctggaacctcatggccagatctagttgctagcaagatagctgctgagcgtcaagtcaccgcggactctgcaatagccaacatcacttgcagtaactcggtgaacatatatgttggcattggtgttccatggttgattgatacagtgtacaacttcttcggttac

SEQ ID NO: 60864 - DNA, 382 bp, Zea mays
  unsure at all n locations
  Clone ID: LIB3069-002-Q1-K1-D2
tgacttcattcccagcggccggcggcgacctccacgtggtgccattcgccggcaacgagcgcccgcccaccaggatccaggtttgtgctgcgagagcgcctatccattcaccatgattaatttcgtgctcctgatcagccgccagggcaaggtgaggctcaccaagtggtattctccttacacccagaaagagaggaccaaggtcattcgcgaactcagtggactcattcttacacgagggcccaaactttgcaattttgttgagtggagaggttacaaggtcgtataccggaggtatgctagcctgtatttctgcatgtgcattgatgccgaggacaatgagcttgaagtccctgagatcatncatcatttcgtcgagata

SEQ ID NO: 60865 - DNA, 345 bp, Zea mays
  Clone ID: LIB3069-002-Q1-K1-D3
gatgacttgcaggctccttgatgccatacgagaatattactgaaatgccttctgcttctgcattcgattcacatatattgggtgcacccataaggcgagggcatctatcacaaaagtctgtcatgaagcgaaagagatctttcaagagacaaaaagccaagttggtcatggaaagcttgaaatttcattgcatgacaatgatgaagaggaggcagcattgcagagagttgcccaagctgaacgtgcggcaaaataggctgtacacagagctattcgactgcgcaacaaggtccaattctcatgacgaacatagagctcgcaacatacaaatctatcatggctctc

SEQ ID NO: 60866 - DNA, 341 bp, Zea mays
  Clone ID: LIB3069-002-Q1-K1-D4
cccacgcgtccgcccacgcgtccgcccacgcgtccgattccatccctggttaagaccaacccctccatctccatgcatctccaatgaacaacaactgacagctctccgtgatctatctatctccttccggtagctttttttgcattggccttgcaagtgctttattgctagagtagctgcgcttgcattattaactagataagttagtgatggatctcgcgacgaccccggcgcggctgcggcccatggagcctggactggcacggcgccttgtgcacgtggtggtcggcgtgtgccacatacttggaggcggcctgttccccaaacgcattatgatggac

SEQ ID NO: 60867 - DNA, 447 bp, Zea mays
  Clone ID: LIB3069-002-Q1-K1-D5
cccacgcgtccgattaccgggaacctgtaaggcctcaatcagctttccagggtgttggaagaacccttggtggtggaccttccccagatgagagtgcaacacctgctcctgcaccagcggcccctgctgcttcgaggtccgctggcatagtcgtggatgactcccagccatttacatccatacagctgaggctggctgacggcactcgcatggtcgcccggttcaacatgcaccacaccgtgggagacatcaggtccttcatcgacgcatctcggcctggaaccgcaaggccgtatcagctgcagacaggtttcccacccaagcagctggctgacccaacgcagaccgtggtgcaagctggactggcaaactcggttatcatgcagaagatgtaatgtttcgacaacatgggtaactaggatgcatcgtactgcatcctttgagaac

SEQ ID NO: 60868 - DNA, 275 bp, Zea mays
  Clone ID: LIB3069-002-Q1-K1-D7
acgcggacgcctgggccgacgcctgggcccggacgccatcatctcgtgcatcgggtcgctggggagcatactcaggtccttctgcgacgtgtgcagcgccttcttcgggagcaagctgcaaacgctgcaggacacgctgtgcaacacccgcaccgactgctacggcgacctcctccgcgagggcgccgcggcctacctcaactccatcgccgacgagaagtacgcctacagaacgcaccaagttcaggactgcatcgacgtagcgctcactttca

SEQ ID NO: 60869 - DNA, 252 bp, Zea mays
  Clone ID: LIB3069-002-Q1-K1-D8
tcgcggacgcgtgggaattgagattaaagttagtttttctaggagtgtattgaatcactctgtgactttccaaaggctaggatagacttatttctgagcaaaaatatatatgcagccattggaagtaaccatttggtcattgaatttggaatttgatcatgtggaacattttagaatatttgccaagcatatacctacttaaacaaaaaggtctacacatttgcacaactgttaaccaactgatttctgcaa

SEQ ID NO: 60870 - DNA, 399 bp, Zea mays
  Clone ID: LIB3069-002-Q1-K1-D9
aaaggaattgacggaaggcgagcacgaggagcagcagggagagggcggtggtggctgggatggcagcagcagcagcagccccaagcaggcagtcaaccctggggaagaggaggtggtggaatctggtcctgtgacagcgacgcccaacgctgcttgtggattccaagaaagcagctatggcgtggtggaggtggagctcgtcttgcctgacagccccttcgcgccccccaccaaggaggaggcctcatacgctgatgctgtcactgctgcagccgctcggaacggtagcaccagcagcagcagccctcgccatgtggcccttttcgcacccgcgtcttccaccaccctcgagctgcccccctacagctcctcctgcttctttcaggtgcccaaggtttc

SEQ ID NO: 60871 - DNA, 294 bp, Zea mays
  Clone ID: LIB3069-002-Q1-K1-E1
gagtcattgtcaccaagaacctcaaaacccggctaagattcctgcgttctctagggagtgccttagacaaaaggttgctgttgctactggagcgctccctgcgacacctcttgttcttgctagggcacccatatgcatttctgcttgacatactacggaggacctgattcaagcccttgatgttatcagtcgagttggcgaccttgtgggcattaaatgctttcctgtccaaccaccacagattgctcgaactgatcatgattagctcgacttacaatcaacccttacttgccc

SEQ ID NO: 60872 - DNA, 421 bp, Zea mays
  Clone ID: LIB3069-002-Q1-K1-C4
ccgcgtcttcccctgcggacctcgcaggtgccgatgtcgagctagcaccgtacctcctcgactccttcggcaacgccacccgcatcgactacgggacggggcacgaaaccaacttcgacggcttcctctactgcctcgcgaggctcggactcatcaccgagcccgactacccggccgacgttctgtgcgtcttcacagcttacctcgatctcatgcgcacgctgcaggacacgtaccagctggagcctgcaggctcccatggcgtgtggggacttgatgattaccatttgctgccgtgcatatttggggctgcacagctgattgaccacaagtacatgaagcccaagtcgattcacaacccagatatcttggaaaatttcttcaaggggtacatggatctggcaggcgttgcatatgtgaa

SEQ ID NO: 60873 - DNA, 143 bp, Zea mays
  Clone ID: LIB3069-002-Q1-K1-E10
gccacgcgtgctctaacatgtctatctaccactactactacccatcatcaacgggccggcacacactacacacactctaatctatccacacagccaacacagataccgacaatacaggaggatgaagatctcagcaaaatgtc

SEQ ID NO: 60874 - DNA, 430 bp, Zea mays
  Clone ID: LIB3069-003-Q1-K1-D12
cccacgcgttcgccaactccatcgctagcgcatatgccaatacaatctgaagtccaggggtgccttcttagaaacgaacggataactgacacttgcatataatcatctaggaaacttggtgctgacactatatacatcagggatcacgcctgaaaccaacatcgtaccttcatacatggcacctgaattgactctcatatcgctcacatctaccaacaagtgataattatacacattccgagcaatagcacttgatatgctgtcatgcacaagcccagacatgccagtccgaaaaactgtcgtcttgctgtgatatcttgtcatctatccactcctagattatatgccgaatgatattcatcatccattcatgacaggtgctcactgctacgccgatctgataaccgaaacaagaactctgcctattcct

SEQ ID NO: 60875 - DNA, 291 bp, Zea mays
  Clone ID: LIB3069-003-Q1-K1-D2
tccacgcgtccgcccactctacctaggactccaactttacctaccatatatacatacatgagcccgggtgcaccttgatcggaccaccaaccttacagctcaattccaacagtagccccacgttcctcatcatattcacataccaagcctaccaagtgctcgacatctattactagaacaacttcttccacatggtcagactcacaaccttccactcagcatcggctgccaaccgccaaccgtcaacctctcactcttatatcccaatacattcgtattaagcacagccaa

SEQ ID NO: 60876 - DNA, 335 bp, Zea mays
  Clone ID: LIB3069-003-Q1-K1-D3
cacgctcctcagaacggtcaggtcggaattttcctgtacttcaactggtacgaggctctgagaaactgtcctcatgaccaagcagcaggccatagagcctgagacttccacattggctggtttgctgatccattgataaacggacactatccacagatcatgcaagatctcgtgaaagaaacgctgtccacgttcactcctgagcacgctaaactggtgaagggctcggcagactacatcggtatcaacgagtacacatccagctacatgaaggggcagaagctggtccagctggcgcccagtagctactctgccgattggcatgttcaatatgt

SEQ ID NO: 60877 - DNA, 476 bp, Zea mays
  Clone ID: LIB3069-003-Q1-K1-D4
tccggccgacgcacgcgtccggagggatatgagacgctgctagattcaactgtacattacatgaagatttgaaggaagctcgatctggttaaaaggtgaagtgagagctcgccacgaagattagtcgagaacgtatccgtcacgagattgacctcatgatgtcagacatacaccctgttaaagcaatgtgtgacatccgcgatttggggctattttatgttgcatgttcttttcctgaaaaatgcaacccttctgtatttgacaagcgtgattggcagagtctttcacatattgaagcagcttgagatcttgcatattctattggcagcttgttgctcagcagtggttctgacttcaagtcgcacgatgagcgaacaaagctaggcttgtctagtgcattattcaaccccctccgaagcatgttctacctggacaaaatatctaagaaagcttctgattctagctatattatcaaa

SEQ ID NO: 60878 - DNA, 351 bp, Zea mays
  Clone ID: LIB3069-003-Q1-K1-D5
cagggaaggtcccatatgtcgtgtatctctttcctgatgaggataagcagcatatggtcctggccagattgagtgatgaaaagattctgcaatgcgatatgaagctaatgcagattacacaacagcatgatcaccatttaacgcctgctaacaccatcactcatgtggataacaacatgcaacttgtgacctccagagatgacacgtctatacctgtgtggaagccctgcatcccagtactgatacactatatcagtgagcctcacatgcactcaacgccatcaattgcactacatactaactcaaagtgactggctgcacacagcttggacaaatagatactgatataca

SEQ ID NO: 60879 - DNA, 198 bp, Zea mays
  Clone ID: LIB3069-003-Q1-K1-D6
ccacccaggccctgaaaaacaataactaccttacacttgctgtaccacatcatgatgcccataccctactagttcactccattaatcctttttataacaactacaaccctaatacacttaaagatgatcccgtcgtcctcaaagccctctactatatatatatcctgaacgaagaaaccattgtgtactgctacaatt

SEQ ID NO: 60880 - DNA, 448 bp, Zea mays
  unsure at all n locations
  Clone ID: LIB3069-003-Q1-K1-D7
gcgctcgggccctcgtaccctccttttcttccttgcgcgcggtcctccgatcgaactggcngaggcgagcttaggagagcagggccctcctgagggccctcccgcgcggcgaccccgtggcgttcctgctaggctgctgctcgttcgggtcggcggcgcggaagcggcccaaggcctcgcccttgccctccccaccgcgcctgtccgccgctgcagcggcagcggacgacggggccaagatgaagggccttttcaagaccaagccgcggacgcccgtcgacatcgtgcggcagacgcgtgagtgcctcgttcacctcgacctccactcgggctcccggagcggcgacgccaagcgcgacgagaagatgactgagctaagcaaaaatatcagggatatgaagtctatcctttacggcaatggtgaatcagagcctgtaactgaagcatg

SEQ ID NO: 60881 - DNA, 359 bp, Zea mays
  Clone ID: LIB3069-003-Q1-K1-D8
acggccgacccactcgtgcgcatggtctatgggacgatgactttgacgattacgaccactcatgccgacgttctagctgagctacaataacaagtcgacggaggtgttccagtccgtgccgtacgtggtggccctcttcatcgtcatgctgtggatctactacgcgctgctcaagtccaaccagctcctgctcatcaccattaactccgccagctgcctcatcgacactctatacatcgccatgtacctgctctacacgcccaagaaggcaaagatgttcacggtcaagatcctcctcctccttaacgtagaccttttctggctcatcctccttctcacgctgttgctctccgtcagac

SEQ ID NO: 60882 - DNA, 365 bp, Zea mays
  Clone ID: LIB3069-003-Q1-K1-D9
acatatcaaataatcttccgcccgatttataaaaaaattcagacctccccactaatatcactctataacctatcctccacaatataaacctcattatatcacacaaacacccatatcaatcaatctctcacatcctctattttctactattatatatcacattttcctttccttaaaaatccaacccttctctacatcacaaccatcaatcacactaccactcacatatttaatcatcatcatatctctcatactctatttacatcctcttactcaacacatcttctaactccaatttttaccattaactaccaattctatacttttacataaacataattcaaccccctcccaaacatattcta

SEQ ID NO: 60883 - DNA, 227 bp, Zea mays
  Clone ID: LIB3069-003-Q1-K1-E1
cccacgcgtccgctatcacacaaccgtactttccgtttacatactaaggaccaaactcaccgttatggtcaaccttactcgagacatccttattaacaataatttcaactacatcttcaatgcccacatgattcacactaacatgcttatgaacaagcccttactacacttgatcatcacaattctcatattcatcaacttacatgcatacataagctatattgaca

SEQ ID NO: 60884 - DNA, 460 bp, Zea mays
  Clone ID: LIB3069-003-Q1-K1-E10
gaccggcatgactatcaccctcgacgtggtctcgtctgacaccattgacaaccttaaggccgagatccatgacaaggagggcattcccccagaccagcatcggctcatcttcgctgtcaaacagcttgaggacgggcgcacgcttgctgactacaacattcagaaggagagcaccctccaccttgtgctccgcctcacgggaggcatgcacatctttgtgaaaaccctgaccggcaagactatcaccctctaggtggagtcctctgacaccattgacaacgtcaaggccaagatccaggacaaggagggcatccctccagaccagcagcggctcatctctgctgggaagcagcttgaggacggtcgcacgcttgccgactacaacatccagaacgagagcaccctccacttggtgctgcgcctcaggggaggcatgcagatcttcgtgaagaccctgacc

SEQ ID NO: 60885 - DNA, 475 bp, Zea mays
  Clone ID: LIB3069-003-Q1-K1-E11
gaccacgcgtccgctccgcgcgcctcccctccccgccccgccgtcgtttccatcggagctccctaccgactgccgggagccattgcatccgcatcagcgacgcgccgcggactctccgctctcctcctctccccttcctcccgtgcgctccgccgccgcctgggccccctcgccgcggcggcctcctcaccgcacgtcgccccgtggccccttctcgctccgcgcggtgccagaaccgcgtcgtccggcgggtcctggcactccccgctgaacgacccgtccccgaactggagcaaccggccgcccaaggagacgatccttctcgacggctgtgactacgagcactggctcatcgtcatggagttccccaccgaccccaagccttcagaggaggaaatggtcgcggactacgtcaagaccctcgcggccgtcctcgaagtgaagaggaagcaaagaagaaaatctactcagtgtg

SEQ ID NO: 60886 - DNA, 335 bp, Zea mays
  Clone ID: LIB3069-003-Q1-K1-E2
gcgtcagcccacgcgtccgcccacacgtacaccacctctcatttcctctgctcaggatccactataccgttaggttccacctatcgaaggtttgaaccctgctcaagaagatcatctgccccatctacaatcagctattgctgacgcactcacgtctatcccagaaccaatacctgatgcccttgcaaaactttctcatgaaatacttgatgcaacaccaccaccattagctgaactgatgaaacctcttgcacaactgatgccaccaaacaataatcgcaatgctccatctgatgtgcatgctgacgggtcatctagctctcccacttcacaaa

SEQ ID NO: 60887 - DNA, 348 bp, Zea mays
  Clone ID: LIB3069-003-Q1-K1-E3
aaagcgaaaccagagccattgcctacacctttaccttaacctaatcccgaacctaagccaggtcctaggcccgatctctaaaataaaaccaaatccaaaacctgaaccaaaaccagatcctaaaccagatcataaacctgagccaaagccagagcctaaacccatacctaaaccagagccaaagccagatccacaaccaataccagagcctaagccagagcctaaacccgaaccgaaacctgatccaaagccagagccccaacctaagccatagcctaagcctgagccataaccataaccaaagccagtaccacaaccaaagcctgaacctaaaccagaaccaaaacc

SEQ ID NO: 60888 - DNA, 435 bp, Zea mays
  Clone ID: LIB3069-003-Q1-K1-E5
gcggacgcacatctatctgtcaagcgtcgccgttgcctcgatcagagtctgaggcgagcacccgcatggcttctgctggcggcggcgcatgagggaaggtatccttcaagatcatcctcaccttcgaccccaagctccctttcaaagtgttcagcgtgcccgaggcggcgccctttaccgcggtgctcaagtacgccgcggaggagttcaaggtcccgccccagaccagcgccatcatcaccaacgatggaattggcatcaacccccagcaaagtgcatgcaacgtgtttctgaaacatggttcggaactgcgtctcatccctcgcgatagggctggagctgtagtcatgtcttccggttagaggatatatacagtccaatgcataatgagcaaaacttgagagaaataaagctttgatgctggccttgcttggc

SEQ ID NO: 60889 - DNA, 415 bp, Zea mays
  Clone ID: LIB3069-003-Q1-K1-D11
gggtcgaccgactcgtccgctgagggcccagatcctgtctgtagcatttttggtagtagatggattgtaggtaccaaaacggatgcgatttctgcataaggagacagcgaagtggcgattccacatcactatggagcataatgtttgctcggacagtagaactcaggaatagaggcaccgtttttggagtggggtggtatatgtgttgtatacagagatgagaggcgtggagcattagtttttgtgttgtcattgtcgctgtgcatccttattgttttaccccttgtccaaaaagggatgcattattatgttgagaggaaggttatagaggtttcgcaataaaatgcacctagccaattgatagtatgaatcagatatataatctaatttatgactgcctattcgccttgtaccc

SEQ ID NO: 60890 - DNA, 462 bp, Zea mays
  Clone ID: LIB3069-003-Q1-K1-E6
gacccacgcgtgcgacgcagccaaacccaaaccctttctgctttccgacgggcgacggcgatggccggtgcgagagagaatacggctgaggacatccgccgcgagctccaggagctccagcgccagcaccgcgagatcaccgagcgcctgcgcgacccccgtggccttcgccgcggcgcccccggccctggtcctggacctgggccgccccgcccgctccgtggcttcgtgagaccccatgtgggtgcggaagtggcggatcaggctccgcagaagcgtcggctgctatcagccgtagttaaggttgatggcgctgaaaataatgaagaaggcacaaaggatgccaatggggaggggcaagaggcgggttcaggtgccactgaaggcagtgacaggaggactttcaacactggcgggttcagaaaggacgggagcctgtggatgcagagtgaggtggactat

SEQ ID NO: 60891 - DNA, 339 bp, Zea mays
  Clone ID: LIB3069-003-Q1-K1-B7
gggccgacccactcgtgcgcccgcgcttactgaccttgcatttatgcattttaaaacggaatcatgggctacgagaacgaggtatctattttacagggactaaaccattgacagcaggtcaagcatcttctactccaaggccactattgccctcaacgaccacttcatcaaactcttctcgtgttacaacaactaatgagtctacagcaacctcgtcgactacctgatccgtcacatgttcaatacccactatgctactatagagatagatttctacctcactatcgagggtcgtcaccaatgtcctttgaactctgaccatctttgctgcttgtctat

SEQ ID NO: 60892 - DNA, 332 bp, Zea mays
  Clone ID: LIB3069-003-Q1-K1-B9
taccgacccaacccacccatccactcagtcataaaatatactcctccgttgactttaaaatcaactaacaggtcacaaatagtttagtaacaaatatttgagaacagagacaattaaccaatattcatagatcattgatcatattatccaaaacgttttgatactacaagacagattatatgcacaagcctattcacaagatatgactccctcagaactaccctacccaaacaccaacccctgaaatgaaccaaggaatatttatttaaaaacataaaatctctgactacaacaaatcacagctcacaaaccaacaatgcttcctgctgact

SEQ ID NO: 60893 - DNA, 319 bp, Zea mays
  Clone ID: LIB3069-003-Q1-K1-C1
ctctcgcctacgtacgccaagtattggattttgactatcggacccaacaggtggcaatgtgcggccggttactaaccttgcagccatcggtgctgtctgctgctgcactatgtgcaatgtcctgtgttactgtcatgaccgtgtcaagtacctaggatcattttgctcacagacgcactcgaacttgacctgaatgttccctggagactacagatgggacaccggcagtctgtccacaaacccataggcgttcgcgcagaacaagacgacagaggtgatccaatgtcggtagtcgatgctttgttcactcggctacata

SEQ ID NO: 60894 - DNA, 444 bp, Zea mays
  Clone ID: LIB3069-003-Q1-K1-C11
cccaggcgtgcgcccactcgttcgcccactcttttgtcgcgaactgaagcgactagtctaaggcggggtttgctgcggcgatggggagcgacctgtagacggagaagaagaagaccccggtggcgctgatgcccatcgcgaagcccctcgctggaaagaagctctgcaagcggaccctcaagctcgtgcgacgagcctctgaggccaagtgcctcaagcgctgagtcaaagaggtagtcaagagcattcgccgcgggaacaaagggttgtgtgtgattgctggaaatatttctcctattgatgtgattacacacgttccaatactatgtgaggaatctaatgttccttacatatatgttccatcaaaagaggatcttgcgaccgcatgaaccactaataggccaacttgttgcgtcctggttctgaccaaaccaaacaaggggg

SEQ ID NO: 60895 - DNA, 439 bp, Zea mays
  Clone ID: LIB3069-003-Q1-K1-C12
atcaggctctcttattacagtctaaatagttttcatactggactgcatgtgctaatgggctgatccatttttcgtacagaaacatatctctacttcccggcaaagatcaaacaaacgacatagaaaggtacaacaccaaattataccaattgatcgaccaatttaacatgcagacggccctatattcttgcctaattctagacgacttcatctaattcactaccaaccaggactacatcagtaacaacctcttgttatccgtatactcttcttccgtcaacaccgatgtcaatatcaatgacgtcatcaagctcaagctacacgacagaagatccagactaatccgctacgttaagcttgactttgcttgcgccgaaagcagcagcaccaacaatgacgaccgctacaacaacaacaacctacacaacaacgacaacaa

SEQ ID NO: 60896 - DNA, 321 bp, Zea mays
  Clone ID: LIB3069-003-Q1-K1-C3
gagcgcgccatctccaaggagggctctctttacactttagagagcacggactgcttcaacggtgatgtgctcctattccatagccatagctcctagctctccttactcttcgatcgttcttacctcttgccatccattcagtcaccgacgccgaggctgactatggaggacgcgctcgcgaacgccgaggcccccatgttctactgcctcgactcgctattctcggacaccgacatcgacccacgccgcgatgtgcgcatgctcatcgtcaactgtagcctcttcaacactacgccatctctcgcgtccatggtagtgcac

SEQ ID NO: 60897 - DNA, 432 bp, Zea mays
  Clone ID: LIB3069-003-Q1-K1-C4
ctccgcgcacgccgccgcccctcgacgatttcacgttctcgccgtcgtctctggtctcgcggtcaagtgctacctggcgtgcgtcctcgccgcccgctacgcccgcctcggcgaacccgatgccgcgcgcggggtcttcaacgccgacggctgctgccgctacgcgacgccgcccaagccgctgctgtacaacgccatgctccgtggctacctctgcctgggcctcccgcgcgaggccgttgcgctcctgcgcgccatgcttgcgtccggctcctgcgcgcccgaccgccacacgtatcacctggccgccacggcctgcgcgcgcgccccggaccttgggctaggccgccgcttcgaggctggcgccgcggcctgtgggctcgcggtgtccgaccttctggtggccactgcactcatcgggatgcatgccga

SEQ ID NO: 60898 - DNA, 457 bp, Zea mays
  Clone ID: LIB3069-003-Q1-K1-C6
gacccacgcgtgcgcggacgcgtgggttctgcctccttctcattctcgaccggtcaccccatctccaccgccacagccgtcgtcttccgccgccgccgatggcccgcctcttcacgcaaaccctcaccctagcccgccccgccgcctccccctccactaccgccgcatccgcttccctccgtggcctcgccaccaaggtcgagatcatcgagatcgatctcgccgaggaagacgctggctcctcgtcccacggctccccctcctcgtccccatcggtcgaggcggtcgggatccggcgcctggaggaagccatccacggcgtcatggtgcgccgcgccgcgcccgactggctccccttcgtgccgggagggtccttctgggtgcccccactgcgccgtcagcacggggtcgccgagctcgtgggccggatcgcggctgccgtgggcaccgaaagggg

SEQ ID NO: 60899 - DNA, 411 bp, Zea mays
  Clone ID: LIB3069-003-Q1-K1-C7
cccacgcgtccgcggacgcgtttttctatttctagatcgcgagcggccgctcggggtctaggtcgctatcggctgccctttagttttttttatgtatccctttcccatccccgtgatggcttgagagctgttctccatctcctaggaggcgcaatattccacctccatcacggaagcgttacagaagaaagagcagtccgagtgtcattagctctccagttactgcatctcaaagttcccaccttgggttggaagagaataagaatgctattgatacgcaaaggctacaagaagaaaataaaaggcatttccgaagaaagatactgctgtaattccgcttgttatatctgatgatgcaactggtgatcctttatctacttttgatcagttttgataattcgtttttggatc

SEQ ID NO: 60900 - DNA, 463 bp, Zea mays
  Clone ID: LIB3069-003-Q1-K1-C8
ggccgacccactcgtgcgcttggtcgagcacgtcgcctaattaaattccccattccaatacacagatctcgcggccgtgggtggctacgaatctcgcggtgcggaggcgcgacagaggcggtgtcgactccgacggactcgcagccaccggtggagacgccccaccggcgcactcctccaacgttcatagtttaagggcttgatttggataattagtcatcaacagaagtgataaaaaatggtggttcttgcagcatcaatcgtttcaaagtcgggaaaagcacttgtttcaagacagtttgttgacatgtctcgcataagaattgaaggattacttgctgcgttcccgaaactggttggaactgggaagcagcacacttatgtcgaaactgaaaatgtgcgatatgtttatcaacctattgaaagtttatatcttctacttatcacaaacaagcagagcaat

SEQ ID NO: 60901 - DNA, 189 bp, Zea mays
  Clone ID: LIB3069-003-Q1-K1-C9
actcagcactccctctggcccaaccacgtacctgtgcccacccggctacgcgaccttcccgatctgccataacctaccccaagctcccaaccgatccgtctcctgctacgtcgcgtccctcaggcgcccctcacgaccgcacgcgtccgcctgtgtctcgaccgggtacacggactcttcaccttcacg

SEQ ID NO: 60902 - DNA, 157 bp, Zea mays
  Clone ID: LIB3069-003-Q1-K1-D1
cccacagcgtccgcccacgcgtccggggactttaacgttacctaccctatatgggaggaggaggccgggctaacaatgtgcagaccaccgaccttacagctcaagtgcgacagtagccgaacgtacctgatcagatccgactaccaagcctaccaag

SEQ ID NO: 60903 - DNA, 458 bp, Zea mays
  unsure at all n locations
  Clone ID: LIB3069-003-Q1-K1-D10
aagtgtcaaaccaatctcccctcgccgtcctgccggcgtgcgctcggggcctcttttggtggagcctttcgccgcggcccgtcctcctgtccgaaataatccgcctcgacgtgttcgcctccccctccccctctctcccctcccctcccatcgcgactcgtctcgtgcgtgactgcgtgctcgctctcctttttggtgcgctcatcttggtatctgtgccagcgctcgcttctccccgtccccgccctccttcctttccttgtctagccgaaggccgaagccactgtgcgcgcgagcgcgacgcgagaggtagctgctgctgtgcccggcgcgcgcgtgcgtgcgacgatgtcgtcggcggtggaggccgtctnctgccccaaggtcgacgtcctcgccggcccggagccgttggagccggccaaggaagcggcgcctgccgcggagcactgcgacac

SEQ ID NO: 60904 - DNA, 370 bp, Zea mays
  Clone ID: LIB3069-003-Q1-K1-B6
gcgcccgacgcgtacgggcctgctctttatggctctactcaagggtatcatgggctacgtggaggaggatctggtttccaccgacttctcctgtgacagcaggtcgagcatcttcgacgccaaggccgggattgccctgaacgaccacttcatcaagctcgtctcgtggtacgacaacgagtggggctacagcaaccgcgtcgtcgacctgatccgccacatgttcaagacccagtaggctagtagagagatagatttctgcctccctatcgtgggtcgtccccaatggcctttggtcgcagaccatctttgctgcttgtctatgctgagaataaatgtgaacggtgcccctggacgctggatccatgct

SEQ ID NO: 60905 - DNA, 418 bp, Zea mays
  unsure at all n locations
  Clone ID: LIB3069-002-Q1-K1-H9
cccacgcgtccgcccacgcgtccgggcagaatcagaatgagaacaggacattatggaagctaggaacgctgccccctggcttgatcactttctactcgaccacaaaacctctggagaaatcttggcatgttcttggacttggatacaatcctagcatcagcatggaggagattagaaatgctgctgttgtgcatttcaacggcaacatgaagccctggctggacatcggtatgaaccagttcaggcacctttggacaaagtatgtggactatgatgactcatatattcgtcaatgcaattttgcaccgncatagaaggttttaattatcgacaacgaagaagaatcggtaaacgtggcacatacatatgcccgaaggcacgatttctgtagagataaggagtttctagagtacaactg

SEQ ID NO: 60906 - DNA, 319 bp, Zea mays
  Clone ID: LIB3069-003-Q1-K1-A1
cccacgcgtacggtggtgctggcggcggttctggctgtcatgtggtggcgtcggtgctccgggaccggcggagtctacggcctgccgccggggcctacaggttggccggtggtggggaacctgttccaggtgatcctgcagcgacggcccttcatgtacgtggtgcgcgacctgcgagagaagtacggacccatcttgaccatgcggatggcgcagcgcaccctcatcgtggtcacctcggcggagctcatccacgaggcgcttgtgaagcatggccccatgttcgggagccggccctaggacagccccacccggctgc

SEQ ID NO: 60907 - DNA, 196 bp, Zea mays
  Clone ID: LIB3069-003-Q1-K1-A10
cccacgcttccaaggaccacgacgctaccttcgtgtgctttcgttccagctttccttggccggcatctttacttcctacggaagccgtcgtgccagtcgccgcccgtcgcgatgggtaacacggtggcactggcgctgatccggcggtgcaagtacctggcatcctccctgatgacgcctcttctgcctagaagcg

SEQ ID NO: 60908 - DNA, 417 bp, Zea mays
  Clone ID: LIB3069-003-Q1-K1-A11
tctgctctcgacccctagctcctttgttctcacacaggcgcggccccctcgttgggaccgatatggctctggcgaatcaggggaccgttgattaccccagcttcaagctcgtcatcgtcggcgatggtggaactggtaaaactacatttgtgaagaggcatctcactggagagtttgagaagaaatatgaaccaaccattggtgtggaagttcatccgttggatttcaccactaactgtggtaagatcaggttctactgctgggataccgcagggcaagagaagtttggtggcctcagggatggatactatatccatggccagtgtgcgatcatcatgtttgatgtaacctcaaagcttacttacaagaatgttcctacgtggcatacggacctgtgcatggtctgtgaaaacatcc

SEQ ID NO: 60909 - DNA, 270 bp, Zea mays
  Clone ID: LIB3069-003-Q1-K1-A12
cctttcgggtccgtttccattctaagcctgaacgaccagctcctgcacaccaacatcatcgacatgcagctcacgcacatgccctgcaacttccccagcctgaccatcacctttctcttccagcacagctccaaccccatgtacctgctcgtgctcatttaacacaacaacaacgactgctacctggtccacgcctacatcatgcataacaactccctccactgcgaacccattcacgagtcctggggctccatctgaaggatctacccc

SEQ ID NO: 60910 - DNA, 408 bp, Zea mays
  Clone ID: LIB3069-003-Q1-K1-A2
accacgcgttcggtggtgctggccgcggttctggctgccatgtggtggcgtcggtgctccgggaccggttgtgtcgacggcctgccgcccgtgcctacgggttggccggtggtggggaacctgttccaggtgatcctgcagcgactgcccttcatgtacgtggtgcgcgacctgcaggagaagtacgggcccatcttcaccatgcggatggtgcagcgcaccctcatcgtggtcacctcggcggagctcatccacgaggcgctcgtgaagcagggccccatgttcgcgagccggcccgaggacagccacacccgcctgctcttcagcgtctgcaagtgcaccgtcaactcggtgccctacggtcccctgtggcgtgctctgcgccgcaacttcgtcgccgagatcgtg

SEQ ID NO: 60911 - DNA, 58 bp, Zea mays
  Clone ID: LIB3069-003-Q1-K1-A4
cccaggcgttcggtcatatggatctcacttactgttctctcaagggctttgtgtaaca

SEQ ID NO: 60912 - DNA, 172 bp, Zea mays
  Clone ID: LIB3069-003-Q1-K1-A6
ctgatatacctgttttacactcttcagatgttgcacatctattctcacattttatgttactcatctgtcaatggatcacgactttccatacacctttacctaggaagctatgcagattaacactactatgccttcacaaatatccactaccttcataaaacccactacattt

SEQ ID NO: 60913 - DNA, 438 bp, Zea mays
  Clone ID: LIB3069-003-Q1-K1-A7
cggacgcgtgggaaattcgttgtgagcattttcttgcagcctggagcctatgagctgatgggttacatagtgtatgagatcgaccagcacccttaccagaatgtattctacaatggcactattgaggtcgttgaggctggaggcttactcagtgttgagtctgtgttcctcatcacccttggaatcgctcttcttggtctctttggattatgggcatatggccaggttcagcagctctcgaagaaaacgaagaatgcccccaaggtggagctcggaactggaacaactgatgccaacatcgatgagtggctggagggcacttcgtttgtgcagagaagcaaatccaagaagaagcagacctgaagctagctctccagactagttaatccttggaggatctagaatgaggcatttgagggtagcccttcacaagtgact

SEQ ID NO: 60914 - DNA, 413 bp, Zea mays
  Clone ID: LIB3069-003-Q1-K1-A8
gggtccaaaactcatatgggagtttcaattttccttggttcaaggaggacctttggccagggcactaactgcaaatctgctaaactgtattatgcaaccttccacatctctcaccactgtttccacaggagttttacatctgggtccctctttcaccacttgattgtctacggtagataaatcgtttgagttctgaactgccttaggtacggcaatgcttgctacgttgacgaaagacaccgccacagatacgaggtgaatcctgacatggtcccagaatttgacaaagcaaggctttctttcgttggcaaggatgaaagtggcgaacgcatggaagtatatatatgattgccaactattttcgtgaagaattaaccttcttctaatctggtctcatgtatttggtctggcac

SEQ ID NO: 60915 - DNA, 444 bp, Zea mays
  unsure at all n locations
  Clone ID: LIB3069-003-Q1-K1-A9
ctaagttttgcttccatctggctggtgctttgcctgacttcagtgaagacaatgaaaagatcacattcaaaagattgcttttgaataaatgccaagaggagtttgagagaggtgaaagggaagaagctgaagctgataaaacagaagaggaaggtgagatcaaacagaccaaagaagaaagagaggaaaagagaatccgtgctcgaaggcgcatgctgggaaacattaggttaatcggagagttgttcaaaaagaaaatgttgacagaaaggattatgcatgagtgcattaaaaaattgtttggaaattgtgatgatcccgatgaggagaacattgaagcactatgcaaattgatgagtacaattggtgagatgattgatcgtgcaaaggcaaaggagcacatggatgcatnatttggtatgatgcataagatgtcaacaagtc

SEQ ID NO: 60916 - DNA, 336 bp, Zea mays
  Clone ID: LIB3069-003-Q1-K1-B1
aatgcatgcgagctgcactcctgctccatttacacttttacacagcacactcccaaaaccagagccaggtccgtctgcacaccggcccctgctttgactagcctggccgccgcagcgacagccatctccaccgctgcccactccctccaactccatggtccgactccttctaaatcctctacccacttctctcaccgtctccctatcccttgccacctccgcacgcaacgcctgcacctggccgactcgtcctccgacctcacctgcttcccctaaccgactaccgtcccgaacggcgtctacgtaccgtggtccgctgccttcttcgtagccgaa

SEQ ID NO: 60917 - DNA, 457 bp, Zea mays
  Clone ID: LIB3069-003-Q1-K1-B10
aagtagcaaaccaatctcccctctccgacctgccggcgtgcgcgcggagcctctgggtgtagagcctttcgcctcggcccgtgctcctgttcgaaataatccgcctcgacgtgttcgtctccccctccccctctctcccctacccttccatcgcgactcgtctcgtgcgtgactgcgtgctcgctctcctttttggtgcgctcatcttgttatctgtgccagcgctcgcttctccccgtccccgccctccttcctttccttgtctagccgaaggccgaagccactgtgcgcgcgagcgctacgcgagaggtatctgctgctgtgcccggcgcgcgcgtgcgtgcgacgatgtcgtcggcagtggaggccgtctactgccccaaggtcgacgtccccgacggcccggagcctcttgagcctgccaaggaagcggcgcacgccgcggagcactgcgaca

SEQ ID NO: 60918 - DNA, 420 bp, Zea mays
  Clone ID: LIB3069-003-Q1-K1-B12
gactggtacaaagcataaaaacccaccacttttcatcgcacagactactgccataatgttgcgtccgatctcacaagcgaccctgcatgttctcaaccaagctactaaccagtgcttccctcatgtaacgaacctaccccacgctcgcatatgaagaacactgcgctcacctgcaacaaccaaccgtacaacactctgcaactacaacgctcattcatgttcatcatactaatgatgtgcatcaaacgacacgtacagtacaggtactccagcaacaccagctaccgaaacgtgccccacaccgaagcactcgtcaagccttcgaccccaacctgcgagcactatgacatcatcatattcacaaactgcgacttactatgaagcaacagcaggagctcccgcatgaggtgccctgtcaac

SEQ ID NO: 60919 - DNA, 77 bp, Zea mays
  Clone ID: LIB3069-003-Q1-K1-B2
ccggaacatccgggccgacccacgcggccggacgggaggcggctgccaacacgccgcagtagaacctgaacggagaa

SEQ ID NO: 60920 - DNA, 271 bp, Zea mays
  Clone ID: LIB3069-002-Q1-K1-H7
acgcgttgcaatgctggtactctcatggttctaaatttggccgtcactccaactgaactaagcgagatcgtccctttgttgcgtctggatgaagaccaaactggcaccgaacgcttcccctcgacatccaacacattgagcaatgcgatgaccgaacatgctttaaaggatgacctaatgagccttatccatgccatgctaggctaggctattgctgcgccaatagtactagtctaactgtacaccgcttcgttacctagaataaaggtac

SEQ ID NO: 60921 - DNA, 191 bp, Zea mays
  Clone ID: LIB3069-003-Q1-K1-B3
aatggtttccttcttttttcactcttcattttaacttttacacatatcacttttaaattcagattccgttcatttgtacacggccttaacctactacaacactatcccaaactcaacatccatctacaccagcaatcactctattcacctataatgacctaatccatctaaatcctctaacatacactcaa

SEQ ID NO: 60922 - DNA, 428 bp, Zea mays
  Clone ID: LIB3069-003-Q1-K1-B4
gccagccctgcgactgcgtgcgtgcggctttcgttcgacgagcaggcagaatggagctggacgcggggaaccagaagcaggcgccgctagtcctcgcgctgtcctgcctcctcctcctcgcccccctcgtctccgccgtccccactccaagaagcctgcgcctggggggccagcagcagcacccgccggctctgaagctcacttcttctcaggaggcggcgatcgcggcggcgatgaacatgggcaggccgacggcgagggtggccgtggaggtgaacgactaccaaccgtccggccccaacaaccgtcacgacccacccaagggcccctgaagagcttgttgaacggcgctcggttggacgacccaataatgcttctccttcgttggtgtcatctttaccagcagtatagagtgctttgctagtgct

SEQ ID NO: 60923 - DNA, 399 bp, Zea mays
  Clone ID: LIB3069-003-Q1-K1-B5
cctgctctcacttacattgcttttaacaatgtaatgctcaaatcatctcaaccaggttccgcaacttttccaatgtgcacaagctttacatgaaagtcttctaccctaatcttcaattagaaccatttctaatctcagcaatctagtctaattcttgaatctttaaactcaggaacatgccacataaacttctaaagtatcatctgacaattatgcaagcatatcacacgaataaactcgactattagatgcacataccaccaattctgcatgatacaacactaatacaacagatactacataatcaaattaacttcaacgttaattgcatcatatgctctcaatagccctaaacatttgacaatctaatatatcttactatgtacaatcatggcttaa

SEQ ID NO: 60924 - DNA, 288 bp, Zea mays
  Clone ID: LIB3069-009-Q1-K1-H1
cccacgcgtccgcatcgaatcgtctcacttttgtctgccctgctcatactgcttgccctggccgggtcgtccacccgcaacgcacaggaggattccatggccaacaacaccgggacgttggtgggcggcatccaggacgtgccggttagcgagaacgaccttcacctccaggagctcgcccgcttcgccgtcgatgagcacaacaagaaggccaatgctcatctggggttcgagaagcttgtgaaggccaagacacatgtggttgctgtcacgatgtactatctcact

SEQ ID NO: 60925 - DNA, 392 bp, Zea mays
  Clone ID: LIB3069-009-Q1-K1-H10
aatcaccgggccgacccactcgtgcggtcaggcaagaaacaacggagatttataattctgatgaagcttatgtgtatgacaggcttggcaagctatatgacaagtacagcgattatgtcacagtctgaggacaaggaacgtttgattgctaagcttcatgatgttgtagactgtctctatgaagatggctagcatgaaactaagggcgtatatattgctaaactactagaacttaataaagttcgtgatgctattgatgctcgctataaggaatgtgagattagaaattctgatgttagtcaactgatatactgcatcaatagcttcatagaatctgcacagtctaccgaccagaagttctgacacatagacatgtcataaaagcgaaaggt

SEQ ID NO: 60926 - DNA, 423 bp, Zea mays
  Clone ID: LIB3069-009-Q1-K1-H11
caggagcctttccccacgggttcaatcatcctagccaggtctgggagatcccggacgtcttgtggtgaagaaaatcaccatgacatccagacagtcttgaccaacggtgacacttcttccaatggagctgacaattcaggtcccaccaaggatactgagtagctgaactgcagcttgctgcatcgctaaccacaaaggcccaagttattactttttgcagacctattttcagttctagcccctcccttcccatttcgattttgtttgttaagtcctcccgatctgtatttattaacttgcatgatgcgggtcaccgaagacttaggctgctgcagaagttttgtctctggcgggaagctatatgcaagagggtggtaccggttcgttccccagaatctatgtgcttgttaacctgaaggccga

SEQ ID NO: 60927 - DNA, 311 bp, Zea mays
  Clone ID: LIB3069-009-Q1-K1-H2
tcgagagacttccgcatataatcgacttacttttgtcttccatgctcatactgcttgccagggccgggtcgatcaccctcaacgcacaggaggattgcacggccaacaacaccgggacgttggtggaccgcatacaggaaactccaggcagctagaacgacacttcagctccaggatctcgcccgtttctccgtcgaggagcacaacaagaaggacaatgctcttctggcgttcgagaagcttgtgaaggccaagacacaagtggttgctgtcacgatgtactatctcactattgaagtgaaggatggcta

SEQ ID NO: 60928 - DNA, 372 bp, Zea mays
  Clone ID: LIB3069-009-Q1-K1-H3
ccgtccgacccactcgtccgatggcgcctgtgtgtcagagagatttgcacttaatcgtgaggatcagtgatgcgaggggcaacaagtcgagagatcaggcagggcaccatggggcgcgggaaggtggtgctgcagcggatcgagaacaagatcagccggcaggtgaccttcgccaagcgccggaacggcctgctcaagaaggcgtacgagctctccgtcctctgcgacgccgaggtcgcgctcgtcctcttctcccacgccggccgtctctaccagttctcatcctcctccaatctgcttaagactctagagcggtaccagaggtacatctatgcttcagtcgatgctgcagtgccatctagcgatcagatg

SEQ ID NO: 60929 - DNA, 128 bp, Zea mays
  Clone ID: LIB3069-009-Q1-K1-H4
cccgctcttgcgatcttaatcatctcactttggctttcatgtatgctgctatgggtcaggttacgatctattttggcctagctagtccaggcagtacaaagcgccaaactgctgaagaacatgtgcta

SEQ ID NO: 60930 - DNA, 427 bp, Zea mays
  Clone ID: LIB3069-009-Q1-K1-H5
gcgctcactcgatgcaaaaaactccatggattttattgctgctatgcttcgctggtggtctctgcttgagaaatttagctgcagtgcatcaaagctgcacctgaagcctcggaggttcaaaacatttgtagaagcattgggaaaacaactgctgaaggacagaaataagtccaggaaaaagcattcacgagtggatatgtgcatatcttctccatctccagttatcagcaaggctcctggggatgagactcctcctgtaaagttcttgtcaatagattcccaaaatggtagcagagtagcatctcctaaagggacaattttcaagcggattgcagaaccaatttctaacaagtcaagaacaactagaggggacctctttgccacaagaaccgtgaaaccgaaaaggaaagcaagtggtgcttgtgca

SEQ ID NO: 60931 - DNA, 273 bp, Zea mays
  Clone ID: LIB3069-009-Q1-K1-H9
gggaggcagcgccgtacccagtggtctgcctttagtgtttcgcactttgctattcagcttcattcttcaccggttcaccctagccgccaccccaacccccagcgacagggaccttcgccgtcaggccgcccccaatccctagcgactgcgagcaccgtcgccaggcgccgtgcagcgagcgtcgccgcctggcgaagtcgcgcgactcgtgccctgcagcgagcgccgatgtcccgcacccaccgtcaaacggctgccgatgcccaacgccct

SEQ ID NO: 60932 - DNA, 350 bp, Zea mays
  Clone ID: LIB3069-010-Q1-K1-A1
gtgggctgcatcatcatgcctcacaatttgtccttgcattcagcactagtgcagtccagaaagagtgacacagacaagaaatctcgtgttctagaagcagtttactactataacatcgagtcgattcttgcactcatcgtgtccttcttcattaacatctgtgtcacaactgtttttgccaaaggattttatgggtctaaacaggctgacagtataggtcttgagaatgctgggcagtacttacaagaaaaatatggaactgcattctttcccatcctctatatctgggctgatggtttgatagcatctgggcagagtagcacaattactggcacatatgcaagacagtt

SEQ ID NO: 60933 - DNA, 295 bp, Zea mays
  Clone ID: LIB3069-010-Q1-K1-A11
aataaactaacaggtaacaattagtttgaggttcaatatataactactagcgccagacaattctaatccttacttcatcatcatccatcacttcattcccaacttcttaccactcccaaccacatctatccactacgcctcattctatgatattactcacctctaatcaatcataataaacttcaaccaccacaacaacccatcaaatctcacttcaatgttcttaaatattctgatctacaacacatcatctctcccaaaccaacaatgctttctgctgccttttatcattcca

SEQ ID NO: 60934 - DNA, 316 bp, Zea mays
  Clone ID: LIB3069-010-Q1-K1-A12
gaccgacgcgttcgacatggcttcaaaccggtggccaatttccgtatagaagtgtgcgcatcttctttcgggtacgtgtgcatttgatgccatgacgacctgttccacaactacgagatcattaaaaatcggttcaagctctagccatgcaacttatcgagcctgaccatcaccttgcgttttcagtacggctgctaactcatatacgtgctcgtgctcatcttgcacgactactgagacagcgacatggtgtaggccgccctcaagcatgacaccttactacactaggagcacgttcacgaatactggggctgca

SEQ ID NO: 60935 - DNA, 337 bp, Zea mays
  unsure at all n locations
  Clone ID: LIB3069-010-Q1-K1-A4
ccgacgcgtgcgcccacgcgtccgcccttgcgttttgatccggagcagccgcagtcccgccnacgtcgacttcggtcgccctccatctcctcgccgctgcctctcgtttctcttttcaataatcaagatgagccgtggtggtagtgccggtggtggtcaaagttctctgggttatctctttggaagcggtgagccccccaaaccagcagtggcaccagctgcaagtgctccacctgttgagaaaccatctgctgcaaagactgatgcggccaagccatgtgctgctgggggtaccagccaaaccaataactaccacagggctgatgggcaggacact

SEQ ID NO: 60936 - DNA, 367 bp, Zea mays
  Clone ID: LIB3069-010-Q1-K1-A6
ggggccaacagtggtgccgggttccgattacgccaaggtgcagcgtgccgtgtgcatagtctccatctccaccagcgtcatccaggtgttctcccgcatcaacagtaatttcgacctcatgtacgccaagcgcgcgttcgtgcactggtacgtcggcgagggcatggaggagggggagttctccgaggcacgcgaggacctggccgccctggagaaggactacgaggaggtcgccgcagagggcggcagtgatgacggcgacgaggaggaggaatactgatctgcttgcatgaatctgtttggctgtcgagccaggttgtggtgttgaaaaacctttgtttgtgtcctgggtaatgtttgggtgttt

SEQ ID NO: 60937 - DNA, 357 bp, Zea mays
  unsure at all n locations
  Clone ID: LIB3069-010-Q1-K1-A7
gtccgcggacgcgtggggtagagttggtggactcaaggtaagtgctgntgacacaagtggtgggggcgatgcctttgttgctggagtgctatctcaattagccacagacttttctctgctccatgatgaaggtcggttgagagaagccctgaagttcgcaaacgtctgtggagcttaaccggaccagaaggcgctattctgcgctgccaccgacaacatgctgaccctgacaattgtgctgaagtaccctgcaccactacttgtggggtatgtgattatgaaccgcctgagcgccatgtcgatagattacaggcgtgatttcgcttgcataccacttggcatttttgttggtgcgta

SEQ ID NO: 60938 - DNA, 66 bp, Zea mays
  Clone ID: LIB3069-010-Q1-K1-A8
ccgacgcgtccggcagtatgtttatcattatgacgacgactactatccatatgcaattgtccgtat

SEQ ID NO: 60939 - DNA, 330 bp, Zea mays
  Clone ID: LIB3069-010-Q1-K1-A9
gacccactcgtccgcttgggcgtccggtactatggggatctcttttgaactgagccacatgatcctgatcggcccgaatgtctcctaaccggacgatatcatcacctcgtaccatatcctgacactgaagtggcacgctgacaagcactcgccgtcgtacaggccgtaagcctatgcgcgcttcaaggccatcagcgaggcctactacgcgctcctggaccatcaagacaacaggtgcgcgttctagctgtgcaacaacggtcgtacgggtgataggactcgcagcgccttcgctggcgcacacggctgccatggccgaggatgaggatg

SEQ ID NO: 60940 - DNA, 372 bp, Zea mays
  Clone ID: LIB3069-010-Q1-K1-B1
tgggggacggcactggtgatgttctgtcttgcgttttttaatgtgatagcaagaagcgcgatcatgctctacattgaccaccatggttttgatgtcctcgccaaaatgcctcaaggagacatccttactaatccacaataccactggaaggagttcaggttcacattcaaggaacctgccaaagatgctgaggacttctgccgcatgctggttgggttagaggaagagtgtttgcagaccgtgaagagctgcagcggttacggttgacaacccacttgcaaggttcacattctaggaaccagccaaggatgctgaaggactctgccgcatgctggttcgattagagggattttgcaacgcgtgaagagctat

SEQ ID NO: 60941 - DNA, 204 bp, Zea mays
  unsure at all n locations
  Clone ID: LIB3069-010-Q1-K1-B10
catggcactagtagatctcattgctgtattttncttgggnggaaagatcacagggaccctgggacggcacgttatggtatacaccgcaattatcctctatgcgctctctacgtcatcacttgcaatatggacttgagacatgaccttgactaaatatcatataaaatgtgaagcaatgtccatataaaatttcaggtgcatatg

SEQ ID NO: 60942 - DNA, 277 bp, Zea mays
  Clone ID: LIB3069-009-Q1-K1-F3
tcgcccactcgtgctccgactcgtgggccaggtttggctctgcaggaatgcatggttaagggggggcgggcgcgttcatgtgcctcatgagcaaccttatggtcctaatcttcgcgtcggactggacgaggagcagtctctgccggcacatccgccaccccggcgtgtgcagcgtctgcaccagcgtactcggccggctcggcaacaagggcgcggtgtccgtacggatcttgctacacggcacgagcttctgcttcgtctgctgccacctgtgcct

SEQ ID NO: 60943 - DNA, 382 bp, Zea mays
  Clone ID: LIB3069-009-Q1-K1-F4
cccactcgtgcgcccactcgtccgctttatttgagtatatgatcgagagcggatggacggggtgggactttaatatcagcgaaatggggttttctgcgtacctttgttatatggctatgtatctcatttttgtggagtttggaatttactggatgcacagagagttgcatgacataaagccactatacaaacatctgcatgcaacccaccatatttacaacaaggagaacaccttgtctccgtttgctggacttgcgtttcacccactggatggtattctgcaagcaatgccgcatgtgcttgcgctcttcctcttcccaacgcacttcaggacgcacatcgctctcgtgttcttggagggcgtgtggacgacaaacatcca

SEQ ID NO: 60944 - DNA, 410 bp, Zea mays
  unsure at all n locations
  Clone ID: LIB3069-009-Q1-K1-F5
cccacgcgtccgccacaagcgagctaggtacccggggcggaagaagagagagaagacgtgtctctcctctcggcgtccccgttccccaacctctcgtctgctgcctgcctgcctgcctgcctgcaaaaaggagtttgtcatggcgtctaagcgcatcctcaaggagctgaaggacctgcagaaagacccccccacatcatgcagtgcaggtcctgctggtgaggacatgtttcattggcaagcaacaattatgggaccacctgacagtccctatgctggtggtgttttcttagtgaacattcatttcccgccagattaccccttcaaacctccaaaggtttctttcaagacaaaggtcttccatcctaatatcaacagcaatggaagtatatgcctngacattctcaaag

SEQ ID NO: 60945 - DNA, 361 bp, Zea mays
  Clone ID: LIB3069-009-Q1-K1-F7
tcgctggggcatatcgccttagtgactcacgtttttgctccaagaaaccacctccgagcccgggcgcacatgcgctcgaggcatgatagagatagaggcggtgagcaaaactatggatgggaaagaggaggacgtgcgcctgggcgccaacaagttctcggagctccagcccatcttgacggctgctcatggcgctgctgacgactaggactacaaggagcccccgtcggcgccgctgttcgagcccggagagctcaagtcctggtccttctactgcgcgggcatcgtcgagttcgtcgtcatcttcctcttgctctacatcaccattctcaccgtcatgggcgtctacaagttcaccttc

SEQ ID NO: 60946 - DNA, 457 bp, Zea mays
  Clone ID: LIB3069-009-Q1-K1-F8
gcggtgcctgtgcgaacggcggcccctgtttccgctgttcactcggatcagcatgtggggagtggtgcgatggtggaggactctgcggcgtccacggtggctccagagtcaacttctgacgcagatcaggctatcgaggacgcagccccggaggacggggtggacgaggatacagtgacaaatgttgatgtcagtcctgaggacatgagaagcatcattgaagttatagctgacaccggaaagttctggcatgactggaggttcctcaagagtgtactgtctattcaattgaagcaggtcttggatgaatattttgaggttgaaatggtgagccaaaatgatgggcaactgaggtctttctcagagctatttagtcggctaaatggtgcccttgaaaggtttgaagagggtcctccattcacactgcaaaagctttgtgagaatttgttggatccaa

SEQ ID NO: 60947 - DNA, 168 bp, Zea mays
  Clone ID: LIB3069-009-Q1-K1-F9
cccacgcgtccgcggacgcgtgggctaggcttctccccgggcctccgactccgagtgggacacgctgttctactcgctcctgttgcgcgaccaattcgccttcttcgacgcccgctccttccaatcccttgacaggctgttcaacgccttccccctgcagaagaaccc

SEQ ID NO: 60948 - DNA, 272 bp, Zea mays
  Clone ID: LIB3069-009-Q1-K1-G1
gtccgcccgcgcgtgctcccactcgtccgctatatttgactttatgatcgagagcggatataccgtgtgtgtctttaatatcagcgacctgggcttctctgcgtacctttgttatatggctatgtatctcatttttgtggagtttggaatttactgcatgcacatacagtcgcatgacataaagccactatacaaacatctttatgcaacccaccatatttacaacatggctaacaccttgtctccgattgctggacttgcgtttcacccac

SEQ ID NO: 60949 - DNA, 431 bp, Zea mays
  Clone ID: LIB3069-009-Q1-K1-G10
cgcacgcgtggagtatatctgcctttaagtttgccagcttgggaaaccccagtggaaccgggtgatcataccaaatggggcgctgccaccacccgaactgcttatctgttgttgagaaggcctgtctgaacaccaacagctgtacaggatccatgacagacgagagcttctggaaggatttatgccctggagtcaccaaaacacttgacatcgaaacggaatgctcttactgacctactgaacacgaaccgtctcagtgtgcatctaagttccactgctagtatgcccgtcaaaattctaaaactgtagtgctagttgcacggcaatgctattgtaacctggattggaatgtatacatctgatctaggctatgtttcaagagctactttaaactaacgttagagctgagcagcatgaaatctgattaacgc

SEQ ID NO: 60950 - DNA, 425 bp, Zea mays
  Clone ID: LIB3069-009-Q1-K1-G11
ccctcactccccgttccactgctcctacactttcgaccagatgacgagaggcttgggggccgatcccatatcatagtgcctggcgctaggagcagcggcggtggtgctgctcgtagcagcggcgctgccttaccaggcatctggagtcgacgtgacgaccgtactctcggtgtatcccaacttcgcggactttgcgcgtatgatggcatacacccacgtggtcagcgagctgtcctggagatcgtgaatgacgctactgtccgtgccgaatgccaacctgccgtagtcaccctaggctttcatagctagcgccagcgccgacattgccgacgtgctgaagtatcacgttctgctggagtacctctacgcctgcgacctggaccgcctctatccctccgggaagctcgtgacgactctgtttcaaa

SEQ ID NO: 60951 - DNA, 434 bp, Zea mays
  Clone ID: LIB3069-009-Q1-K1-G12
gggcccacgcgtccgcccacgcgtccgtctacgtttccggctggccatgaggaggcgagagccgtgacctcgatccccttctcttgcacgcaggctccatgccttttcttcgtctctgcgggccgctgtcgcgtcgtgtctgcgaagaatggaggaggcggaggcatcaagcagtagtacgacttctggctaattgagcccatcatgtttagtggtgccggtagagacgacgccgtcgtcgtcgtcccactcaagaacatgggcaggcgagggagctttcgttgtgggaatcagatttgaagcggcgagaggtggtgggttgtgcttgatcggtggtgtgctcatgccttctgttttgtggctgtaggatatcaagaggaggaaagaggcgctgaagaatggtgcagatccacatttgtttttgcataattgct

SEQ ID NO: 60952 - DNA, 226 bp, Zea mays
  Clone ID: LIB3069-009-Q1-K1-G2
gacccactcgtccgctggaatgaaagatactattgattgtgcatgaagtcttgtcccctgtgatagcacacatgtgctggaatgaaagatactattgattgtgcaaaaattcatgaaaacttcttgctatccagaaaataatcgatttcatacatcaatcataacacgtatcatatttcttatttaaaaaaaaaacacaatacaaacatttaaatacaacccacca

SEQ ID NO: 60953 - DNA, 416 bp, Zea mays
  Clone ID: LIB3069-009-Q1-K1-G4
gcagatgcttcggtttcgtgagctacgactctcctttctccgcgcaggcagccatcaacgtgatggtcggctaccagttaggcggtaaaaaactcaaggtacaactgaagagagaaaacaacaccaagcacagtagtaaaccgttttgacagacaaggcagcagccgtccggtacccggtacatattaattgaccatcaacacattgcatcagcagccttcatggcctggggagggaagagacccgtgtaccccctctttgttcaccttcacattcttggagattcgtcagtcagctcagctcgtgtaattcattgcagcagccataggccgtagcagcagtctgtaccatgatcaggatcacttgtacacatgattcattcaattgttactgacagccgggattttcattctaaa

SEQ ID NO: 60954 - DNA, 383 bp, Zea mays
  Clone ID: LIB3069-009-Q1-K1-G5
cggacgcgtggggcgatgccgagcttcctttcgtcgggcgccgtcaccatctgcgagatgaaccgctacctcgttgcggcggatgccctctccgacgaccgcgccaaggacgcatatggggatgtcctcgggatggtgttcgccccgattccgttccagccggaggctcttcttctcgccagccgcgagcctgctgctcctgccgcggaccaagtcgagcctgctgacactgtgcccaccgctggtttggcagccaccatatccgacttcttcaggctgatggtcttccctccactagacccaaatctgctagaagaatttgacactcagaaagtaagttggtacccatacaagcatttgctagcattcgtgtctgggaagaa

SEQ ID NO: 60955 - DNA, 344 bp, Zea mays
  Clone ID: LIB3069-009-Q1-K1-G7
cttgaggaaaccatgctctgctcccaagttgaaggagatgacacgaagcggtatatttggggctgttggcgagggtgaagaagatgaatccgtcaatgtctctgcaacttccgtccggacggctccaaagaattatcaggcaatcagtactataagccacatctcatttgccgaggaagaaagcatctctccaaagaagccaacttcgatagcagaggtcgcaaagcagcgcgagctaatcggcacgcttctgatcgaggacgacagcaagatgaagaggcagatatcggacctgaaatccaaggagctgagcggtcactacatctttgccccttcggaggatc

SEQ ID NO: 60956 - DNA, 404 bp, Zea mays
  Clone ID: LIB3069-009-Q1-K1-G8
gacccactcgtccgctgactcttgcgtgcctcgagcacgacctttggcctgcattgccgtggcggcggttgcgctcctctcgccgacgctcggagcggagatggtcgagcggcagttcgtggagtgggtgcgctacatgggcggcctacggcacagcacgttccatcagcacgcgctggaccgcgcgtgcacatcgtactcgctcgtcgtcgacgcgaaccctgcgttcggagacttcacgaccatagatgccgccgtcgactcgctcccagacatgaacctcgtacgcgtcgccatcagggtcaaccgcagcacctacactgagaaggtgagcatcttagcgatgcgcgcgtgcatcaccgtggatggcgccggagcggacagcacgatcgttcactggggcg

SEQ ID NO: 60957 - DNA, 433 bp, Zea mays
  Clone ID: LIB3069-009-Q1-K1-F2
tcgcccacgcgtccgcccactcgtccgcaaactttcttggagaagtttgataaaggatctggggatgctgctattcaacaagtgaattgggacacctcaaaagtgaaggataagcttagacgtgacattgaggctcatgtagcttcagttcgagctgctaaattatctgaactttgtgccaaatatgaggcacaacttaccaaagctctggcggaaccagttgaatctcttctagattcagccagtgaagatacgtggccagctattagaaagcttcttcaacgcgagacaaaaactgccgtttcaggtcttcaatctgctgtgtcagcttttgaacttgatgaagcaactgagaaagaactgcttgtgaaagctgtagaagcatggaatgaagtgtgttgagtcataggcaaaagaagaagctggaagggtt

SEQ ID NO: 60958 - DNA, 417 bp, Zea mays
  Clone ID: LIB3069-009-Q1-K1-D7
cccgcgcgtccgcccacgcgtcctcccactcgtccgcccacgcgtccgattttcgactagttacgcgaagggaaatggcgaccgttccaggggatctgatctggcagattgtgaggaagaacatctccttcctggtgaagcagtttggcaacggcaatgccaaggtgcagttcaccaaggagcccaacaacctctacaatttacactcctacaagtactctggcttagcaaacaagaaaactgtaacgatccagccagctgctggaaaggactcggctgtggtcctctctactaccaagaccaagaagcagaacacacccgcgaagctcagccacaagtctgtgatgcgcaaggagttccgcaagatggccaaggctgtgaaaaaccaggttggcgacaactattacaggcctgatc

SEQ ID NO: 60959 - DNA, 392 bp, Zea mays
  Clone ID: LIB3069-009-Q1-K1-D8
gacccactcgtgcggtcggcccttttttttttctttttcatggttaaagaacatcagtttctcatcgggtatggaacattacattagtttcccgtgacaaaaaaggacatgagggaaaaaacgatgaagatacaacaagaaatcgaaaccttctcatgctgttagattggttaactgacctacacaatttgtcaaacaactcaaccaagcactacgtgagggccttattatacaagtgtgttcaagcacatataacagcttgagcgactagaatcatgcgcgagctcatctctaagctttgagctctttattcatctaccctccaccgtgtgtatgctatctatggccagcatatagtggcagtaccgtatgaatgtgcgtgcatgccatac

SEQ ID NO: 60960 - DNA, 391 bp, Zea mays
  Clone ID: LIB3069-009-Q1-K1-E1
tccacgcgttcgcccacgcgtccgtccactcttccgtaaagaggggcacaagcaagagagggattgggagttaggacacatacgctagagagagagagagagagagaggtggtggccggtgggacgtccgtggtggtggtggagttggatcggctgtgcttgttcctcgcttcttgctggatcagaggaggtcatgatcaactaatgcctattcatttattatggacttgcaccagttgttaaagtacagattaactggtgctaacgtctactacgaatttcctacagagaacaacttagcaaacactccttggccagctagtccactgaagtctgagttcagcagctcatcatacactcctcttttatcccagcttgagtgtgataattt

SEQ ID NO: 60961 - DNA, 428 bp, Zea mays
  Clone ID: LIB3069-009-Q1-K1-E10
cgcctgtgaaagttcggagccgccttcccgttcgcctccctctccgcctcccgtgcccaaggccaatagttttcaagtggcaatggcggaccaggctaaccaacccactgtccttcataagctcggtggccagttccacctgcgctcgatcatctctgaaggtgtacgggcccgtaacatatgcccatctgtctcatcttatgaaaggagatttgccacaaggaactacatgacccagagcctttggggcccttcaatgtctgttagcggtggcatcaatgtcccagtgatgcagaccccgctctgtgctaatgctcctgctgagaaaggaggcaagaacttcatgattgatttcatgatgggcggtgtttcagctgctgtttcaaagactgctgctgctcccatcgagcgtgtgaagctgcttattc

SEQ ID NO: 60962 - DNA, 376 bp, Zea mays
  Clone ID: LIB3069-009-Q1-K1-E11
atcaggcttctcatcgccaccaatgtgccactttcgaggtccagaccccgaccgtcgtggcgggcgaggaagcgcccgtggtggagaccccgccgccggccgtcgtgcccgaggagtctgcccccgccgaggccgaggccgaggccgaggctgctgctcctgctgatcccgaggagcttcccgcggccgagcagcaggcagccgccgaggcggaggccgcggctcctgctggtgccgaggagcccgtcgcggccgaaccggccgccgaggcggaggctgctgctcctgctggtcccgaggagactcctgcggtcgagcaggatgcagccgccgaggaggaagctgctgctgctccttctgctggtgccgaggagcc

SEQ ID NO: 60963 - DNA, 255 bp, Zea mays
  Clone ID: LIB3069-009-Q1-K1-E12
gcgcttttactctagaagaagacaccttctcatattgcacttacattagaggcggtatgtgttagggaggtttttccaccaaaagttcttaatttcaaaacctttgaagaggcaatcaaagggccaggagaatttctcatgagtgatttcttcaagttcgaccgcccaccttttgtgcatttggcctttcaagctttggacaagtttatgactgaattgacacgatttcctattgctgggtcaacttatgatgtt

SEQ ID NO: 60964 - DNA, 396 bp, Zea mays
  Clone ID: LIB3069-009-Q1-K1-E2
ggagctaggtggctttaaactagaccaactcatggattgacatccaaatttgtcttgcggagacggaatctatgcggtttaggcgtgcacccatatcctcaaccaccctagctgggctcagctttcttctatgcactactttgatccctggtcgttactgttacttgaggtggttttgatttgtttgggtgtggtcgtgttcttttgctcctggtgcatttgcaatcttctgacctgtgaggggcgtgttgtttgtattacattcttcttaatgcaatgatgtgcatttctcccgtgtatttgagaaaaaagtataaataagatgggaaataagatacctttttttgttatctttcccaaaagtttttttttcctgagaaacggaatagctgtatt

SEQ ID NO: 60965 - DNA, 338 bp, Zea mays
  Clone ID: LIB3069-009-Q1-K1-E3
cccactcgtccggggaaaaccatatggatttatcctactggataccttccgggtcggatggcacctgttaagaacttttttggactgatgtcttttgcatttgtcgtacttgggatctattggttttatcagtatatgaagtcctggagagaggttcttccacttcagaactgtattactcttgtgattacactgggcatgtttgagatggcattgtggtattttgagtatgctgaatttaatgagactggagtacggccaaaaggcatcacattttgggctgtcacgtttgcgactgtcaagaggactgctgcttgaattattgttctgattgtctc

SEQ ID NO: 60966 - DNA, 403 bp, Zea mays
  Clone ID: LIB3069-009-Q1-K1-E4
ggagacgagatctgttgacgaagcaagctatgcattgtccctggatggcattatgttcgaatgggcaccggtgcaggttagaacgccaacatactacaacccttgcattgcagccgtactgggcccaagccagcctagccccaatctgaatcttgctgcagttggcctaacagcatgatctaatggaggactagaaggtccagaccgtatttttgtgggtggcctcccgtattacttcactgaagcgcaagttcgggagttgcttgaatcattcggtcctcttcgagggtttgatcttgtgaaggatagggaaactggtaactcagaaggctatgcattctgtgtttaccaggacctcaccgtcactgacatcgcttgtgctgcactaaatggtatcaagatg

SEQ ID NO: 60967 - DNA, 425 bp, Zea mays
  Clone ID: LIB3069-009-Q1-K1-E7
ggaggaaaggcaaccgctacgactggaggttaccattccgagaggaagattacggcgaggacgccgctggctttgcggcaggtggtcgaggcaatggataccgcagccgcaggagcagcagcaactattatgaggggagaaggaggacgagcaactaccagtcaagtgtttctaacaattttgctggtgctgcctcaactggtgttggagctgacggtaacaccaagagcagcagcagtggatatggaggatgggatgagcttctggacaacgacactgctgctcaggagacaaagaggaggagctcattctcagctggcaccactgatcaaagcacaaaatcgcagccttcagcgactggggaggaagatgcagattatactgccactcctttaacaagaacgagaatgagacgacggcggacg

SEQ ID NO: 60968 - DNA, 321 bp, Zea mays
  Clone ID: LIB3069-009-Q1-K1-E8
gcgcccactcgtccgctctgaggcccttgaggtcctggcggcgctcgagaaggactgctagggggtcggtgctgagttcgatgagggcgaggatggcgacgagggtgacgagtactagagaagtttgctgatgacgcagcatcaggccagtgtgctgcccttatcccgtgatctgccgagagttgctcctgctatcgtgttatgtgtgtctgttctgaagtattgtgtggtttacaacacctgatgttgtaagagttgttaattcccctgcattgctaccgggttattgagaataattatggctgtttacgttgttgcttc

SEQ ID NO: 60969 - DNA, 433 bp, Zea mays
  Clone ID: LIB3069-009-Q1-K1-E9
aggacgcgctcccgtcgttcccgctttcgattgcggcggcggtcatgaacggtggctgcgggctcatcgtggacccagcctctggtctgccaaccgcgctgtcatcagctgcggcggcggcaacggccgtgtccggcggcagcaccacggagaaccccatcctcacggcgctgttcaaggagatggtacgcgcgatgctgagcgtcgtcggcagcggcggtggcaccacggcacttcaggggctggagccaccgccccctatcgcgggggtgccgatggaaggggagaagtggcggcagcagcggatccgggagctggaggtgtacctgcgtcggatggacctgctgcaggaccaggccagggcggcgctggaggaactcaggtccgcgccgcacgccgggggcatgaacacttgattgtcttgggttcagca

SEQ ID NO: 60970 - DNA, 428 bp, Zea mays
  Clone ID: LIB3069-009-Q1-K1-F10
ggctcctctcccccgttgcgcaattcgcttttccccacttcacccgcctcggcggcatggggaagctcgcgctggcgctcctgctcctgctggccgtggcggcgtccgcgtcggccagcagcagcagccacctggatctcgacctgcgctccctgtgctctggagaccgtcggagggagtgccgcgggacggtggccgagtgcctcgccgaggagtcggatgaggagggccttgacctgcccggatcccaccgccgcgcgctctacggcggcgggtacatcagctacggcgcgctgcggcgggacaacgtgccctgctcccgccgcggcgccagctactacaactgccagcccggcggccaggccaacccctaccaccgcggatgctcccgcatcacccgctgccgcggctgacgcggctacggatcc

SEQ ID NO: 60971 - DNA, 405 bp, Zea mays
  Clone ID: LIB3069-009-Q1-K1-F11
cccacgcgtccgccgacgctcaacctgcacttcgccacttcacacgccttctgaccgggagtgagatctctctagcgctccttgtcctgcttgacttgccttactcagcatcatccaagaccactagccacctagatctctacctgagcttcctatcctctggagaccgaccgacatagtgccccaatacgaaagactattgccttagagacaaatcagattacgagagccttgtcctgacctgatcccaccgtcgtacgctatacagcctcgagtacatcaactactgcgcgcttcaacggaacaacgtgccctgctcccaaacggatccagctactacaactgtcaccccggcggccagaccaacccctaccactcgagaatgctcccgcatcacccgatgcc

SEQ ID NO: 60972 - DNA, 436 bp, Zea mays
  Clone ID: LIB3069-009-Q1-K1-F12
gcgcaggaagcaagtgcacactcccactttccctctccactcccgcgcgcctcgcccgcgaccggggcctgtggtggtggaggcggcggccatggcggagctgcggcactcgatggcggtgcgctcgtccaactcccccgccaagcgcgattccgacaccttcgcggcgttgtcccccttcctcctgtccccctccacccgcggcagccgcggcggcggcggcggggacgacgacggcaaggacgctcaccgctcgtcccctctcctctcgcatcaccaccacaagcgtgtccacctgctgacgtccccgttccgctccctcctcgcactcgaggaccccaggtcctccgtcgactcgtcctcctaccggatcctgcttgctctcctcgcgctccttctcgccgctgtgatcttctgcgcgcccttgttctggtcc

SEQ ID NO: 60973 - DNA, 446 bp, Zea mays
  Clone ID: LIB3069-009-Q1-K1-D6
gcgcccgctcgtccgcccactcgtccttatttttcggtttgcttgtagggctctcgggtctggtcccagatacgctcatgattggcatggagctcagggacaaggtaacggagtatgtgaaggagaggattttagctctaagagcggcaaacccaggacagtatgataacatatccgttgtccgcacgaactcgatgaaatacattccaaattacttcagaaaggctcagctcaccaagatgttcttcctgttccccgatccccacttcaaggagaagaaccacaggaggagggttatcagcatgcagctgttagacgagtatgcttacgtgatggaagtgggaggaatcatatataccatcactgatgtcgaggagctcggagagtggatgctgtcgtgtctagagaaacacccgttattcgaaaccgttcctgaagaagagatt

SEQ ID NO: 60974 - DNA, 192 bp, Zea mays
  Clone ID: LIB3069-006-Q1-K1-A2
cggctagacccacgcgtccaccgacacttgcaaacactcgtccgccttcacgtttttgaactcataagtggaaccctgatcatgtggtccatcttaccgttcttctcttatgccatcgtaccatggaaccgccctcttgacaacttgactatccacatgccttaacgagccaacagcaacataaacggatac

SEQ ID NO: 60975 - DNA, 439 bp, Zea mays
  Clone ID: LIB3069-006-Q1-K1-A3
ggcattaccgcacgcgatccgcggacgcgtgcggacagccaagacacttgtggtttctggcaccatgtactatctcacgattgaagtgaacgatggcgaagtcaagaagctctacgaagctaaagtctgggagaagccatgggagaacctcaaggggctgcaggaattcaagcctgtcgaagagggtgctagcgcctaaagatgtctccttctccatgtgcgagcctgaagctcatagcaaagttgcagaataaggagccatgctcccttgtgtaatttcataagactacaaccctattagggcttcgttggttgtgtctgtatcgaatggaattgaaggtgattaattatccttctattctaataaagggcgtttaatctactacaatactcttcaatccacacctaaccgaacaagcccttaatatgatatcttaca

SEQ ID NO: 60976 - DNA, 422 bp, Zea mays
  Clone ID: LIB3069-006-Q1-K1-A4
gcgtccgtcggcttctagcaatgctgaaagactttatgttctttctcaaagaaaaagaagaagagaaatacaggcaacttgagaataaaaagatacagactctacttgtaaagaggcatgagaattcaataatgttaaggcccaacacaagcttcagccgtccatcaagcagaggcttcaatacgagtcctggctccacatccatctggagcagccaagtttctgcaaaagttcagctgcctgactcagagaactccccagctgaaaaagatatgcgtgcaaaaataattaggaacagaggtacgcagggcattttgggaaataacagaagctgttcaatctctcatgaagataaagcagaagtctccacagtgaatcaaggcatttcaccaatttaattttttctcactttaaatttctac

SEQ ID NO: 60977 - DNA, 267 bp, Zea mays
  Clone ID: LIB3069-006-Q1-K1-A5
acccacgcgtccgcgtagtctttgggctaatgtatgaagttctgctcgagactgcacccagagcacattggtacatttgaatcagttgctaaccaataacttcaccgaactcaaacttctcgtacacatttgcgttctaaagacgatcctccaataatcctctcactaaatcatcaatgcctttaagcacaaaactctcttgtcctctatcactgtgctgatctacggtcttcaaacaaagaacattctcactcaacatacaatgca

SEQ ID NO: 60978 - DNA, 188 bp, Zea mays
  Clone ID: LIB3069-006-Q1-K1-A6
agcgcgactgccgtactttttaattttttttttttactttttttttaggcccttcgctcattttaaaaggtttttagactttaaatttatttaattcatatttttttaaaaaaataaagtttttttaaacagaaacaagattctttaaaaaaaaccaccataacaacaaatttccaaaaaccaccaaa

SEQ ID NO: 60979 - DNA, 375 bp, Zea mays
  unsure at all n locations
  Clone ID: LIB3069-006-Q1-K1-A7
gttactacggtgctttgttgttttgctcttggagtgcggatggcgaatattggttatcatgtggtgaagatgatcttgtgcaagtatggagcatggatgatagaaagatagttgcatggggtgaagggcataattcatgggttagtgcagtttcttttgatccgtattggtccccaccaaattctgatgaaacggaagaaaatgtcatgtatcgctttgggtcaattggacaggatacccaactgcttctctgggatctggcattggaagagattgctgtccctctacgccatccgtctggtggctcaccgacattcagtagtggaagcccatctgcacagtgngataatgcgtgcccttcagccggtgttctac

SEQ ID NO: 60980 - DNA, 440 bp, Zea mays
  Clone ID: LIB3069-006-Q1-K1-A8
cggctatccccatcaacaactcaaatttctaaaccgctcgctctggtccagccatatgcacagtcgccatcgcccccacctctcgtcgtcgtctccgtgcaccactcggcccccactgtcggccgcgcctcccagccacctcgtgccgctctgccaccccgcccgtcctccactgcccctatggctgccatgggcgagcgctgcccgagtagccgaccgccctttccccgccgtcttcagctgccgcgcgctgccccgcctacccgccaggcctccactgcccacttctccggcggctacagcggaaggcaaggagaaggacagcgggcagcggtagctggatctagcaagcacagggcgtcttctccatccgccacctctcggcgcatcatcagctgacagtttcaggcatttgctcaagtgttttcatttcataatat

SEQ ID NO: 60981 - DNA, 392 bp, Zea mays
  Clone ID: LIB3069-006-Q1-K1-A9
cccacgcgtccgctgagctacaccatcatttttatggagcagcagaacaccaacagcaaggagggggtggaggtgctgcagcaggccccgttccacgaggatgccaagcttggcaagggccacttcacttccaaagtttatcatctgcaaaggtttggtttttatcactcgatgcgatgcacagatacacagtaatttttttttacctactttgtacagttttatatatataaatgaatctaaagctgtttcagaagcataattactcgatcaggcttctatcgaatacatgaatgcttgttttttttataccaaaattgtataaggaaccttgacttaaacagtcagattatgtgcagcaagattccgtcatggatgaagggctttgcacc

SEQ ID NO: 60982 - DNA, 215 bp, Zea mays
  Clone ID: LIB3069-006-Q1-K1-B10
acattacaaaactacatactccatacacacgcactactaatcatattacaaaccattttactacctatcaatattcatatatacccccgacacttaccatccctacacttacatactacactttgaccttcagaccaccctacatacatcacatctagacaacatactctatgaccccctcaatactttctactaaatacacaattaaattcccc

SEQ ID NO: 60983 - DNA, 300 bp, Zea mays
  Clone ID: LIB3069-006-Q1-K1-B11
caatcatcacattttccttataactcactcacactatcacatcgaaaagttaacttaaaaaaataccacgacctacctcaaattaagctaacacattcttcattcaaccttcaccaaacattatataaaccaaaaaacttcttaccatgtaaacactatatcacaccaacatccatattcacacaatcaccttcatcatctttctcacttcaatttcattcacaatacttttaaccttataactacctatataccccttaacaacaacactcacatctcttaaaatatttcacatataat

SEQ ID NO: 60984 - DNA, 303 bp, Zea mays
  Clone ID: LIB3069-006-Q1-K1-B12
tcacaggccttccctatttcaacaactcgcatagattatccacaaaacatgctctactgaatgctagcctaaatatactaactatcatcaataatccaacacatgctgctatacactatcatctttacaagaaaccaacccatgtcacagagaagcatcatctcattttcaaccctctactatgctcctacgatatcatcctacttacaatctaactaaatatcttccaagtcaatatcacaactacctacacccatctctttcatccagactctgactacagactggttaaccactacttcc

SEQ ID NO: 60985 - DNA, 432 bp, Zea mays
  Clone ID: LIB3069-006-Q1-K1-B3
gagaactgctggtaaccctaacatagtctaggattctcctgcaccatcagcaggatcgcgtggtggcaatgacagtctatcggggggaggcagcagcggaagcattggtaacaatgggggttcctctccgtcttctgctggagtcattgtaggctcagtggttggtacagtcgttggactaggccttgttgctgcattgggattttattgttacaagaggaaacagaagcctttcggaagggtgcagagtccacatgccatggttatccatccgcgacactcaggttcagatgacatgggtaaaaatcacagttgcagggggaaatgctaacgatggtgctcgcgcaagcgagacatatagccaagcgagcaatggtccacgggacatccatgttgttgaaagtggaaatatggtcatttcaatccaagttc

SEQ ID NO: 60986 - DNA, 256 bp, Zea mays
  Clone ID: LIB3069-006-Q1-K1-B4
cggggagatagagagaggagagggagttattgcttatagagaacctgaacccaaaccgaatcagggaacactatcgttacctcaccaaggcaggcgtgcatgccagcagccatggcgatggcgtacaagatggcgacggaggggatgaacgtgaacgatgagtgccagcgctggttcatggagatcgaagtggaagaaggtgcaccgattcgtggtgtacaagatcgacgagctgtcgcacgccgtgctagtggac

SEQ ID NO: 60987 - DNA, 411 bp, Zea mays
  Clone ID: LIB3069-006-Q1-K1-B5
cggacgcgttcggataaatttctgattttgtctcaaatgagcttggagaggagatttgcccagttcagtgtttttctagcctctactctgatggaatatggtggtgttccacaatctgcaactccagagtctcttctgaaagaagctattcatgtcatcagctgtggctatgaggacaaaactgactggtgaactgacattgggtggatctatggttctgttacagaagacattctcaccggattcaagatgcatgctcgaggctggcgatcaatctactgcatgcctaagcgaccagctttcaagggatctgctcctatcaacctttcggatcgtttgaatcaagtgcttcggtgggctcttggttccattgaaattcttttcagcaagcattgtcccatatggtatggc

SEQ ID NO: 60988 - DNA, 412 bp, Zea mays
  Clone ID: LIB3069-006-Q1-K1-B6
cgcacgcgtccgcccacgcttccggtttcacccggccagcctccatcgctggtaccagtcctagtcccaagtcccagccttccatcgacggcgagggagggagaggcgacctccatccgggctggttagattcatcgcttttcttgtcgctgtccctcggcctttccccctactgtgctccgagtctgggagaagcgactcgcgcacgcgctcggccaaaccaattaagcacagagcggggctctcgggcgagaacgcgctgaggcagtgctgggtttgcagttcgtgccgtagcgttttttttgtgtgtgtgccgaagcgaagaggcgatggctgcgccgaggaaggtgacggcgacgccgctgggcaccgtgttctcgccggaggagacgaagagggccgtggcgagggt

SEQ ID NO: 60989 - DNA, 335 bp, Zea mays
  Clone ID: LIB3069-006-Q1-K1-B7
ccgactcttccgcccacgctatcggatccacccggccagcctccatcctggtaccagtcctatttccaagtcccagccttccatcgacggcgagggagggagaggcgacctccatccgggctggttagattcatcgcttttcttgtcgctgtccctcggcctttccccctactgtgctccgagtctgggagaagcgactcgcgcacgcgctcggccaaaccaattaagcacagagcggtgctctcgggcgagaacgcgctgaggcagtgctggatttgcagttcgtgccgtagcgttttttttgtgtgtgtgccgaagcgaaaaggcgatggctg

SEQ ID NO: 60990 - DNA, 448 bp, Zea mays
  Clone ID: LIB3069-006-Q1-K1-A12
ggcaaccatgaatgcgttcattaaatcgcatctatggtttttatgaggagggcttactcagattcagtgtaaagctgtggaaaacattcactgactgctttaactgcttgccagtgtcagcattgatagacgaaaagatcctctgtatgcatggcggtctatctccagagttgaacaagctcgaacaaatacttaatctgagtcgccccacagacgtgcctgatactggattgctctgtgaccttctttggtctgatccttctaatgaagcaacaggatgggccataaatgatcgaggtgtttcatatacatttggtcctgatagtttctgaattccttgagaagcatgatttggacctcatctgccgagcccatcaggttgtcgaagatggatatgacgttttcgctagccgtcaactcgtaacaatgttttcagcccctaactact

SEQ ID NO: 60991 - DNA, 255 bp, Zea mays
  Clone ID: LIB3069-006-Q1-K1-B8
cgcacgcgtccgcccacgcttccgcttacataggtttagctccatcaccgacaccagacctatttccaaggcccatccccccatccactgcgacggatcaagacgcgacctccaacccaactggttagactcataccttatcttgacactctccctcgaactctaccactactgagctcctaaccttctagaaaccactaccgcacccgctctgccaaaccaatcaaacacaataccgagctactcaactagaac

SEQ ID NO: 60992 - DNA, 380 bp, Zea mays
  Clone ID: LIB3069-006-Q1-K1-B9
tcccaggcgtgcgcaccttgatggttcaactttcgttgttgaggacattggccgtcagctggtgaggtatggacgaagaattcctacccccgagctttttgcaagaatagatgctgttgatgcaagcactgtgaagcgtgttgcaaaccgcttcatctttgatcaggatgttgctattgctgcgatggggccgatccaaggacttccagactacaactggttcagacgccggacctacatgctccgttactagattaatcagccggtgtacccatgtttaccgtctgcaaaagacaagataaaatttgcctcttttagcgtcagtatattaaggcctcagcactgcacattacgtgctgcgatggaggaaatttttgaga

SEQ ID NO: 60993 - DNA, 347 bp, Zea mays
  unsure at all n locations
  Clone ID: LIB3069-005-Q1-K1-G9
gcgtacgcccgcgcgtacgctccactcatcttttcgtttttagaacctctaaaatttcccccgctcggcagtctcagcagcacctgtagccatggacgccagcggagccggtagcaaggggaagaagggtgcggccgggcgcaaggcaagcggccccaggaagaagtcggtgacgcggtccgtcaaggccgggctgcagttccccgtcggccggatcgggcgctacctgaagaagggccggtacgcgcagcgcgtgggcactggcgcccccgtctaccttgccgncgtcctggagtacctagccggcgaagttctggagttggcagggaacgcggcgaaagacaaca

SEQ ID NO: 60994 - DNA, 358 bp, Zea mays
  Clone ID: LIB3069-005-Q1-K1-H1
ggccgaccccgcgtacggttgggttcttcatggtagatggttgagactttggctttggtccattgaatattccaacttgggcgcgcacaaactagtcagctgatcaacatggaatcatcaccttggtttgccctttggagtgcttgtgcagcaaaagaagtatttttgtctgtgaatgtgaaacaaaggcatgaaacacgatgggctaaagctggtcatctcttggctttagcacaactgtgtttgccttagaaaaatggctttgttctgagtgtgagtgcattgtccagtagccctttggtctgtgaacgcattggtgataatgtgaccatctgcaagaataatgcctggaaaatta

SEQ ID NO: 60995 - DNA, 378 bp, Zea mays
  Clone ID: LIB3069-005-Q1-K1-H10
ccggcccgacccacgcgtccgcccgacgcgtccgcccacgcgtcctcaccttctgatcacggagtgatcaacttcgtgaatcctaatctgggtgcaaatctgagtttgacaatcctgctagataattatagtgttagtgaaataagcataagttatgcgacattaggcatcataaatttttatgtatgtgcttaatttggcaaggaacaaaaatagtcgggaagaggactttgtgcagatgggagagcttcagtatttcagcaatatttttcgatggacaaaaaaaaaaattaaaaagtataagatatggattggtaaaatatcttggaataggatagaattgcccaatttttggaaattaatgcttgtactcattag

SEQ ID NO: 60996 - DNA, 313 bp, Zea mays
  unsure at all n locations
  Clone ID: LIB3069-005-Q1-K1-H11
gcagttgcttcagagagctaccgccaccatctattgagctactgcctctgaccaagtccggggctgcgctgcgcctgctatgtcgtcgtcctcgcccgtatcggcggtctcatcagccactgcgccgcacgtcgtggacgactgcctcggcatcgtgcagcttcttagcgatggcaccgtgacgcgctccgcggactactccgacatccctctcctgggcgaggtgccgtccaacctgcccgtccagtggaaggacgtcgtctacgaccccgcgcacgcggctcgnnctcgcatgtacaggcccaccgacacc

SEQ ID NO: 60997 - DNA, 295 bp, Zea mays
  Clone ID: LIB3069-005-Q1-K1-H12
acccacgcgcgacactggcaatcaaatctatcgctcgtcgctgttcacacgcacgctcagccgaactggtgcgtgcctctcccgcggtgcctggcttcctccaagctcgcccccaaccacaaccacgccctgatccgcgctccagccctccccatcctcctcttgctatggtgcccagctcgagctctctccccttactgccatggccgacgcccctccctgctgcagctcgatgccctaccctgcagcaagcagtgccctaccctttctgcagcaagtgggtgcccccggaccc

SEQ ID NO: 60998 - DNA, 341 bp, Zea mays
  Clone ID: LIB3069-005-Q1-K1-H2
gcgctgcagtgaaccttggggcgcctgttggtttcagaagccgcgcatcgtcatgggcgccatgcgcttcgacaacttcatcatccaggccggcaccgacgcgtcgctcgtgcccaccgacatggccaccaccaactccaccgtcagattcacctaccgcaacaggggcaccttcttcgggatccacgtcaccgccgacccgttccagctctcctacagccagctgacgctcgcgtcaggagacctccacaacttctaccagcctcgcagcagcagccgcaccgtcagcgtcgccgtggtcggcaacaaggtgccgctgtacagcggctgacccacgctga

SEQ ID NO: 60999 - DNA, 440 bp, Zea mays
  Clone ID: LIB3069-005-Q1-K1-H3
ccaggcgtccgcccacgcgttcgaagcaatcaagctgcggccggagcatcttggagacaggaagaatgggtggtagtaggtgaaaccggaggcggcaggatagggagagggagcgagagtagaggccacgcctgcttgacagcaaggcccgtgcgctcggcggcggcggcggcggatatgggcgactctggcggctctgttgtgtcggtggacgtcgagcgcatctccttcggcggcaaggaacatcatattcaaaccaaccatggatctgtatctgttgccatatatggtgaacatgataagcctgctcttattacctacccagatattgctttgaaccatatgtcttgctttcaagggctactcttctgtcctgaagcagcttcattgctgcttcataatttttgcatttaccatatcagtcccccatgacatgagtt

SEQ ID NO: 61000 - DNA, 234 bp, Zea mays
  Clone ID: LIB3069-005-Q1-K1-H4
ctggcgatggcgtagacgatcgtcggcaactccacctcgatccaggagatgttccggcacgtcagcgagcaggtcacggacatgttccggcgcaaggccttcctgcactggtacaccgattagggcatggacgagatggagttcaccgaggccgatagcaacatgaacgacctggtggccgagtaatagcaataccaggacgcgactgcggaagatgaggaagagtacgaggag

SEQ ID NO: 61001 - DNA, 431 bp, Zea mays
  Clone ID: LIB3069-005-Q1-K1-H5
agcaaagcacgctctggagaaatccttcgtttaccttcaccagttgaccgcactagtggccgtcgtccgaccacgatgagcacccgcgcggcaggatccgccctcctccgccacctgggtccgcgcgtcttcggcccagttttttctccggcggtcgcgccgccgaggccactgctggccttggccggcggcggggaacggggcggggcgctcgtgtgggtgcgggtgcggctactgtccaccttcgtcgtcgaggcgaaggaagaggtggcggcgtccaaggggaactcaggaagcaccgcggcggcgaaggcggaagcggtggaagccgctaaagagggtgacggaaagagagacaaagtggtgagcagctactggggcgtcgcgccgtcgaagctgatgaacaaggacggcgccgagtggaggtggtc

SEQ ID NO: 61002 - DNA, 408 bp, Zea mays
  unsure at all n locations
  Clone ID: LIB3069-005-Q1-K1-H6
ctggagtgaagctttcatcatttgtgatttatcatttatgcaacttatgcattgtgtttgattgttgatcatggcaccttttcactgtgtatttacatcaatggttgttccttttcaagtctagcagctgtgctcacgcaacttcgtattatttgttcataataggttgagggaagttgaagcaaaagtctaacaaaaaatgttttacgggggatatgcttaccatggcaactcgtttgagcaaacatactctttgttatccagcatcgttttttgataagccacacctggaaggcggcgataaagtaataatgccaccttctgcccttgatcgtcttgcttccttgcacatcgagtaccctatgctnattgagctgcacaatgatgcaacccaacggatttcacact

SEQ ID NO: 61003 - DNA, 449 bp, Zea mays
  Clone ID: LIB3069-005-Q1-K1-H7
cggacgcgtggggttcaagaacctctcggtttaggccaagacggccatcctgctgtaccacgccgtgccggactactactccatgcagttcctcaagtccaacaagggcaaggtcaccacgctcgccaccaccagcgtcgccaagaaggactacacctacgaagcggagagcaaggacgacaccgtcacgctcgacaccaccgtcgtcacctccaccatccaggccaccgtcagggacgacgacccgctcgccgtctacgcttgctccaagttcctgcagcctaaggagctgttcaaggccaaaaccgctgatctcgcgcctgcgccggctccacaagggcccaagaagaagagcaagaagaagcccaccggcacttcggcggccttcgcgccctcggacgatgaatctgcagatggcccgtctgccgacgacgacttgttcgatgatg

SEQ ID NO: 61004 - DNA, 338 bp, Zea mays
  Clone ID: LIB3069-005-Q1-K1-H8
gatcgcgtgatccgaccttcttgtccttctatctgttgattctgtggatgccgggaaccatgcgaagctttcggtgatagtgtccacaggagcattaccctgtaccgaaactgatctttataacttaccaccaatgctcgaacatgttgctggttgctggtatttttagcactgttctctctggctaatgggtctgaagacatctcaaggggatatgtggtgcaatctgagttctttaaagggcatttgcacttgtggatgttgattgtggtgcaaccttggcttgctataatttttagataccgtttagttgactagcattagcacgctcaaatgca

SEQ ID NO: 61005 - DNA, 287 bp, Zea mays
  Clone ID: LIB3069-005-Q1-K1-H9
gacgcacgcgtccgcccacgcgtccgcccactcgtccgtccacttttccggccgcctgtcccagatccagagaaaggcataacgggcgtggagccagttgggccagggaagatttaaccagtcgggcccggaaggagcctaagggttggatctgatgctaccaggtcgctgagcatcgctacggaagggggcagcttctgattccggcagatggctcctgaaatgatggaggaggggcaatcagctttctataccggggatgacgctctcttgtcatcaggttttgg

SEQ ID NO: 61006 - DNA, 434 bp, Zea mays
  Clone ID: LIB3069-006-Q1-K1-A1
cggcgaccccgaggccttcgccgagcttaggtgaaggagctcaagaacggccgtctggccctgttttccatgttcggcttcttcgtccaggccatcgtcaccggcaagggcccgctcgagaacctcgctgaccacatcgctgacccagtcaacaacaacgcatgggcctacgccaccaacttcgtccccagcaactaagctcaacggctatgctatgcaacttcattgtctttcggatcggagagggtgtacgtacgtggattgattgatgctgcgagatgcatgtgtgtcttttgtttcacgttgcattgcataggcaagtcgagatgatgagttggcgttgtacactaagatgaaccatgtttgtgcaatagtggtgggttttgtttcctgcttgttaaattgtgatatccattaatttgtttttcttctat

SEQ ID NO: 61007 - DNA, 414 bp, Zea mays
  Clone ID: LIB3069-006-Q1-K1-A10
gatggaacagcgcctaaagttgagaagccatcggttacaccacctactaaagttgattatggcacggatctctttaacatgttgtcaatggatggaacaacagagaaagagtcagcttcatcttcaaacgacgataatggctgggatggcttccagtctgcacaaccagtacctagttcagagaaacaagattctgccaaaccagcagaaagcaagacccagtctacatctggaatggaagacttatttaaagactcaccagctgtgccattatcctcagctccagctgattcccacgtaaacgctaagaatgatatcatgagtttgtttgagaagctatgctttgcagtccaatatggtatcacctttcgcttgccatcaacagcagcttgcgctcatgtctcagcagcaagc

SEQ ID NO: 61008 - DNA, 453 bp, Zea mays
  Clone ID: LIB3069-006-Q1-K1-A11
gacccagcgcgtcctcccacgcgtccggctgtacaacagcttgcttggattattaactcaacaagttctactgaagctgagttgaaatatccaaactatgaccaaaatttcctcatatctgtttcaacagtaacatcccttttggtaactcatacatgggacagcgtagcagcattggctctccatgactcttctatgctattaaggaatcatgcaatggcattgcttactgaatatgtgccttttgttgataggaagcacctgcagtccttcctttcatccagtaacgctatcctgactggcttgggacaactttctggtgtaattgaaaagggctattttacacgaatgtctttgctgatgttttctaaggcatgtctttattctaatcctgaagatatcgctttgatacctgaatgtgtttggcacaagttgaaaacatgcaacatcaac

SEQ ID NO: 61009 - DNA, 387 bp, Zea mays
  Clone ID: LIB3069-005-Q1-K1-G8
cgggcgcgtggggtgctgtgggcccccggtgcgagttaagctgttcgacgatgtttctggtctctgccatgaccttgacaacgggatgcagccaatcagtgtcctcttcccgtacctcccaatccctgcgcataagcgccgtgacagggcacgggcacgtttggcagaaatctttgccaccatcatcaagtcccgcaaggcctctggacagtctgaggaagacatgctgcagtgcttcattgattccaagtacaagaatgggcgccccaccaccgagggtgaggtaaccgggctacttatcgcagcgctctttgctggacagcataccagctcaatcacctcaacctggactggagcgtacatgcttcgcttcaagcaatactttgc

SEQ ID NO: 61010 - DNA, 347 bp, Zea mays
  Clone ID: LIB3069-005-Q1-K1-F11
cgagcgatcccactcccgatcagcagctgttcgctcactcttgcagctcgatcattctttggctggtctagctctagcctctagccctagctagtagctagccactcggtcgtgtagtcatcagccttctgatcgtcacccatggccactgccgaggtccagaccccgaccgtcgtggcgaccgaggaagcgccggtggtggagaccccggctccgcccgccgtcgtgcccgaggaggctgcccccgccgccgaggccaaggtggaggagccagctgccccggcggagaccgagccagctgccgccgctgagcccgaggcgggccccgtggcggcggatgaagagac

SEQ ID NO: 61011 - DNA, 362 bp, Zea mays
  Clone ID: LIB3069-005-Q1-K1-F2
cggacgcgtgggcggacgcgtgggcgcgattctttcattcatggcggcgatgtggcggtggatgacgccgatcaagaagagccagccgtcggcgcacgacgccttcgtgggcaactggaagccgaccaagaacgacacgctcagcaaacgcctgcctgggttcggcgccaccatgaacatactctacggcgagtcgatctgcggcaagggatacgtcgacgccatgaacgttataatctcgcactaccagtgttaccttgacctcatgggcgtcggccgtgagcactctggcgacaaccgtgattgcgccgagcaggcaccgttcaaccccttcagtccgactgatgaccagaagcagcagc

SEQ ID NO: 61012 - DNA, 420 bp, Zea mays
  Clone ID: LIB3069-005-Q1-K1-F3
cccacgcgtccggattaaggctgctctagtatgctgtctgcccaggcacagtctcctgtgcgcgacattgttgcccttgcggctcgtgattccaccgccctggttggtggaccatactgggacgtgccacttggccggagagactcgctcggtgcaagcatccagggctccaacaatgacatcccagcccccaacaacacactccccactatcatcaccaagttcaagcgccagggcctcaatgttgttgatggttggtcaccctctcaagtggtcacaccattggtatgtctcggtgcactagtttccggcagaggctatacaaccagacaggcaatggcatggctgacagcacactggatgtatcctacgccgcaaagctgaggcagggatgccctcgctctggtggtgacaacaacc

SEQ ID NO: 61013 - DNA, 343 bp, Zea mays
  Clone ID: LIB3069-005-Q1-K1-F4
ccggagtccaggcagcacgctagtcggggtgcgttttggaggagatatggatcggtcgtgtgtgcctgtggcggcggcggccgacgccctggtcctcgtgtgctgctccggcctctgccgcggcgagcggctcgaagcgagggagtgcgaggacctggggttcaccggcctcgctctctgctacgactgcaacgcgctctccgagttcgtcaaggaccaagagctggtggaggattgccataaatgttgcaccgaggattcagatgattctatcagcaagctcacattttctggagcaattattgaggagtgcatgaggaaactggtattttatccagaagtt

SEQ ID NO: 61014 - DNA, 67 bp, Zea mays
  Clone ID: LIB3069-005-Q1-K1-F5
cccacgcgtccgcccacgcgtccgtttacgtgtccgcccacgcgtccgactagttcgagagggcggt

SEQ ID NO: 61015 - DNA, 451 bp, Zea mays
  Clone ID: LIB3069-005-Q1-K1-F7
cccacgcgtccgcccacgcgtccgcagcattgatctcgttctcgccactattattctgcagagcaacgcatcaagccttctagaaccatctcgccgccgccacaccacaacccgtcgaagcgaagcaagcaatggccggagtcggatcgaaggccctcgccgttgccgccgttctggcggccgtctccctctcggtggccgccgcggccgaggcgccggcgcccagccccgtctccgccgccgtcgcggcgtcgtcgcccttcgccgcggccctcgtcgcctccgccgccgccttcctcttcgccgccgtccgccactgagccgatggggcctcgtgcctgcaggctacctagcagtacttccgccgctgctgccgccgccgcctagatctatttattggagtgctatccagtagtactagtagtagtgagaattcttcggtgctgtcgtg

SEQ ID NO: 61016 - DNA, 406 bp, Zea mays
  Clone ID: LIB3069-005-Q1-K1-F8
aatcccttccgacccagagcgacgcatacgtccgcaaacccaaggtcacgatcttgattttataccctcgagcagctttcttggaccggaatatgagtggcaatggtttttgatgccaacctactacgttacaagacgggcaaccagattggttatggaaccaaccaaatgtgcagcatgcacaccttattcaagtctggtggcaccaatagatatatgctatgtctagttaaattctttgtagcgctgcgccgatgaagcctaacatggtgcgagttttgttgtttcgccttttgtacagtatatatctttgcccaatcatttcgtcatgatatgatatcaactgatgggtatagttttggtcggacccacggaaagcaatgggaaaaaaatctactaggtgtgt

SEQ ID NO: 61017 - DNA, 387 bp, Zea mays
  Clone ID: LIB3069-005-Q1-K1-F9
cgaccacgcgtccgcccaggcgtccggacagggtgaagaactgttttattttcaacgagccgaggtgcgtcgcggctcggggctacgacaatggcttgcacgcaccgggaaggtgttccgggtgccccgccggaggcaactccaccacggagccgtaccttgtcgcacaccatctcatcctttctcatgcagctgcggtcaggcgataccgcgacaagtatcagcttcaccagaaggggaagattggaattctcctggatttcgtgtggtacgaacctttcagcgacagcaatgcggaccaggctgcagcacagcgagccagggacttccacctaggctggttccttgaccccattgtacattgacggtacccgtacttgatgcaag

SEQ ID NO: 61018 - DNA, 394 bp, Zea mays
  Clone ID: LIB3069-005-Q1-K1-G1
cccacgcgtccgctttcattcgccgtcgctttctgttctctgctgccgtcgccatggggagaaggcctgcgagatgctatcgccagatcaagaacaagccataccccaagtccaggtactgccgtggtgtccctgaccccaagatcaggatctacgatgttggcatgaagagaaagggtgttgatgagttcccctactgtgtgcaccttgtctcttgggagaaggagaatgtctccagtgaggctcttgatgcttgtcttattggcttcaacaagtacttttcctattttgcaagaaaggatgcctttcaccttttggtcctggttcacccctttcatgtccttcgtatcaacaagatgctttcgtgtgctggggctgataggcttcatactgg

SEQ ID NO: 61019 - DNA, 409 bp, Zea mays
  Clone ID: LIB3069-005-Q1-K1-G10
cgacccacgcgtgcgcccacgcgtccgcccacgcgtcctcggattcgtgggcttcaacaggttgcatgagaccgggaggcaactcctgatgctgcttttcggactgatgtcgctaagcgtgcatttgttggttggatgagagatctacgtggcatagctatggcaaccaacagccgcaagacatatggcctcctatttgactggttgtatccatctcgcatgccacttctgctgagagccatctcactttgcactgatgaaccagaggtcaccacacccttgctcaagttcacgtatgaatttgttttgaacaaagctcaaagactgacatttgattcatcatcaccaaatgggatccttttattccgagaggttagcaagataatcgtggcttacgggtcacgaattc

SEQ ID NO: 61020 - DNA, 173 bp, Zea mays
  Clone ID: LIB3069-005-Q1-K1-G11
aaaagaacataaaaaaaataaaaaattaaaatgtcaaacaaaaaaaaaaaacctaggggacggagcattcatacaacgtgaatggctatactataatctcacctaagttaacaatgaaatgaacgtcgctagacatcgcagggactgtgaaaacactaacattacccaaatta

SEQ ID NO: 61021 - DNA, 398 bp, Zea mays
  Clone ID: LIB3069-005-Q1-K1-G12
ccgacgcgtccgcccacgcgtccttccattcgtccggtctcccccttcaggatgtgtaggagattggtggtattggaactgtccctgttggacgtgttgagactggtgtcattaagcctggtatggttgttacttttgggcctactggtcttactactgaggttaagtccgttgagatgcaccatgaggctctccaggaggcccttcccggtgacaatgttggcttcaacgtgaagaatgttgctgtgaaggatctgaagcgtgggtatgtggcctccaactccaaggatgaccctgccaaggaggctgctagcttcacctcccaggtcatcatcatgaaccaccctggccagattggcaatggctatgccccagttctggactgccacaccttacac

SEQ ID NO: 61022 - DNA, 341 bp, Zea mays
  Clone ID: LIB3069-005-Q1-K1-G2
caaaccctagctcccgatcttgatgtgtaaccctcgcgtcttcttcgagaggacggtcggctgctccccggtggacctgatcgtgatggagctgtacgccaacgaggtgcccaagaccgcggagaacttccgcgcgctgtgcacgggcgagaagggcgtgggcaagtccgggaagccgttccactacaagggctccaccttccaccgcgtcatccccgagttcatgtgccagggcagcgactttacccgtggcaacggcaccggcggcgagtccatctacggcgagaagtttcccgacgagaagttcgtgcgcaagcacaccgtccccggtgtgctctcca

SEQ ID NO: 61023 - DNA, 442 bp, Zea mays
  Clone ID: LIB3069-005-Q1-K1-G3
gggaactgagcaggcccatggcacaggctatggtggtagtggttttaagtttaacgaggaagaggatgaagcacggaagaccgcgaagaaggctcaggcaagggaatatggatatgaggaggacaagtcagattcagattctgatgatgaagggggagtgcgtaaggcaggaggtgatctggcagcacaagctattggcaatgctcatgcagctgctgctttggttgcaaacaaggctgctaataatgcatgatcagcaaataccaagatctgcaacagcccccttgattcctttactcacagcatcaaaccaacaaaatgattgaggccactgctcgggcactttaagctgcaatggacttgcaacaaaatctggcaaggatacaggcccatgcagttccagaacactatgaagctgaacttgagattaatgatttcccac

SEQ ID NO: 61024 - DNA, 157 bp, Zea mays
  Clone ID: LIB3069-005-Q1-K1-G5
ccaacgcgtacgtatactcgaagcttcactttgtggtggacgcgccaaacattatggtcaggagcatcatccgggacagcgctgacatcaagcctatgacatacagccaggacactaaggatatgctcaagatctacaaggatcacgatcaccacgc

SEQ ID NO: 61025 - DNA, 414 bp, Zea mays
  Clone ID: LIB3069-005-Q1-K1-F10
gccgcgctcctgatccttatctcttcgcgtgctgcatcggcgcccgccgggaggcggatggccgccgcctcgtccatgttgtgggtccgcaatatccgtcgcttcgtcgacacgggcgccggcctcggatccgaggccatcatggaactggagactaaaaggatattgcttgagattttcaaggagcggcagcggaagagtgccgaggctggttccatcccaagtttttacaagaaacctgaagaaggatccattagctctagagttcaaaggttggccaagtacaggtttctaaagaaacaatcagagcttctgctgaatgctgatgatcttgatgccatgtgggtttgtctcagagaaaattgtgttatcgatgatgctactggtgctgaaaagatgaattatgaagatttc

SEQ ID NO: 61026 - DNA, 309 bp, Zea mays
  Clone ID: LIB3069-005-Q1-K1-G6
cgaccacgcgtccgctacgcgaggcgtccggacacttgcagcttgcctctgatgacggctgagagagaagtgctcccgctctttccttatcttttcctttcccttaggatcggacgatgaagatggttgcattttttaatggccttatgcatttatgctgcttgtaatgaactattattccgtcataactaccagttactcatcatgtgctcttttttttattaaaaaatggacttagttcttttcaaccgagccttatgctagtaacctctcaagtctgccaacatatgcaccaagcaaggagatgga

SEQ ID NO: 61027 - DNA, 274 bp, Zea mays
  Clone ID: LIB3069-005-Q1-K1-G7
tatgatttgaaaaagggggattgattgttccaccatggaccacattagaccagttaggcaccctaagaatcgtgtcctgtcagttaccataacttcaggtcgaagaactgagcttcgcaaattactaccaaactatacacatacactgtggttgaaatattattctattgaatctctgatcagccagaaacattggactcgtaatttggatgagatctgggtattggctcttgttcctagatcctgtttattgaaacttagtgaaaaacatgtc

SEQ ID NO: 61028 - DNA, 385 bp, Zea mays
  Clone ID: LIB3069-002-Q1-K1-B1
cgctaaacccagaccaccaccggaggaaacagggatgaattcgcagccccagcagtcatggggagctccatcaggttcctggggtgcacagtagatgaagtgatattgtgagagcccctccctgtcccagccctagggctcgtagcggatcgtgagggatgattttgtgtggtgtgtcgcatgtgtgaaatgcctttgttgtcccaatattcctaccgtgttgggggtggtcgcttgctcgcgtccacgtctttcacatgaattggttactgtggtagttgtaactctggatacggtaccaaaacataagtattgctgtcaacaatctgcaacagccgggaaaacagtcgataacctttgcaaataataccttgtggcgtggaaa

SEQ ID NO: 61029 - DNA, 418 bp, Zea mays
  Clone ID: LIB3069-002-Q1-K1-B10
gactcacttgatgctgctggcactaacgcggatgctgccagtaagattgagaggttggtgattcaaccgagagtagaggatgcagtacttggccggcggaaagctgaaaacgcaatggcttggcgggcagtgtttacatcggccgggtttgctccggtaccgctcagcaacctcgcagaagcacaagctgactgcctgttgaagcgcgtgcaggtccgaggattccatgtggagaagtgtggaatgggtctagcactctactggcagagcggcgagctcgtgtctgtctcggcatggcggtgctgatcatacggaccccatccatcaaccatcatgacacctacaccaatttgcaggcatgtttaaccctggtaatgtgcattttgtcttgcaatttcaaacatcgtgaagaaaacta

SEQ ID NO: 61030 - DNA, 401 bp, Zea mays
  Clone ID: LIB3069-002-Q1-K1-B12
cccacgcgtccggtcttttacacatagtgcacctgagattgagaaactgtttgagtcagtggctaggtcctgcggcgcaaaagctgtagatgaaggaatcagtgtgcaggatggcagtcactaataaagtaatttgctttgttagtgctgtttttgtgctatttcgcactgtaaattgtgtgctaccctatctgggcttgtacagaccacggaaatacatagtgcgtcacgtcagctatttgggtgcctgtgctttgcctggtagctaggaattactattgatcgccagatgctccaggtgcaaatttttccgtggactggttcacttatttgattcaactatgtcagaatggtagatggtgcgaactttagcttagatagtgagttgaagttgcagcatg

SEQ ID NO: 61031 - DNA, 338 bp, Zea mays
  Clone ID: LIB3069-002-Q1-K1-B2
ggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacgggaaggagctggacggccgtaacatcaccgtcaacgaggcccaatcccg

SEQ ID NO: 61032 - DNA, 373 bp, Zea mays
  Clone ID: LIB3069-002-Q1-K1-B3
acgaaacattaatgatcagtactggacactgcgtgcggaggaggttccagatgaggagaaaagccttggtccctttgatcgattgattcatgtatatcattttacaaaagatactcaaaaccaaacgcaagttcagaactttggagaacctttttttatggttattcgtgaggatgagaccctatcttctatcaaagagcgtatacagagaaagcttaagattccagatgaggatttctcaaagtggaagtttgcatacatttcacttggtcgtccagactattttgaagattcagatactgtaactttaaaatttcagagaaacatgtatggagcttgggagcagtatcttggactggaacatccagacaca

SEQ ID NO: 61033 - DNA, 207 bp, Zea mays
  Clone ID: LIB3069-002-Q1-K1-B4
cggacgcgtgggtggtgagccgccacatgggaaacttggctgggccatctatggggatcaaggttcatttgaggcacttgcaaagaggatgaatgcataaagcgctactttactaggatctacatggctgcggttagctacggatagacaggcaaaaccgctttcagtcgaaactacatctaatcaggatccattggtgactaaagg

SEQ ID NO: 61034 - DNA, 144 bp, Zea mays
  Clone ID: LIB3069-002-Q1-K1-B5
catgacagggaattctagtatataaatatacctatccttatcagctgattacatattaacatgactagtatcaaccttttactatatatgacatagaagataaatgcgtatcaataatcaaagattattaacatataagcttat

SEQ ID NO: 61035 - DNA, 384 bp, Zea mays
  Clone ID: LIB3069-002-Q1-K1-B7
cggacgcgtgggtggggagccgccacatgggaaacttggctgggccatcgatgaggattttggttcatttgaggcacttgtaaagaggatgaatgcagaaggcgctgctttacaaggatctggatgggtgtggttagctttggataaagaggcaaaaaagctttcagttgaaactacagctaatcaggatcctctggtgactaaaggtgcaagcttggttccgctgttggggattgatgtctgggagcatgcgtactacctgcagtacaagaatgttaggccggattacctgaacaacatctggaaggtgatgaactggaaatatgctggagaggtgtacgaaaatgttcttgcttgaattgtcttaatggacaatactcatct

SEQ ID NO: 61036 - DNA, 362 bp, Zea mays
  Clone ID: LIB3069-002-Q1-K1-B8
cggacgcgtgggcttgggtctgggatcatttcttcagccagatcgagcctattgctgccagtactccataccatgtctgtataggaaatcatgagtatgattggccatcacaaccctggaaaccatggtgggctacatatggaacggacggtggaggcgaatgtggaataccttatagtgtcaggttcagaatgccaggcaattctattctacctacagctaatggtggcccagacaccaggaatctttattactcctttgactcaggcgtggtgcatttcgtctacatgtcgacctgaacagattttgttcagggaagtgagcagcacaacttcttgaaagcggaccttgagaaggtgaac

SEQ ID NO: 61037 - DNA, 417 bp, Zea mays
  Clone ID: LIB3069-002-Q1-K1-B9
acgcggacgcgtggggcaatatcaattgtagtttgtgctttcttggcatcgtgcggactgagttttaatgtctagtgtgctacctttttgggatcaaattagatatgcactatttttaagtggaagtatgcttagaatacttctacaaagtcctaggattttgcagattttgtttgagcagctaactaaaggctcctaagtgatgaaggaaacatagctgagcagcaaatgaaacacaactttccttttttggagcagaataccaattcttcaactgagtttgccttggttttttagctggacggtgatgagtttctgggctaaataaaacctacaaagatggctcttctctggtctacgattctggggactgaaatgcaagcatgtgtgatctgtctgatgtctgccaagaaaaag

SEQ ID NO: 61038 - DNA, 390 bp, Zea mays
  Clone ID: LIB3069-002-Q1-K1-C1
gttcgctgcagtccaaggattgttgctgtagcacttgcagcacaaatctactgctttgatgctgttactcttgagaacaagctcagcgtcttgtcatatcctctgcaaggtgcacctggggtaaatattgggtatggcccgatggctgttggccccagatggttagcctatgccacaaatactcctttattgtcaaacacaggccgtctaagtccacagaacctcacaccttcaccaggtgtgagcccatctacttctcctagcagtggcagtttagttgctagatatgcaatggagtccagcaagcaattagcttctggtattattgacatgggatataaaacattttcaaagtaccgccaggaacttctaccagatggttctaacttc

SEQ ID NO: 61039 - DNA, 427 bp, Zea mays
  unsure at all n locations
  Clone ID: LIB3069-002-Q1-K1-C10
ggccgatcgctcctgctcctaccagccgcagctggtcgcggcggcggcggtcctggcggcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggngtgcgctcgctcaacagccgcgcgtcgtcggcggcggatcggcaggcccctgcaactgcctcaagaagcatgacggcccggttcggcggcggcgtcagcatggccaacgccgccaacatccccggcaggtgcggggtctccgtcggcgtgcccattagcccaaccgtggactgcaccaagatcaactgatcgatggaaccatagtggaggtagctcgctcgttggatg

SEQ ID NO: 61040 - DNA, 403 bp, Zea mays
  Clone ID: LIB3069-002-Q1-K1-C11
cacagacaagtggtttccaaagccaagtgtgtgtactagcaaccagctagctcgggcggcagcaggcagccatcatgtcggaggagaagcaccaccacttcttcaaccaccacaagaaggacgaggagcagcccgccggcgagtacgggtactccgagaccgaggtggtcaccgccaccggcgagggcgagtacgagaggtacaagaaggaggagaaggagcacaagcacaagcagcacctcggcgaggccggcgccatcgtcgacggcgccttcgcactctacgagaagcacgaggcgaagaaggaccccgagcacgcgcacaggcacaagatcacggaggaggtcgctgccgcggcggccgtcggcgccggcggctacgtattccacgagcaccacgagaa

SEQ ID NO: 61041 - DNA, 364 bp, Zea mays
  unsure at all n locations
  Clone ID: LIB3069-002-Q1-K1-C12
aacagctcaaatactgactacaaggtctggaaagacctatgagaattgctgcaccattcctgtatctgagggtgggcaattgacaggccaagaagatattggaaatgcatcacgtcaagacctacgagaattgctgcactgttcctttatctaagggtgagcaattgacaggccaagaagatagtagaaatgcatgacgccttcaaaaatatgttcttaacatagatagttgtttctatcattctgcggtcagatatatgtgcatagttntgggaacactagcagctggtaactgatttttatttgtcatgcctattttcttgtaccttgtattcttctggtgcaatataagctctatctctct

SEQ ID NO: 61042 - DNA, 219 bp, Zea mays
  Clone ID: LIB3069-002-Q1-K1-C2
ggggtacttttcacactatattggaaaaagaagctattatatatctttgactgaagaaaagtgtcgatgtataattatctttttttcgtgtccgtgtatgcaacccctcctctcatagacccatagcgccaaatagtcatccaatgaatattctatctgactctttgtatacctctctcttagtttaaacgggctatctattctttactctcaaacaga

SEQ ID NO: 61043 - DNA, 392 bp, Zea mays
  Clone ID: LIB3069-002-Q1-K1-A9
gtgtacgtgaagctgggccaggggctctgctccttcaaccacctgctgctcccctagggcatcgggacattgccggtgctggacgacagggccctcacgcggagcttccgggaggtgagcccaccccccgaggcgtgaggcggagagtgtggccccatggtgtcccccacgctgctcgaggcgtgttcctccaagtggatgagctgttcctcgaagacttccaggccccgccccacgagctcttccaggagtttgactaccagcccattgctgcagcgagcctggcccaagtgcaccgtgccaggctgcacgatggcaccgtggtggccgtgaaggtgcagtacattgacctgcgggaccgctttgatggcgacattcacaccctgtagctc

SEQ ID NO: 61044 - DNA, 323 bp, Zea mays
  Clone ID: LIB3069-002-Q1-K1-C3
accggccgatccggtcgcccacgctcgtcgagaagactgaggaatactaccctctttaacccataagtcgaataagaagcagttttcatttggaatatatattggcaaggttatttcaatagacattacagatgagccatcacatgccatggggaggtcgaatgagaatctgtaactgataaacttattaaaaatagtaagtatatagtaaaaagttattgtagagaaaatgtaatcgaagtttatgccacttgattgtttaacgtggggaatctttgatgttcggggaggtaccactaagttcattgttgattttcatatat

SEQ ID NO: 61045 - DNA, 437 bp, Zea mays
  unsure at all n locations
  Clone ID: LIB3069-001-Q1-K1-H11
cgctgatgctggtggcgtgcaccgcggggttcgttctccagtggcgcctcgcgctcgtgctcctcgccgtgttcccgctcgtcgtgggcgccaccgtgctgcagaagatgttcatgaagggcttctcgggggacctggaggccgcgcacgccagggcgacgcagatcgcgggcgaggccgtggccaacctgcgcaccgtggccgcgttcaacgcggagcgcaagatcacggggctgttcgaggccaacctgcgcggcccgctccggcgcttgttcttgaaaggggcaatcggccgcagccgcttccgggtggcgcaagtcctgctggacgcgtnctacgcgctggggctgtggtacgcggcgtggctggtgaagcacggcgtgtccgacttctcgcgcaccatccgcgtgttcatggtgctgatggtgtccgcgaac

SEQ ID NO: 61046 - DNA, 402 bp, Zea mays
  Clone ID: LIB3069-001-Q1-K1-H3
ctttctttctcggaggcgacagctcgaactcgaatccctcatccagcctgtcgctggcgtcgccggtcgccgccgctcgattgcctccgcctgaatatcccttgccccataaggcctgaccttgaaagcctcgccacttgatcccggcggcggcggaggggagggcgatgccgaagcggacgacacacacctactcgagcgaggacgcactgccggagggccccgagtccgaccttttcgtatactactgcaagcactgcgcctcacatgtcctcatcaccgatacccaattgcagaaaatgcccaagcgaaagactgacagagcacatgttttagacaaggctaagcatctttcaaggctaaatgttaaggaggcaggaaaagtaatgttgaaacgtggtg

SEQ ID NO: 61047 - DNA, 400 bp, Zea mays
  Clone ID: LIB3069-001-Q1-K1-H5
atcattgctgaagtagatacagatcatgatggaagaattaattaccaggagtttgttgccatgatgaggaacaacagccctgagattgttccaaatcggaggcgcatgttctaactgtcatggacaatcacattgaatactttcaagaacaatctgcccttagacataatctttgtcccattttctttttggaacagccgttaagaagactccttaatttgagatccatgtctctgctgcccggacctgtttgtcccaaaatagggtggtgttatagtgattcgtacttgatgctttgagcttcatggactcttgcgtggcaatgtttatccccattgtacgtctggttgttctgctgcttcgatctgaggctttctttaggtgtaaacggatatctgaa

SEQ ID NO: 61048 - DNA, 411 bp, Zea mays
  Clone ID: LIB3069-001-Q1-K1-H6
gaaagttgcccgcacgtctactttgttgggaatcaagataaatatgaaactcgactgggggaagggcaagaaaaacagaaagtgaggctaatctccatcccaaggttctcggagagtggagtcgctgtaatgctcaatctgaggaacttggaatgcagcacattgagtttctcaacaagctttgatgcctgaatatgctctgatgtttgtaagtgcagaagacttcaatgtagcatgttgagcggcatgagcacgagggaactacgtgaaccctttgtggggtgtgggggtgggggcatggaaggatgtatttgtaccagaacagttctttattagatgtatgatgatgaccttaggttttgccaaatagatcttttagaatgcagatgctgtaacttgtaaccacaaccg

SEQ ID NO: 61049 - DNA, 185 bp, Zea mays
  Clone ID: LIB3069-001-Q1-K1-H7
gacagacctaccatagtagagcacatggatgatcacatcgatatagacaacctgatggcagagctgatggtgaatctagactataatctcgactatggtaccaccgatgggaccatcatggcgggagctatggtagagcctgctgagaagcttgctgagcatcttattgagcgtattatggaggc

SEQ ID NO: 61050 - DNA, 407 bp, Zea mays
  Clone ID: LIB3069-001-Q1-K1-H8
acaacttcttggcccgcgacctgacgatcgagaactcggccgggccgtcgaagcaccgggcggtggcgctccgcgtgggggcggacctgtcggcgttctaccggtgcagcttcgtggggtaccaggacacgctgtacgtgcactcgctgcggcagttcttccgcgactgcgacatctacggcaccatcgacttcgtgttcggcaacgcggccgtggtgctgcagggctgcaacctgtacgcgcgcaggccgctgccgaaccagagcaacatcttcacggcgcatgggcgggaggaccccaaccagaacacgggcatctccatccagaggtgcaaggtggcggcggcggccgacctcgccgtcgcccagtccttcaccaagacctacctgggccgtccatggaagcag

SEQ ID NO: 61051 - DNA, 376 bp, Zea mays
  Clone ID: LIB3069-001-Q1-K1-H9
cgacgcctggcacatgatccctcattgaatgatgttgaagagaccatggtagagacgattgccctctgccagagaaattcacataatttgaaccaacagcagagagaggcactctggtttccgttattggaggcaatgatggcccctcagaagctgtctagttcagcttcacctcatccacactctgaagctctgaaatctttgaccatgcaagttctcaacagtatggcagcatttattgcccttccatccatcctgcagcgaatcttacaggacccagtttattgaaaaggaaaacttggagaaatccaaggccttattctgggaatgttggatacctttaactatgaacagaccctgctggaaacgacaacta

SEQ ID NO: 61052 - DNA, 353 bp, Zea mays
  Clone ID: LIB3069-002-Q1-K1-A1
gcgccaacttgctgaacgggctgatcaacgcgaccctggggacgccgcccaggacgccgtgctgcacgctgatccaggggctggcggacctggaggcggcggtgtgcctctgcaccgtcctcagggccaacgtcctgggcatcaacctcaacctgcccatcaacctcagcctcctcgtcaactactgcggcaggcgcgtcccctcgggcttccagtgcttctgactatcacacgcccatcgatcgatcgatctgcaggctaaataatttctccaagctagtatacgtacgttgatatatatatgatgtagtattattatatatatgtccatgcatgcaatgcatctcgtcgtc

SEQ ID NO: 61053 - DNA, 390 bp, Zea mays
  Clone ID: LIB3069-002-Q1-K1-A10
cccacgcgtccgcccacgcgtccgcccacgcgtccgcccacgcgtccgcccacgcgtgcgatttcagccgccgccgcgcgtagcaagcaggagcagcaaggatgccggctggccacgggctgcgctcgcggacgcgcgacctgttcgcgcgccccttccgcaagaagggctacatcccgctcaccacctacctccgcacctacaagatcggcgactacgtcgacgtcaaggtgaacggcgccgtccacaaggggatgccgcacaagttctaccacggccgcaccggtcgcgtctggaacgtcaccaagcgcgccatcggcgtcgagataaacaagcaggtgaatggtcgcatcatcaggaagcgtatccatgtccgcgtggagcatgtgc

SEQ ID NO: 61054 - DNA, 443 bp, Zea mays
  unsure at all n locations
  Clone ID: LIB3069-002-Q1-K1-A11
caaaggagccccagaagatctttcagattttttgcaactaataaaatatgtcagtgggtcctatgatactggagaaggatttgagaaactgaacagggcaatatcagagtatgaggtgtcaaagagttcaggaagctatcgcaggctcttttatttggcattgcctccatctgtctacccttcagtgtgcaaaatgatcagaacatattgcatgaatccatcttctcaccttggatggaccagagtcattgttgagaagccctttggaaaggacttggattccgctgaagaattaagtgcccaacttggggagctattcgaggaacaccaactatacagaatagaccattacctgngaaaagagttagtccaaaacttgcttgttcttcgttttgccaaccgattgttcttgcctctttgganaccgcgacatattgataata

SEQ ID NO: 61055 - DNA, 329 bp, Zea mays
  Clone ID: LIB3069-002-Q1-K1-A12
cccacgcgtccgaccacgcgtccgaaaaaaaatacaaataataaaatataaaggaaaagagatataatactggagggcgctttagaggaaatgaacagaaaggatgtccgactgtgacgtgtctgagctttcaggcgcgttatcctattctctttcatttgccgttgtactgatttcgttaccctacaaagtacctaatgaatctacacattttgcgtctatctatattttcaccttaactgaaccagagtcattgctatgaagccctttgtatacgacttgcataccggttgcgaattaagcgtcacaattggcgcgctcttcgtgga

SEQ ID NO: 61056 - DNA, 392 bp, Zea mays
  Clone ID: LIB3069-002-Q1-K1-A3
gagctacgcgtacgcgatacccaaggccaacgtttcctggtgcaatccgtggacgactgccactcaggggtgtggcccagagcttacagtggaagcgcagtgccacagattcctcaactgctgtaaaaccaagtcaggctgcaccttcagctcctgggaatcagttggtcaccccgaccccacgaagcttcacctacacacgcacggagccaaaaccaaatgacggtgcgatggcttgactgctcagctgcagcatgccgcagctcctgatgaatctcgcagaaagagttcgtgatactgttacgtggttcattcagctgcttttggtaaatatttaagtagctgcagatgttaagttggaacaagctggtttttgtggaccaaaaactttg

SEQ ID NO: 61057 - DNA, 142 bp, Zea mays
  Clone ID: LIB3069-002-Q1-K1-A4
caaccagcaagcaaaaattccccaatcctgtcgtgtccgaggctaagatgtccgggcgcgggaagggcggcaagggcctgagcaagggcagcgcgaagcgtgaccggaaggtgctgcgcgacaacatccaggggatcacgaa

SEQ ID NO: 61058 - DNA, 374 bp, Zea mays
  Clone ID: LIB3069-002-Q1-K1-A5
gggagttgacttttgtaagaagctctgtggagtctctattgtgcgaagtggtgagagtatggagaacgcattgcgtgcttgttgtaaaggaataaaaattgggaaaattctaattcatcgtgttggagacaatggacaacagcttgtttatcacaaactgcccatggatattgctgaacgacatgttctacttttggatccggtgcttggtacaggcaactcagtagcccaagcaattgaccttcttataagaaaaggtgttcctgaggatcggatcatttttctcaatctcatctcggctcctgaagggattcagtgtatctgcgagcgatttccttcgctgaagattgttacatctgaaatcgattatggtc

SEQ ID NO: 61059 - DNA, 356 bp, Zea mays
  Clone ID: LIB3069-002-Q1-K1-A6
cccacgcgtccgatcagcagtttatattgtgttttgtacgtattaaaaatgcaagaatcatgagcaaaacgagcaaaatttgaatccatcagctgtttatattgtaataaagtatgacaagctctctgaaaaaaaaatcagttgcgtaatctgtccaatgttgcatttgagctattgcgctagttaatccttttattttcggtatgacttgcagtgcctctagagatggagattctatgctaagggtttaggagctgcattggtggatggtacattgtgctttctgcgccgtgcttgctgaaagtctatctgaatgtagtttaaaggatggtttatgcaagtgttcccgatatttc

SEQ ID NO: 61060 - DNA, 242 bp, Zea mays
  Clone ID: LIB3069-002-Q1-K1-A7
gcatctcgctccttgtcgacaagacatccaccatgcaagacagcgcctttcactggcgcaggcaatccaagaggctgcgtagagctctttggatgaagaatgccaagcttctagttgtgttgacagttgtcatagtagtgctgctctacttgatcatttctgctttctggggaggcctttgcttgtcatcatgcagatcatgagttacacaccagatggctttggcccttccttaaaatgga

SEQ ID NO: 61061 - DNA, 388 bp, Zea mays
  Clone ID: LIB3069-002-Q1-K1-A8
tcggttgcagaaaatgagagttgaaatggctggaatgagaagagatgcagagcattattctagacaggagcatgttgaacttgagaagagataccgtgagctaactgacttactgtaccacaagcaaacacaattggaatccatggccagcgaaaaggctgcgttagagttccaactggagaaatcattgaaacaatttcatgaagtgcagattgaggcagaaaggagtaaagctactcgcagatcagcatcgtcgtgggaagaagatgctgatatcaaggcattagagcctgttcctctacatcatcgacacatggcaacagcaaatcagcagttacaaaaggctgcgaagcttttagacacaggagctgtgcgctcaacaggattt

SEQ ID NO: 61062 - DNA, 408 bp, Zea mays
  Clone ID: LIB3069-001-Q1-K1-H1
tcgggagcagaatcccccaatcgatctctgtggtcttcacatcagcgaggccatgcacgtgctgaactacgagctcaacaaccgaagaaagatcgtgagatccactggtcgccgactccaggctatgatcatatcaagcgcccgcaccccagcaaggctgactgctgccgtcgagcagtacctcatggaacacggccttcagtacacgcaggcgcaaccaggcctcttccgcgtcctgctctagtgatggagccggcctagctgttgtcacatagacgagaaagaagacgtacaaagttgtacttgcgtatatggcagagatggctagcaggatagaagcgttaagatagctcatgcattcacatatcaggctttagcatatgtatacatcttacaagttgcggagtt

SEQ ID NO: 61063 - DNA, 117 bp, Zea mays
  Clone ID: LIB3069-001-Q1-K1-F5
gtttgttgtgtcaactgtcataactattgtgcatttttggacgctatatgtgtagccgtgatatgaatagatttactgtacttataagggctggtgtgactcagccgtttgctcctt

SEQ ID NO: 61064 - DNA, 277 bp, Zea mays
  Clone ID: LIB3069-001-Q1-K1-F6
tcgcccactcgtccgcccactcgtccgatattttcttgttttagtcaagatgctcaaaaggttggaaaaatccaagtgactgcctttcagtcagaggatgaactacaggatgaatctcatgtacatgactgtatggctgactacagattaagtgaggccttattgtctaaggttacctgtgatgtagtaaccgaggagctgaatgtgaacagatgctctgaatatctgtacttcacatgtagtattgttttaagatcgttatatgagagtttgagcg

SEQ ID NO: 61065 - DNA, 400 bp, Zea mays
  Clone ID: LIB3069-001-Q1-K1-F7
cggacgcgtgggtggtgacgccggagatcctgaagccggacatgatcgcgccgggggtgaacatcctggcgtcgtggacgggcaaggccgggccgacgggcctcgccgccgacacccgccgcgtgggcttcaacatcatctccggcacgtccatgtcgtgcccgcacgtgagcgggctggcggcgctgctccggagcgcgcacccggagtggagccccgccgccgtgcgctcggcgctcatgaccacggcctacgccagctactccggcgggtcgtcgctgctggacgcggcgacgggcgggatggccacgccgttcgactacggcgcggggcacgtggaccccgcgcgggcgctggacccggtgctcgtctacgatctgggcacccgcgactacgtgga

SEQ ID NO: 61066 - DNA, 307 bp, Zea mays
  Clone ID: LIB3069-001-Q1-K1-F8
ctgaagcaaaattcatccttgatgccaattatgttatcgtcactggctgtacctttggcgcttacctggaatattgttgctccctggtgtttccaaatcccagctgctggcttggcctaaaacgaaaatctccaggctccagctgctagctgtcataccctacaagtgatggcaccacactctacactagaattgttacctagtgctgcgaacagcagcaggtcaaggcgtctgtagactctacatgtaattctcgaaagaaccaagacttctgcatttaatgtaggatcagctgtgctgtgctctt

SEQ ID NO: 61067 - DNA, 390 bp, Zea mays
  Clone ID: LIB3069-001-Q1-K1-F9
gcaagacaatgtttgagcgaatagatggtgcatttcaaaagggaatgtctgagcactccaccgctattcagcatcaagtcgagtcttcacatagtccgttagcgctaactctaaaagaaatcatcaattctgcatcatccatcacccagagtttttcatcggagttacttgatggcaatcgcaagctactggcacttgttacttctgggaatgccatggcacataataccagtgctttgcagcccattaatggtcctatgggtggatcccaggaggttgaggctccgttagatcctatgaaagagctgggcagactgatatctgaacgcaagtttgacgaagcatttacaatggctcttcaaaggagtgatgtttccatagtatcgtggc

SEQ ID NO: 61068 - DNA, 384 bp, Zea mays
  Clone ID: LIB3069-001-Q1-K1-G1
tcgtcttgctgctgctgctgctgctgtcgctggatggccaggagcacaccagctgcttgctgtgtcgccgtcgtagaagcagccgcgcgctgtcgtcgtcgtctcgtccgcgacgcgaccactgcggcggctgctgctgcctcttatgctggccacgccaccgacgcttttgtgataccatactaagcgccgtggcgggcacgttggagatgtcgtcactgggtgggcaacagcagcacggccgctgagaccaggccagggcgcgtactcacgtggactcgccagctgcacggtcgcttcgtgctcgccgtggcccagctcggcggcgcggacaaggcgacgcccaagtccgcgatgaggtcgatggccgcgtcggggctcacg

SEQ ID NO: 61069 - DNA, 283 bp, Zea mays
  unsure at all n locations
  Clone ID: LIB3069-001-Q1-K1-G10
cccacgcgtccgaggtgctgctggagggtatggacatggtggcggcggcggtggcggtggtggtgagggcgcgggagctggtggctctgggtacgggtccgggcaaggatctggctacggagctggcagcggtgctgccggtggatatgggagtggcggaagtggtggaggtggangtngccngnggncagggtgggggntncggatatggccatggaagtggtgaaggatacggttctgggtctggctttggtggtggtgctgctggcggcggcggtggaca

SEQ ID NO: 61070 - DNA, 435 bp, Zea mays
  Clone ID: LIB3069-001-Q1-K1-G11
accgaccgacgttccaagaagcgaaacgaaacgataatgatgatgatgatgggagagagagcgcacgcgcctccgtggcagcgctcgccggcggccagcggcgtcacggacgcggacgacgcgtctccgtacgccctcctagcggcgctgcagcattacctgccgtcgaacgaggtggcggcgtacgacgaagacgacgaggaggcggccctggcggcggcgaccgccgccgtcgacgcgtacgcctgcgacgagttccggatgtacgagttcaaggtgcggcggtgctcgcgcgggcggaaccacgactggacggcctgcccctacgcgcacccgggggagaaggcccggcggcgcgaccccaggcggtaccactactccggcgccgcgtgcccggacttccgcaagggcgggtgcaagcgcggcgacgcgtgc

SEQ ID NO: 61071 - DNA, 289 bp, Zea mays
  unsure at all n locations
  Clone ID: LIB3069-001-Q1-K1-G12
cccacgcgtgcgcccacgcgtccgcagacaccgctacaatccactagctaagcgcgccatggcagagnncgctcanggtcaccaccgcgaggcctccgacgccggctgcgtccgtgccgtcctcgccgagctcatcctcaccttcctcttcgtcttcgccggcgttggctccgccatggcaacagggaagctggccggcggcggctgggacacggtagtgggcctgacggcggtggcgctggcgcacacgctgggggtggccgtaatggtgtcagcggtgctgcacgtt

SEQ ID NO: 61072 - DNA, 411 bp, Zea mays
  Clone ID: LIB3069-001-Q1-K1-G2
tcgcccacgcgttcgagcgcttgcctcatttgaagattgtaacctcagagattgatagtggattgaacgatgaatatcgtgtcataccaggacttggagagtatggtgatcgatacttcggcacagactaaccgatgactgatgctgtcgtagttagcagtgtgaaaaggtactcaaattagagctgacattaccgtggcagatatactggtgtttggttgctttatggtatactggaagacaaacgtggataggtttctggtaggtgctgaaaccgtgaccgtgtggtcttgtccattatcatatgttttgataccacaaaccgttggttgtgaggcaaatttgattttttttgcattttgaggctcctagctgaagtgcctgcttctagtcacacaatactgttataca

SEQ ID NO: 61073 - DNA, 388 bp, Zea mays
  Clone ID: LIB3069-001-Q1-K1-G3
tcgtccacgcgtccgtccacgcgtacgctcggatatcatttactgatgatgtagatccatggtgggtcgctgggaggattgtcgagtgctcttggaacaaggaagaacagtgatgggcatgtatgcgtattagatctgataaatcaactccaaacgacatcaacacataccggaaggtgatgaggagtattacagataacattaccgaggagaagcttctcgaatagactgatgtgataacgctcctgccgatgtatgtcgataggatgaatgttcctgttcatacagagatggcacatcatcagcgaagattgtcaccacagtgctagtctcgttgctagagtgctgggtcgctctcctagccagcggctggcttatgtagctgtgt

SEQ ID NO: 61074 - DNA, 412 bp, Zea mays
  Clone ID: LIB3069-001-Q1-K1-G4
cacgaaaaagatgaaaatctcaagagaggctatagatgccagcgggagaatctcaaacgcagaggatattctgacaatagaagtaaggcctggttggaagaagggaacaaagattacatttcccgacaaggggaatgaagctccaaacatgaaagctgctgatattgttttcatcctcgatgagaagccccatgatgttttcactcgggatgggaatgatcttgtggtgactgagaaaatctcgctggtggaagcgctgattggatatactgcacgtgtcactacgcttgatgggcggagcctatcattgcccatcaactcgataatccatccgagctacgaagaggtagttcctagagagggcatgccaatacccaaggacccctctaagaagggaaatctgcggattaag

SEQ ID NO: 61075 - DNA, 397 bp, Zea mays
  Clone ID: LIB3069-001-Q1-K1-G5
atcgcctcgcctcgccgccagcgcaactccagccctggccgggatctctttcaccccgggctctctctccgccgcttcgctcccccgtctcggggcctgcctcggatgctcccggcctcgcatccgctgctctacgcctgcgtcttccgcgacacccacctcgtcgccgagctcgaccacgcccactcccactcccagagcaccgccaccttcgccgaccccgtcgcttccgacgccccctcccccgcccctgacgacgacctcccggcgctcgccgctgcgctcgtcgccgccgctccgccgcaccaccgtcacctcacacacacagccggcgggcgtgcgcacgcgctgctcctgtccccgccggtcgcactcgccgccgtctcgcgggcgcccc

SEQ ID NO: 61076 - DNA, 364 bp, Zea mays
  Clone ID: LIB3069-001-Q1-K1-G6
ggtgttcggacgtggcatctatttttgacggaagctggtgtgaattgtagatcgttgtggtattagattacagtatttaaactgctagtttcctggtttcaaagttttttcaccacaaatactggaggtgttcatgccttgcatgatttgtacatcttaccatgtagtatgaagcgatcgaatcgtaggtgacattacaaacgcagagaggcatacttatcagatagtgagttacaaaagtgtttttggcatgaccaaggatgcattctaccgtctagccaaattggaagcaagaactacagaagcgaaaagcaaatctatggtaaagagaacacgccttgtctcatgcgcttgctacaaaatg

SEQ ID NO: 61077 - DNA, 402 bp, Zea mays
  Clone ID: LIB3069-001-Q1-K1-G7
gtgtgctctgacagtgagatggcgagcgtgaaggttttcgggtcacccacctcggcggaggtcgcccgcgtgctcatgtgcctcttcgagaaggaggtggagttccagctgatccgcgtcgacgcctaccgcggcaccaagcgcatgccccagtacctcaagctgcagccgcaaggcgaggcgctcaccttcgaggacgagagcctcaccctctccgactccagggggatcctccgccacatctcccacaagtacgcgaagcagggcaacccgtacctgattggcacgggcgcgctggagcgggcgtccatcgagcagtggctgcagacggaggcgcagagcttcgacgcgcccagcgccgagatggtctacagcctcgccttcctgccgcccaccctgccc

SEQ ID NO: 61078 - DNA, 400 bp, Zea mays
  unsure at all n locations
  Clone ID: LIB3069-001-Q1-K1-G8
aaaaatcttcatttcacatatagaattttctttctttcatttcattgcagggctttcttgttggttcttatgggctgacgtgggcactcaataactcaagcaaagtccttaaattagcaatccttaacagtcctcttacagtttcttctccagtccctggattgtttcagcagctaaaatggccactctttggtgaatttacttgtcaaaatgctgttttggctgagcgtttcattgaagcagatatatgctgaaattggaaaaggctgatgtatacaggttaccgtatctatccagtggcgctcctggattcgctttgcttgaagctgncaggaagatcaatttcaagatgtactaaatagaattttcgccggatttttgtccaaacgttgggaaaaac

SEQ ID NO: 61079 - DNA, 383 bp, Zea mays
  unsure at all n locations
  Clone ID: LIB3069-001-Q1-K1-G9
tccctgtgatcctattgcccaaggagaagcttgttgacaccaacggcgcangtgacgctttcgtcggaggctttctctctcggctggtccagggcaagagcatcgaggactgcgtgacggctggttgctacgctgccaatgttatcatccagcgcccaggctggacctaaccaaagaagcctgacttcaactagtgcaatactcaggcaccgaggcacgttacgagcggttcggcgtgtacactcccctgtatcctttccggtccggccaattttttgtcgccgtgatatttgttcagcaactatggacgacgtcgcctctgttctgtacgaggcatggtttgccatcattattctgttagcttcggcgatgcttgcaatgcg

SEQ ID NO: 61080 - DNA, 413 bp, Zea mays
  Clone ID: LIB3069-001-Q1-K1-F4
tcgcacgcgcccgctcctcttcgccctcgtcttcctccatcccacggtcccacctgtccctctcaccgcctcgttattttttcgcccccatctttgaacgccgggactccaactccaccgctcctccctcttcgttccctccgatcccgcccctataaatccagtcgcctcagccgccacagcgggccgcaagcacgcatccacacagctcactgctgctcccgtcttcccgtgtcctgtcgtgctcccgtcgccgggggcggaagggttcgcgaggccggcgggcggttagggatttctccggagtcccgcgatggcgaagctgtacgtgcaggcgttcccgcccgcggatctgaacaagaacaccgagtggttcatgtatccgggcgtctggacgacctacatcctcattg

SEQ ID NO: 61081 - DNA, 422 bp, Zea mays
  Clone ID: LIB3069-009-Q1-K1-C10
ggatccgattcagactgggtacagtctacctttaaagccaaaaaacaccatagaagagtgtgtagccattcaaatcctaacctggattgtcaaaatacacaaggcaatgcataaccagagaagccctcagatgaaaagtgcattttgcccaaatatatttcatcagacggctgttcatgctcaaaatcctcctcatgcaagaccaacaaatgcgagtgcagaggctcaggtgcacaatgcggtgcaggctgtggttgtaaggattccaaatgttctaacagggattcttctatagaaaaagccaatcagggagccatgcttcttcagaacgcgttttctgagaaggattcccaagatgcatagccaaggaagcctttgattaacattggtaataatatggttaaccaaactgccgagacaaa

SEQ ID NO: 61082 - DNA, 395 bp, Zea mays
  Clone ID: LIB3069-009-Q1-K1-C11
agccaaccgcatccagtccaccctttccctttcgaccccgacaaccccgagtcccgacccggtggcgcccaaggccgagaagaagccagcggagaagaagccggcggccgaggagaaggcggagaagacgaccgcaggtaagaagcccaagtccgagaagcgcctgcccgcctcgaagtcctccggcaaggagggcggcgagaagaaggggaagaagaaggccaagaagagcgtggagacctacaaaatctacatcttcaaggtcctgaagcaggtgcaccccgacatcggcatctcctccaaggccatgtccatcatgaactccttcatcaacgacatcttcgagaagctcgccggcgaggccgctaagctcgcccggtccaacatgaagccca

SEQ ID NO: 61083 - DNA, 404 bp, Zea mays
  unsure at all n locations
  Clone ID: LIB3069-009-Q1-K1-C12
ggaagaaaaactagaaaccctagctatgctgtagatccgcctgagcaagattggctcgtcggactccgtcggtgccgccgctagcacggcagctggcgccggcgcccccgccgcggttggggcggctgcggcgctcggcggcagcatcctggaatcggtcaccgtggcatgccccgaccacctcgtgatcgcggacctccccgtcgcgaagagcctcggtgccgtcacggcctccgctgccgccgccacgcgcgccatcggccgtcgctcccgtcgtccgctcggngagcgcgtncacatctgttcccgctgcgagttccccatcgccatctacgggcgnctcatcccttgtgaacatgccttctgtttatcctgtgcaagaagcgattctagctgctatcttt

SEQ ID NO: 61084 - DNA, 365 bp, Zea mays
  unsure at all n locations
  Clone ID: LIB3069-009-Q1-K1-C2
cgggctcgtgggctcaccaccaccgcgccttctcttctccccccaccctcggtctgaaaggcaaggttccgcttctctcatggccgacgccaccgacgccctctcagctcggagcaaggtgcacgctttcctggaggctgcgcgcgccggcgacctccaatccctcaagaacctcgtcgcggcgctcgacgaggacggcacggtcgccggctccgtcgccgccgccgtgcgcgacgccaacaagcgcaccgtcctacacttcgcggcgatcggatgtcgcaccgacgtctgtgaattcctcatcggcgagctcggcctncctgtcgacccaaaagacgatgatggcaaaacttcgttcatncatg

SEQ ID NO: 61085 - DNA, 343 bp, Zea mays
  unsure at all n locations
  Clone ID: LIB3069-009-Q1-K1-C4
cccgcgcgtgcgcccacgcgtccgcggactcgtgtgtctccatcttggcccaaccgatcgcaaacgtctccccttttctccgtcctctcctagtccacacggcagacgccgccgccgggggagaggagaggaggggaggggatcggctccaagggaacaggtgagatggcaatcctgtacgcgctggtggcgcgcggcacggtggtgctggcggagcacagcgcggcagccaccaacgcgggcgctatcgcgcgccaggtcctcgagcgcctncccgacggcggcgccgacagccacgtctcctacacgcaggaccgctacgtcttctacgccaagcgcaccg

SEQ ID NO: 61086 - DNA, 442 bp, Zea mays
  Clone ID: LIB3069-009-Q1-K1-C5
tcagccggcgaccccatcgtgactgggccttctcatcgaggtctccctctttcggcgtcgttgaccatggccccaagccgtcggaggtgtacggcttcgttggatccatcaccaccgtcattgccaccgtcgtgtacctcgcctgggcatacacgcccgagcccgtcctccagtcactcggcatcacctactaccctagcaagtactgggcactggcggtgccatcgttcgtggttgtgaccgtggtgctgtccatgggcatctacatgggcctcaacttcgctgccactccttctccgacttccttcagtactatcttcgatgaaaagagtagggagcacacagccttttttcctgcaactgaagatgaaaggcccatcgaacccatctcagacatcggtattgatcggatcaacactcttatgtttggtgatagatgatt

SEQ ID NO: 61087 - DNA, 326 bp, Zea mays
  Clone ID: LIB3069-009-Q1-K1-C6
gcgtcgagaccccaaaccccaaacccttgcttctctcgatgcggctagccgtctatggggaacgctctgctatccaaacgcgagaagcggcttcagacgttgcgccggtagatagcggagccgttctacgacaagaaggacgccgccaagctctccgcgcaggccgcagccctagctgctgtcccgctcccggtccgcggtcccccgtcgtgccaggatgccggcacctcccgcgcagctagctcggcctcggctatggatgtggagatgtctggtgcaaggaacagcaggtctaagacctttctgaagccacttggcagcattag

SEQ ID NO: 61088 - DNA, 274 bp, Zea mays
  Clone ID: LIB3069-009-Q1-K1-C9
gatacgatgctcaagataaatgacttttatgttttcccacttcaattggatcttgagagaggggattgaaaatatctttctccatactcggatagaagtgtgcgtaacctatatactcttcatagtgtactggttcatagtggtggagttcatggaggacactattatgcctttattcgtccgaagctgtctgatcaatggtacaagttcgaggatgaacgagtgactaaagaagacatgaaacgagcattgtaggaacaatatggtggtgaag

SEQ ID NO: 61089 - DNA, 439 bp, Zea mays
  unsure at all n locations
  Clone ID: LIB3069-009-Q1-K1-D1
acgcgggcgcgtggctatatatcttgtttcctttcttcttcagtattcgccgaacctgcgttgtatcgctcttgaggcgtgtgctcattcattctttgacgaattacgagaatcacatgcaagactccctaacggacgcccatttcctccactattcaactttaagcaggaactatcaaacgcaccaccggagcttgtcagcaggctattaccagagcatgctcgacggcattcaggattcggttccttatttgggagtggaccgtagcccgtatgaaaatctcgttttaatgttgggctgctgtacgctgtcagagggcaatctgcatatcctaaatctaagttntagaacctgaccatcttgttgaaaagttgccagccttagaaaaacccgaagtggcctcttgtgtccatgctctgccagtaacggcacataatg

SEQ ID NO: 61090 - DNA, 429 bp, Zea mays
  Clone ID: LIB3069-009-Q1-K1-D11
cccacgcgtccgctgactcgtgggctgcattctaccatcctcacagctgctgctggcctgagtctcaccctattcaccttctggggcgtcaagaggggctaccacttcaccttcacgttccccttcctgttcgcctgcctcgtcgtgctgctggtgctacatcatcatccacatctgcttccccctgggaagggtagccatgaccatctacggcgttctggccaccgtcgagttctccggcttcatcgtctatgacaccaacaagctgctgaagcgccactcctacaaccagtacgtggtctcagccatctccctctacctggacgtcatcaacctcttcatggaccacatggccatctccttccagtgatggattgacagtctcacctgtacggctgtaccccatgcatgacgggccctctcccgtct

SEQ ID NO: 61091 - DNA, 426 bp, Zea mays
  Clone ID: LIB3069-009-Q1-K1-D12
gggacctttcactggaaagagattctgaggtggaggctgagttcagagcaaagatgaaggagcaggcaaacgcacctgaagatttgcccccacaacttctctttgctcatcagggccagagagacttgaaagaactgcactggcacccacagataccgtcgatgatcatatcaacggcaattgatggcttcaacgtgttgatgcctagcaacattgatacaaccattcctggcagcactgatgcagcaatgccatctgctgagccacagcactagccaacattgatacaagcattcctggcagccctgatgcaatgccatctgctgagccatagcactgatgtaagcgtttcttgtagcatggctcccagcttaaaattccaagtctacgcagtggtgtatccgagtgcggttggcatttgtgttg

SEQ ID NO: 61092 - DNA, 252 bp, Zea mays
  Clone ID: LIB3069-009-Q1-K1-D2
ccttccgccataacaatatatcttctttactttttacttcattattctcctaaccttctttggatcgcgtctaattcttcttctcattcattcttttactaattactataatcacatccattactacctaactaactcccatttcctccactattcaaccttaatcaatatctatcatactcaccatcatatctttccatcattctattaccacatcattctctacatcatttaataacccctttccttatt

SEQ ID NO: 61093 - DNA, 433 bp, Zea mays
  Clone ID: LIB3069-009-Q1-K1-D3
cgggcgcgtgggcggactcgtggggattttcagtctattggttgtggggatttggatatggaagggcttactgaatccatatatgtggcccacaaagatgagtacacagaatttgagcaggcatcactcaagcagctatttcagtcaaagatggctgaactgagagctgaggctaagcaacaatctgagtctactggctcaattggacgtgcaaaaggagcatctttgaccacatcaccacagcaacagatatctgttactgtagtaacggaatttgttcgctggaatgaggaagccataaccagatgcacactactgttttctcagcctactactgttgcagctaacgtgagatccatatttgcatgcttgcttgatcaagtgagccaatacttaactgaagggcttgaccgtgctagaaagagtttaaatg

SEQ ID NO: 61094 - DNA, 405 bp, Zea mays
  Clone ID: LIB3069-009-Q1-K1-D4
cccgcgcgtccgccgcatccgccctagcatctcgcgtcgagcaggatctgcccagttgctgttgcggtagttcccccaactgtcaccatgcagaacgaggagggtaagactgtggacctctatgtccccaggaagtgctcggccacaaacaggatcatcactgccaaggaccatgcctctgtccagatcaacattggccacttggatgcgaatggcctgtatgatggtcacttcacaacgtttgctctctctgggtttgtccgtgctcagggtgacgcagacagctccttggacaggctgtggcaaaagaagaaggctgatatcaagcagtagattttacatctagtttaccaagaattggacaccgtctttaactatgtttttgaattcatgtcactatatgca

SEQ ID NO: 61095 - DNA, 391 bp, Zea mays
  Clone ID: LIB3069-009-Q1-K1-C1
cccactcgtgcgcttctacatcttgctgtttgcctttgggaaggtggagatccttatgtgcgcgggttagccttactcccagagcagccgggatgaggccttcatggacatggtccggtgagactgctgcggacgatgaaaggggttggttgctcggcgccgttttcgcttggctgtgagctggtagcctcgtttcgcccttacccagagccttctccaccgtgctgaacgatctgaagtatgctgacactcatgaatggttgaaagttgagggtgattcagcaaccgtggggattactgaccatgcccaggatcatttgtgtgacgttgcttttgtggagctaccacaagttggcatcagtgtatcctatggtaagaactttggtgctgt

SEQ ID NO: 61096 - DNA, 435 bp, Zea mays
  Clone ID: LIB3069-009-Q1-K1-D5
ccggccgacccactcgtccgccactcgtccgcccactcgtcctccactcgtccggccaacccctactcgcgcggctgcggcgccatcacccagtgcaggggctgatgcctgcctgatgatttccgttccgtttcgtccccagctattagtcgggtcttcaatttaaagaagaagacatgcatggagcgatgtcgtcgtctttgctgtgcgctatagcctttctcgtccgcctgaggcacgcatgactcgtccgtcgattattgtgctgcagtggacatgtgtatgtgctcctgtttctagcatatccccttgctttcaggaagaaagtgaaagtaattatatatatgatgatcgtgtaataattttcgtctacgagggagaatgaccttgtcatgcagaaaagatcaattcaagtggctcagcgttcggattaaa

SEQ ID NO: 61097 - DNA, 437 bp, Zea mays
  Clone ID: LIB3069-009-Q1-K1-A3
ccgggccgacccactcgttcgagcggggccataaaagaggctatgtgttttatgatggatcctttggtggggaagaaagtggttatgtagtgatcacagtccaagttcaataggtatggagcatttgataagacagcagatacacgtaccagtgcattcatggcaccagccttcttgtgatggttataacctggccttcccgatcccgaacctcttcccttgcaagaaccttgtgacacgtgaaggcagcgcctggttgtacagtcctgactccaaagcgttgagggaaaagctcaggcttccagtcgggtcctgtgagcttgccgttccactcaaagccaaatcgaggcttttctcggtagatcgacgaagagaagcgtacgcgacgatactgcattcagcgagcgaatacgtttgcggcgcaatctcggcagcgc

SEQ ID NO: 61098 - DNA, 394 bp, Zea mays
  Clone ID: LIB3069-009-Q1-K1-A4
agaggtttgaggctgaagcctaagtactcttcccatagccttgtccaatacatggagatgatttctaaacttcggcaccgtcatttggtcagcatcattggtcattgcattgtcagtgatgaggagaatcctaatatcgccagctcggtatacctagtttctgaatgcgagacaaatggatctttaagaagtcaccttactgagtggaggaagcgtgaaatgctcaaatggccccaacgggtttgcgctgtcattggcattgcgagaggggttcagcttctgcataatctgactgctcctgggatcgtacagaacaatctcaacatagaacatatcctgctagacaagaccctcacgtctaagatcagcaactttagtctttcaatgattcaac

SEQ ID NO: 61099 - DNA, 390 bp, Zea mays
  Clone ID: LIB3069-009-Q1-K1-A6
gcgcgggcgcgtgggcggacgcgtggtcggactcgtgggcggacgcgtgggacctcggtcgcgcagccctcacccagcatggtgctccagctccactgcgccacaccgaccatcaccatctctccgcctcccgcccgccctcgtcactacccccaccacctctacggcgccagcggagcgctcccggccccagctcgcggcctcgggcaacttccccgcctcctcctcgtcggcgtcagagacccgcgcgcggacggagcggtctgccacgtgaggaggcaggtgcggtacgacgaggaagacgaggaggaggaggacggcgaggagtggggccacaacgaggacgtcgcgaggattgaacggtacagcgaggacccccgcgaccaggcg

SEQ ID NO: 61100 - DNA, 463 bp, Zea mays
  unsure at all n locations
  Clone ID: LIB3069-009-Q1-K1-A7
acccactcgtgcgatcatacacaacacagcctctcgtattgcttaattcattaagatttcacaaatggaaacggccagctgttactttcaagagaagaaagcaatgcacaaggcaatagttaccttgacagccggtgggaaccctccatcagtgacagtaataatggtgagcataatcatccataggcaggtctgcaaactatcctggagaattcagaagatttaccgtcaccatcagggagaacacaacctgccgttttcccacgtggccaaagctctggacaaagaattatgggcaatatgatggataatattttggtcagaagtcttacgtccaaatcaaatggtcaaacagatgatattgctccaccctcacctgtgaaggcccctgatgatgaggctgacaaggctgaagatgaagaaagccctatgatggaaactgtcangagcaaatgtattacac

SEQ ID NO: 61101 - DNA, 453 bp, Zea mays
  Clone ID: LIB3069-009-Q1-K1-A9
gcgtgcgcccacgcgtccgtcgacgcgtcctttcacgcttccggatttttttaggcggctgggggcctgcctgtctccactggaagctccggattacgtaggaaaggggcgggcggcatgaggatccagtgcgacgcgtgcgaggccgcggcggccacggtggtgtgctgcgccgacgaggcggcgctgtgcgcgcgctgcgacgtggagatccacgccgtcaacaagctcgccagcaagcaccagcggctcccgctcggcgacgccgcggcgctccccgccagcctcccgcgctgcgacgtgtgccaggagaggccggccttcatcttctgcgtcgaggacagggcgctcctctgccgcgactgcgacgagcccatccacgtccccggcacgctctccggcaaccaccagcgctacctcgccaccggcatccgcgtcggcttcagctccgtc

SEQ ID NO: 61102 - DNA, 407 bp, Zea mays
  Clone ID: LIB3069-009-Q1-K1-B1
cccggtcagagaacccagccgccgtcgcattggccttccaggtaagcagtaacgttcacggtatcggtcgtcatgaagcgcaacccccgcgtcacgagctcccgccggaagtgccgcaaggcgcacttcacggccccgtcctacgtccgccgagtgctcatgtccgcggcgctatcgacggagctccgccacaagtacaatgtgcgttccatcccgatccgcaaggacgacgaggtgcacgtcgtgcgcggcacctacaatggccgtgagggcaaagtggtgcacgtgtaccgccgtcgctgggtcatccacgttgagcggatcacccgcgagaaggtgaacggctccaccgtgaacgtgggcatacacccttccaaggtcatggttacaaagctgaagcttgacaa

SEQ ID NO: 61103 - DNA, 289 bp, Zea mays
  Clone ID: LIB3069-009-Q1-K1-B10
atccagctcactctccactggtcgtttactcttgcagctccacccttcactcagtgttagtgtgttattagctataggctctagctatccgcgccactccttcgtgtatccatcagccttctcatcgccaccaatggccactgtcgaggtccagaccccgaccgtcttggcctccgatgaagctcccgtcgtggagaccccgccgtcagccgtcgtgcccgaggagtctgcccccgcctaagccgatgccgaagccgaagctgctgctcctgctgatcccgacgagctt

SEQ ID NO: 61104 - DNA, 423 bp, Zea mays
  Clone ID: LIB3069-009-Q1-K1-B11
gcgctccactcatcttttcgcgtttagtacctttaaaatttcccccactcgccagtcgcagcaggacctgtagccatggacgccagcggagccggtagcaaggggaagaagggtgcggccgggcgcaaggcaggcggccccaggaagaagtcggtgacgcggtccgtcaaggccgggctgcagttccccgtcggccggatcgggcgctacctgaagaagggccggtacgcgcagctcgtgggcactggctcccccgtctacctcgccgtcgtcctggagtacctcgccgtcgaggttctggagttggcagggaacgcggcgaaagacaacaagatgacgcgcatcattccgcgccacgtgctcctggcgatccgtaacgacgaggagctcgggaagctgctggcaggcgtcaccatcgcgcac

SEQ ID NO: 61105 - DNA, 346 bp, Zea mays
  Clone ID: LIB3069-009-Q1-K1-B2
tcgcccgctcgtacgcccactcctccgatgagtttgattagagaaggttcagtcccttttagggtcagggcaagtttccatgtttctatgtttattaccaggaaaataaacagtccacacgaccatgcatcggagtggtaaacctgaactggtttttgcctgttcagcggaagctcaaatggcagaatcgcaacaacagtagcatcggcagctcaaaagaacccgcgtggaagctcaaatggcccgttcggttgctgttgatgaggaaggaaggaagagtgccgtgcaccaattcgctccgagcaagaatcaaatgtcatcgtaacttaaaacagattgttcacat

SEQ ID NO: 61106 - DNA, 306 bp, Zea mays
  Clone ID: LIB3069-009-Q1-K1-B4
cccactcgtccgcttctacaccgtgctgtttgccctttggaaggtggagatcctgaggtgggctgggtcgccttactcccagagcagccgggaggaggccttcatggacatggtccggtgagactgatgcggacgatgagaggggttggttgctcggcgccgtttacgctcggcggtgagctggtggcctcgtttcgtccttacccagagccttctccaccgtgctgaacgatctgaagtatgctgacactcatgaatgggtgaaagttgagggtgattcatcaaccgatgtgattactgaccatg

SEQ ID NO: 61107 - DNA, 450 bp, Zea mays
  Clone ID: LIB3069-009-Q1-K1-B5
ctcgtgagaagattgacaaaaaagtggacttccaatcaattcttgatttgaaacgattggttagtgactctaaaggaacagattttaaatacagcctttatggtgtcctagtccatacaggttggagcactcaatcaggccattactattgctacgttcgtacatccagcgggatgtggcacaatcttgatgataaagaggtgcgccaagttcgtgaagcagacgtattgaagcagaaggcttatatgttattttatgtacgtaacagtattgggaagtcggtggtgtgcaaagataataatgctgctaatttgctcaagaagaaaacctctgaaaaaatctcaagtttgaatggtattgcacaaaccaatgtaagagcacaaaatttgaatggtgtgtctccatttggtgataagacgcacggcacaatcattggctactctacaattt

SEQ ID NO: 61108 - DNA, 417 bp, Zea mays
  Clone ID: LIB3069-009-Q1-K1-B7
gcgcccacgcgtccgcccactcgtcctctcactcgtccggccactcgtccgatcggggactggatctcctaggtctgatctccagcttctgagaatgggacctgatggccacattgcgtctatcttccctggccaccctattgttaacgacaaagagaggcgggtcacatacattaaggattctccaaagccacctccagagagaattacattcacgtttacagtaatcaactcatccgcatacgttgcgatggtcgtgactggagctggaaaggccgcagcggtgcacaaggcgctctcatacaagcaaacctcgtcagacctgctgcctgttgagatggctgtgctgcaagatggagacttcacctggttcactgataacgcagtagtgtccttgctgcagaacatgtatagtcc

SEQ ID NO: 61109 - DNA, 259 bp, Zea mays
  Clone ID: LIB3069-009-Q1-K1-B8
cccggcccgacccactcgtgcgcccgctcgttctcccactcgtcctcacactcttcatccaacgcgaccaatcgagggatcgctctaattgaaccgagctcgagccccagacaatggaaccagatacccacacaacatccatctacccaggccaaccaatgggcaactacaaaacaagactcaccacatacattaacgaccctccaaatcacccatcagacacaatacaatcacctacacacaaacaacacataccaat

SEQ ID NO: 61110 - DNA, 372 bp, Zea mays
  Clone ID: LIB3069-009-Q1-K1-B9
tcgcccacgcgtccgctagatcgcgtatttcctgcatgttgtgtaatatgcctgtgctcatggggtgtaaattagaacataaaaatgttgtaatttttgttttcttgcctacaaattcccacttgatttcttatctggggtttggctaccgtatatttgtattcgaatgtaacgcacttgtgtatttttgtttttgggtttattacattcaacaaggtcagaactgtatcgtagaaaaaaaaaaaaataaactataaataaattttttttttttactaaaaaacaatatatctaaaaacttacattagccacatttctatattttttttaaaaaattacaatcttaatttcaatattaaataaatacttaat

SEQ ID NO: 61111 - DNA, 350 bp, Zea mays
  Clone ID: LIB3069-009-Q1-K1-A2
ctcgtatcgtcggagaaccaccgaatccatcgcattgcagagacgagtagaggttagatgtatgctgaggtaagatggtgtgcatccggcaggcgaccatcgaagacctgctggcgatgcatgcgtgcaacctgatgtgcctgccggagaactaccagatgaagtactacttctaccacatgctctcgtggccgcagctcctcttcgtcgccgaggactacggaggcagcatcgtcggctacgtgctcgccaagatggaggaggacccctccgagccctgccacggccacatcacctccctcgcggtccttcgctcccaccgcaagctcgggctcgccactaagctcatg

SEQ ID NO: 61112 - DNA, 352 bp, Zea mays
  Clone ID: LIB3069-008-Q1-K1-F8
gtcctgactaaggtgcttctccgtctcatcttcactactggcggcctcatcggggtccggttgtgtcccgcgtcctgccttgctcgtcctcctcattccagcagcaactacaactactactgcgactggtgccctcgccgttccaccgcctcccccgacctcgacgcgtcgttgctgcgttcttgtggaactagtagagacggcgacgacggtggcttctgctgcgggtacgggtacggggctgcggagcagctggacggaagtggagctccccacgtcgccgtcgcgggcgccgactccttcttccgcgccggcgccggctgctgcgcctgctaccagttgaggtgcaaag

SEQ ID NO: 61113 - DNA, 394 bp, Zea mays
  Clone ID: LIB3069-008-Q1-K1-G10
aagggacgcaggcaacaatgatttgcacagtagcatctgcaggctgtgggccgttcctccgggaatggcacctacactggtgggaccgggactcgcttgtttattctaatcctgtgagatcttcacgctggaccagctggtctgtcacgtctgtctgcatccagtgtagtcccatgtgggtagcatcagcatcttcttgtgcatcacacacccatgctaccccctagtactgctgtgcatatcatggtcatggaggagcagctacctatatgggctggtaatagtcactactactaattaatgctaaatgcatcatgtaacgcaacgtaataggagagcaagcgctataatctgatgcttgctgctgccatctgctgacctttggtttcatggt

SEQ ID NO: 61114 - DNA, 422 bp, Zea mays
  Clone ID: LIB3069-008-Q1-K1-G11
cccacgcgtccggaagcccctcaagttcgacttggcatcggcttaaggttgggagtgttcacggtggagatgaggactaccttcctctggctctgctgttacctgcaagcattgctgctgctggatgtgtgtgtttgataagtgactggctgctgctccatagaagatgaacggagagaaggatgatgaagaagggctttggcaatcgccgctgcaactgcaacccatgccatgccggcttagtgattgggtataatttggcttggcagcagccagcattattatgtgctgatcttttatctttactagtttggtcgtccgatatctttctttctttctccccccccccccccctttcgactctgtactgaaactgctgagagattcgcagtattggtggatcgtattcgtatgctactgtt

SEQ ID NO: 61115 - DNA, 288 bp, Zea mays
  Clone ID: LIB3069-008-Q1-K1-G12
cgggccatgagagtcgtcagaagctgatgcaggataagaggtcgaaacagtagcaggtccaaaagcaggtctgggacagtgggaccggcatttctgtcactggaagcgagcaacagcaggaagctgctaatgggaagcccaatccgtctgcaccagcaccaaacggtgtccctgcagaggtgaaggcagcgaaggcttctgcagagaacggcaccgtcactccagctatttcctacgcggcaaatgtggtccaagcagcatcagagaaacccgttctcgccaacggag

SEQ ID NO: 61116 - DNA, 409 bp, Zea mays
  Clone ID: LIB3069-008-Q1-K1-G2
ctcgagtccggccacaccaagtgcatctctgactatatcaaggttaacgccatggccgtgcgcgagtaccacatcgtcagccccgaccccaacttccccgatgcccagctccccgaatcgcaccgcatctccctcagggtgacgtcgccgtacgggaacagcatgcactacgcggagaacgtgcagtcgggccacttcgccttcacggcggcggaggccggcgactacctggcctgcttctgggcgcccgaccataagccaccggtcaccatcgggttcgagttcgactggaggagcggcgtctccgccaaggactatcccagcgtcgccaagagggcaaggtcgatatgatggaattggagctgaaaaagctagaggaaactataaaaatatacatgaagagatgttt

SEQ ID NO: 61117 - DNA, 300 bp, Zea mays
  Clone ID: LIB3069-008-Q1-K1-G5
cccacgcgtccgggaggatacaatggacgtttcagcaatgaggtttatacacttagcctcgaatcagattttaagtccaccacaaaagaagaaactgtctcagatctagggtcgtcgaaccagaggttgaaatggtgattggcgtggacagtgctgattcagacctgaagaacagtagtacagtactgatgaagcaagtgaacagttcttagcagctctcaaagctgagaaagaggaactagaagcgacacttaacacggaacagcttgaaaactgtacaacttaaggaatacattgctc

SEQ ID NO: 61118 - DNA, 297 bp, Zea mays
  Clone ID: LIB3069-008-Q1-K1-G6
gcgccggccttttttttttttttcttttgaattttggacattttctctctcgttgcggatgggttcaattaataaatagctgtacatgcttgcctcggaccatagctgcagaagcaacttgttctaagttaaacttgcttcgttgcttgtacttgacacatttgctgaaacatatatacacaacctctcccaccatgagaacagagcttcctcaggtataacttcccttcctcatcatttctacaaactcttcgtagtcgattctcccatccttgtctttatcaacttcgtccagca

SEQ ID NO: 61119 - DNA, 291 bp, Zea mays
  Clone ID: LIB3069-008-Q1-K1-G7
cccacgcgtccgcccacgctccggacccactctttcgcggacgcgtgggcggcgtgcttgggatctcaacccaagtcgtgcctccgctccggtcacccgtcgctccacgcaaccatgtcgaggaggaagaccagggagcccaaggaggagaacgtcacccttggacccactgtccgtgaaggagagtatgtctttggtgtcgctcacatctttgcatccttcaatgacaccttcattcatatcactgatttgtctgtgagggaaactctgggtcggatcacccgtggcatg

SEQ ID NO: 61120 - DNA, 450 bp, Zea mays
  Clone ID: LIB3069-008-Q1-K1-G8
cccacgcgtccgccttcacccaatcgattttcctagcgagcggcagcggcggcggccaggggagatgatggtgcgcaaggcgaaggttgagttcgacgagcagtcgccggataacttcgacccgaagaacccgtatgccgacccggtggcgatgctcgagtaccgggaacacctggtgcgagagaagtggatccagatcgagaccgccaagatcattcgggagcgcctccgctggtgctaccgcatcgagggcatcaaccaccaccagaagtgccgtcacctcgtcgaccaatacctataggctacccgcggcttgggttggggcaaggatgctccgccgcctgaacttcacgagcccaagaagaccgtcaaggctgagtagcggcgctggtgccttgcttctcgtgctgctgttcctggattggacaggtgatctgaccctttcattga

SEQ ID NO: 61121 - DNA, 430 bp, Zea mays
  Clone ID: LIB3069-008-Q1-K1-G9
gcaagaaatccaagctgggcttcactgcgtatccatctccccaggtgtcaacctgtgttgtggagccttacaacagcgtcctctccactcactcactcctggagcacactgatgtctctatcctgctcgacaacgaggccatctatgacatctgcaggcgctccctcgacattgagaggcccaactactccaacctgaatcgccttgtgtctcaggtgatctcatctctgactgcttccctgaggttcgatggtgccctcaatgtggatgtgaacgagttccagaccaacctggttccttacccgaagatccacttcatgctctcctcctacgcaccggtgatctcttctgcgaaggcctttcacgaacagctgtctgtggcggagatcaccagcagcgcgttcgaaccggcttccatgatggtcaaatg

SEQ ID NO: 61122 - DNA, 290 bp, Zea mays
  Clone ID: LIB3069-008-Q1-K1-H11
tcgcacgcgttcgaaaaaaataaaaaaaaaattataaattacaaaaaaaaaaaaaaaaaaaaaagaacacggtttaaaaaaatcctggcccactcaaaactaccaaaccttactttccctagcatacaacttcatatcctattctataatctcacctaaattcaacacactgtcacacgtttaacaccttcaaaaccgtaaaaacacccaccttacccaacttaatcaccttgcaacatattccattttcacaaatttccataataccaaaaaatcccacacttaccaac

SEQ ID NO: 61123 - DNA, 248 bp, Zea mays
  Clone ID: LIB3069-008-Q1-K1-H2
aaagtaaggcgatcagagatagcaaccttttacttcttttacatgatcccagccctgcttcttggctccaagaacagcataagtacctcccttctggtcggcgccgtgttccatcaagtatacatgttccacaaggagattcttctggactacgtgcaccatgatatcaccagaaagtgggctttgatttacttcaagctgcttttgctggtgatggctaaggacaccatcatgtacttcaatctgtt

SEQ ID NO: 61124 - DNA, 289 bp, Zea mays
  Clone ID: LIB3069-008-Q1-K1-H3
cttggtccaagggttttgtcgattcgaggtttagatttagtcaaatgctagcgcacttaggagtactgacctaaggtatgccatatctaacgtacttccaaaatcttcgggttgatccttaaccagctggtttagctctggacgatatgccatggcaaaccatttcataagaaactaattccaatttgactcttaaagatgaaactgaagaagtaaaatagggtcatggactccgagggatcaaagctatcattcgcttccttgcaaagttttatggatcttatagact

SEQ ID NO: 61125 - DNA, 56 bp, Zea mays
  Clone ID: LIB3069-008-Q1-K1-H4
aaaggaacaggaacatagacagcaacccatacaatttagaacaagaacccagccca

SEQ ID NO: 61126 - DNA, 319 bp, Zea mays
  Clone ID: LIB3069-008-Q1-K1-H6
acccacgcgtgcgcgccgaaggagaccagatggtggttccatgacgacacggtgtaattgagcgccggacaggcttccttgctgtggtatatctcgtcaaggggagattggggatgatttaggcctatttgtaagcatccctctatcggattgcgaagcttaccttgctgtggtggtgtgttaaatgagttgcacacatgtgtcgagtctgagaatacatattaccatcatcaatgatataagtaatatagaataagcatgagtgtaaaaaacaatgtatatattcattaatctcttgcgtgtgttggtgttttcagca

SEQ ID NO: 61127 - DNA, 220 bp, Zea mays
  Clone ID: LIB3069-008-Q1-K1-H8
cccacgcgttcgcggacgcgtgtgtgagttatgtgtaaacacactgaagaaggagtggggccctatccttggattaagacatgttcttctggtagtgagatgccttctgatcgaaccatttgctgaatctgcacttaatgaacaagctgggaagatgctactcgaaaattatgaggaatatgcaccgcatgcaaggttatacactggcatccatgccctc

SEQ ID NO: 61128 - DNA, 126 bp, Zea mays
  Clone ID: LIB3069-008-Q1-K1-F7
cccacgcgtacgcccactcgtactttcactttttggctcacgctttttctcactaggtgggtttattttaacatgaatctatccacattttcttagcacataaattacataatcattatacacaaa

SEQ ID NO: 61129 - DNA, 73 bp, Zea mays
  Clone ID: LIB3069-008-Q1-K1-H9
aaaaagaaaaaaaaaaaaataaaaaaaacaattttaaatacaaacaaaaaaaaaaaaagaacaagaccgggtt

SEQ ID NO: 61130 - DNA, 409 bp, Zea mays
  Clone ID: LIB3069-009-Q1-K1-A10
gaagcggccaccactgtgactccgtgacctttctgccctgctgcacagcacatcacacacagcccgcacaccgcaccagctcagctcagctcagctcaccaagacaatcaatcatggctcgcccgcgcagtgtcgctgccgctgcccccctcctcctgctgctgctcgccgccgccgcagctgggctcgtgtccgccgcgtcgcctgcagccagcgacttcgtccgcaagtcgtgccgcacgactcagtacccgtcagtgtgcgagcatagcctggcgtcgtacggctggtcgccgtcgccgcggagcccgcggtagctggcgcgcgccgagctgtcggtgagcgcgtaccgcgcgcgcgccgagtcggcgtacgtgggccgtctgttctgcgccagcaacggcaaatg

SEQ ID NO: 61131 - DNA, 445 bp, Zea mays
  unsure at all n locations
  Clone ID: LIB3069-009-Q1-K1-A11
gcgagaagatcagccagtgttggcgattggtcatcaaatgataagacaacgtctactggtcatggaaggaatgaactctgcaatagctctgtatctacatcaattctgattccgcatcttcaaaaccttgcgaagcaaactgcactccagcaagatctgattacgaacctactaagtagcttgcaacaaaatgagagagtcgatgcagctcagtcatcaagagttcagagcacgacgagtgatacagtggttgaagctgctactgctgacagagaacactcgttacttgttaaaatttttgagttacaatctaggatgatctctttgactgacgaattaattgcggcaaagctganacatgttcagctgcaggaagagctaaatgtactctactgccaagaagaaatctgatttgagagaggacgagaacgaagaagcatgatgc

SEQ ID NO: 61132 - DNA, 424 bp, Zea mays
  unsure at all n locations
  Clone ID: LIB3069-009-Q1-K1-A12
atccgatgatgaaaagcctgaaaatctggattcattgatcgctgctgttaacagcagcgatggcagtctcattgttcatgtccgtcctggtgaaaatgctctctctgatgtcctcctaagcactcctatatttactggtgaagaaggtggaagtggttttgctgcttctgcagcagctgccgtagctactggagcatctggatttgaatttggtgtggacccaaatgtagatccagagttggcactcgccctgcggttgtctatggaagaagaacgagcaacgcaagaggctattgcaaaaaaggctgcagatgatacatctaataccgaaaatatcaatgcctcaagctcaaacagcgattctgttatggctgaagcagaacttgcctcanatgctgctgctggtgacaagcaagaacagcca

SEQ ID NO: 61133 - DNA, 101 bp, Zea mays
  Clone ID: LIB3069-001-Q1-K1-A1
ggcctcctggatctcctgggacatatggtgtttgacacccagcagatcataaagaggcctcaaggtggccacatgggctacatcaaccaggcgctcttatc

SEQ ID NO: 61134 - DNA, 415 bp, Zea mays
  Clone ID: LIB3069-001-Q1-K1-A10
acacacacacagacaagtggtttccaaagccaagtttgtgtactagcaaccagctagctcgggcggcagcaggcagccatcatgtcggaggagaagcaccaccacttcttcaaccaccacaagaaggacgaggagcagcccgccggcgagtacgggtactccgagaccgaggtggtcaccgccaccggcgagggcgagtacgagaggtacaagaaggaggagaaggagcacaagcacaagcagcacctcggcgaggccggcgccatcgccggccgggcctttcgcactctacgagaagcacgaagcgaagaaggaccccgagcacgcgcacaggcacaagatcacggaagaggtcgctgccgcggcggccgtccgcgccggcggctacgtattccacgagcaccacgagaagaag

SEQ ID NO: 61135 - DNA, 442 bp, Zea mays
  Clone ID: LIB3069-001-Q1-K1-A11
ccggttcgggattcgaccctcgcgtcacgcgtgctacaacaggccttatatgaactacaatgttattcgtgctgataacatggtgatccaggcaatctttctattggatatgcttaacaaggacatcaattccttctccatgagagtcagcccctcaaatcaactttggaacccaaatggtcaagcctttggacggaaagttcagcaaaggtaatcgattaaagaggcttcacagcagtggctgagggacccaggagttgtggggcgtcacagataatcggcatggaatttagtagtttataacagtgcctgaaggagctaggatttatgaatcattctccaccaccttgaggtactcaccggagccagaatttatgaatcgttgtccaccatctcgagatatgatattgacatgaccaaatgcatttactgtgggttctac

SEQ ID NO: 61136 - DNA, 424 bp, Zea mays
  unsure at all n locations
  Clone ID: LIB3069-001-Q1-K1-A12
cccacgcgtncagccacgcgtccgcccacgcgttttcccacgcgtccgcccacgcgtccgcggacgcgtgggttctacatcacaacccttcgttgagtcctatcaacctttcattgctcaggtagctggcttttttattgttgaggaccgtgtctttcgaactgcagatggacttctatctgagagccaggttgatactatgttggaaacagccatttctaaacttactctgatcttagaggaacagttctctcgcattcatgctgccaaccacctnctnctcattaaaggttatgtcagcctttttggtgcaaccctggagaagtatgggtaccgatccatgtcgctggctgaaatccttgataaaactagggacaagtatcttgaacttcttctttctgactgccggaagcagctcaacgag

SEQ ID NO: 61137 - DNA, 340 bp, Zea mays
  Clone ID: LIB3069-001-Q1-K1-A2
tcgggactttgaggttaaaaacagttagatttgtaaagaattcttttcatttaaaattgagggggcgtgatgatatagtgccagaacacactggggggtaaatgggtgtgacaggtaatgttagctttcatctcatttagtttgaggtccgctaatagctgcttactttttatcttaccgtcttgttctgtttgtgagagactttgaaggccaatttctaaggaaatcaagagtaatttagatttaaagatgtttacgaagctgttacacattgaattagtatgtgatctacaaccaaactctgtcccatatgagcggtcatagattttctgagatgact

SEQ ID NO: 61138 - DNA, 466 bp, Zea mays
  unsure at all n locations
  Clone ID: LIB3069-004-Q1-K1-G3
cagagacttcttgaatccactagctaagctttccatgttaaagttcgctcttggtcaccagcgcnaggcctacgacgccggctgcgtccgtgccgtcctcgccgagctcatcctcaccttcctcttcgtcttcgccggcgttggctccgccatggcaacagggaagctggccggcggcggcggggacacggtagtgggcctgacggcggtggcgctggcgcacacgctggtggtggccgtcatggtgtcagcggggctgcacgtctccggcggccacatcaacccggccgtgacgctgggcctcgccgtcacgggccgcatcacgctgttccgctccgcgctctacgtggccgcccagctgctcggcttcacgctcggctgcctactcctcgctttcctcgcagttgccgacagcggcgtgcccgtgcacgcgctgggcgccggcgtctgcgcgctccggggcgtg

SEQ ID NO: 61139 - DNA, 376 bp, Zea mays
  Clone ID: LIB3069-004-Q1-K1-G4
ccgaccacgcgtccgggcgttagcgatggtcctgttcatggctgtcgccgttctgctcgccggggctgccggcggcggcgcgcagcatggcgtgtggagcatcatcacccggcccatgttccagagcatgctgagccaccgcggcgacagcgggtgccagggcgccttctacacctacgacgccttcatcgaggccgccagcaagttccccggcttcggcaccaccggcgacgagcagacgcgcatgcgggagctcgccgacttcttcggccagacgttccacgaaaccaccgggggatgggcgactgctccggatggaccgtttgcctggggatactgccgggtgaaggaacataaacagacgggcccaccctac

SEQ ID NO: 61140 - DNA, 414 bp, Zea mays
  Clone ID: LIB3069-004-Q1-K1-G5
cccacgcgtccgcccacgcgttcgcaaaattctttgacccttcagagtgtgcttgggcatatggtatgaatatttttgacctgaatgcatggaggaagacaacaatcaaagatcagtatcatcattgggtcaaggggaacttgaagtcaaacttcacactttggaagcttggaacattggcaacaagccttattggctttaaaggccatgttcacccaattgaaccatcatggcatctgttaggcttgggttatcaagaaaagatagatgtcagtagcgttgaacaagcagcagttatacattataacgggcaaagtaaaccgtggctggagattggttttaaacatcttcagccattttggacaaaatatgtgaactactcaaatgaattcataagaaactgtcatataatgg

SEQ ID NO: 61141 - DNA, 427 bp, Zea mays
  Clone ID: LIB3069-004-Q1-K1-G6
cccgttgcaagtatagtctcttcggctcttgaagacgatgggcaaggacgacgtgatcgagagcggcgctggcggcggcgagttcgctgccaaggactacacggaccctcccccggcgccgctgatcgacgcggctgagctggggtcctggtcgctgtaccgcgccgtgatcgccgagttcatcgccacgctgctgctcctgtacatcacggtggccaccgtgatcgggtacaagcaccagacggacgcgtcggcgtcgggtgccgacgcggcgtgcggcggcgtgggggtgctgggcatcgactgggccttcggcggcatgatcttcgtcctcgtctactgcaccgtcggcatctcggtgggccacatcaaccccgacgtcaccttcggccctttcctggcgcgcaaggtcctcctggtgcgcgcg

SEQ ID NO: 61142 - DNA, 413 bp, Zea mays
  Clone ID: LIB3069-004-Q1-K1-G7
ggaagcaatggccactgcgttcggtgtaattgttgatttcattgaccaggaactgtcacggttcattgcagctgggaagctgcactgcaagattgataaggttgctggtgttctggagactaaccgacctgatgagaggaatgctttctaccaggcgaccatcaagcaaggggacttcttgctgaaccgcatccagaagctttcacgggtcattgacctgtaaggactgtttgtgttggagctattcctgcaatcggcgcctgcaaatgtttcccaccctacgtcttccacaagacatctctccttgagtggggattggggaacaagccctaagaacatctgtgttttaagtgcagaatatttgtgttttaatcagtaaacgctgtccaaaaaaaaaaaattgcccaagatct

SEQ ID NO: 61143 - DNA, 295 bp, Zea mays
  Clone ID: LIB3069-004-Q1-K1-H10
gaccactcgtccgctgaggttccagcgttcgcgctctcttctcctctccgtcggcgacgactacgccgggtgttctgtagacccaggtcgttgccgcctacgccaggtgcccaaatcttcttagggcccttcgccggcgacgagcacacaagcttggttgacccccaacaaattgcaaaatgtcagccaatgtcggtgaatcaaccagcggtggcagcagcaatgatgcagctggggggagctttgaatgtaacatatgctttgagctgcctcaagagccaattgtgactctttg

SEQ ID NO: 61144 - DNA, 314 bp, Zea mays
  Clone ID: LIB3069-004-Q1-K1-H11
cgaaccgacccactcgtccgatctgctcctccaaagatctgataagctgttatgtttgttgcaattcataacattgttcagacagggtaccacggcagaacacgtacaagcccagacgagcactgtacatagctacaataagtcttctgacatcaccaagatgacccacaaaacgggtactgacaagatatagtacaatgaaatcatttcgctggccctggaacttgtccacaatggtaaccttggtagggggctcaatattccatggtttgcatcttctgatgatcacatcacgaataataagcttctgacca

SEQ ID NO: 61145 - DNA, 401 bp, Zea mays
  Clone ID: LIB3069-004-Q1-K1-H12
aataccgagcacgcgtacgatcgacaccgctcctacaactgtaggtcttttgctttgatcgtcaggtttggcttgatggctaagtgggacatgaagtttatgctgcggatcctactgccagcagtggtgctgttgtaactgcagaatgcactgtcacagaactttcacttggagatcttgaagggcttctgctgcaaatagccaatgaccagcacatggtcgaatcccaatcagatctttctgcaccaactccacatcataacttgaatcaagcttacattggggatttacatgaatctcatggtgctcgggttggtaatccttcttgtatagttcaggaaagcacattttgtgaaccacggacttgaccaaatgatcaatttccacaggctaatgtaacc

SEQ ID NO: 61146 - DNA, 248 bp, Zea mays
  unsure at all n locations
  Clone ID: LIB3069-004-Q1-K1-H2
acccactcgtccgggagaggatccgttgatcagggcagggctttaggccttcagcagncnngctatcctaccggcaccgcgtcaccgacagttcttgcacagctacagctctgtagagggatagtagaggattcttatcatgcgttttgtattctgacctttgcttgttgtgagacccagtccacatgaagatgttttttttatttgttattgatactttcacgacgttgaagcatacaattatatgc

SEQ ID NO: 61147 - DNA, 450 bp, Zea mays
  Clone ID: LIB3069-004-Q1-K1-H3
tccggatgggcgtctgcgtactcgcctacctcctttgctcattacctttcccccttctcccaatggccgccggcgatccatcccgtaacgcgacaccatgagggagtgcatttcgatccacattggccatgccggtatccaggtcggaaacgcgtgctgggagctgtactgccttgagcatggcattcaggctgacggtcagatgcccggtgacaagaccattgggggaggtgatgatgctttcaacaccttcttcagtgagactggtgctgggaagcacgtgccccgtgctgtttttgttgaccttgaacccactgtcatcgatgaggtgagaactggcacctaccgccagctcttccaccctgagcagctcatcattgggaaggaggatgcagtcaacaactttgcccgtggtcactacaccattggcaaggagattgttgacctgtg

SEQ ID NO: 61148 - DNA, 403 bp, Zea mays
  Clone ID: LIB3069-004-Q1-K1-H4
ggacgcacccacacggccgcatggtcaccaagccgacggctacctggttcacggggaacgattccgtcgggctcaacgccactggccaccagtacttgctctgcggctacccgggccactgcgctgccggccagaaggtggacatccgcgtcgcctcctctgctgccccttccgccgcaccgtcgccgaccccctacggctccaagccctgcggcggcgccacggtcgcgccgtcgccgcaccctaacgccgcgccgaaggccctctccgccagctccgtagccgcggctgtcgccacgtccctgctctccctggccgcggccgtgctggcatgatcacttgatcaggatcgcgtagtgctggccaggggacagcgcctttgcgaattgtgagagctcggact

SEQ ID NO: 61149 - DNA, 453 bp, Zea mays
  unsure at all n locations
  Clone ID: LIB3069-004-Q1-K1-H5
cccacgcgtccgcccacgcgttcgcccacgtgtccgcaactctttcccaaatgcaccggcggctcggctcgcccatcttcgcgccaagcaccgaatctccgatggcccgcacgaagcagacggcgcgcaagtcgacgggcggcaaggcgccccgcaagcagctggccaccaaggcggcgcgcaagtcggcgccggcaaccggtggcgtgaagaagcctcaccgcttccgccccggcaccgtcgcgctccgggagattcgcaagtaccagaagagcacggagctgctcatccgcaagctgcccttccagcgcctcgtccgtgagatcgcgcaggatttcaagaccgacctncgcttccagtcctccgctgtcgccgcgctgcaggaggccgccgaggcctacctcgtggggctcttcgaggacaccaacctttgggccatccacgccaagcgcg

SEQ ID NO: 61150 - DNA, 447 bp, Zea mays
  Clone ID: LIB3069-004-Q1-K1-H6
cacgcgtccgctgcgcacgcgcctcaacccttcctctttgcggcggcgccggcaaggcgggagccaagcggagctggagctgcgatgaagaagatcttcggcgccaaggaaggacaaggggcccggcccccttcattcaagacgcccccgaacgcattaaccaaccgggttaaaccggggccagaagatccaaaacttgaccaggagctctccccgtgcacagggcacatccccaagacccgtcccgggccgttccaagaagccatctaggcacccgccatacgactcctcaagcacaagcgcatgtaccacgagcaacgcaacatgttgtacaaccaaacctacaatctcgaccaaattggctttgctgccgatggcctcaaggatgctcaacagactatgaatgccatgaaggcagcaaacaaggagctcatgggaatgatgaaa

SEQ ID NO: 61151 - DNA, 403 bp, Zea mays
  Clone ID: LIB3069-004-Q1-K1-H8
cgggcgcgtgggcggacgcgtgtgcgccttctgccttctgcgcctccatttcggcctcggtcccttgcaagttcagtctcgcctccaaccatgggtaaagagaagtcccacatcaacattggggttattggccatgtcgactctggcaagtcgaccaccacaggacaccttatctacaagcttggaagcattgacaagcgtgtgatcgagaggtttgagaaggaagctgctgaaatgaacaagcggtccttcaagtacgcctgggtgctcgacaagctcaaggctgagcgtgagagaggtatcaccattgatattgctctgtggaagtttgagaccaccaagtactactgcacggtcattgatgcccctggacaccgtgacttcatcaagaacatgatcactg

SEQ ID NO: 61152 - DNA, 458 bp, Zea mays
  Clone ID: LIB3069-004-Q1-K1-G2
acccacgcgggcgtccgattcaccctcttacatttattcactgtacgtctacatacaactcctcgctatgcaaactaatggagtattgtttgagtccagctgttattacgcttcaggaccgcctgaaggaaaatgaacttcggctatctatgttaaaagaggagtgtaagcaactggaggctgatacccaaggcatgagaaatggttctcctcgtcgcctcatgaatcacggagctggtggcagcggttcacctatggctcagagcaggcatcctttctccagccaagggagccctagaagcccgagcggcggcagccggaggagggcttgatgatgatcttgctccgcctgatgcgttgatgaactgtccgttgtggcttaaccagatgctttctgaaaacccagatatttgacggacgaagtgcccagacaacagacactgtacctgtacataccc

SEQ ID NO: 61153 - DNA, 351 bp, Zea mays
  unsure at all n locations
  Clone ID: LIB3069-004-Q1-K1-H9
gacccacgcgttcgccgcgcgtgcgcccactcgtccgcccacgtttcctcccacgcgnccgcccacgcgtccggccacgcgtccgtccacgcgtgcgcccacgcgtccggtacttccaaagttccacagttccactgcacagatcgtcggcggcggcgcaggcaaggccacaatgtcttcggcgcccagcagcggcaagcgcgggagggttcccgacccggaggaagacgtctacgtcgacaacctccactcccacaagcgctaccttaccgagataatggcatccagcatgaatggcttgtccgttggagattcagttcctgacaatatcatggggtccccaatgagagt

SEQ ID NO: 61154 - DNA, 224 bp, Zea mays
  unsure at all n locations
  Clone ID: LIB3069-005-Q1-K1-A1
cgtgcgcggactcgtggaggacgttggggctgcaaggcttgcaggnaggtgcaagacanactttgacaagcttgggtgtagccatattctcggagagtacagaatggagttaccagagtacaacacgattgaaccttatgcgaaaatgaacgagaactgtccgtccttgccctcatcttacaaacgacccgaacgctgctgactacgagattgtctactatgta

SEQ ID NO: 61155 - DNA, 262 bp, Zea mays
  Clone ID: LIB3069-004-Q1-K1-E7
cggacgcgtgggcggacgcgtgtgtgccttatcagatccatgaaattaaatacgtcctcggcacacttaaaatgacgtatggcctatcatactaacccatcataaacatctccttgactaatctttatctacacctgcacaactacaagttcacatcgagataaacctgcctgatgaaaatgctacgcttcaaattcttcatattcatacatataatactaatgataattctctactatcaccagatattaatctacttgat

SEQ ID NO: 61156 - DNA, 460 bp, Zea mays
  unsure at all n locations
  Clone ID: LIB3069-004-Q1-K1-E8
gcatgaggaaatcaacgactgattctccattactgtcggtcacttcggatggcggcaccgccngatgggaatgtccgcttaggcgaggggtgggacgaggacgacgtgctggagccgcagccgctggaggtcatagcgccggatgtcaagtccaagaagcgcaatccggcgcccggagttcgggttgttggtcgccggatctacgatccagagaatggcaagacctgccaccaatgccgtcagaagacaacagacttcgcagcggcgtgcaagcaagtcaagaagaagggtccgtgcccagtcaagtattgcctcaagtgcctccttaacaggtatggcgagagtgccgaggaagcggccggcaaggaagactggatctgtcctaagtgcatgggcatctgcaactgcagcttctgtagaaaggagaaaggccagatgccaactgggataatggcccaca

SEQ ID NO: 61157 - DNA, 358 bp, Zea mays
  Clone ID: LIB3069-004-Q1-K1-E9
ccgtcccgacggcacgcgtccgcccacgcgtccgcccactcgtccttttactcttgggcttcaacaggttgcattaagccgggatgcatctcctgatgctgcttttcggactgatgtcgctaagcgtgcatttgttggttggatgagagatctacgtggcatagctatagcaaccaacagccgcaagacatatggcctcctattcgactggatgtatccatctcgcatgccacttctgctgatagccatctaactttgcactgatgaaccagatgtcaccacacccttgctcaagttcacgtttgaatttatttttgaacaaaactcaaaaactgacatcagatttatcatcaccaaa

SEQ ID NO: 61158 - DNA, 315 bp, Zea mays
  Clone ID: LIB3069-004-Q1-K1-F1
tcgcagacgcgtgggtagacacatggactgacttgtgatcgaacccgctgggattggtaaacgagatcgggagtttattgcagtggaacaaactgtgatggcacaagatgtccaagaccaaagtgatcaggagcgcacacattgacacaaaggtgcgagcagggagaaccatcccacggaggatctacatgttcacagatccaggatccccgggcaggaaacatgttgcgagagcatcacatgagccgaaagcagagatcacaacatctgaaggaaaacatatccatgaaattcctgtttccaggaatgcaagcc

SEQ ID NO: 61159 - DNA, 396 bp, Zea mays
  Clone ID: LIB3069-004-Q1-K1-F10
gacccactcgtccggatgatgatacttgctttcctgacttcatttgcttttgctcggcgcattatgaaagcaagatcggtcctaaaggttgctgcaaaggtcgttggcgaagtgcaggcacttattatttttccagtcgtgccatacttgatcctcgctatcttttacactttctggttttcagcagcacttcatcttttcagcgcctgtcaagttatacaaaatgattgcaatacagattgctgttcctacgatctgaaacttggcaaagtaaattgtgacagatgttgtggctacactatccattacaccccacatattggcatcgccattcttttccatctttttggctgttactgggcaacacaagttttcatcgggtgttcttcgactata

SEQ ID NO: 61160 - DNA, 409 bp, Zea mays
  Clone ID: LIB3069-004-Q1-K1-F11
cccacgcgtccggagcaatatatatttggtgtgaggtacacagggattaagtcaaggggcgagaccgttcgctaggctttgattgcttgagcaaacacgttttgctatcgctcaagcttgttatatgctcatgtggtggttcgggtattgacttaagtctctggctaaagaaagtgaaacaccacctattacggcttctcctatatataaaatatatatgtagcagattgttttcaaccatcttgtgaagagttctgatcttttgtttcttcgatatagcgaaatatatagatgagaatgtctctgtgtttgtaacgtttgtgtagtgttatttccgttgagttgatatatatgacatgtacgctttggtcatttgggaaaaatatggtctagtgtagctcactttaaa

SEQ ID NO: 61161 - DNA, 255 bp, Zea mays
  Clone ID: LIB3069-004-Q1-K1-F12
cttactttgtgaacaactgtatcttcttctacgagccgaagtgcatcaagactggtttctacgacaatggctcgcactcaccgttaaggtgttcctcgtgccacttcttatgcaactccaccattgatccttaccttgtctcacaccatctcatcctttcttatgcttcttttgtcaagctatacctatacaagtctcatctttaccagaacgggaagattgtaatactactggatttcttgtggtactaacctt

SEQ ID NO: 61162 - DNA, 54 bp, Zea mays
  Clone ID: LIB3069-004-Q1-K1-F2
cccacgcgtgcgcccacgcgtgcgcccacttgtcctttatggcgatgtcgcgct

SEQ ID NO: 61163 - DNA, 447 bp, Zea mays
  unsure at all n locations
  Clone ID: LIB3069-004-Q1-K1-F3
actgagcacagcacaggcagttcgagagattgtagagatagagagagagataaatatgtcggggttcgggcaccaccaccacaaccagccggctcccccggcgtcgggccccaaccaggtgttcaagatcttctgccgcgccaacgagaactactgcctggccgtccgcgacggcgccgtcgtgctgggccccgtcaaccccaaggacgaccaccagcactggtacaaggacatgcgctttaacacccgggtcaaggacgaagaaggcatgccggcgttcgcgctcgtcaacaaggccacggggctcgccatcaagcactccctcggccagtcccacccggtcaagctcgcgcctttcagcccggaccaggaggacgcgtcggtgctgtggacggagagcaaggacgtgggcaagggcttnccgtgcattcggatggtcaacaacac

SEQ ID NO: 61164 - DNA, 468 bp, Zea mays
  Clone ID: LIB3069-004-Q1-K1-F4
cttggccctgctcctttgcaggatatggctaggcaaattgctacactacagccaatggcgctactggctataatagggattacctgttctcaatggagaaggcattagccagcattagtccccaaactcgacgcgcaggtacgagaattagccaccagccgacgggatctcgatggcgagctccgcgtagcagaaggacaagagcagcaccgccaggtccccaaaccattttcgcgcgggtataaaaggctatcatgaagctttctggtcaaagtcccaaaagaatgagagacctatcaaatcagcaagcccgaggactgggaatgtaagccaacgccaaaaaagttcttcgtctggttctacggcaccgatgagatgtttatgcgccatcctgagtattccagctttcctatatggacagtttgaacccaaggtttgctgtgtaatctaatatcaacagttgcactc

SEQ ID NO: 61165 - DNA, 268 bp, Zea mays
  Clone ID: LIB3069-004-Q1-K1-F5
cccacgcgtccgcagcctcgctgtcaagatccgcaacagcggacagacacgcgggtgtgcggtcttgatacacgtgcacgaagggatctaccaaaagctcgcacaagcactcatccaggctgagcacagattgaaggtcgagaacggtctataagagagtacacctcagggccccctgattaacgaaactgctgcgcaaaaggtggagaagaccacaaaagacgcaacctctaagggagcaaatgtcatgccaagacggaaaagacac

SEQ ID NO: 61166 - DNA, 461 bp, Zea mays
  unsure at all n locations
  Clone ID: LIB3069-004-Q1-K1-F6
ggagggcaaggttgaggatgtttatgagtttgaagaaaaggaaaagaagaaggggaagagcaaggaggtttctcatgagtggcaattggttaacaagcagaagcctatctggatgagaaagcctgaggagattaccaaagaagagtatgctgctttctacaagagcttgaccaacgactgggaggagcatctcgccgttaagcacttctctgttgagggtcagcttgagttcaaggctgtcctgtttgtgccgaagagggccccctttgacctcttcgacaccaggaagaaactgaacaacatcaagctctatgtgcgccgtgtcttcatcatggacaactgtgaagagctgatcccagagtggctgagctttgtcaagggcattgttgactctgaggaccttccnctcaacatctnccgtgagacccttcagcagaacatgatccttaaggtcatccgga

SEQ ID NO: 61167 - DNA, 412 bp, Zea mays
  Clone ID: LIB3069-004-Q1-K1-F8
gtggctggtcaatggttttatttaccagtttaggctgacaaaaaggagggtggattctgggtagcactagatacacgagagctattttacagttttcatactgatgatgtgcctgcagaatcagttatgcacaaatgtgtggtccatttcattcctcagcaaaaacagattcccagtctaaagcagcatccgggatttattgtccagaaggtctatgatgcagttgagaagaaactgtggaacctaacagacaaggactatgaggataacaagcagcaagagattgatcttctggttaagaaaacaatagaccgtattgggcagcttcctgatctcgaacctgaagagacacctcttgagaacaattatttgtcaaataaacgaggcctgcgtaagaaacctgttaacccta

SEQ ID NO: 61168 - DNA, 415 bp, Zea mays
  Clone ID: LIB3069-004-Q1-K1-F9
gaccgcactcgtccgcccacgcgtccgaacattgagatattagttttgttactaagaaagatgcaataaaggttgtgtcctgtcttccatgctgcacctgtttcacattacaccagcacgttttaaacaatatacaaggattatgtcccacagtgctcatgaaggacataatggatgagaatattttatttcaacttctgctgttatgtctttctataatcttttaaactagtctcacttgctctatattcttaaaagctgctagcgatgtgtatcatctttattggttcttgacacctctaaactgcttcatttgtagtgtgatctggtggccactttgaaaagcatgaataactaattagcattgatgaccgaaatatttttctttggaacctaaaccttgtcaattaattaa

SEQ ID NO: 61169 - DNA, 128 bp, Zea mays
  Clone ID: LIB3069-004-Q1-K1-G1
gccgacccactcgtccgaccaggcgtccggtcgttcacgtaatcatttttcagtttcctgccatacgcacggaccagggtaagggtactgtctatattgctgcccggactaggtcccaaaacacaagc

SEQ ID NO: 61170 - DNA, 392 bp, Zea mays
  Clone ID: LIB3069-004-Q1-K1-G10
cgacccacgcgtacgcgggcgcgtgggtactgatctcactgatcttggattgctatggcaaaggcaggcgcgccgggggggtcggcggcccagctggtgactctcgggctatcactcctctgcgctgtcgccggcccggccgccgcgcagaactgcggctgccagccaaacgtatgctgcagcaagcttggctactgctgcacgaccgacgagtactgcggcgacgggtgccagtcgggcccgtgccgctcgggcggcggcggcagcagtggcggcggtggtgcgaacgtggctagcgtcgtcaccggctccttcttcaacggcatcaagagccaggccgggagcgggtgcgaaggcaagaacctttacacccggagcgcgttcctgagcgc

SEQ ID NO: 61171 - DNA, 290 bp, Zea mays
  Clone ID: LIB3069-004-Q1-K1-G11
acccacgcgtacgcccacgcgtgcgcccacgcgtccggaggatttcgttgagatctaagatagagaatcgctggggacagtctgttgtctgctgcgtacggtggtgttgaaggggagaagtttaagatctgttccacagatcacgcgtgcgcgctcgcgaatcggaggttccacacatagcttcgtcgttttgaatttgatgtactaatggagtctaagggtggcaagaagtctagcagtagtcgttccatgatgtatgaagctccccttggctacagcattgaagacgt

SEQ ID NO: 61172 - DNA, 272 bp, Zea mays
  Clone ID: LIB3069-004-Q1-K1-E6
aaaccatctccacacaaagattgatagtggggaggcgctgaataacgcatggcgtattggaatgacccatcgcaaagatatgcttgacgaaactctattgagacctggacgataggaagatcacatcgagataaacctgcctgatgaaaaaggtcgcgtccaaaaacttcagatacatacacataagatgaaagagaatactttcctatctccagatattaaacttcttgagctagccgcaaggacaaagaactacagaggagcacagatgg

SEQ ID NO: 61173 - DNA, 314 bp, Zea mays
  Clone ID: LIB3069-004-Q1-K1-G12
tctgcgactactacagccagtaccacatgttcgttcaagagatggtcgggtacctcaaggcggggaagatagcctacgtcgaggacattgctgatgggctagagaaggcgccggaggcactcatcgggctcttcaccgggcgcaacgtcggcaagcaactggtcgccattgcgcgggaatgaatgctgggcatccatatctacgttgagaataatgtcgtataaactataaagcatgcgtacgttttcagacgtgttaggaattgatggtttgcagtgcttgcagttttatgctgttcgagtgaaatgtttcaa

SEQ ID NO: 61174 - DNA, 353 bp, Zea mays
  Clone ID: LIB3069-004-Q1-K1-C9
cccacgcgtccgcccacgcgtccgttgcttctcgcatggcctcctctacccagggggccggaaactgcctcccaaattctcaaatggggcctgctgttccacggcgagggcgtcggaccggagcgagctggcgggtaaaagcgggggcttggcttggagagcggcggggagaaaggggcggctgcttggcgtcaccggagctgggcgaggccccttctttggcggcggcgggaggcgtatggacaagggcactagccgggtcgtggggaacctcgccttcgccgtcgtcgtgacgtacctcgacgtgaccggccagctccggtgggttattgacgccatcgtctctctctggc

SEQ ID NO: 61175 - DNA, 373 bp, Zea mays
  Clone ID: LIB3069-004-Q1-K1-D1
acccactcgtccgcccacgcgtccgctctctacaagtccatatttcccattcacacacactacgcacgcacacgggagacatggacgctcagccaaagcatccacacacagctctcttcctactacacttcatactagctagtctctgagccctctagactctagccacttacacacgcgccaacgccaataatttccataacatacaaagcaacagcaattgcgaagacttcgacgagagatgcaagatgcatggactactgttctccaaacgacacgcagcagccacttaagatgcatgctccgccctaccctcagaatgacctgagcattcgattctacacgttctaacacgacctagaccaattcatca

SEQ ID NO: 61176 - DNA, 343 bp, Zea mays
  Clone ID: LIB3069-004-Q1-K1-D10
cgacccacgcgtacgcccaggcgtgcgcccacgcgtccgcccacttgttttctgacgcgtgggtgagccttccgggggagggtgggtggtgctgggtgccggggatgagctgcaacgggtgccgcgtgcttcgcaaggggtgcagcgacgcgtgcgtgctgcggccgtgcctgcagtggatcgacggcgccgaggcgcaaggccacgccaccgtcttcgtcgccaagttcttcggccgcgccggcctcatgtccttcctcaccggcgtccccgagccgcagcgcccagcggtgttccagtcgttgatgtacgaggcggccgggcggacgatcaaccctgtgag

SEQ ID NO: 61177 - DNA, 397 bp, Zea mays
  Clone ID: LIB3069-004-Q1-K1-D11
cccacgcgtccgcccacgcgtccgtccactcgtccgagccctcccagggtctctgtgcgggggcggcgatgtctctcgccccggacccggcggacggcggcgccggcaccggcaccggcaccggcgacgactggttcctcgactgcggcatcctcgacgacctcccggccgcggcctgcggggccttcccgtgggacgcgtccccgtcttcttccaaccccagtgtggaagtgggcagctatgtgaataccaatgatgttttcaaggagcccaatgatgtcttcaaggagcctggcagcaataagcgtttgaggtcaggattcaatgatgtgcatgtgccaacatctaaagcttctaggggaaaaatgatgaggaacaagctgaatgacaggtttct

SEQ ID NO: 61178 - DNA, 333 bp, Zea mays
  unsure at all n locations
  Clone ID: LIB3069-004-Q1-K1-D12
cccgcgcgtgcgcccacgcgtccgcccactcgtctggttccaccggtgcatcaacctgggggtaggtactttggggcagctcgctcaaatactggtgggcctattggtggccaccttgctcatcaacagaactcccagcaagctatggggagcattgggtcaaattttaactacactggaatggagaatccaagtagtcagccttctggtggagcacanatgtcccaaactggattaatgacccatgtgcctgtccaaggactaagtcacattccgtgatggtttttctattggtgggatgtcacaggacttctttgtagacgattttaagag

SEQ ID NO: 61179 - DNA, 461 bp, Zea mays
  unsure at all n locations
  Clone ID: LIB3069-004-Q1-K1-D2
cacagttgtgcaggagttctggctggacaatgtcggtggaggtctatgtatgtcaatttcgtcaatggcgctttcaataacaggcattgatgataggaggtattggaacttcattcccagtgatgaatcaagattccgcacggttgcgtacctctcgcaaatctggtggtttgaagtgagaggggaggttgaattcttcttcccagaaggcacgtacagcctattctaccgcattcatctcggccgaccattcaagcgtcttggccggcgagtctacagctcggagcacgtccacggctgggacatgaagccggtgcgtttccagatgtcgacctccgacggacagcatgttcagtccaagtgctacttgagcgatcccggtatctggatcaaccaccatgtcggggacttcgtcgtgaaggactcgagcaggccagtgaacatcangttcgcgatgattc

SEQ ID NO: 61180 - DNA, 166 bp, Zea mays
  Clone ID: LIB3069-004-Q1-K1-D3
attgactttcaaaacaaatatagaggatctcatatggtccatgtatacgacttttacaagcccgatcgtgcgagtgaatatccaatgccatgaggtagcatgtttgtgatagctttccatcaaccaccgtatattcactcgcatgatcgctcttgttaaagtcgta

SEQ ID NO: 61181 - DNA, 304 bp, Zea mays
  Clone ID: LIB3069-004-Q1-K1-D4
gccggacatgcgggcatgtgagcaaggacttcttatctacaggaatcatcaccatacccggctactgggacggatcagaacagcacttgcaatggctactagcacactcaagagagctcatcgctctggagcgtagcaagctgtagctgctgcaccaaatggcgccgccataagatactcctagatgctactgcctccagagctcgacgacatcgatacgtccggcactcgccatgcggatatacaacaccgggcagtgatcttacacacgcatggcatccagctctcttgacgactcactata

SEQ ID NO: 61182 - DNA, 449 bp, Zea mays
  Clone ID: LIB3069-004-Q1-K1-D6
gcgcaggagatcgagcacaccctcctccttatccgcggcctcaacctccacgtggcacagggaggcacaggtgaactgggcacggtggtgttcctgcacggcttcccggagatatggtactcgtggcgccaccagatgcgggccgtggccgcggcggggtaccgcgccatcgcgccggactgccgcgggtacggcctgtcggagcagccgccggagcacgaggaggtctctcctgacgacctcatcgccgacgtgctgggcatcctcgacgccctcagcgtcccgaaggcgttcttggtgggcaaggacttcggcgccatgccggcgtacgagttcgcgctgcagcacccgggccgcaccctcggcgtggtgtgcctgggcatccccttcaacccggcccccatgtccttcgacgccatcatgcccgaaggattctacatcctgcgctg

SEQ ID NO: 61183 - DNA, 460 bp, Zea mays
  Clone ID: LIB3069-004-Q1-K1-D7
acactagctagctaggtcgtcgttcctaattatctgaccttgcagcaggcaccacagcagggggagcataaagctgggcgtgccgcaccggagcgccggcgcggacgagcgcggcgagagctccgcgccggcgatggccggcgtgcagcgggaggtgtactcgaagaagggcgtgatgcggcggctgatgcggtggagccggccgcggtgggccgcggcggagcaggcggagtgcgcggtgtgcctggacgagttccgcgcgggcgacgtgctggcgcacctgcgctgcggccaccgcttccactgggcctgcgcgctgccctggctcgagggcacctcacggtgccccttctgccgcgccgtcgtggacgccggcgccgccgtcgacggcgcctagaagcggccgaggctctggtcttgctggggctggcccgtgggacggcgcggggcgccttgtcgc

SEQ ID NO: 61184 - DNA, 458 bp, Zea mays
  Clone ID: LIB3069-004-Q1-K1-D8
cccacgcgtccggccatgtctactccatatatgacaatgccacagtggaggatgcagcagcagactatgaattcatgatcaggcagctggttaaggtccgcacaataggagtctcagagagaaacgactgtcccaagttcgatctcatccttctcaccatgggctccgatgggcatgtggcctcgcttttcccgaaccaccctgccatggagctgaaagacgactgggtcacctacatcaccgactctccgcagcctcctcctgagaggatcaccttcactctcccagtgatcaactcagcatccaacatagcaatagtgtccactggtgatgacaaagcaaaggctgttcacatagcagtttctgacatggccgaaggtcttgatgctcctacatcactgcctgctagaatggtccagccaacggacgggaagctggtatggtttctggacaaggcg

SEQ ID NO: 61185 - DNA, 303 bp, Zea mays
  Clone ID: LIB3069-004-Q1-K1-D9
cccacgcgtccgcccactcgtcctgtagattttcgtgccttcgtcgtccgtgccggtgcggggcgtgttggccgtgccgaccgtccgtccaccccctctcctcttcccggcgccggctacagcgggagggactccctgggaggaatggccgtggtgagggctccgctcggcgcggtggctgtggccgctctcgtcgtcgccatcttcatgccggccgtcgcatcggcgcaggcaccggcgcccgcgcccaccagcgacggtacgctgcctctctctctttctctctcctaccccttccttttt

SEQ ID NO: 61186 - DNA, 202 bp, Zea mays
  Clone ID: LIB3069-004-Q1-K1-E1
tgttgctcccccgtgctctcgggggaaggtttagagttgcgcgcgagagagatctaggggagaggtgggcaggtggtcctggaacgaatctgttgtcggcgttcatcggtcatgtggcgcaggtgccggctgagctgctggcggctgacagtcagacgccttttcccaaaactaaggcaccagatctggggcgtcacttcct

SEQ ID NO: 61187 - DNA, 70 bp, Zea mays
  Clone ID: LIB3069-004-Q1-K1-E10
gacccactcgtccgcccacgcgtccgataaacttgtaatcattttgtaataaagaatttatttccgctgc

SEQ ID NO: 61188 - DNA, 252 bp, Zea mays
  Clone ID: LIB3069-004-Q1-K1-E11
ggactctgggttgctggatgatactttcattttattgaaagaagacatctctctggcagagaatgcacctggtggaatgattgaatttcgcagatcgcttactttgagtttctttttcaaatttttcctgtctgttacccatgaaatgaaaataaaagggttgttagcagatggattgcatgcagatcatctgtcagctgtacagccttacagtaggcctgttactgttggaactcaaagttatgaattagt

SEQ ID NO: 61189 - DNA, 312 bp, Zea mays
  Clone ID: LIB3069-004-Q1-K1-E2
tcgcggacgcgtgggctacttctccctaccgttcgagaccccaagcaccagcgcggcttttggggctgcggcgaccatggctgtcgggaagaacaagaggatctccaagggaaagaagggtggcaagaaaaagaccgtcgaccctttctctaagaaggattggtatgacatcaaggcaccgtcggtgttcagtgtgcgcaacatcgggaagactctcgtatccaggacacagggtaccaggattgcttctgagggtctgaagcacagagtctttgatgtttgcctagctgatctttaaggtgacgaagatca

SEQ ID NO: 61190 - DNA, 237 bp, Zea mays
  unsure at all n locations
  Clone ID: LIB3069-004-Q1-K1-C8
cccttggttaagacagtgatgattcgntgtttccaatgtacaaggtgtgtgagggttgctgctgatgttgctggagttcaagaccttggtatgttaggtcctggcagtggtgaagaaattggaacatatgttgagaaacttatgacaagtgagctatctggaaatgtcattgatatctgccctgttggtgctcttacatccaagccatttgcatttaaagctcggaactgggaactt

SEQ ID NO: 61191 - DNA, 394 bp, Zea mays
  Clone ID: LIB3069-004-Q1-K1-E3
aaggcaggctgtggatatctcacccctgatatagggtgaaccaggccatctacctcctcacgactggtgccagggagagcgctttcaggaacatcaaaacccattgctgagtgccttgcagatgagttgatcaacgctgccaagggctcttccaacagctacgccatcaagaagaaggacgagattgagcgtgttgccaaggccaaccgttgagtggagcttgtatcctggtgcacttgcactagaactacgtttctggcagtcgtatttttttcttgtgtttttacccatgtttagactttgagacctatatctaaggttttggttctcagtgaacaatgaaaattactgtgaaatgcagttgttttggtgcagaaatgcgcactgagaaaaa

SEQ ID NO: 61192 - DNA, 444 bp, Zea mays
  Clone ID: LIB3069-004-Q1-K1-E4
cccacgcgtccgcccactcgtccggtagcttcttatctacagtaataatcacaagagcgtgctaggtggtgggagcagagcagcacttgcaattgcaaccagcaagcgcaagagaggagggggctcaagagtcttgacgcgtctagccttcgcagaaaagggttcaagcgagaagagggggggagagggcacgggttcagagctggaggagatggagagcccgcgcagccccgaggcggagatcggccaccgggtggaggacctctgggaggtggcggagccgcagctctcgccgtcggagaagctcaactcctgcttcgaggacatccccgtcgcgtccttcccgcgcacgcacccgtcccaagtcattgagattccttcagatgcaagtcttgctgaaactgtagaaatattatccaaaaacaaaatcttgagtgcacccat

SEQ ID NO: 61193 - DNA, 306 bp, Zea mays
  Clone ID: LIB3069-004-Q1-K1-E5
cggacgcgtgggcggacgcgtggtcggactttttgggcggacgcgtgggctcgacaccgagggaagcgcaacaaagcaacgcaaagcccacgccgctacagtgctctcttgcctgccgctacgagccaacgactcgaacgcatacactccaatggcagcgacggtgatggcctccatgagccccctcgccttcggcacccccggcgcgcgtcgcgctttccctgtacggctgctccaggcttctacactcgcgccgcgccggcgcgccttggccgtgagggcccagagcgacgacgccgagccaaa

SEQ ID NO: 61194 - DNA, 133 bp, Zea mays
  Clone ID: LIB3069-004-Q1-K1-B1
accgaccacgcgtccgctcacgcgtacgcaaacacatgatagccattaggcctttaaagcacactcccttctatcgagccatagactcacattctgggataagattgtcagatcgacgagatgcatacctaac

SEQ ID NO: 61195 - DNA, 305 bp, Zea mays
  unsure at all n locations
  Clone ID: LIB3069-004-Q1-K1-B11
gttgggtgatcctaatgagcaagctcgcctatgactgagatgaatggcatgctgggttggtctaggcctatgcgtattgggcctgctgcaaacaagaaagctactgttgttcaggagaaagtaccaagtgctcagggagttcagtctgacaatgatcctaacaatacaaccatttttgttggtggtcttgaccccaatgtcactgaagatatgttgaaacaagttttcaccccttatggggacgtagtccatgttaagattcctgttggcaaaagatgtggttntgttcaatatgctaacagatc

SEQ ID NO: 61196 - DNA, 387 bp, Zea mays
  Clone ID: LIB3069-004-Q1-K1-B2
ctcgggcgttctctgctctcgcgttctcccacctctgttcgccgattaataccgcccgcgcgtccgggcaccagatcgacatacattctactcccacggtcgctacaatggggaacccgccggagctgtaccacaagatcctcaacatccccaaggacacctcgccgcaagaacttcgagccgcgtacaaaggcctcgtcacgaaatggcacccctacaagcacccgccatcgtacaggccggaagccgaagcgcgctttaaggccatcagcgatgcctaccacgcgctcctagaccagcaagagaacagggccgtgttcgggccgtgcaacggcagccgggcgggcgagagggctggcggaggctccggttcgcgcgtggagagga

SEQ ID NO: 61197 - DNA, 456 bp, Zea mays
  Clone ID: LIB3069-004-Q1-K1-B4
cattgagcgtctcatcgtcttcgccttcgtttaatcgtatttattagggatcatcaggggtgagagccggtggctgcacggtgcagcaggcgctgtcgccggaggccgcggtggtggtgaagcaggccgtgagcctggcgcggcgccgcgggaacgcgcaggtgacgccgctgcacgtggccagcgccatgctgcagcagcaggcgccgacggggctgctgcgcgccgcgtgcctgcagtcgcactcgcacccgctgcagtgcaaggccctggagctctgcttcaacgtcgcgctcaaccgcctgccggcctcggcctcgccgctcctcggcggtcacggccacgtctactacccgccgtcgctctccaacgcgctcgtcgccgcattcaagcgcgcgcaggcgcaccagcgccggggcttcgtcgacacgcagcagcagcagcagccgcccgtgc

SEQ ID NO: 61198 - DNA, 437 bp, Zea mays
  Clone ID: LIB3069-004-Q1-K1-B6
cttaaatagtccataacagcacttcagctttaagtttattatttatataagaggatgaaagtgcaagtctacaacttactagaccagtagagtagtagactatgaccaaggtccaagaaggcaacacctatatgagatcatcatccagcttgaattgatcaccagcagctccagattcttcttcatcatcaattgctttttctgcagcatcttggtcattttgagttggctcttgatgatcattttcgttgtgactgtcactgccactgccatctccttgctgcaagtcctgagctactgtaactttttggcgcttcctactcctaacataggtctcggagtaggtcctcccaccacgtgtagctgctgccctaggcaagtttctgccctgggtagcttgagttgcacctaaaacttcatctactgcactccaaagc

SEQ ID NO: 61199 - DNA, 439 bp, Zea mays
  Clone ID: LIB3069-004-Q1-K1-B7
agcaagatctgtgcttggaaactagtcagtttatctctcgatggcaaaagatcggaatgggcgtgcaaagtctgtagagaataggcatgaaaggtcagagggtgctatgaagcctgacgttcagcaaaagaagagcactgtggcttcaaatggatctgatattctaatacaatcttccttcgtacaagggaaatcttcagtggttgcacgtgcaatggatgagcctccaaaacctgtgtctgatgagggggttaaagtttctacaaaatctacttcagaatttgagacaagggcaacacaaaagcgtgctggcaatgctgggaaggtaatgaagcatgatgttgcaaaggaagatgcaaaagctgggaaacctacaagctggaatgtaaatcaacaagtcttcactgttgatagagaagtgtctcatgcagctgatgct

SEQ ID NO: 61200 - DNA, 428 bp, Zea mays
  Clone ID: LIB3069-004-Q1-K1-B8
cccacgcgttcgcgaccgcttcttcggcgtggagggcagcaagctgctgcagtgcgtgtgctggtccaacggccgtgagaccgagaaccccagcgtcgacaacaagcagtgccccgggaagaacttcgtggtgctggtcgtcaggctcctcctcgtcgagctcttcctccgctacgacacattcaccggcgaggtcggcaaggagctgctcggcaccagcgtcatcttcaccggtgtcacgaaagctacctccggtccgggcagcgagtaaaccgtccggccggcgcgcgtcgttggatatatgatgagtggacgtgacagagtgtcccattatttcttaatttcgtcattttactccttccttctaataagacttctctgtcaccctcgggcccacctttacttgtgattggaggtgtttgtcgctt

SEQ ID NO: 61201 - DNA, 365 bp, Zea mays
  Clone ID: LIB3069-004-Q1-K1-C10
ggggcatttgccacgagcgccccccctgctttgcctatttcgctctcctccctaggcaacgaaaggccgcgctcccgcagacggtaccagccgccgcgatggggtcctcgtcctcgccaccgccaccaccgccgctgccactgcccatgattgggcgggccgggaacctcaccatcttcatcacgccgccatcccccgctagcacgccccggggcgctgggcgcacgccgccgctcgagtccccgcgctcggatatctccacacccatcccgcagagggcagccccgtcgccctccctttctccctctccgcggaaccacgagagccgggccgtggcgcctgcggtggtgttcacccccgccccc

SEQ ID NO: 61202 - DNA, 333 bp, Zea mays
  unsure at all n locations
  Clone ID: LIB3069-004-Q1-K1-C11
gtcggcgtccagagcgcgagcaaccaacgtctccccgctgtctccgccggtccgggcccggccctcccctcccccgaatcgcgtcgtcccgtctcctgctgccgcggaaccctcgccatggcggaggcgcccgagaccgccgtccccacccagccgcctcccgcgccggcggcttcgtccccgcctcccaagtcggggatcccgccgcggtacgacctggacgccaagtgggacgcgtgcctcgacctctccatccgccgcgtcgcctactcctccctcggcggcgccttcgcgggcctnctnctcttacggagccctactactcgctgggca

SEQ ID NO: 61203 - DNA, 157 bp, Zea mays
  Clone ID: LIB3069-004-Q1-K1-C12
ccagcatccaatggaagcagaggaaaactgatgaaactggagcaactgcaggcaaagctaatcgacccgatgcggctgcaagacaagcatagcagctggccaagaaacgcaaggtggatgcatgaacccctgagaatacacacaggagcaggaaacc

SEQ ID NO: 61204 - DNA, 447 bp, Zea mays
  Clone ID: LIB3069-004-Q1-K1-C2
ggaaaaaaaactcgcctttttctctctgctttttcatgaacgccatggaaaatctcgagcgctcgctgtgattcctgcgagtacccaagcccaaccaagccctagcccggcagccattctcttcgcgccacatcgcacgacctccccgaagcagacgtgcccgctgcccgtccgtcccccgtggccatggccgcgacgtggtcttcgtcttgctgcgccgcgaccgcgtcgagcagcgctctgcttcgtcatgcccgcgtcaagagcgcgccttgggtagccggtgccagccggagtagctacaggcagcggcggcggcggcgggagctgtacatccgcgccacggtcgcggcgccgtcgtcggccgtggtctacgcggacgccggcgccgacaacgtggcctcgctgaagatcaagctcctgagcgcggtgttcgggctgaaccgt

SEQ ID NO: 61205 - DNA, 344 bp, Zea mays
  Clone ID: LIB3069-004-Q1-K1-C3
cccacgcgtccgcccactcgtccgcggacgcgtgggcttacgcgtgggctgctccgagcggcgtagtgggcatcgtcgcaggcgtggcggcggagttcgtgaagctcaccttccgtgccctgtatatgcgcctggctggtccaggcagcagggagatgactgtgccgggaaggccatccgaccagctgggcaggaaagtcgtcactgacaggcccgtgtacgacggccgtggcgcctactcccgtctcgtggctcgcatacaaggagtcacggtccttgtccgtaacgcatacgccttgttcaccatggtggtcgaaaccgactggctttagggttccacgctc

SEQ ID NO: 61206 - DNA, 155 bp, Zea mays
  Clone ID: LIB3069-004-Q1-K1-C4
cggacgcgtgggatcatacgaaaaccctctttgcgagtagcgctctccgtcccacacacgggcgccggagacttcggagtgcgcacctgccttcacgacttgtcgtgctcgtgcgctactcttctcgagcgccgcgcggagcacggggacattaa

SEQ ID NO: 61207 - DNA, 155 bp, Zea mays
  Clone ID: LIB3069-004-Q1-K1-C5
cccacgcgttcgcccacgcgttcgaccaatttgccaatgccacatcgggatttggggaagagaggctcatcaagcatggtcactcacgtgatctataccatggtgtgctccaagacgggactgccgtggtggtgaagaagatcactttgcgcgtg

SEQ ID NO: 61208 - DNA, 455 bp, Zea mays
  Clone ID: LIB3069-004-Q1-K1-C6
cccacgcgtccgcccacgcgtccgctccttttgctcagaaacccaccaacccgggccaggcgccggctgtctcggccgtcggcgccggcgacgtcgccctatcccggtccttcaggtgaaccaagttggccatggccttcaacaagatcaaggtcgccaaccccatcgtccagatggaccgcgatgagatgaccaaggtgttctggaaatctatcaaggacaagcttatattccctttcgtagacctcgacatcaaatattgtgacctcgggctttcacaccgtgatgctaccgacgacaaagtcacagtggaagctgctgaagccacactcaagtacaatgtggctatcaagtgtgccaccattacaccagatgaagcaagggtaaaggagtttggcttgaaggctatgtggaagagcccaaatggcacaattaggaatattctgaatggcact

SEQ ID NO: 61209 - DNA, 314 bp, Zea mays
  Clone ID: LIB3069-004-Q1-K1-C7
cccacgcgttcgcgcttcccttttcccgctcggcggagttcacaatccccacgggccggggtagcggatattgcgagttacgacggggaaggagaggaagatccgtcgatccgcgcagattcgtttcgatcgtggtttggtgacttggtaagaggggaggggagaagcggcgatgtcgggcgtgttcggcagggtgttcgggaagtccaaggagcagagccaggccaccgcgctggcctcgctcgacaagctcaacgagacacttgaaatgttgggaaagaaggaaaacttgctagtgaaaaaggccaatcttg

SEQ ID NO: 61210 - DNA, 469 bp, Zea mays
  Clone ID: LIB3069-004-Q1-K1-A9
gaccgacccagacgtacgcgcgagctagggctctggcgtttgccccatttcggtgctcacctggactagactgtgcctgcccagctgggaattcactcgtcgagccttacactgctggccataacattctcctagcccacgctgaggctgttgatctttacaacaagcattacaagcgcgacgacacccgcatagggcttgcgtttgacgtaatgggtcgtgtgccatacggaacatcgtttctggataaacaggccgaagaaaggtcctgggacatcaacctaggatggttcttagagccagtggttcgtggtgactaccccttctccatgagatcattggctagggaacgactacccttcttcaaggacgagcagaaggagaagctcgccggttcctataacatgttggggttaaactactacacctcacggttctccaaaaacatcgatatctcaccaaactactc

SEQ ID NO: 61211 - DNA, 431 bp, Zea mays
  Clone ID: LIB3069-003-Q1-K1-G9
gacccacctcgccacgacgttactcccatcgccgctttttgggcgcaccccagcaaacatcggtcgatccgcaaccggcgaccccatcgtgactgggccccctcatcgaggtctccctctttcgccgcccgtgaccatggccccaagccgtcggaggtgtacggcttcgttggatccatcaccaccgtcattgccaccgccgtgtacctcgcctgggcatacacgcccgagcccgtcctccagtcactcggcatcacctactaccctagcaagtactgggcactggcggtgccatcgttcgtggttgtgaccgtggtgctgtccatgggcatctacatgggcctcaacttcgctgccactcctcctccgacttccttcagtactatcttcgatgaaaagagtatggagcacacaaccttttttcctgcaac

SEQ ID NO: 61212 - DNA, 220 bp, Zea mays
  unsure at all n locations
  Clone ID: LIB3069-003-Q1-K1-H1
ccaagcggacgctgtcggtgtgcgccgtttgctcgttctaggaacgaccgacgagcggtgcggcncgggcagaagccatttgcacgcgtccccctttcagctttgttgcgcccagtccgagggttttgtctttgtttctgtcgtccgaatggagcgagtggtgatggtgaagtgtgtcagaaatagatcggagaaaaatgaaatagaaagcagcaacagc

SEQ ID NO: 61213 - DNA, 438 bp, Zea mays
  Clone ID: LIB3069-003-Q1-K1-H10
acccactcgtccgcggactcgtgggcggactcgtgggctacttcttttgatcgcctgaaggaaaatgaacttgggctagctattgttacaagaggaggctaagcaacttgatgcttatacccaaatcatgataaacggttctcctcgtcgcctcatgaatcatggagctggtggcaagagttcacctacggctcacagcaggcatcctttctccaaccaaggtagccctagaatcccgagcggtggcagcctgaggagggcttgttgatgatcctgttccgcctgatccattggcttgtggcttaaccagatgctccctgaatccccgatatatgatggatggacgaagtgccccggcaatagcactgtacctgtacatacccattgccgttcagcgctgtgctgttgtggaatcccaacggtctcactttgttttgt

SEQ ID NO: 61214 - DNA, 198 bp, Zea mays
  Clone ID: LIB3069-003-Q1-K1-H11
cttggccccaaaatccgatattctgagatgtttcaacatgatggagagttgaagctctcaaggcgttacctagtttgcccaccagagatagatagaacatctgccgagtacttggtgaagaatggcatccgcactcatgctcgcattgagacagtttaattcggccatgtcacatttttctggaacggtaacacgtcg

SEQ ID NO: 61215 - DNA, 390 bp, Zea mays
  Clone ID: LIB3069-003-Q1-K1-H12
acccactcgtccgcccaggcgttctacctcctcttcattagctgcgtcaacggctggatccgctttaaggcctgtttcttcatcaccagccactaccacctcatgttgcgctgttcccctcttctcaccttcaacaactgacaaggaagctacggctccaacaccgttggggggctcggctacttcaagttccatcgcgcagcaccctgcatcgtatacgtctgagatcgatctcgattcaaaaatcacattaaagaacctcggccgggatgaattgaacaagaagctcttttctttttcgtaataagatatatacatatgaatcaaataatagcttcaactctttggtttaattttgttgctttttctattctattttgtttggatggg

SEQ ID NO: 61216 - DNA, 226 bp, Zea mays
  Clone ID: LIB3069-003-Q1-K1-H2
atatgcgaatgacatccggatgaaaccagtaataataaggaattgagaactcaatagatcagggataacggacttacaaagcaacgaccgcatgacctgtagaatgacaccacccatctaaaagatacaggctaacaaacgcatgcatgcaaagcaatacatgtcatataagaaagcctaaattgacacaactgatcgtctagtaacaacgaagcctcatgtaaaa

SEQ ID NO: 61217 - DNA, 195 bp, Zea mays
  Clone ID: LIB3069-003-Q1-K1-H4
catcgctggttcatggagatgaagtggaagaaggtgcaccgcttcgtagtgtacaagatcgacgagcggtcgcgcgccgtgctggtggacaaagcgggcggacccagcgaagggtacaacgagctcgtggccacactgcccggctacgactgccgctacgccgtcttcgacttcgacttcttcactgttgacaac

SEQ ID NO: 61218 - DNA, 436 bp, Zea mays
  Clone ID: LIB3069-003-Q1-K1-H5
gcgcggacgcgtgggttcaggagttgttagactttacttcgcaagaaaggctccctggggtgtggagggaacaggtaaacaccgctggctggttttctcgttacatgtacatatatttccgtatagcaacacatcaaacccattgctagattgattcactgtggagaaaatgcggtacgtaccagtttcggacttggatgaagagtacaggtctagttgccattgtagagatggataggatagatgggtcgagtcgttggtaaggtatgtagagagacaaaggaggagggacgtggctagtgtggttcatgtcatttgcatatatatatagtatatgatatgccttttcggtggtctgtggtgctgatactactatacatatagatcatgctgacatttgtggtgatgaatcaaaagatgtatctaaggtcttttc

SEQ ID NO: 61219 - DNA, 431 bp, Zea mays
  unsure at all n locations
  Clone ID: LIB3069-003-Q1-K1-H6
gcggtcgcgcgccaagtcgtactcgttgccttttcacagccccgcgccgccgcctgtggcccgtggccaaggaggaatccaagaaggagaagaagaaggccaaggccaaggtggccaatggagccgccgccgccgccgccgccccggtccctggcgcgagggccgcggtggtcgcctccgtcgccgccttcctcgagtccgctgggctctcgcgcacgctcgtcgccctccaatccgaggccggcctcgaggccggtgcgtgggggtcgtcacaggtgaacttggaggagctggttgccagattcttagagtcgagcaattcaactcgggcggctgccattctgggaagcgatgagcaagaacaggaaaatgatgatatagcangagaagttggcaaggaaaaaaagaagagcggcacataaaccggtgag

SEQ ID NO: 61220 - DNA, 345 bp, Zea mays
  Clone ID: LIB3069-003-Q1-K1-H8
acccactcgtgcgcaagatcactttgcgtgcagcattctattttccgaaatcgagggtttggttagggagaggtccgcttgtaacagttgacagggacgagatggacgccagcggacgcggcgtctaggtcgccgttctctgcatgctgctggtcttcgccatcttccccctcctcctctggcgccgccgctccgatgccgtcacctccgataaccaccgcgtcccgctccagcccctccagtaggatcacgtgctgcacggtcgcgcgtcggcgcgaccgatgcttaagatgcctgaagctgccggaacatgctcctatactgcgtcaactactcgcaatgctg

SEQ ID NO: 61221 - DNA, 58 bp, Zea mays
  unsure at all n locations
  Clone ID: LIB3069-004-Q1-K1-A1
actagttttagatcgcattgccgccctttttttcnnattttattagacagaagccaca

SEQ ID NO: 61222 - DNA, 356 bp, Zea mays
  Clone ID: LIB3069-004-Q1-K1-A11
caaggaacgattccatttccttcctccggtcaaaagccctcgtgcccggcaccggcaccggcagtgtccaacttgctcctcgccacgcttctctcgtgcggcgcacgagccatacggacgcactgcggctatgtctccgcggtcggtgaccccggcatgctgcgcgacagcctccgtgtggcatgggaggcgtggaactgctgcaacgaagacggtcaggaagcccccggcatgggcagcccacgcagtgccaattgctacgatcttctcggaccgaccattccatctctaactatcctctatcaccgtagagagtgaatgggttgccaccaagattaggtctctgaggaagcgtg

SEQ ID NO: 61223 - DNA, 148 bp, Zea mays
  Clone ID: LIB3069-004-Q1-K1-A2
ggccgaccacgcgtccgcggacgctaggcagactcgcgggtagattttgagtgtccgcccagaccgtaaccataggcgtaagtgtaaactttcaaccggccacggaaacgtaaatagcagaattacatagaccatagacacactacta

SEQ ID NO: 61224 - DNA, 444 bp, Zea mays
  Clone ID: LIB3069-004-Q1-K1-A4
gacccactcgtccgcggcgcgtgggtccctctcgtcgccgacttctcccgttcgcaacgccacgctccccaacggcgaaatggcccctaagcgaggtggcagggcaccggtgccggccaagaagaagaccgattaagtgacgaaccctctgttcgagaaaaagccgaaacagttcggcatcggcggcgcgttgccttccaagaaagacctgcaccgattcgtcaagtggcccaaagtcgtgcgcattcagcgccagcgtctcattctcaagcagcgccttaaggtgcctccggcgctcaaccagttcacccgcaccctctacaagaaccttgctaccaacctgttcaagatgcttcttaagtaccggcccgaaaacaaggctgtcaagaaggagaagcttcttaaaagggcccaggcttagaatgaaggaaaaactgttgaatt

SEQ ID NO: 61225 - DNA, 371 bp, Zea mays
  Clone ID: LIB3069-004-Q1-K1-A5
tgccgcggcgtcgggctcgtggcttttgccgtatacatacccggcccgtttcacgatctctctagtctctccctggccccaaggcatcgcccgaccgccgtctcgtcccctcctccgacctctcgacccatccccaccctacacccactctgcccctggctgcgcgcgttccagttggtgtgcgtgcgtgcgtgtccatggggaacacgccgtcgtgcataccgcttgcgcccgcggggggcggcgcctcggcggcggcgaccagcgcagccaccgaggtgatccacgcggacggcaccgtcacccggctggcgcgcccggtgcgcgcgtcggagctcatgctccaccacccgggccggttcgtctgcgac

SEQ ID NO: 61226 - DNA, 459 bp, Zea mays
  Clone ID: LIB3069-004-Q1-K1-A6
cccacgcgtccgcccactcgtccgcccacttttccggcggcaaaaccctccctaatccccgtttctcgccatccccaccaccccatttccaccgccagattcggtgccgttaggatcgatttcttgtgcatcttggagcatctacaaggggtgggcgactcagcaaaatctgctggcatctcctctcttttcttgcatcgaattttgtaattgccgactgaaccgtgcagagaagtcttgacaagcgcatgggcggaggtggagatggggaatcgtgcgatctcctccaagtcctttttgagggggccttggctggaagagctgctggtgttgttgttgaaacagctttatatcctattgatacgataaagaccaggcttcaggctgcacaaggcggaagtaaaattcaatggacagcgcttctgcaatttttggtggagtatatgaaccagctaaaag

SEQ ID NO: 61227 - DNA, 444 bp, Zea mays
  Clone ID: LIB3069-003-Q1-K1-G7
gcgcccacgcgtccgcccactcgtctttccactcttccgggctgactcaaggctaagggagcaggtagaaattggtaatgatgacgggctttacgttagttgtgtggcttcctcggcaaacctttgggcactcatcatggacgctggaactggtttctgttctcaagtttacgagctctcaccagtttttctccacaaggactggataatggagcagtggcagaaaagttactacataacagcaattgctggatcaaccaatgggagttcattggttgtcatgtccaaaggaactccttacactcagcaatcatacaaggttagcgaatcggtcccttacaagtggatcaatataaagtggaaagaagggttccatgtaacatctatggccactgctggaaaccgcttgtgcgtagttatgtcaaggaactcatggttttctac

SEQ ID NO: 61228 - DNA, 152 bp, Zea mays
  Clone ID: LIB3069-004-Q1-K1-A7
cccatgttgggtactatctatgtactatttctatatccaaaactatagttgtgctggctgaattgaactcaaaagggtttgtttgagaaaaaattgtcccaagattggattgcttgttaaagctcaatattgttattgaagtgttattgctt

SEQ ID NO: 61229 - DNA, 222 bp, Zea mays
  Clone ID: LIB3069-003-Q1-K1-E9
gtaaatttccctaagtaaagactgattaatatctaattagtggtccacatttcaagaaaattaataaaaaaaaaaaaaccccaaaaaaaaaaaaaaaaaaaaaaaaaaaaaaaaaaacaaaaaaaaaaaaaaaaaaacaaaacaaaaccaaaaacacaaaaccaaaacaacaaacaaaaacaataacaacaaaaaaatacaaacacaaaaaaaaaaaccaaa

SEQ ID NO: 61230 - DNA, 486 bp, Zea mays
  Clone ID: LIB3069-003-Q1-K1-F10
attaccggtccgacgcatgcgctcgtggggacatatatccagattatgattgcatcgctgttcgggcacacttgttcttccgggaggaggatttggaaagtttcaagcagatggtagacacctacttatctgatgcctctaggcaatgggcagccacaaatgaaggcagttctcttctggacagtatgactaaagcaattgatgaggttatcaaaattaaagagtgtgacatctacagctataatccagactctgacgcatatccagttcttgagaaaggggccatatggtcgttcaactactacttctacaataggaagctaaagcgagttgtgagctttcgatgttactgcactagcaaattatcaggagatgacttcttaaccggtgttgcgtctgatggtgaagaggaagatgccttgattgacatggacatatgactgaccgtgttctgctagctacctgatgtgcgtataatataaaaca

SEQ ID NO: 61231 - DNA, 462 bp, Zea mays
  Clone ID: LIB3069-003-Q1-K1-F11
gaagaggcgagtcttctcaccgtcggacccttcgtttcatcggcacgtcgcctccgtctcggggtgtgtcacttactgctccgacttttcttaccgcatggtcgtcgaatcccggtaccagagggtcgccgagggcagatcccgcctcgcgcgcctcatcctcgtgcaggcgctgcacctagtggccggaggcttgcttctattgctgtcgttgtccaagggggcggcggtgaacaagttcgccgtgctgtccatggccgcgggattcctggctatagtggtgggggaattagggcgaatgcggaccatggcagtgctgcttcggctttacacaagcttgtcatcaattgcggttgcattctctgtgacgtgcattatccggtcagagttgttcttgaaggttatgaagcaaaacacagaggccatcacaagctacgaaatgcttgatgcggttcgtgttgc

SEQ ID NO: 61232 - DNA, 457 bp, Zea mays
  Clone ID: LIB3069-003-Q1-K1-F12
gacccacgcgttcgcccgcgcgttcgcgactagtgagcgcgatttattctgcgctgcgcgggatcagggccaatgttagtgttcaccgggagaaggtgatcagcggtctgctgctgggctcggcggtggcgctggggtggaagtcgtcggagcagcagcgcgagatccagagcctgttggccgagaagagctctctccgagccaccaacgcctctatgtccgccgccatgtgggcctggcgggaggagctcttcgccctcgccgccgcgccctcctcccccatttccgcgtcccggctccgccacatctacggcgaggaggagcccgcgccgctcgcgcccgcgcccgcgccgccaggagcaaatgatgggaaggaagaggaaccgatctccatagcctgaactctttccgcacttttttccagtcgagcgtgtgccgttcgtgtacatcatggccc

SEQ ID NO: 61233 - DNA, 309 bp, Zea mays
  Clone ID: LIB3069-003-Q1-K1-F3
cccacgcgtccgccctaaactcccctcctttctccttacaataccgcgaggcgaaagctgagctcgcgtagcctctttcccacaccttcgcctgtgcctatactcctgcacaaataaccccttcgagtgcggttgctgctgcttcatctgcggtatttcttccacacactgactcggtatccattctacggacagaccgaccaatcgacccatccgtccaccgagagccatgaggcacaagcagatccacagcaagcagaacactagcagccaccggcgacgatcgcactcctttcatcatcagccttc

SEQ ID NO: 61234 - DNA, 347 bp, Zea mays
  Clone ID: LIB3069-003-Q1-K1-F4
ctagctcgcatacagactaataatctctttttcacttcactaacaccaactagcaactctgtctctgttacaataatgcccgctcgctcctactcctcccagccgcagctgatacacccggccgcggtcctggcagcgacgctgctgctgctgtcggcgtagcccgacacagcctctacccatgtgacctacagccaggtgacatcatccatagcgccatgcctagcgaacacgatgagcaacacgacatcgacctccgaagcgagctgcaacggtctgcgctcgctcaacaaccgcgcgtcgtctgctgcgcaccgacacgccacctgcaactgcctcaatagcat

SEQ ID NO: 61235 - DNA, 53 bp, Zea mays
  Clone ID: LIB3069-003-Q1-K1-F5
aaaaaaaaaaaaaaaaaaaaaatttaaattttaaataaaaaaaaaaataaaaa

SEQ ID NO: 61236 - DNA, 328 bp, Zea mays
  Clone ID: LIB3069-003-Q1-K1-F6
aaggaatctttcagctcacaccttcctatccctccttcccttctcctcctactgcgactagtcgccttgtcccctcgctcgctcgctcgtcgtcttcaacctcacacaattatttgtgctcccgctccttccgtccgtccttcctccccccttcccctctccctcttccaaccgccgctcctgctgccttgcctctcagcccagggacgccaaggtctctgccaggatggtgtatgccgtgcctctcgcgcattatgaggtgtggtggtgagggatgggcgatggcctttgcagatgaaggagcgacagcgctggctgcctgaggaag

SEQ ID NO: 61237 - DNA, 313 bp, Zea mays
  Clone ID: LIB3069-003-Q1-K1-F8
acccactcgagcgatcgactatctcaacatccaattttcatattctcagcttccatctaatacaacatgcaaaagtccaattatactttcccaaccacttacccaaccctaacatgacacaatcctcttcctcttcgcagactccgtacagcatcccatcaacttctatccctacatatcacaacattcatctatcacacatagactctcacacccttaaccaaacctgcaatgactaccagaacaccactcatctattgtcgtctcagtacgaattcttctgagaaaccatctttaccattatccaaccacc

SEQ ID NO: 61238 - DNA, 464 bp, Zea mays
  Clone ID: LIB3069-003-Q1-K1-F9
ccgagtccgagtcgtccgtctcctgcccgtttccttttccgggcgcctccgccccgtttctgcgcggcattcttcggcgccgccgtcctgagccgtcgcacgcgccaccggggcgcctccggcgcgcgctccctacgccggctccgccccgccgccatgggctccagagtccttcacttagacgttcctgcacattctgaggcctatcttatgagaaatgtaccagggagtgtaagtagccctcgcacgaatggtgaaaagggtctctttcgaaatcagaatgcggggttcactgcacttgcaagtcctgtgaggagagaaatcggaaacagatcgtctacaaggtccttctgtgttgaagacaatgacttggaagatggtaagacctcaaaagaaagggagggttctgcacagtcactcaggctcccaaagattcagaatcaggctctcttatctggtctggc

SEQ ID NO: 61239 - DNA, 264 bp, Zea mays
  Clone ID: LIB3069-003-Q1-K1-G1
cacagaccctggtgcagtgctcatcacttatagccgttgccgcaaccgcttgctagcgctgggctctgtaatcctatcttccgggaaacgtcgactcgacatagcctcccagacggagacgatcgccttgccaccagagaccaaccaactgctatgattcatcatcaagaccttatactccaacaccgagatctgcctaagtgagcccactagcaactccaggactgccttgcattcgatcacgaccgcgagtatgacgagcac

SEQ ID NO: 61240 - DNA, 440 bp, Zea mays
  Clone ID: LIB3069-003-Q1-K1-G10
gacccactcgtccgctcagtcttagtctcttattagctctaggctctttctagccgcgccactccttcgtgtagggatcgttcttctcatcgccaccaatggccactgccgaggtccagaccccgaccgtcgtggcggccgatgaagcgcccgtggtggagaccccgtcgccggccgtcgtgcccgaggagtctgcccccgtcgaggccgaggccgaggccgaggctgctgcttctgctgatcccgaggagcttcccgcggccgagcagcaggcatccgccgatgcggaggccgctgctcctgctggagccgatgatcccgtctcggtcgatccggccgtcgaggcggaggctgctgctcctgctggtcccgaggagactcctgcggtcgagcaggatgcagccgccgaggaggatgctgctgctgctcctcctgctggt

SEQ ID NO: 61241 - DNA, 385 bp, Zea mays
  Clone ID: LIB3069-003-Q1-K1-G11
ctctttcggccagtggaaaaacgatggaccatgttgatttgttgagagaacagttgaaaattttgtcaggggaggttgcgtttaatacaagtgctcttaagcgcctcacagaggaagctgaaagaagcccaaagaacgagaagattcagatggaaatgaagaagaagaccgatgaaattaaggggaagcagcaacagatagcatctttggagagagagatagctcatgcaacattaggaactcaaggaaaggtcgatacgttagagcattcaccgtcttatcatgaactacttgagcagctcaatgagaaatctttagaacttgaagtgaaggctgcagataatagagtgatacaagatcagctgaatgagaagataactgaatg

SEQ ID NO: 61242 - DNA, 430 bp, Zea mays
  Clone ID: LIB3069-003-Q1-K1-G12
gacgcacgcgtccgcccgcgcgttcgggttctcctgtcgctcttcgtttctgtcgtgcggcacactatccatagagggggcgttcttcgcacagaagagagaaccagccgatcggatcggctgctcttccggagggatgaaggatgatggagaaggctcttaccaagctcggcagcttcacaatcttccgcaaggccaagcaggagctctccgccatcggtgacgacatctcccgtttttcgagcacggtggaggagaaggcaaaatgggtgttcgagaaactcatagggcacaagaagtcgctccctgatctactgcgcgagcacaacctccctccaggtctcttccctcgtaacatcatctgctacgagtacgacgaatcgacctcgaaactggtggtgcacctgtccaagccctgctaggtgagctt

SEQ ID NO: 61243 - DNA, 346 bp, Zea mays
  unsure at all n locations
  Clone ID: LIB3069-003-Q1-K1-G4
gcagtctcnagttacaattcccaatccattaaactttaccagccttttgcaaactcagaggagnacgttattgtacccaaggcggagaagaagcctgtttttaagataccctctgaggacgagcccgtggccccggcggataaagcccccgctgtgaataagcctaatgcggataaactgctcccggcgggaaaatccgacggcaaggaatgccgtgttgacaagaacgtgcggaagaatgccaagaagagcgtggagacgtacaagatctacatcttcaaggtgctgaagcatgtgcacccagacatcggcatctcctccaaagccatgtccatcatgaactcct

SEQ ID NO: 61244 - DNA, 438 bp, Zea mays
  Clone ID: LIB3069-003-Q1-K1-G5
cccacgcgtccgcgcggtaaatttttcttttaatctctcatgtgttgtctgatagggtcacgaatctttccaaagtcccacataatatcttactctaggctgcctttaacaatgtcactaacatgtaccttcaggatccacatgtcaatgtcatctacttgctagaaatcatgattctgatcatgaagctcatcttgtaatacaactgaaagtgaagctcgacttataagacaactatacaaagtaagacactccataattcacaacagatcaaacgatgtctgttgctttgattgatgacccttgctgtgctcattgatactcactcgcatacttaatcctcttccccatttgtggtgatagccacaacccaagatacattctaaactgcagttagaactcatttgacatataacgcttacttcaacggttaatcac

SEQ ID NO: 61245 - DNA, 284 bp, Zea mays
  Clone ID: LIB3069-003-Q1-K1-E7
ggcgacttgcatggtacgactgtgtggttttctatttatccaatcgtcggaccgtgggaagatataggagtgtttcaggaccaggatgcgttgcagtgcaaggacattgttgtggaatttttgttgctgattgccaaggggtgggtcggtcgatgtagcgtctatgcatggcttgtagttctcctgtaatgttgttgttaatttccgcttggcggcttgtaatcttacgtgtatctggaacttgaatcctgggtgattaatccggcaagcagctgcctgtttgt

SEQ ID NO: 61246 - DNA, 330 bp, Zea mays
  Clone ID: LIB3069-003-Q1-K1-G6
cccactcgtccgaaaaaaaaatttaactttttaaatctaaataaaaaaaactaagaggatgagtaaactttccaaagtcccaaataatatcttactttaagaattccatcaacaatctcactaacaactaccttcagaatccacatctcaatctcaactacttgctagaaatcatgattctgatcaggaaactcatcttgaaatacaactgaaagtgtagctcatcttataagacaacttcacaaaataagacactccataattcacaacatatcaaacgatgacttttgctcctattgatgaccctttctgtgctcattgcatctctct

SEQ ID NO: 61247 - DNA, 362 bp, Zea mays
  Clone ID: LIB3069-001-Q1-K1-B12
ctaagttaggattttaaacttagttgtacatgggttacgcgagagcacatacacaggccgcaccgtacagacatggactacatcaagcacgcgctgactatattcaccgactttgttagcagctcttggactgatgcttgccattatgatgaagaacgcacaggagaaatcccaagacgagaagaggaagacgcggtagctgctgaatgaataggatgacatatggtgccagggccactacttcatagtaccatgtactcctatcctattgtactcataataataatacgacgaaagatgactggtgggaaatgaatattgggtcctgctaaaaaaaaaaatgggttaattccaatcaaaag

SEQ ID NO: 61248 - DNA, 289 bp, Zea mays
  Clone ID: LIB3069-001-Q1-K1-B8
ggcgggttcgggattaaccctagaaatgaaatgaaaggctgaaccgagagcggttggatggctgatatggcatatgctgctgttgtgttgtgttgtatctgaggaatcaatcagtctgtatcgagtctcttggcaagttttctcttgtttggggcatcctggtatagtagggaagaacaatcgtgtgaccacatgatgcgcgatggtaaactgacaatgtttggaaatgtaattggtgatgtttttttttggaaaaaaaaaaaaaacataaaaataaaataaaaacaaa

SEQ ID NO: 61249 - DNA, 224 bp, Zea mays
  Clone ID: LIB3069-001-Q1-K1-C2
cataatgagtccctctccggaccttggtagctgcttgcttgtggtgagcgagagtgtgagactgatggagaagaggtggcgggcgtggggctacgtcgagagaggcgtgttcctgtaatcctgtactcgcttcgttctctctgcatgcgtctataatcgtgttcaataataagtgagagcggtgtgatgtgtggatccccttgtcaggctaaaagacaatgatt

SEQ ID NO: 61250 - DNA, 365 bp, Zea mays
  Clone ID: LIB3069-001-Q1-K1-D5
acgattaacatgatttatgggattatcagtcttacaagttgctgaggttgggcaaagccagtagagtaacttcaggcgtttctatcaagtgacagcctgattagcagggccgttactgatcggagggcactggagggcaccccgagaaccccatctcctacagcagtgttaaaacccctccttcagaggcactggatagggcgtggcccgtgacagccaggggccactccactggcttttggtgcccactgacccctttcagcagagactcaaaggccttcagaggcaccaaggacgcatgatgggctgggcaggtggaaagactggtactttctaaccgaggctctgtctctggccttgatctc

SEQ ID NO: 61251 - DNA, 329 bp, Zea mays
  Clone ID: LIB3069-001-Q1-K1-E7
tatgaacatatatacctacgattagctttgggtgctcatcagtcatcaccggccatatcaccagccatatacagggtgctgtacttgaggaggcaagagacccatatccacacagtgctgcttatcgtagtcccgggtaccaggaatggctccggttgccagcctgagaacctcattgccagttaagcatcgatgggccaacgctagaccgccatccattatgtcggacacattatgctgtgaggttcttttattctttcttgcactaccttgtccaggctggcaaccggagccattcctggtacccgggtctacgatatgcagctctg

SEQ ID NO: 61252 - DNA, 402 bp, Zea mays
  Clone ID: LIB3069-002-Q1-K1-B11
cccacgcgtccggacccaggttgttgcggcggtgaaggtgaagcaacggtgctctagctgctatgtacagcttagcaattcagtgtggaagggctttgtgcttactgatatagcttagatccatattgaactcttccagtagcttttatagctatctagtctaggagtccagatttgtgattttggcgatttaggtgttcagttcttttgtacattggttgagctagttgtgtgtagctgattctattgcagcaccaccggtgagctctagtgacctatttgttgacctctgctggaagttgcatcttttgtgctagcaactgtgtcgtgactcgtgagtgctattgctctgctgaaggtataaaagttgctggaaaggatgttcctggaaaaaaaaaacat

SEQ ID NO: 61253 - DNA, 347 bp, Zea mays
  Clone ID: LIB3069-002-Q1-K1-G4
tataactctgagccccatcggagactcggagtcgggggcgccagcgtctcgcctcgccgtcagcagcagcagcagctgcacctccattccacggcttccgtcgtgcgcttcgtctgcacccacaaaggcgacggcgacggcagggggaggagatgaagctgaagcagctggagggcctcttgggtggcctgacccagttctccgaccccaaggtactgctgactgcgccaccggcaccggccccacctcttgggtggcctttctttcttcctttctcgtaccctgctcgatttcggctgggccaaccccgacaagagggagggggaaaagcggatgagtatctgact

SEQ ID NO: 61254 - DNA, 322 bp, Zea mays
  Clone ID: LIB3069-002-Q1-K1-H8
aagcagggtcgttgtgaacaaacctataccaggtcttgggagcacaagtcagcatccgtgatattcacatgctctcagattccacaggctgcaacagaaggtgtacccaaggctacttctcgttgctggtagccacaaaaggcttactcctgtatgtgtcttaagtggaaagggaaatgctggcactgctgatgatcctttgatggaatctttgaagaaagctatggctgatgcaaaaaagcccaggtccatacaagacttgctgaaggagcaagtggctaaactcagagaacaagcattcggtggaggcggaaggaatggg

SEQ ID NO: 61255 - DNA, 433 bp, Zea mays
  unsure at all n locations
  Clone ID: LIB3069-003-Q1-K1-B8
gcgcccacgcgtccggagttccagacttaccttgtaccctacccgaggatccacttcgggctagcttcgtacgctccagtcatctgtgctgagaaggcctaccacgagcagctctctgtggctgagatcaccaacagtgccttcgagccatcttccatgatggccaagtgcgacccacgccatggcaagtacatggcctgctgcctcatgtaccgtggtgatgtggtccccaaggatgtgaatgctgctgtggccaccatcaagaccaaacgcaccatccagttcgtggattggtgcccgactggcttcaagtgcggcatcaactaccagcctnctagcgttgtgcctggtggcgacctggccaaagggcaactgtgccgtgtgcatggatctccaacttcaccagtgttggtgaggtgttctcccgcatcga

SEQ ID NO: 61256 - DNA, 461 bp, Zea mays
  Clone ID: LIB3069-003-Q1-K1-C10
ctacgttcttctgagattgcattctaaagcttgttgttcaaaaaattggtgccttatgggggaacttgttcaatatgcttcaactttacgtgaaagtggtggacccttatctccaagtagaatcctttctaatctgaggaatattggatgtcgcttgggtggtggaactcaggaagatgcccatgagtttctaaggcatcttgtgatgtctatgcaagcagcttgcttggatgggctggatggtgagaagcacgttgaaccaagtttgcaggaaacaacactgatacaacagatgcttggtggccgtcttaaatccaacgttaagtgcctcatatgctatcacgagtctgaaagatatgagaatataatggatcttactatggagattcatggctgggtagagtccttgcaagatgctttgacacagttcactgctcctgaagatttagatggcgataata

SEQ ID NO: 61257 - DNA, 281 bp, Zea mays
  Clone ID: LIB3069-003-Q1-K1-C2
gacggatccaactcccgaacagcatctgttctctcactcttgcacatcaatcattatttaggtgctcgatacctagcctatagccctagctagtagctagccactcagtcgcgtagtcatcaaccttctcatccgtacccatggccactgccgaggtccataccctgaccgtcgtggcgaccgacgaagcgccagttgtggagaccccatctacgaccgatcgtccagcccgacgaggctgcccccgtcgtcgaggccaatgtagacgaaccagctgcccc

SEQ ID NO: 61258 - DNA, 196 bp, Zea mays
  Clone ID: LIB3069-003-Q1-K1-E4
cccacacgtccaatatcacgtccaacaccttcacatttaaccttatccagatcctatttcagacctagttcaattatctaaaggttgtccaaatccatatcaagatccactacctcatccaaaaccataacctgcacatgcgccctattcacaccctaaacctataccataaccacatccaaatccttaacctcaa

SEQ ID NO: 61259 - DNA, 410 bp, Zea mays
  Clone ID: LIB3069-003-Q1-K1-F7
cacgcgtgcgacggctgaccaacaccaacttcatgtttctactccatgggatgaacatgcatggggccatttatggctttgccaacgagttaggcaaccctggcatgatgcaagcctcgtcctctgggcagactgcggacagcatcccatcagctgcggtccgtagggatcacgacagtgatctcgcgcacagagtctctgcagtgcttaaccaagcctggaatgacgaccaggacaccggtcatctcttggggtctctgtacgaggtcttctgagaagccatctactcctttgtccaaccaccatagatatgcttgttcgtgtagagagagacagacagacagagagatacagagagagatacagacagagagagagacacctagagagagaggaaatgcattgactct

SEQ ID NO: 61260 - DNA, 287 bp, Zea mays
  Clone ID: LIB3069-003-Q1-K1-G2
cccacacattcgtccactcctcctactatttctagttcgccagcgcccgcccttatctctgtgctcgctcatactttctttcgtgaaaggttttctctacatttcctcctatacttatactttctcctttcattcttatatcaaccctctgctatccctcatcataaacacattctactccaacacagacatcttcctcagggaactcattacaaactactcctatgcctttccccagatcataccctctagcacaacaaacaccttcaaacctaatacccataaat

SEQ ID NO: 61261 - DNA, 458 bp, Zea mays
  Clone ID: LIB3069-004-Q1-K1-A3
taaatagatgacaatgacaacattgaagtttaagatttagaatacgacgctgaagctggggctaagagaaagctcacctcagctgtttggaaagagttcaagagagtgaagttcaatggcacagtccgggcaaagtgcaactattgcttcaagcaactttctgcgtcaagtaataatgggacaaaacatcttcatgttcatttaaaaagttgtgtgcaaaggaagattaagttgaacgggaagacattggcacatgcttctttgagatttggtagaacggatggtggaacagtttcaatagagaattacacatttgatcaagaaatagctagaaatgaacttgctgcgatgatagttctgcatgaataccccttaagcatggttgatcatgtgggtttccgaaaatttgttggtgctcttcaaccacttttcaagatcggaaccagaaacattgatag

SEQ ID NO: 61262 - DNA, 239 bp, Zea mays
  Clone ID: LIB3069-004-Q1-K1-B10
tactttttattattttttttttttttttttttttggtttgggtttaattttatttggggggaaccccaaaccaaattgaccgccgaaaaaagttttgtggccaaaaacttagccacaaacacattaaacatgcgggaaaaatgctttcccaaaccctacgacgaacttacataaataaggggatctaccacaaacggcccggcctttgtctaaagcgacacatggtttaacccctccct

SEQ ID NO: 61263 - DNA, 428 bp, Zea mays
  Clone ID: LIB3069-004-Q1-K1-B9
tttgatctgttcgaggtatcttgctgatttaaatgaagccccctccttctgatcgaattgggtatggatttacgtcaatgcctgatctagaatgggatttggaatcttctgttggggataggaaaatcaccaacagtcatatcgctgcacttattggtaacagattcaaggcttcgcttcgagatagcttagtgcttccgaattgtgaaagcatctccatgccgtggatgttggctgaaaaggatgattgggtacctcgcaaggatgctccttttatttggctaaatcatgagcccactgagatgagaatccatgccacagctacagcatcaactcagtccgaggaaggtggcttgaaggatggtgggagtgaggaatcatcgagagtagtggcatccattgacgaggcaaaacatgagcccaagcag

SEQ ID NO: 61264 - DNA, 157 bp, Zea mays
  Clone ID: LIB3069-004-Q1-K1-G8
ccaggccatcgccacagccatttacgaaatgaagaacaccaacaaccacgaggtgacacgcaacattgcaacgggcaagcgagcactcaacacagacaacacagctacgtgcactggagactaaccgaccacaagagaagaatgcattctaccagac

SEQ ID NO: 61265 - DNA, 302 bp, Zea mays
  unsure at all n locations
  Clone ID: LIB3069-005-Q1-K1-A11
ggaagatgacggtgacgccacggatcacgttgagttacgggcggctgacggtgcgcgggggtacggtgctcaccggcgtgccggacaacgtgtcggcggcgcacgcggccggggcggggctcgtcgacggggccttcgtcggcgcccacgccggcgaggccaagagccaccacgtcttcaccttcggcacgatccgggactgccggttcctgtgcctgttccggttcaagctgtggtggatgacgcagcggatgggcgtctncgggcgcgacgtccctctgagacccagttcatgctcgtcg

SEQ ID NO: 61266 - DNA, 456 bp, Zea mays
  Clone ID: LIB3069-005-Q1-K1-A3
gctgcaccggcgccccagccttgacgagctttatgtcgacacggctgttaagaagttggagagcagagattttgttggtgctaaaaggattgcccttaaagcacagaggattttcccagagatagagaacataccccagctgttaactgtctgtgaagtacattgtgcagcagaagcaaaagtaaatggaatgttggatttttatggaattctccaagtagaaggaacagcagatgaggtgaccataaagaagcattatgcgaagcttgtcctctcacttcaccctgattaaaacagttatgctggtgcagaatctgctttcaagtttggtgcagaagcatactcaacattgtctgatcgaaccaaacgatatgcatatgatgtcaaatggagggctgcttccaaagttgcaccaaaaccagctacacaggcgacacaacccaatcaggctacaca

SEQ ID NO: 61267 - DNA, 442 bp, Zea mays
  Clone ID: LIB3069-005-Q1-K1-A7
cgagaggggaaaacccaaaaccctatcacttccgccccgtcgccgacggccgccggagtggagagatggcggtggacgaggtgaactcggtctacgtcggcggccttccctacgaggccaacgaggagatgcttcgcgacgccttcgggtactacggcaccatcgtctccgtcaaggtgattaatgatcatgctgtcaaaggcaagtgttatggttttgttactttcactcaccccagagctgctgagcaagcaattgcgggcatggacggcaagaaattaggcaaccgtattgttcgagtaaatgaagtgcgtacaagaggcccccggcgatttgggccgagatgggttcagacgagatccaagaaggtatggtagagatccatactgggacagaagggacagggaacggagctatgatcgtgaaagagatccctaccatg

SEQ ID NO: 61268 - DNA, 399 bp, Zea mays
  Clone ID: LIB3069-005-Q1-K1-B1
cggacgcgtgggcggacgcgtgggggacgtttgtgttgcaaggcttccaggttggtgcagggcagggacggacaagcttcccttttgccagattctcggagagtacagaatggagttaccagagtacaacacgattgaaccttatgcgaaaatgaacgagaactgtccgtccttgcccccaacgtacaaacgacccgcacgctgctgactacgagattgtctactatgtatctttctgcagctgcttcgtttacacagttggcagtagagtgttgatgctatgttctgtaaataaaagacactatatatataggtgcttggtagatggtagttcttaccaggaatgtagctgcgatgtattcaggttcacggttttcaggcgatcaggtctgaagccac

SEQ ID NO: 61269 - DNA, 280 bp, Zea mays
  Clone ID: LIB3069-005-Q1-K1-B9
ggacgcgtgggcgggcatcccgtggcggtttatctcgaggcaaggcctctcccgcgtgtgcctggtggcgaaggcctactgcgtgatccacgtcgtcaacgaccacctctgctcggtgaccttagtgcggggcgccagcatgctgccgtccctgaacctggcgggcgacgcggtggcggtggacagggtcagcgtgaggctcggccgggtcgcgccggtggacatcgtgctgatgatcttccccgaggacccccgcaagtcggtcgtcaagcgcgtcgtc

SEQ ID NO: 61270 - DNA, 364 bp, Zea mays
  Clone ID: LIB3069-005-Q1-K1-D1
atctgattggcaccggtggaacactctgtttttcgtttcaaacttattgaacgtgttggaggaaaggttgttgagtgtgcttgcgtcattgaattggcagaactgaagggccgagacaaacttggggactgggcagtttttgttcttgtggaagcagatgcttgagcggaacttgagacttctcttctcagagagttagagttagcgctgttgatgctacctctctggaaacaacaaagtttcccatgtttgctatagactggctgacacgtaataaagtttcattccaaattgtgatcccctgaatgatatgtcaatgtagacatgattgctggtccttgtatactgtggcttattattcaca

SEQ ID NO: 61271 - DNA, 402 bp, Zea mays
  Clone ID: LIB3069-005-Q1-K1-F6
cccacgcgtccgtaccaaaccagagtaactatagatcaaaattaataataaaccagaatgcgatgcaaatgacaaattgaatttaattccataaattaataatgcgaaagtcctgagctgctcatgaccgcgagcatggcgtataccagttttacactctgtagaggttgtaccctttacccacaagtcatattactcatctgccacggggttgtacggatctcatacacctctaccaaggaagcgaggcagggtaacactacgaggcctttacaaagttctactagcttcagaaaactcgttacaatttctaggaagagcaatgcatgaatctcccgtttgatcgctatcgcagcaaaatcaacacgagaaccttcctacacgctcactcccctactgctc

SEQ ID NO: 61272 - DNA, 358 bp, Zea mays
  Clone ID: LIB3069-006-Q1-K1-F5
cggacgcgtgggcggacgcttgggagttttctaattaggagatcagtttagagggcagttctgtattattttttgcataatcaaagtggaacttaagatgcaggcacccaaaaggaagagagaatcagggggtggtggtgggcacatgcgcgaggagctggcgtccgaggacgacgaatccccaccaaggaagcaaccgactgttcagcatcgtagaaaggctgtcgtgtttgatgacagcgactaggactagtgtgtgtatgacctgacctttacagtttattttttccatttcttgtcgagaatgatttatctggaaagaagatgttggtaactgttaaaaaaaaaatgttaataa

SEQ ID NO: 61273 - DNA, 136 bp, Zea mays
  Clone ID: LIB3069-008-Q1-K1-B6
tctctttttttttttttttttttttagcgttagggtaatttataccctaaactgatattatcattcctcactttatatcccattttttcttaaatcatataatttactatttttataaccccaaatttatcccaaa

SEQ ID NO: 61274 - DNA, 72 bp, Zea mays
  Clone ID: LIB3069-008-Q1-K1-H10
cccacgcgtccgaaaaaaaaaaaaaaaaaattaaaaataaaaaaaaaaaaaaaaaaaaaaaagaaacgggta

SEQ ID NO: 61275 - DNA, 340 bp, Zea mays
  Clone ID: LIB3069-009-Q1-K1-A8
gaaacagagggcgtcaacaattgcatgaagctatacctacaaagccattttcgcaaaaaacttgctttttaacagtgcactagtaacagcgccggtcacaacaggggcggtagtaacacaagccaccgttgccgtcacgattattttcagggaaaagaaaccaacttttgccggaagagaccaaccaaccatggcgtctcgagttcaaagagcctttaacatgtcctcggagctgcttttggtgaacgcgccgacctccttgaggttgagcacctttaccacgccgtccttcgcgagcaatgcgtttcggcaggacctgactccgagccccaagggcttt

SEQ ID NO: 61276 - DNA, 292 bp, Zea mays
  Clone ID: LIB3069-009-Q1-K1-B6
tcccgctcttacattgactcatattttgacttttaatcaaacccttattttaaacgatttgttaatttctacaattgaactgataacatatacatcctctatcatcacctatttcatactctttcaaacactaaatcatgacatttctattattactttcattcatccacatatcttttacacattcttgatcatacataaacaccataatttcacaatccatacttatttcctcacacatcttatatcatattacatctaccaaacaatatttttaaaaatcatttatact

SEQ ID NO: 61277 - DNA, 403 bp, Zea mays
  Clone ID: LIB3069-009-Q1-K1-D10
cgggccgacccacgcgtgcgctacggtccctcatcacttgttcctctacgttcggccacctagctcgccgcgcgcgcaagcgtgcgccaccacccactctactagcttagtctcccctcgtgcagcgcgacgacagccagcaatggccgccgcccagtgaggcagggtcgcagtgacggcacgagacgcacacccacgggcgctggcggcatgccgggcgacgcctacgacctcctgtgcgccgaggacgacgccgccggcagcgccctgctgtgcaccaccgacgacgacgacgggtgctgctccgctgtcgaggaggactcggcggcggcggcggcctccatcgccgagctcatcggcggcgaagcccagtactcgcccaagccggactaccccgacaggc

SEQ ID NO: 61278 - DNA, 298 bp, Zea mays
  Clone ID: LIB3069-009-Q1-K1-F1
gacacagatacacaatggactgaatggattatgcaatggtacaaattagcggaagcggatgctgtgagcaagttgctagatctttctcccttagcttcttgacatttggttcttgccacagctttttgatgcttctcttggcagctggacttaatgttttgctattcttgtcgacatcacgagttgaattgtcaaactagtctcttatgttctatgctgatatgccttaaccagaaaaaaaaataaacacaagtaataaaagaagcatgaataatactattctcttaaaggttataaa

SEQ ID NO: 61279 - DNA, 473 bp, Zea mays
  Clone ID: LIB3069-009-Q1-K1-F6
ccgggccgacccacgcgtgcgcgcgcacacacacaaccagatcttccccatatccacccgtcggcacctccgctggaagaggcagatctttgtgaaaaccctgaccggcaagactatcaccctcgaggtggagtcgtctgacaccattgacaacgttaaggccaagatccaggacaaggagggcatccccccagaccagcagcggctcatcttcgctggcaaacagcttgaggacgggcgcacgcttgctgactacaacatccagaaggagagcaccctccaccttgtgctccgcctcaggggaggcatgcagatctttgtgaaaaccctgaccggcaagactatcaccctcgaggtggagtcctctgacaccattgacaacgtcaaggccaagatccaggacaaggagggcatcccttcagaccagcaacggctcatctttgctgggaagcagcttgaggacgggcgcacgc

SEQ ID NO: 61280 - DNA, 277 bp, Zea mays
  Clone ID: LIB3069-009-Q1-K1-G3
tgcgacttgcgagccttcctgcatctagttttcacttctaatcgtcgccaagagagaaggccttcggggtccttttcaaccggcgccgccgactctcgtgttcctccccgcgtcctcgttctccttgctgctggacccgctcgtggggatcgacctgatttctcctgtgctggcttccaaggtagaaacgaagtcttttgttacatcatggccttaccaactgcagcgcctattttgcttgaccagaaccaacagctcaatataggcaacagggcca

SEQ ID NO: 61281 - DNA, 429 bp, Zea mays
  Clone ID: LIB3069-009-Q1-K1-G9
tgcgagttgcgagtcttcctgcaactatcgttcacaccgaattgttggcaagagagggaccgttcctcttcccgttcaaccggcgccgccgactcgcgtgttcctccccgcgtcctcgttctccttgctgctggacccgctagtggggatcgacctgatttctcctgtgctggctttcaaggtagaaaagaagtctttcgttccatcatggccttaccaactccagcgcctattttggttgacgagaaccaacagataaatagaggtaagagggccaatggaccaagggccaaagggctgaagccatgcgagaatcctggcaatcaagggaggagagctcttaaagatttgtccaacttctctaaaggcactggtttgaaggacactttcaccctgaaagagaagtcccagcagaaaactcgtaataat

SEQ ID NO: 61282 - DNA, 350 bp, Zea mays
  Clone ID: LIB3069-009-Q1-K1-H6
cgtgctcttcgtcatactgctgctgggctttctgcatcacccgaccatctccggctgtgtgggcggcatctacatcgtcgcgaggttcttctacttcaagggatacgccaccggcgttccggacaaccgtctcaagattgggcggctcatctacttggcgttgcttgggctgatcattcgcacagcatctttcggcatcaacctgctcatcatggagatgctctaaactctgggtttatatgtgagctccacgctgggttaaccgcacaagttactcatggtctgagcatcataactttgtgacactggtcttttgggattctatagtggagttctcgtttctttctttg

SEQ ID NO: 61283 - DNA, 287 bp, Zea mays
  Clone ID: LIB3069-010-Q1-K1-E3
cagagcaggcgcatccacaacctgcctttctcgttccctggcggcgtccgcagcaggagagcgtaatctactgcgaggacggtgaacgatgtcaacccgcacgagatcgtcaaggcctactacgcccacctcaagcgctccggcaagatggagctccctgagtgggttgacattgtgaatactgcgaggttcaaggagcttcctccttatgatcccaactggagccaatgtgacgaaggctgctgccaagaagaaatgatctatctggctggtgacgaaagctgctg

SEQ ID NO: 61284 - DNA, 373 bp, Zea mays
  unsure at all n locations
  Clone ID: LIB3069-010-Q1-K1-F4
gagttttggcgtcctgtacaagatagctgagatatcgttcttggcaccctacaagaggganatgtttgatgttatcgagaagggagagaaacagtccaacatcactattggcattatggtctccgatgtcatcgtgttcgttaccgttctcttcaagctcctgtttggtggcaagaaaccagtggcacctgtgaaacctgcagctgatgcgaagaagcccaaggccgtggagactgacggtgctggaagcagtggtgacaaggatgagaaagaggatgaaaaggaggagacaggcccacgtttgaggacccgaaaggagacatagacctgtttttgacgtgttttagctcttctggcgtctgcttattttgag

SEQ ID NO: 61285 - DNA, 185 bp, Zea mays
  Clone ID: LIB3069-010-Q1-K1-G10
gtagcactaccacattcacaaggctttaatttacacgcctctttgccaacttcacccgggaggtttctctgaacatatctctgatccaatctctcggcatgaataacttcatacctaaacgacatctcatcaagaataatctccccatggtgcaatactaactcaatctccttatatagcatgca

SEQ ID NO: 61286 - DNA, 139 bp, Zea mays
  Clone ID: LIB3069-011-Q1-K1-A5
gggaacagaaatgtttggtgcctgttttatcgaactccagttctcttgtcatttttctttgtgctatagtctgtattatggatgcgtatgagtattgagatgattctgcatttgaattgtcggcttaaaaaaaaaagac

SEQ ID NO: 61287 - DNA, 188 bp, Zea mays
  Clone ID: LIB3069-011-Q1-K1-C2
ccaacgcctatgcctgttcaaacgctgccttttgttagtcacagtgaatgcttgtgttccggtatgatctgtataggcgaactgctcgtagaaaacaagtcaacaacatcaaaacttgtatggtccagtgggcctgactagtccttaaaaaaatttgttcacttgcaaaacacataaataattataat

SEQ ID NO: 61288 - DNA, 375 bp, Zea mays
  Clone ID: LIB3069-011-Q1-K1-E5
cacggcggcaccccgtgcgtcggctgcttgctgccccagtgccgcccccgcgttcccttcggtcccgccgacaccgacgccggcactgccaccgccggcatggcgaccccgctccgcgccaccgcggtcctcgcgtggggttccggggaggacgggcagctgggcatgggcgggaacgaggagaaggactggccccacttcgttgaggcgctggggccctacgccgtcaccgccgtcgtcgccggcagtcgcaactccctcgccatctgcgacgacggccgcctgttcacatggggatggaaccaacgcggcacgctcgggcacccgccggagaccaagacggagagctccccgggccccgtcgacgctctcgcg

SEQ ID NO: 61289 - DNA, 398 bp, Zea mays
  Clone ID: LIB3069-011-Q1-K1-E7
tacgaatgcactgtattattccatttcaatctttgaacatatacaacagcagtacaggacggttttggcgctaaagatacatgtcaagcaagcaccaacatgctaatcataataagcttacaaggcagatacaaatctgcatacacaaatgctaagcagcaatactttattaacattccagtgaaagacacattcacaaatcgagttgcacataacatggaactgcattctgaacgagatacaacctgacttcacaatggtcctcattcgcacggcaatgagccaacctatatgccattcttctgaacgattgccttcaatgcctccgacatagacctatcctagatgatcacatgattcaacctaacgtcacgctgggcaaagagctgacattacct

SEQ ID NO: 61290 - DNA, 85 bp, Zea mays
  Clone ID: LIB3069-011-Q1-K1-G7
cccacgcgtccgcccacgcgtgcgctattatactcgctcaattggaattgcttatacgtaaggagtgattgacgaaactaagcac

SEQ ID NO: 61291 - DNA, 131 bp, Zea mays
  Clone ID: LIB3069-011-Q1-K1-H2
cccacgcgtccgtgaatccctggtcatacttatatttgtctcatgaaatttggtacaggggggaatgctttaaaacgccctgaatcattttataaatcacatatgtctctattgctgttaaaaaaaaaaca

SEQ ID NO: 61292 - DNA, 260 bp, Zea mays
  Clone ID: LIB3069-011-Q1-K1-H3
cttagattgctcttgctaccaaaatcagcatgcgtggagttgaaacggtagggcgttagatgattaacaagaatggttgcttgctatgtttgcagtgcattcgtgcaattgttaacctaagattttgttggtgaaaacgatttcttttcagacttgcttctgttgagtgctatcattccatatcaatgtacttcctcttctagaattttcgatgcccgcaagttcaaaagtaaatttacaatgtagcgactggtaaaact

SEQ ID NO: 61293 - DNA, 288 bp, Zea mays
  Clone ID: LIB3069-012-Q1-K1-D5
cccacgcgtacgcggacacctaggcttgatacgttgctggatgcaccatgaatacgaggggggtctctgcatggtaaacggggcatgtgacgacatgaaccgctctcagctatacaagttatgctgctatgatctcgcatgccacctgcttgagctataccaacacaagcacaagcggactaagatgctcgaggcactcggcgtcctccgtgacatgcaccataatgtcgccaacgtgatcctaccaggacatgctgaaacgtacacggttcatacgaatatgactgt

SEQ ID NO: 61294 - DNA, 417 bp, Zea mays
  Clone ID: LIB3069-015-Q1-K1-E8
cccacgcgtccgcccacgcgtccgcccacgcgtccgcccacgcgtccgaagcaagcagccgaaaaaaaccgtatcgtctcgcctgttcagtttccttctcttcccgcagcccggtttgccgaccaggttccaccgttccagagtagccaagcgaatcccgtgtctggttcgcgcgatggcggaggagcagtccaacccccagcaccagcaagcggaggagagggaggttatggtggagcagcagcagccgaggagggccccgaagctgaggtacctggacttcgtccaggtggcggctgcccaggccgcggtgtgcctcgctgggctctacggcctcgccaaggaccacgccggcccgcttccgcccagcgttgacgccgtcgagtctgccgtcaagggcgtcggtagccccgtcta

SEQ ID NO: 61295 - DNA, 65 bp, Zea mays
  Clone ID: LIB3069-015-Q1-K1-H5
aaagaaaaaaaaaaaaaaaaaaaattaaaataaaaaaaaaaaaaaaaaaaaaaaagggaagagga

SEQ ID NO: 61296 - DNA, 177 bp, Zea mays
  Clone ID: LIB3069-017-Q1-K1-G1
accacgcgtacgatagtacctgctgaataaacctcccatgcaccaacagggagagagtctggacgtcttgtttgtaatcatgaaccgcttgtacgtgtaatatctagtaaaccactctccaccttacacataaaataaaggtggcctcgtatcggattagccattgaattccgatat

SEQ ID NO: 61297 - DNA, 296 bp, Zea mays
  Clone ID: LIB3069-018-Q1-K1-B1
ctgccactggcttcaggtcctagaattgtttgctgggtcgtgcaaaaagtaataagtcggctgtaaagcttattaagcatctgcctaactcatcaaaagaaatctattccttattgatgatgtaccgagatttttgaacttaaagcggtactacgtgctgctaacagttgattaatgatttttctttgcctctatcaaaaaaaaatcattaatcaactgttagcggtactacgtgctgctaacagttgattaatgatttttctttgcctctatcaaaaaaaaaaaaatagaaaaat

SEQ ID NO: 61298 - DNA, 423 bp, Zea mays
  unsure at all n locations
  Clone ID: LIB3069-018-Q1-K1-E6
aagccatggcagccaaccccaaccactgcctccgccgcctcgcctcagctctctcccacggtccccggccttcgactcctaccctatccctcctcttcccccgcctcgcgctctccagctccggccccttcacgggcccgccgncgncgncggcggatgccgtaaggaaaggggagggagaggaagcggcggaagctaaggccggcgaagccgacgccgaagcggggaaagaggaggagcatgaggccgacggcggtgcgcacgtgaacaaggccaccggcgaggtctgcggcccgcggtggcccgagcccacgaggtacggcgactgggagcgcgccggccgctgctccgatttctgaaccgccgctggccgcgaggtgaggctcgtcagcgtcagcacggaacctgtggatgtggttcccc

SEQ ID NO: 61299 - DNA, 340 bp, Zea mays
  Clone ID: LIB3069-018-Q1-K1-G5
cccacgcgtccgaagcaactgaagatcagctgcaacctaaacaatgctgcctgcaaactgaagttgaaggattacaaggaagctgcgaagctttgcaccaaggttctggaactagacagccaaaatgtcaaggctctctacaggagggtgcaagcttacattcaacttgctgacctagagctagcagaggccgatatcaaaaaggcactggaaatcgatcctgacaacagggatgtcaagttggaatataagatcctgaaggagaagatcaaggagtacaacaagaaagacgccaaattctacagcaacatgttcgccaggatgacaaagtacctttggg

SEQ ID NO: 61300 - DNA, 241 bp, Zea mays
  unsure at all n locations
  Clone ID: LIB3069-019-Q1-K1-E11
aagcggaagggtctcctcgctctcctatcttcgntatatcagctgctgcgggcggcgatgggggcgcggaggaggctgctgtcggacacgccgncggagcatcgccataggcagggcgcgccggcgtcggactggagcgcggggtaccttaacgggtggctgtcgcagccgacgccgatcttcggcctccgnctctgggttctcgtcggcatcgccgtcggcgccgccatcgtgctcgtgc

SEQ ID NO: 61301 - DNA, 376 bp, Zea mays
  Clone ID: LIB3069-020-Q1-K1-B1
tagcactcccagtcccggctcccgccgtcttctcgacgcttcccccctcttcctccgccgccaacccagcgagagagctcccagtccgcgaagacatggcggggaagaagcgcaagtccggctccgagaagccgacgaagcaccgcctcccgctgggagccgatgccgacgctgtcgccgaagcctcgaagcgccgccgatcgggcgccaccaagcagcaccaggcggacgaggaagcgtccatcccgccctctctcagcgccaagatccttcgcgaggcgcgcaagcagcaggaagaggagatgcgcgccgactccagcgacgaacagcgaccctcagccgccgaggcgaccgcggggccgtccacgtcgtcctc

SEQ ID NO: 61302 - DNA, 62 bp, Zea mays
  Clone ID: LIB3069-020-Q1-K1-B5
cccacgcgtccgcccacgcgtccgataattataaaaaaaaaaaaaaaaaaaaaaaaagaagg

SEQ ID NO: 61303 - DNA, 314 bp, Zea mays
  Clone ID: LIB3069-020-Q1-K1-C4
cggacgcgtgggcggacgcgtgggcagttttactgtagaaaatgtttgtttggatagcagcacgttagtatacaacagtggaataggatttgtttgtaatgttattagatgcgggcacctgttgcccattaagctatggcatggtatccctggtttcttgtatatcttggagagcgtcagctcttatgcaggacatagtgctatgccgtcaaactcttgtagaaatgttgtaggcaataaaccagtgacacttgtcgaaaaaaaaaaatgtaatataactaatataataattctagaagtatgcacagagtcta

SEQ ID NO: 61304 - DNA, 410 bp, Zea mays
  unsure at all n locations
  Clone ID: LIB3069-020-Q1-K1-C7
tacttatttcgtctcaaacttgaagaaatcagcacatatttcttcgaagtccactcagtactcacctcaaggaagtgaaagtagtaatctacaagttggtcaaggcaacttgaaacttcaatataatgaagctggaaaattatccctgtactccgatagtaagactatggttcaagcaaactttgagcagaaatacaagtattatattggacaggatggaaatggaagtgatcctcaggcttctggagcatacatatntccgcctaatggcacagttccaatcagtactgatgggcaggtttctctcacagttctgcgtgggcccatattggatgaagtgcaccagcagataaattcatggatttatcagattaccagggtttacaaggagaaagactttttggaaactg

SEQ ID NO: 61305 - DNA, 458 bp, Zea mays
  unsure at all n locations
  Clone ID: LIB3069-020-Q1-K1-G12
gaattcggccgcncaccgacgcgtaaagaagaccgcatgatgatcacaggtatgcatactgtttctgatatcttctgtgttggctgtggatccatagttgggtggaaatatgatgcggcacatgagaagggccagagatacaaggaaggcaagtttattctggagaggtacaaggtgtcgggccctgacggaagccaatactgggttccacaagatgctcacttgggcggaagcgacgccgatgacatataaaacacgatccaacaagctcaagcctgtcgttgatcccctgtaaataacctgngtggcgttgctctttaggcagccgacagccggggattgctccattgaaataattcgccggcgtaaattgttgctgttccaggtgacatgatcgtatccctcccttcctgccgttgtccctggaagtcattagatgttaccgctgtatatgtgcg

SEQ ID NO: 61306 - DNA, 449 bp, Zea mays
  unsure at all n locations
  Clone ID: LIB3069-020-Q1-K1-H10
cggacgcgtgnnggcgttggatcgctgagtgttactgcagggacagtgatgatcaatctgcagaggagaatggggagttcttcttctccaaactccttggtatgagcataatccaaccggagttcagtgacgcgaggatggtctcatgtcaaatcaatggatttttccgtgagtgcatgctctcacggtcaggggaaatggaagaccttgtcattgaactggccgacagatgcaacctaaccacccaacgcagcgggcgtcatcttgtcatatcggaaagctgggacagagataagattttattcgagagcatcgacttctcacggatacggtcaatgacagtgtttggaatgtggagatcattcttcatctccaaaagtatgaagctcgtccgggtgttggatctggaagatgcattaggtttaacagatgaaaatgttgatcagatg

SEQ ID NO: 61307 - DNA, 156 bp, Zea mays
  Clone ID: LIB3069-021-Q1-K1-A5
aaagaacaaaatgacaataaaaaatttaaatatcaaaaaaaaaaaaaaaaaaaagagaaaggaataaataaaaaccggagaaaggcaatccatcaaatgtgtccgccgatctgcagcaccctacctttccttccggtgctcccaacttcgtctctt

SEQ ID NO: 61308 - DNA, 404 bp, Zea mays
  unsure at all n locations
  Clone ID: LIB3069-021-Q1-K1-B8
tattgttttaggagctcttggagatgctctaatctcttctgcacttgggctcggcaaccgtgacccgatcttccagatttcccgtcgccgagccacgcgggtcgagtacccgtcgaactcgccgctgtcggatcgttctcgcttggggcgatcaagctaacgggatttgaggagatctaggccagccgcgggcagcagccatcagccatgagcgaggtgttcgagggctacgagcggcagtactgcgaggcctncggctcgctctcccgcaagtgcaccgctgcatccgacctcgatggaaagaggaagaagcagaagctcttcgagatccagtccggcgttgaggaagctgaatcgctgattcggaagatggacctggaagcaaggagcctacagcctagcat

SEQ ID NO: 61309 - DNA, 453 bp, Zea mays
  Clone ID: LIB3069-021-Q1-K1-D8
aagcttatcagagagctgtgaagccttgcttctgtactgctcgagttcttcttcaacccgcttgaacttttcatatgtgtgattcagctcctgctccagctcctgtgtccgtgagtatacaccttcagcatgagtctttgatgtgtgaagcaaatcttccagctccagacttctttgccgaactgaatgagcttgcttgccgaactgaatgcgcttgttcttgatgctctgaacatttatcagtcagctccttgacttcttgttcaagtagctgatttttagacactgaggaatctagggaggattgtagctcaataattttatctttgtatccctctgcactggtcacagtttcttcaagctgcattcctctttctgctgatacagcagcttcttgatgaatacgctctttcagcaactctatttctttacttgatttaacaaatttattct

SEQ ID NO: 61310 - DNA, 460 bp, Zea mays
  unsure at all n locations
  Clone ID: LIB3069-021-Q1-K1-G8
gaataatctcttcttcacctcactaacaccagctagcaactctttctctcctgcaataatggccgctcgctcctcctcctcccagccgcagctggtcgcggcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggngtgcgctcgctcaacagccgcgcgtcgtcngcggcggaccggcaggccacctgcaactgcctcaagagcatgacggcccggttcgcggcggcgtcagcatggccaacgccgccaacatccccggcaagtgcggcgtctcccgtcgcgtgcccatcagccccaccgtcgactgcaccaagatcaactgatcgatggaaccat

SEQ ID NO: 61311 - DNA, 449 bp, Zea mays
  unsure at all n locations
  Clone ID: LIB3069-021-Q1-K1-G9
cccacgcgtccgtaccaaaccagagtaatattagatcaaaattaataataaaccacgatgcgatgcaaatgacaaattgaatttaattccataaattaataatgcgaaagtcctgagctgctcatgaccgcgagcatggcgtataccagttttacactctgtagaggttgtaccctttacccacaagtcatattactcatctgccacggggttgtacggatctcatacacctctaccaaggaagcgaggcagggtaacactacgaggcctttacaaagttctactagcttcagaaaactcgttacaatttctaggaagagcaatgcaggaatctcccgtttgatcgctatcgcagcaaaatcaacacgagaacctncctacacgcccactcccctactgctcttgccctttcgggtaaggtagttctccactagctttcctaattagtc

SEQ ID NO: 61312 - DNA, 344 bp, Zea mays
  Clone ID: LIB3069-022-Q1-K1-A5
gacaaacattctctggaatacggaattgactcgatcgagatgcatgttggagctgtacaggcaagcaatcgagcgtcagcagatcatgatcttagtgggaagaagggaaacactctgcgcagcggtcaaacttattgaacgagttggagcaaaggttgttgaatgtgcttgcgtaattgaattggcagaacttaaggcgctacacgaacaaggggacatgccagcactgtgtctcgacgaaacacatgcttgaccggaacttgtgatttaatacctcacagagttagagctagagctggagatgctagctgtctggaaccaccagagtactcgatgtatgctat

SEQ ID NO: 61313 - DNA, 435 bp, Zea mays
  Clone ID: LIB3069-022-Q1-K1-B12
cccacgcgttcggtgatagcagggtgcagcggctcgaagctggaggaagcggacgggttcgccatggggtccgagggatcctcgggtccagttgtcgttcccagaaactttaggctgctagaagaactagaacgtggtgagaagggcattggtgatggaactgtgagctatgggatggacgatgctgatgacatatttatgcggtcctggacaggaactatcattggtcctcccaacactgttcacgagggacgaatctatcagttaaagctgttttgtgatacagattatccagataaaccaccgactgtccgattccagactcggatcaatatgacatgtgtgaaccaagaaactggattggttgaaccaagtctatttcctatgcttggaaagtgggaaagggaacatacgatggaggacattctgaccagc

SEQ ID NO: 61314 - DNA, 109 bp, Zea mays
  Clone ID: LIB3069-022-Q1-K1-D12
tggaacagaacgctccgcaccaatcaattttcgaacccatgatatgccattacagacgggcttaatcactgtctgcgccgtccagcctcaactctttcacactgcccca

SEQ ID NO: 61315 - DNA, 300 bp, Zea mays
  Clone ID: LIB3069-022-Q1-K1-E12
ttcggcttgttgagccaaccggatttactttaattactagactcatagacattagcacgggaacctcacatatcgatgcctcacgttccattatcaattccaatgaggggacaaccactcactgcgctgtctgctacaagactaactaccttgtgcactacctcacacgcacgacatgcgcatgtgctacaggcggttcttccgcttcctccacttcaaggggtacgttcagctcgtgaactacaacttcttcgactgagtgctctacttgattcattacttctaccccatggtcctgaa

SEQ ID NO: 61316 - DNA, 227 bp, Zea mays
  Clone ID: LIB3069-022-Q1-K1-E3
ataatatggtggtatggtatagacgataccctaaatacaattgactgagtagggacatgaccacgactggactgagtagaccctaacatgacataacgatgtctataagtagcagattcacatatgactatctgacgggataactatgaggctcgaactgattgccctagcgatcaatgacgcaacatgggagtacattagatcacgatgagtatctgagaattgag

SEQ ID NO: 61317 - DNA, 470 bp, Zea mays
  Clone ID: LIB3069-022-Q1-K1-E5
ggaattggaattccgagctagacgtacgcgtacgcccacgcgtacggcgaaagacccatacatagatgcgatcgacttgaagaaggcttgtaacggaacgttaaaaaatattatatggtggtatggagaaacataacaaaatacgttagattcattaaggacatgtacaacaatgttatgaatagtgttgaacaagttataaggatgtatataactttttgattaaaataggactatatcaagggtcaactttgagcctttacctttctgccctagtgatagatgatgtcacaagggaatacatgagatgaacatgaatatatgagatatgtggctatacaagaatggatcgagttcaaaatgatgatatacgctatagattataagtagcactagcaccaattaaagaaaaacatattcaacatcgattgagatagtttggacatgtacaacggagatcccaaacacac

SEQ ID NO: 61318 - DNA, 345 bp, Zea mays
  unsure at all n locations
  Clone ID: LIB3069-022-Q1-K1-E9
aacagaagctacaggccaataatagcttgatttttagagtacaaaaatctgttatttgcgctgatagtttatctggagcagtttcattttacatatgactgtaatttgtgagaatgcacatcttacgatttttgttgaccagtattcataggtttttagttagcaatgtgttgttggcccgttgctagtccttgtaatacaagcccacctgtttttttgcgcacggcaagacttaaactgacaacattttgtagtaccttttattttgtatcacctgctctatacacgagttttcttggaacatcggaaataataatgccctccaaaaaaaaaaaaannnaaaaa

SEQ ID NO: 61319 - DNA, 434 bp, Zea mays
  Clone ID: LIB3069-022-Q1-K1-G8
cacggtccctgcctatttcaacgactcgcataggcaggccacaaaggatgctggggtgattgctggcctcaatgtgctgcgtatcatcaatgagccaaccgctgctgctattgcctatggtcttgacaagaaggcaaccagtgtcggtgagaagaatgtcctcatttttgaccttggaggtggtaccttcgatgtctccctccttacaattgaggaaggtatctttgaagtcaaggccacagctggcgacacccatcttggtggtgaggactttgacaacaggatggttaaccactttgtccaggagttcaagagaaagaacaagaaggatatcactggcaacccgagggctctccggcggctgaggacctcttgtgagagggccaagagaactctgtcttccactgcccagaccaccattgagattgactcgc

SEQ ID NO: 61320 - DNA, 441 bp, Zea mays
  Clone ID: LIB3069-022-Q1-K1-H9
aacggttctgactctatccatgactgtctgtccgagaattggcagtttgcacttgctgaactaaacagttctcattacatggcaatctgtatagaggatgactcaacaagttcagattctagaaacggtagactgccactaggattgaaagtatggaagaccactccgttcgtggaagatatacttgtttctggaacggaagctgtaaaacttgtcagttgagtatgtgagaggatcaagtgatttcttcagatgacaatgtgatgcaacgaatgtatttggacgaagtatgcgctgtgcagggagactgaacggttttcttcgagcatactgcatgcattgatgaactgaccactgacactgtgtgctttagttaagatttggaaatgcaacgacatacactttggagtcctgatattcgtattagcatatcacgacact

SEQ ID NO: 61321 - DNA, 94 bp, Zea mays
  Clone ID: LIB3069-023-Q1-K1-C12
gccacacgtccgcccacgctttctcatttgcgtccggcttaaatacgcgagcatgcgacgtcatatctgtggcatagggcacctaaattcaatt

SEQ ID NO: 61322 - DNA, 66 bp, Zea mays
  unsure at all n locations
  Clone ID: LIB3069-023-Q1-K1-F7
cccacgcgtccgnntaaaaaaatttatttttttaaaaaaaaaaaaaaaaaaaagggaggagttttt

SEQ ID NO: 61323 - DNA, 406 bp, Zea mays
  Clone ID: LIB3069-024-Q1-K1-F4
cccacgcgtccgaagcgcgccatcggcgtttaggttaacaagcaggtcaatgggcgcatgggcaggaggcgtatccatgtccgtgtggagcatgtgcagccgtcccgctgcacagaagagttccgcctgaggaaggcgaagaatgaccagctgaaggcggatgccaaaaagtgcggcgaggttatcagcaccaagaggcagccattgggtcccaagcccggcttcatggtcgagggcaccaccattgagaccgttacttccatcccatatgatgtggtcaatgatctcaagggtggatactaggttgtttggtccatctacctgcagtacccaattctacatctgtgttactctagcgcgtgcaactttgctcactctgagcagtagtatgaacctggtgtgtgtt

SEQ ID NO: 61324 - DNA, 266 bp, Zea mays
  Clone ID: LIB3069-024-Q1-K1-H8
cttgcagtaggaagacggagctgcaatttttggcgacagctgatattcgacgaccactggagctgcaatttaccgtgaaaatagaaatcccttgccaaactagccatcaatgatgggaaaacctgcgtgctggatgatgaaactttatattagttctcatgagtaccttgtaccgaccaattgtgtggcctaatccagtaagtcatctttgtaaaatcatactaactcttattgtaactggatttggttccgaattaattcatttt

SEQ ID NO: 61325 - DNA, 282 bp, Zea mays
  Clone ID: LIB3069-025-Q1-K1-A1
ggtgggttggcttctcctccccctccggttcgggttcgggttcgtgaggttctccgggggtcggtttcgtgggtgagcggatcgagatggctgcgtcagatgttgagtaccgctgcttcgtcggcggcctcgcctgggccacggacgaccactccctgcacaacgccttcagcacctacggcgaggtcctcgagtccaagatcatcctcgatcgggagacgcagatgtcccgcggcttcagcttcgtcaccttcttcacggaggaggcgatgcggaacgcca

SEQ ID NO: 61326 - DNA, 432 bp, Zea mays
  Clone ID: LIB3069-025-Q1-K1-C2
cccacgcgtccgctttggtcaggaagcagctgagtatctaagtgaatgtttgctcagtaggtcagagcaatatcgggcaatgattgaagaacgtgatgcttctgggggaaaatcaaagggacaaggaaccggaaatgttctcattgttactcttgttgatgcggagacagaaagtagcataaatgctaccatgcttgaggaaggccttgctcggcttgaaagaagcaagagatgggacactagggagaggaagacggctctccagaacctgtaacagttccaggagaaggcaaagaaggaaaggctgcggatttggcagtatggcgatgttgaatcggatgaagacgagcaggccccagctgcaatgaagcctggaggtcgtcggtagagctccccaaatgtgagactctgctgggagttatagattcaact

SEQ ID NO: 61327 - DNA, 314 bp, Zea mays
  Clone ID: LIB3069-025-Q1-K1-D12
aaaaagaaaggaattggcttagttttaaggaaaaccgagtctgaaatctacacaggatgcacaagcaacccagacaatggtagccccacacacaaagcccatacaaggtcattgttgtcgagctcaacacaaaagacgagcaactctgagccaaaatgagcaacacaaggtcaaatgaggaaaccaacaatgtctatacccaaaaaacggcacagaagtatgaagaccacggcgcggcgtcgttgccaagccccaagacaccccacgcgaggcagctccgattcttcaccaataagacttccaaacttgatact

SEQ ID NO: 61328 - DNA, 406 bp, Zea mays
  Clone ID: LIB3069-025-Q1-K1-F3
ggcgcacgacgaggactgctaccggtggattacctccccggacatcctctgctaccggtgggccgtcttgcagggccggcgtgatggagcaggtgcgccaggactggcacaagatctttgtgctcgacgtcgccgtgctcgccgctctcgtctgcatctgctcatgcgggtgttgcgccttcaggaacgctcgccgctcccggtcccagtacccatacggggtaaaccaaacgtccaagataaacccacgctgggactactggtggcgatgatggggtggtagaagagaacagatctactaggctagctgtagcttctcaatgcctggatgatattttgatccagtcttctgtggaaaaagataaaataacacttgggatcaaaaagacatgaatttgtccaacat

SEQ ID NO: 61329 - DNA, 415 bp, Zea mays
  Clone ID: LIB3069-025-Q1-K1-F4
cttggataaatgccgccgtagatttgaccttggatatgcagattatcttagatatcgtgggatgcatcaatttgaccaggcgatgcagcaccttgagggagaatatgaattcatgacatctgatcactcatatgtatcacggaagcatgaggaggataaggtgatcatctctgagagaggagatttggtcttcgtgttcaacttccactggagcaatagctattttgactatcgcgttggttgtttcaagcctgggaagtacaagattgttttagattctgacgatggccttttcagtggatttagatcgcttgatcatgactctgagtactttactgctgactggccgcatgacaacaggccgggttctttctcggtctatgcaccctacagaacagccctcgtatatgcacct

SEQ ID NO: 61330 - DNA, 282 bp, Zea mays
  Clone ID: LIB3069-025-Q1-K1-G10
cgggatcttacattcattctttctacgaaaatttcacaaaaccaactcagatgattacagtacacaacaaaaaacaggcccatttacatactttaattaactatagattaatgctaatattctgtttttcctagtatagactaacatgtaatgaacaagccctccaatgaacaggcatacataaataatgtgcaggttgctctgttccactggcagatgcattcctgcctgccttattgagaaccaagtttgtacacgggagcattgcataatcaaaatacc

SEQ ID NO: 61331 - DNA, 385 bp, Zea mays
  Clone ID: LIB3069-025-Q1-K1-G8
cacctgcaactgcctcaagagcatgacggtctcggctcggcggcggcgtcagcatggccagacgccgccaacatccccggcaagtgcggcgtctccgtcggcgtgcccatcagccccaccgtcgactgcaccaagatcaactgatcgatggaaccatagtggaggtagctcgctcgttggatggcagcgtacgtggccatcagcagcatgcagtcgtcgtcgtagcagagatgtcctagctacgtgtgtgtcatgcatcagactggcacataataaagaagtagatcatgcacccactagtgatcacttcgtctagtggcccttcggtcaatggcgtcgtcgtcggcggggaccttacgtgacatgctgtagcacgtacgctagc

SEQ ID NO: 61332 - DNA, 264 bp, Zea mays
  Clone ID: LIB3069-025-Q1-K1-H10
aaagaggtacacacggccacacgccatatttagcttcctggcttgttttgcgccctttgtgaatatgtgtaagcttttgttccctcgccaccgccacccccctggtgcctcttgtttgttgcaaatgcagccgtggggatggatggatccaagtatggagccatttaagcttcggttgcgcagtaaactttataaatacgtaatgtaaaggcttgtcgtgtgtggtttgtgctgcacacaaaaaaaacaacaagaaacttactt

SEQ ID NO: 61333 - DNA, 104 bp, Zea mays
  Clone ID: LIB3069-025-Q1-K1-H11
gtgttgtgtgggtgcagcacaacacaacactctgctcgccgcctgatgcgacgtatagcgtcggtttctatacatcttatgtctatacactaaaacagtataac

SEQ ID NO: 61334 - DNA, 396 bp, Zea mays
  Clone ID: LIB3069-025-Q1-K1-H2
cccgacgtacggctcaacaatggcgacgcggcgccacatcctccttctcgccgctgccttcgtgtccctggtcgcgctcgaggctgtggagggcctcgaagaggggccccgcgggcgccggctgctggtcctgctggacgacctggccgtgcggtcgtcgcactcggccttcttcggctcgctccaggcgcgcgggttcgatctcgaattccgcctcgccgacgaccccaagctctcgctgcaccgctacggccagtacctctacgatggcctcgtgctgttcgcccccttcaccccacgttttggtggatcagtggaccagaacgcagtccttgaatttattgatgctgggcttgatatgatcctggcggcagattcctctggctctgatcttat

SEQ ID NO: 61335 - DNA, 438 bp, Zea mays
  unsure at all n locations
  Clone ID: LIB3069-026-Q1-K1-G12
cccacgcgtccggttcgcaattacagagatctagagagagagatagagggcagatctacgctagagcgacagagccacaaccaaccgagagggacagtccagtatggtggtggcgctcgggcccggccggttctacggcagcggcctgccgaggccgcgcttcttcccgggcgaccgcgtggacccgccggcgtccgtcaccgacccgctgctcgagtgggcgcgcgaagcgcactggtccatgggcggcatcagcgtgaagcgcctncgcctgcagggccgcatcgagggttccgtcgacaagctccgccgncgcgcgcaccgcgacgccagggtcaaggccaaggccaaggcccgcgccgctggccacatgccggcttcgctcgccgcgcttgggtccgacgacgacgccttcagcggcgactccgaggacgagca

SEQ ID NO: 61336 - DNA, 330 bp, Zea mays
  Clone ID: LIB3069-027-Q1-K1-B10
ttttttgttcgagtcagtcagacagtcaggcgcattgcatgggccatggcatagcatgccttgctctatctgctccatcttcttctacgcatgccttgttctagtggtggtactggtgggggaacgaataattgtaccgagatgttggcgccgtgtcgtgtcgtgtcgtgtcctgtcctgtcctttctggggctcatatagcagtcagactgtgttgtgttgtgctgtgtgggccgagtgtgcagtacagcatcaggccatgccccctgttccatctcatctgtgtgcgacttttgtttgtgctgtgtcatctatctatctaatccatct

SEQ ID NO: 61337 - DNA, 446 bp, Zea mays
  unsure at all n locations
  Clone ID: LIB3069-027-Q1-K1-B12
cccacgcgtccgcccacgcgtccgaagcatgccatgtggaggagggctttagcgatggtcgggttcatggctggcgccgcgctgctcgccggggctgccggcgccggcgcgcagcagggcgtgtggagcatcatcacccggcccatgttccagagcatgctgagccaccgcggcgacagcgggtgccagggcgccttctacacctacgacgccttcatcgaggccgccagcaagttccccggcttcggcaccaccggcgacgagcagacgcgcaggcgggagctcgccgtcttcttcggccagacgtnccacgaaaccaccggtggatgggcgactgctccggatggacccgttgcctggggatactgccgggtgaaggaacagaaacagacggacccaccctactatggacgaggacccatacagctaactcataagtacaacta

SEQ ID NO: 61338 - DNA, 397 bp, Zea mays
  Clone ID: LIB3069-028-Q1-K1-A12
cccacgcgtccgtaggaattgaacaaggtcttttcacaaaagctggaggttcagacacagaggcttgaactattgacttctcaaaggatggctaacgagaatgccctggcgaaaccaattgacacacgccccatcaacgaggcaacaatgtatgcggatgaaggagacgaggtaagtgtccttcaccaagtatttagatggaatttggtagttgatcctaccacataatccttgatgttaattttttgtgctgtcatgttgtgttcccagagtatggttccagtgttttagcttgaataagagctagtttggaaactcaaataatttccctatcaatcccctttaatcccagagaggatttgagttttcaaactagccctaagagcttgtttgggag

SEQ ID NO: 61339 - DNA, 395 bp, Zea mays
  Clone ID: LIB3069-028-Q1-K1-A2
gattaaaagatgtttggggatttatacctaattgttgataaacgcgcgcagggcgcgcgctctggactagtatatattacatcgactaggtacacatgcttctctaaacatacagttgaaccaactacttctcgacaacaaatgacagacacatcaggatgtaattaagggattatacatggcattaggaaatctatgacctatcgctatatatgacggcacaaatgttttgactaaattgccacctaaaatgttgaaactagtactttacaggagacagttgtgacgaaagttaccagtgctagctacaccgaagagtacctcttcatggtatcgatggctcaactgctctgaagcattcatggacgcagtctccagtcagaaatatgtgagct

SEQ ID NO: 61340 - DNA, 451 bp, Zea mays
  Clone ID: LIB3069-028-Q1-K1-A3
tttcgcacacctcgacgcctctctctctttcccctagctctcgaaaccctaggtgcgtgccgaccggcggcggcggcgaggtgatggcgatggacccggacgcggtggcgaaagccttcgtggagcactactaccggacgttcgacaccaaccgcgcggcgctggtggggctgtatcaggagacctccatgctcaccttcgagggccagaagttccagggcccatccgccattgccggcaagctcggatctcttcccttccaggcctgcgagcaccagatcgtcaccgtcgactgccagccgtcggggccccagggaggcatgctcgtcttcgtctccggttccatccgcaccggccccgaggagcaccccatcaagttctctcaggcattccatttgctgccggcagctgggtccttcttcgtgcagaatgacatgttccgcctgaacta

SEQ ID NO: 61341 - DNA, 441 bp, Zea mays
  Clone ID: LIB3069-028-Q1-K1-C12
aaagagattcgatgaagctattgcgcagtttagtattgttttgacagaagatgaaagtagtgtgaaagcgctgttcaggcgaggaaaagctaaatctgaacttggccagacagaatcagcgagggaagatttcctcaaagcgaagaagtactccccagaagacaaggagatcattcgggagctccgtttgctcgcggaacaagacaaggcactataccagaagcagaaggagctctacaaaggtctctttgggccaagtcctgaagcgaaaccgaagaaggcaaagtacctcgttgtgttttggcagtgcctggtgtcatttatcctttatctggctgggatgttcaaacggaagaacgagtaggataatttaccagaaaattgtgtagaactggtggcctaattgaccaaccttgtattataaggagtgttgaattttct

SEQ ID NO: 61342 - DNA, 361 bp, Zea mays
  Clone ID: LIB3069-028-Q1-K1-C5
ccagagccaaagcctgagcctaaacttgttctcaagaccagaaccagaaccaaagccggagcctaaacctgaaccaaaaccgaaaccagaaccggagccacaaccaaagccagagcctaagcctgatccaaaaccagagcctaaacccgaaccaaaaccagagccccaaccaaaaccagaacctaagcccgaaccaaaaccacagccagaacctaagcccgagcccaaaccaaagcctgaccctccacacatcccaccagcagctatcaactgaggaagtggctattaacaattattgtagtgtttaaataaaatgccatgttgcagcgtgcttttgtaggtgctgctacttgttgtatct

SEQ ID NO: 61343 - DNA, 234 bp, Zea mays
  Clone ID: LIB3069-028-Q1-K1-G8
aaaaaaaaaaaaataaataaaaaaaataatttaaaaaaaaaaaaaaaaaaaaaaagggagggatttttaaaaaacacagtctgcctacaaaacaataactatttacatactatcctaataaacaccttctacataccttcactttcaacacctacctgtctcaagtttatgcgcctcttcttttaatcttcgtccctccacatttccctgtcgtaaccctgcaacttatacaca

SEQ ID NO: 61344 - DNA, 272 bp, Zea mays
  Clone ID: LIB3069-028-Q1-K1-H2
cccacgcgtccgatgattacgagcaagtgtgagaagcagctggctggcctgaaggcaaggagggcgtttggagtcgtcacactcaggagcaaggcgatgcgtatgtacatatatcttaataagcagctttaggatagcttggtttgctcgaccgacatgttgcaagtttatgcgcctttttctttattctccgcccctccagttttgcccgttgtagtatggaacttataacatgcgtgttttatgccgcatcttacaaaatatttttgtcc

SEQ ID NO: 61345 - DNA, 234 bp, Zea mays
  Clone ID: LIB3069-028-Q1-K1-H9
cccacgcgtccgcggacgcgtggggttccttaagtttcctcccggcaaggaggagaacagggcgtataaatatgagggcgagagaccaagtgtacccctttcctctgcatccactcttacgtagtgtctgttgcatcttgcatggaccgtcattacctcctgtttcttgacagtgtttgtcacctctcaccggccagggctcccactaatagaaataaaacttttgttctaagc

SEQ ID NO: 61346 - DNA, 423 bp, Zea mays
  Clone ID: LIB3069-029-Q1-K1-B9
gcttctggggggcacatcatcttcttccattgcctgagtcttcttggctattgcctattgccattggatgttggtgctctagtttgcatgctgaaggacaatgtcatacttaagattgtcgtggtgacaatcacattggcttggagctcctgggctgcgtatccattcatgagcgctgctgttaacccaaggagaaaagctctggccctatatcctgtcttcctcatgtatatctcagttggtttcctcataattgccattgattaacggggttgagctttgtagtaacatctgaagagttgagagtttccttggatggttgaaccaccagaatacatacaagtttgagtagacaatgcttctatccttgtaccctcgtggagtctttgtgaattgcctcgtaagaatttttgtttttacatg

SEQ ID NO: 61347 - DNA, 343 bp, Zea mays
  Clone ID: LIB3069-029-Q1-K1-C1
gaagaaagttcgcggacatggaagtccagttggtcatgaaacttgttccctacaagattggtaacaaggatggcaagccctacattcaggtcaagatcaaggatggggagaacaaggtcttcagccctgaggagatcagtgccatgattcttggcaagatgaaggatactgctgaggcataccttggcaagaagatcaatgatgctgtcgtcactgtccctgcgtacttcaatgatgcgcagaggcaggcaaccaaggatgctggtgtcattgctggcctcaatgttgctaggatcatcaatgagcgcaactgctgctgctattgcctatgggttggacaaga

SEQ ID NO: 61348 - DNA, 177 bp, Zea mays
  Clone ID: LIB3069-029-Q1-K1-D5
ccttcttcttcttttgtgccctcgttactgtcttgcgtggaaatgatagataggtggaagtggtaccctccgatttgtcttactttactacctgtgtaattagctatcccggtcttgctgacaggcactgggccaaacggtgtacctaatgctgtgctcctgctctcaaagacctgc

SEQ ID NO: 61349 - DNA, 373 bp, Zea mays
  Clone ID: LIB3069-029-Q1-K1-E3
caaggctgaacaaacgcgcatgccaggatgttgctgttttgggcctggggtttctcaaagttgatgctcgtgcacggaaggatactcaaaagattgaccacacagtgaaggagagagcagcacttcttaaccattttgccagagcatttaaggagcgagctcagtcagacttgaagaaagctgcagacaaacattggagtgatggtgccttggaggcagacctgcgacgagctgacttggttgttaaacgacgtgccatggaagacgctttcatggcattgaagtttgttcaggatatccatgacatgatggtgaacaaaatatatgagcagctttcgaaagacgggtcatcttctcgtacaaattcaacagg

SEQ ID NO: 61350 - DNA, 203 bp, Zea mays
  Clone ID: LIB3069-029-Q1-K1-F7
gacaaatataatggcacctatatttgtctgaagtcccaaagctctcaatctattatgccgacaaggctagctgcatatgcgtcattagccacttacacttaaattattcgtgactaagaattcaggaatctttttcttgattaaaaaaaaaacaataaaaagaaaaaaaaaaacaacaaaaaaaaaaaacgactgcaaattag

SEQ ID NO: 61351 - DNA, 133 bp, Zea mays
  Clone ID: LIB3069-029-Q1-K1-H3
acaacacgtacgaccactcttgaggcactttatttccagagacagcaggtctgccactcgaggggatctaaggtgacctacgcgggcttccaacaccatcgatctacaataggggcacctaaatttaattcat

SEQ ID NO: 61352 - DNA, 411 bp, Zea mays
  unsure at all n locations
  Clone ID: LIB3069-030-Q1-K1-D11
aagcaagagccaagttctggtggttgtagattgtttggaattaatatatgctcagctgaggaagaagtattacctgaggttactgctccaggtgttggttatgagcagactgctgcctctgtagagttgaactcggataagctctcacagccatctgatgtcaacaattctgatgccctagcagctagcagtgaacgttcacctcttgaatcccaaagccggcaagtgaggagctgtaccaaggtaattatgcaaggaatggcagtaggaagggctgtagacctgacaaagcttagtggctacagcgatctttgccagaagctggaggagatgtttgacatcccaggggagctgggttccacactaaagaaatggcgggtcattttcactgatgatgangatgacatgatg

SEQ ID NO: 61353 - DNA, 300 bp, Zea mays
  Clone ID: LIB3069-030-Q1-K1-E12
ttttctggcttgtctgtgattcttgtagagttcagcacttgtatggttctatgttgggccattagtttttttttaactctctttctctgactgccccgatttgccgtatagaattacatttctaagcgcaactagccaacctgtagcattttctgtcaccagcatttgaagttttgaactgagccctggtcgtgtccctgaggtttgatgtgctcttggtgtactactcgtatttgctaattagaaaaggaccttttgtgggtttgctagcgtttggcactaacgcccacgctagaactt

SEQ ID NO: 61354 - DNA, 225 bp, Zea mays
  Clone ID: LIB3069-030-Q1-K1-F10
aaatgtagcagcaatcagtcaagctacctcacctcatggtaatataacatcttgaacaaccataatacaaaatgaaatgcagttctgtcacgacaacatcgcattcataagcaataccacccatctagtacctagcaagcatcaccacacgaaccttaaactgacgagtactaacagcgatacaaggaatatcatatctgtaccaagcactgcggagaatgactt

SEQ ID NO: 61355 - DNA, 447 bp, Zea mays
  unsure at all n locations
  Clone ID: LIB3069-031-Q1-K1-A11
tcgcacagcatttccttgagaacgatctatgcgaatgatattgagacacatttgaaaaagggagatatgctcctttgctatggccctttgcattccaggcacccaagaacatncccgtgcaagccctaattaaagggtcacagttcccaagcaaatgccttagctcagcaaactctgattgcacattggcagagcattgtgaaaatattgacaaattacttgaatgttttaaaagcaaattatgtcccttcagtcttaatcagcaaagtgttcactcaaatcttttcatttattaatgttcagttatttaatagtcttcttcttcgacgggagtgctgttcatttagcaacggagaatatgtgaaagctggattggcagaattagagcagtggcgcatttatgcaacagaagagtatgcaagttcttcctgggaagaattaaaacat

SEQ ID NO: 61356 - DNA, 285 bp, Zea mays
  Clone ID: LIB3069-031-Q1-K1-A3
ctcttggatatgtactcatgtacttcctgaggggcagccttccttggcaaggtcttaaagcaggaacaaagaagcaaaagtatgagaaaattagcgagaagaaagttgcaacatcaattgaggctctatgccgtgggtatcctactgagtttgcatcatatttccattattgccgttcactgcgatttgatgacaagcctgactattcctatctcaagcgattattccgtgacctttttatccgcgaaggttttcagtttgattatgtctttgactggacaatat

SEQ ID NO: 61357 - DNA, 206 bp, Zea mays
  Clone ID: LIB3069-031-Q1-K1-A9
cccacgcgtccgcccacgcgtccgcccactcgttctcccacgcgtccgcttgcagttatggaaccttgttatattgtatcctgcaatttgttttttgcaacttataagagtaattttatttgatgagtcttaaaaaaaaaaaaaaaaaaaaaaaaaaaaaaaaaaaaaaaaaaaaaaaaaaaaaaaaaaaaaaaaaaaaataaaaa

SEQ ID NO: 61358 - DNA, 324 bp, Zea mays
  Clone ID: LIB3069-031-Q1-K1-B6
catgatcttgcggcctgaatttcagctgacgcactgcaaaacgtgtggaagtgacttgtcatttgtagtgccaggacgaacaatatgcctggactgaattttcaggcgtggaaatgtagctgtaggtcgaattggtgtacagaatggacgaggtacatatcataaatgttatgtaaatttagtgggggcaggggtgatagtggttaagaaatcctgtaaagatggaatacattttatacgtgtaaaatacgagtatttaagggccacgctgtaaaaatagatttacctgtaaaagataatgaacatatggtcctacttttacca

SEQ ID NO: 61359 - DNA, 201 bp, Zea mays
  Clone ID: LIB3069-031-Q1-K1-B7
aacggacaatggtgcatgctaaggatgctccatcaaccgaaccactgctaggaaggaagcatccgtagcgctaggattacgattagccctgtatctttgatattgctcctgataatcattaccaatgtgaaatggattatattttgaaaataccatcttgatgatgaatgacaaccaaaaatgattgagaacaggcgtgga

SEQ ID NO: 61360 - DNA, 257 bp, Zea mays
  Clone ID: LIB3069-031-Q1-K1-D10
aagctttggcggatgaagtgccacgccatatgatggattggcttcattggtcaagaaaggttggcagaaaccaggaccaccacgcccgaaccgtgctggacaaaatcatgccgccagaagttgtagggagaagcttggtgaagtccatgagataggaatttggtgagatcacatagcagattgccagaaaagtgctctatgaaatattggtagaagcactgggtgggttcgggatattggctccgcggccacaaatg

SEQ ID NO: 61361 - DNA, 294 bp, Zea mays
  Clone ID: LIB3069-031-Q1-K1-D8
tatacacgcacgtgcacgcgcaggggcatggctatagcgtcaccaacattgtactatggggtggaccgagagggtcggtacaggacatcactgcagatcggacaccgcagcgtcttcacagcgtcaccgatcgtgctggcgctgccgtcgactacatcgagttcacctatactgacagcgctgggcagaggcgcgccgctgggcgttgccgtggacttggcggcaatgttcgaacgatcgaccttggcaacgccgatgatgtcagggaagtctcggcaacatacggtgcatttg

SEQ ID NO: 61362 - DNA, 64 bp, Zea mays
  Clone ID: LIB3069-031-Q1-K1-E4
gtcctgtttttcttttagggttcgctgcagatttaaggtacacattacttgatctacagaaaaa

SEQ ID NO: 61363 - DNA, 289 bp, Zea mays
  Clone ID: LIB3069-031-Q1-K1-E7
cacggagaagcgaaaccgacctttccccctcccccgcattccacctcgcggagatccaggccagccctagggtttcgccagcggcgagccaaactccacgagcgggggaagaggggaaagcagggacgacgagggggcagccatggggcaacagtcgctgatctacgcgttcgtggcccgtggcacggtcatactggccgagtacacggagttcaccggcaacttcaacaccatcggcttccagtggctcatgaagcttcccggcagcaacaacaagttcacctacaac

SEQ ID NO: 61364 - DNA, 77 bp, Zea mays
  unsure at all n locations
  Clone ID: LIB3069-031-Q1-K1-G11
gcgggagccacgcgtgggcccacgggtgctagatcgcgagcggtcttcccagnaaccaggcagacgaggacggaagg

SEQ ID NO: 61365 - DNA, 456 bp, Zea mays
  unsure at all n locations
  Clone ID: LIB3069-032-Q1-K1-E6
tctgtctcgtatcatttcatgactccaactccagtcaagttgtttcgtaccatcgactatgtctatgcgaagggatggacgagtatggttcgtacgctggagaattgactctgcaagccgattgatcaagtgcagtctacatgcgtttgggcgactcctgatctagctcgcggacatgcagatcggcaaagtggcttcaggtccccagataatggcgctggcanagtgacaagtcgccgtcaaatgtcgtctggtggcaaaggtcaaagcaggaaggtcttctctgagggcttgcagaaccgtggaaatcgggnggagggtggaacctggaagctggaagtaggatacccactcaagtcagtagaagtttaaaatccaacctgtagggctaatatgtgattgcatgttatcatggtgttgcgacacaaagtccctgatgcctcttgatcatctttc

SEQ ID NO: 61366 - DNA, 243 bp, Zea mays
  Clone ID: LIB3069-032-Q1-K1-E8
ctcggaacgatcactgtatgaaagttttctctacaacggcctgccatatatcaaaggcaggctgcaatgtgtgcatgcagtgccagacgcccagttcgaagaagtttcggataaaggtcaagctgatgatcctgccttcactagatacttggccttgcatccaaaacgattttaaataagtagcataagcatgacctctgtcggactcatgattacccgcacaaaggacaaggccctagagta

SEQ ID NO: 61367 - DNA, 341 bp, Zea mays
  unsure at all n locations
  Clone ID: LIB3069-033-Q1-K1-D2
aacggtccaaggcgagtgacaggcagggcgactcgggcggccttccatccgccggaccggcgccggcggcttccaacctcgccgtcaccggagtggccgcagatggaagcttggcagcaacttcaagcttgcttgaagggcggatagtggatagccgccaggcgctcaccgncgccggctcccgccttcccgagccgcacgccgccagatcccaccctcaggtgccgcccagcgccggatcccgcttcaccgagctcccggtcgccggatcccatcgtcccgagtaggcgccgccggatcctgccgtcccagagcaggcgctgccggatccgtcttccccg

SEQ ID NO: 61368 - DNA, 186 bp, Zea mays
  Clone ID: LIB3069-034-Q1-K1-A1
aaacccccccaaaaaaaatcgggggaaaaaaaaaaaggcgtttgttgttacactgggcaaaaacccggagctttattcttcaccatgtaggggttaacctggcccggttaaaggctttttttttaaatagggaaattactttggccaagcttcccccaagtttggggctttgtcgtcaatgggaaa

SEQ ID NO: 61369 - DNA, 115 bp, Zea mays
  Clone ID: LIB3069-034-Q1-K1-B4
cccacgcgtccgcccacgcgtcctaaaaaaaataaaaaaaaaaaaaaaaaaaaggaaaggtaaaattaaaaaaaaaataaaaataaaaaaaatttttaatttaaaaaaatatata

SEQ ID NO: 61370 - DNA, 439 bp, Zea mays
  Clone ID: LIB3069-034-Q1-K1-C5
tacaggtggtttttgttggagggcgcactcagccaggcactgtaaaacctgaagaaggagaccgtcacccttattcggtgttagattgtgcgtcacagcgtgaagcaattttgcctttcgtactctatatccagaaaacattgcgcaggaggcctttcttaataaagaatcttgaaaatgttatgcgtaaattcctgcaatccttggagttctttgaggaaaatgagaggaagaaactcgccatattcacagcccttgcattttctcagaagctatcagggcttcctcctgagactgtgttccagccattgctcaaggataatcttgttgccaaagggatagtactttcattcattactgagtttttcaaggagtaccttgaggaaaacagcttggatgatttgatggcacttttgaagaaagggcaaatggaggacaa

SEQ ID NO: 61371 - DNA, 289 bp, Zea mays
  Clone ID: LIB3069-034-Q1-K1-C7
gacggcgccggcaagcgccgcccgccgtggcgggcgcgggacaacaacggtctcgcggacgcgctggactgcagcgaccaccaccagcagcagcagcagcaggagcggatcgtcctcgcggcgacgccgtcgtcgtgctcgctggccagatcgtgctccctggaccggcgcgtcgagttcggcgtcaagaacaggagctcgtggctgcccctccgcggctgcgaagccacggcgccggcgccggccgacccgtgggagatagagccgtcgtcggaggactacacgtgcg

SEQ ID NO: 61372 - DNA, 310 bp, Zea mays
  Clone ID: LIB3069-034-Q1-K1-F12
acggctcgtacccaccttacggtggagcatcctatgggtctcctccaggtgctccagctgcagcgcctcacaacggtggaagttatggtgctgcaccatactcgtcgagctatggatactaatccggagcaagagcttgcctcagacttagggaaggagggttatcgttatggttttgtttgctagtctattcatctgttgagaactcaagattgttattgttaggacgtgtgaactttggtgttctaggctgctttcagacgccagtgtcgatatactctctttgctttattgttgcggaatttatcgt

SEQ ID NO: 61373 - DNA, 138 bp, Zea mays
  Clone ID: LIB3069-034-Q1-K1-F8
cccacgcgtccgaaaaaaaaaaaaaaaataaaaaaaaaaaaaaaaaaaaaaaaaaggagggacattctaaaaaactccaaacttacatacgcctcatgctacatcatacctcttctatagagacacctaaattcaatt

SEQ ID NO: 61374 - DNA, 78 bp, Zea mays
  Clone ID: LIB3069-034-Q1-K1-H7
cccacgcgtccgaaaaaaaaaaaaaaaaaaaaaaaaaaaaaaggaaaatataaaaaataaaaaaaatataaaataaaa

SEQ ID NO: 61375 - DNA, 208 bp, Zea mays
  Clone ID: LIB3069-035-Q1-K1-B11
aacgacgtctctttagattgaggtaacctaattgcattcaagtgaccgcttttttacaactacggatctggaaaacccctgacggtacccgacttaatctcttagcaacacattcacctttaagcacctggcgtctgatctaaaagcccatgaccgagcgcactttccagcagttgcacaccctgatgggcgaatggaacgccctctg

SEQ ID NO: 61376 - DNA, 176 bp, Zea mays
  unsure at all n locations
  Clone ID: LIB3069-035-Q1-K1-D6
tcgtctcgtcccacgtccgtccgtcccacgcccgtccggttcgttctcagagagnngcctgcgagggagggggctcatcttgggggagtcaacannaccttgaggggatgannggtttgtggccnnngtgggttctcaagggcngccagcntttggtcgaccccttgnngtgaagc

SEQ ID NO: 61377 - DNA, 126 bp, Zea mays
  Clone ID: LIB3069-035-Q1-K1-G8
ttttttttttttttttttttttttttttttttttttttttacgggtttctgcatctgtaatagctatttttttaagcgcaaaacatgtcttctctttggtgctataaaaagcctatagtttcaccc

SEQ ID NO: 61378 - DNA, 335 bp, Zea mays
  unsure at all n locations
  Clone ID: LIB3069-036-Q1-K1-D11
tatgtttgtgtctgcatcctgtcagcaattaggatgtgacaggacatggcctccctccaatgcaaaaatcccaaaagctccttgcaggcacacttatttgcattctttgcgctgacatgcagttaggatgcgatagggcctccctccaatgcaaaatcacattaaccatgtcaccgctgtcaattgtttttttgagtttgttcccaaaacctcttaattattattgcccacggatagtcatgttatctacataatccgtttttgccactcttcagggttctgcattgtgaatagaggttcatctttgtgattagattgccaccgncgctgctttt

SEQ ID NO: 61379 - DNA, 292 bp, Zea mays
  Clone ID: LIB3069-036-Q1-K1-D2
aaaaaaaataaaaaaaataaaaaaaaggaatatgattaaaaaaaaaaaaaaaaaaaatgagcgaaagctttagtaagatacaaacatacaaacgcgtgcatgcaaagacatagaaagtatgatagagttacctaaatgtagttttctaaggccagcttaagaacgtcactaactgggagaatcccggcgttgcgcaacgtaatggccttgctggacatcagcctttacacagatggcgtgatatctaagatgcccagtacgatcgctcttgtcaccgatggcgaaacctata

SEQ ID NO: 61380 - DNA, 438 bp, Zea mays
  unsure at all n locations
  Clone ID: LIB3069-036-Q1-K1-E8
cccacgcgtccgcccacgcgtccgtacatttgcttaaaatgtgaatttatgctcatggatggacaaagtgcaaatcaagagtaaaggtatgtttctaagccttagtacattggttttatgtactaatatacttgtctaagtgttagaaacagaaagaagaagaaaagaaaagagatgaaaaaaggcttggctgggtacagccaagactcagctcggtctggcacaccggactgtccggtggtgcaccggacagtgtccggtgcgccaggctgactcggcgcgaagtggccgctctcgggaattcgtcgacagcgtacgactaanattcaccggactgtccggtgtacaccggactgtccggtgagccaacggtcgtgaaaagaaatgtgcccttgggccatttctaagtattttgtgattgagtgccaacacaagtgc

SEQ ID NO: 61381 - DNA, 60 bp, Zea mays
  Clone ID: LIB3069-036-Q1-K1-F10
cccacgcgtcctcccacgcgtccttcctctcgtccgcccacgcgtccggttctagatcgc

SEQ ID NO: 61382 - DNA, 350 bp, Zea mays
  Clone ID: LIB3069-036-Q1-K1-F3
cccacgcgtgcgcagacgcgtgggagagtaaattatacctctgatcataaaattgagcgtcggcttcaatagatggatgcagaacaattatgacgaacggattcatgtgatgggcaatctaatcggtgaggcacggaatcaacatcaggatcactagcacaaaacattcactccagaacaaatgggggtgagcatggttctcagcaactgcaaaccctgtatcgcgtcgactctctagatggctaccagatgcatgacagtgaacattctcttgaaaaactgcctaagtatcgacaacgatacagcatgccgctgcaatcttatgtgatatgagaagaaacattgaatcg

SEQ ID NO: 61383 - DNA, 71 bp, Zea mays
  Clone ID: LIB3069-036-Q1-K1-F9
gccacgcatactggaattgacacttgatttgacaaaaaaaaaaaaaaaaaaaaaaaaaaggaaaaataaaa

SEQ ID NO: 61384 - DNA, 299 bp, Zea mays
  Clone ID: LIB3069-036-Q1-K1-G11
atcggcgagcatgaggggcggcggcggcggcgggatgatggacgatgaagagagggtgggccatgcggagatcccgaccagtttcggtcccgagctgcgcgcctgcctccgatgccgcctcgtcaagacctacgaccagttcagggagaacggctgcgaaaactgcccgtttctagagatggacagagagcacgacaacgtcgtcaactgcaccacccccaacttcactggaattatctctctgatggaccccagtaggagctgggcagcccgttggttgagaattggcaggttcattc

SEQ ID NO: 61385 - DNA, 335 bp, Zea mays
  Clone ID: LIB3069-036-Q1-K1-H10
tatcactgctgcctaacactaaacaagatttctctcaggcccccgaccccgatggtttgctcgcacacccatcacatggccgcctcctccccttccacctcctcccctaatggcagatgctaggcggcggcgcccctcttgagaagtgaaagggaaagatttgttttgccgcccgcgccctgctcaggcgctcggcctcggtcgggccacacaaggtagcgccttccgcctcgttgcctgacccattcctgtttcgttcgaagcactgaagcagccccagaccgacgccaggcgcccaggccagtggtcgacgcctgtggtgagctgataggcga

SEQ ID NO: 61386 - DNA, 336 bp, Zea mays
  Clone ID: LIB3069-037-Q1-K1-C7
ccttgtgctgtcaaatccgacaagcttttttctcttcctgtttatatgtaaattgtgaagtccgtacttattaggatctgggcctgaagataccggtacaactgcaacagctgtgatggcttggagctgagtcatgggtaaaacggccacagcgatgtttatagaatggcactgccctgatagtaatttatcgtgttcaatgtatgtctccatagtcttgcacccaactgccaactcattagttctttattcttggagaacagtttttgtcagagtgttatactgtcatgatatgatccattctttgtagacacagagattacaacacaaaataag

SEQ ID NO: 61387 - DNA, 242 bp, Zea mays
  Clone ID: LIB3069-037-Q1-K1-D5
gaaacccccatggaaaccttaactccaaagctccattacaaaaacggcttggaaattggaattctactaccgtttttaggctgtttaaaaatacccgaagattcccaaaaaaaaaacccaaaaaaaccccaattggatctttactccctttactgaactgggtctccttttccttgcctactacagtactactagtgggatccgtccatttgacaagacaacacccgggcccaaacggaaac

SEQ ID NO: 61388 - DNA, 269 bp, Zea mays
  Clone ID: LIB3069-037-Q1-K1-H3
tactgatctacatgcaatgagccatggtttgtatcgctactgggctatgacacaagatcaacggcttctcattggtgcagcttatgcgctggttgtcgtcatccagcaaccagtccttacatagatgctcaaaattcgctcttggcacatgcttctgtagcagctcgagaccttacgagagatcaagctgtttataatggttaggccgtgatcatcctgcacatcatgtgctactagtctctaacatacttaccaggtgaccaatcagc

SEQ ID NO: 61389 - DNA, 177 bp, Zea mays
  Clone ID: LIB3069-038-Q1-K1-C2
tagaagggctgatggtgcaccctccatggctgcacttgtatgcagctcttgtggtacatagtgttgttaacagtgacctggatgcttaaccggttgtcaagtgaagaaggctcaaactaccggaagaatgattgagatggttgaacacagaatcttaccctctcagttggatagact

SEQ ID NO: 61390 - DNA, 384 bp, Zea mays
  Clone ID: LIB3069-038-Q1-K1-E5
ccagtaattctatctgtctctgtttattattatcatctacttacaagcaattaggataattatcccaatcaaaaacacgtgacttctctatagccctatacagctgcttccacctccagcagttctgacttcagaacaagcccagccatgctagaacttcagccacagctggacgatggcgtgccaaccaatagttagcccatgatgtcagctacacatttctgatcagtgagaattcgtcatcgtgtaccttgctatgtgtttcttaatttctgtctatgtacactggaatcacacccagggatctgttaggatgatgattagtgtgactttgatgctgacaagggggctggaggccctggttgacacaggcagtcaggaaaa

SEQ ID NO: 61391 - DNA, 381 bp, Zea mays
  Clone ID: LIB3069-038-Q1-K1-F4
cctgatcagtgatgcaatggttactggatctgtgcagatcaactctgcaccggctcgtgggcctgatcatttccccttccagggactgaaagacagtggcattgggtcccaggggataacaaacagcattaacatgatgaccaaggtgaagagcactgtcataaacctgccgtcaccatcctacaccatgggctgagatattcttgttaagtgttctatagctccatgagcatgtagagagttaaatgtttcatagccacgtgagatttggacgctatttacacctcagttcttcctgcagaagatcttttgcagtttaaagaataaagtgcgttgaaagtaaaaaaaataaatattttaaaaatgtttttgaaataataa

SEQ ID NO: 61392 - DNA, 92 bp, Zea mays
  Clone ID: LIB3069-038-Q1-K1-F6
aaataaaaaaaaaaaattaatttaaaaaaataataaaaaaaaaaaaacaaaagaaaaaaaaggaaaaaattttaaaaaaacacaagaataca

SEQ ID NO: 61393 - DNA, 305 bp, Zea mays
  Clone ID: LIB3069-039-Q1-K1-A7
attccaacaccgagaggctgagggcggcgatggcgaacaggagcagcggatattacttgggtttcgatcccatgtgcgtagactgggacgactatttctacagggttcacatccccggtgttgtcaagtacctgtgtggttactaggttaatacatatttaagatccggagagagccaaatgtatcttcgcatgttttaatacacaaatatgtcgctgtagtttgcagattattaatttccctagcattcttgttcagtggtacaggtttttaagaatggtacttgttttcctttaaaaaataac

SEQ ID NO: 61394 - DNA, 127 bp, Zea mays
  Clone ID: LIB3069-039-Q1-K1-B6
aaaaaaaaaaaaaaaaataaaaaaaaaaaataaaaaaaaaaataaaaaaaaaaaaaaagggggaataaaaaaaaaaaaaaaaaaaaaaaaaaaaaaaaaaaaaaaaaaaaaaaaaaaaaaataaaaa

SEQ ID NO: 61395 - DNA, 102 bp, Zea mays
  Clone ID: LIB3069-039-Q1-K1-F2
aaaaaaaaaaaaaaaaaaaaaaaaaaaaattaaaaaaaaaaaaaaaaaaaaaaaaaaaaaagaagaaaaaaaaaaaaaaaaaaaaaaaaaaaaaaaaaaaaa

SEQ ID NO: 61396 - DNA, 59 bp, Zea mays
  Clone ID: LIB3069-040-Q1-K1-A11
cccacgcgtccgcccacgcgtccgcccacgcgtccgggcgtggtatcgctttcgcgtct

SEQ ID NO: 61397 - DNA, 452 bp, Zea mays
  unsure at all n locations
  Clone ID: LIB3069-040-Q1-K1-A7
ggcggctgcggcggagcacggaggcgaaggaggaggagcagcagcagcaggcggcgccgaggagcggcatcccactcagtgcttgcaaccatggctaggggattgaagaagcacttgaagaggctcaatgcgcccaagcattggatgctcgacaagcttggcggagcttttgctcccaagccatcttctggacctcacaagtccagggagtgccttcctctgatcctcatcatcaggaacaggctcaagtatgctctgaactaccgtgaggtcatttctatcctgatgcaacgccatgtacttgttgatggcaaggtcaggactgacaagacctaccctgctgggttcatggatgtcatttccatccctaagacaatggagaactacaggctgctttatgacaccaaggggccgttncgtcttcacccaatcagggatgaagatgccaagtt

SEQ ID NO: 61398 - DNA, 222 bp, Zea mays
  Clone ID: LIB3069-040-Q1-K1-D4
ggccggatgacacgccgtgggatggaggcacgttcaagctgactctgcagtttacagaagattaccccaacagacctgcaactgttcggtttgtttcgaggatgtttcatccaaacatctatgcggatggaagcatctgtttggacatcctacaaaaccagtggagccctatatatgatgttgcggcaatattgaccctctattcagtccctgctgtgtgac

SEQ ID NO: 61399 - DNA, 427 bp, Zea mays
  unsure at all n locations
  Clone ID: LIB3069-040-Q1-K1-E5
aggcagtgagaacgacaggctagcgttcttgcagaggaggtggtgactggtcagtgccgagcagcaagctccattggaaatgccaacaagatgacgtacgagaggctttcagggagtaattgagaataagaacgttttcatgtgttcctgcgagtgttctcgtcgtttttctttctctttttcttgtttttgcaatgtgatcaatcatgcgactagtgtttcttttctttttatcagtggccaacaagtgtatgacggaaatttgattcatactgcacttggcatgtaaatccttgctcttattaatgctgntcttggattgtgtcaaaaaaaaaacaaaaaaaaaaaaaaaaaaaaaactaaaaaaaaaacaaaattaaataaataacaatctcaaaacaaattttaaaaaaaaaaaaagggcggc

SEQ ID NO: 61400 - DNA, 208 bp, Zea mays
  Clone ID: LIB3069-040-Q1-K1-G1
cagaaccagttaatccgttcacataatcacatgaaaactagtgtcatcaagaaatgaagagaacacatattagcatactgatgatgcgaaactctccagtttccacgccttgatgaaattgtacatctctcaagaccagatatagatatggttcctgtcggaggtagcaagagctcctagtccgcaccatgcacttgccaagacgggt

SEQ ID NO: 61401 - DNA, 346 bp, Zea mays
  Clone ID: LIB3069-040-Q1-K1-H12
gtttcagaggggcttaaattgccacttagtggatcatttcaacgcttattcatgatctctgtacttgggtgaagaaatattgattatcagagatgctgctggagcacctgacgtcttaaccagacttgaggggccgcaaccgaatccaggtgacggcacagcagatgcagtgatatcggaatatgaaagctaatgcctcagtgctgactgtagctccgcacctagctcctgtttatggctcctttctcctctttggtcattttctcagtctcgcgcgtatataaagctttctagttctagtgttgtcaaaaaaaaaaaaacttacagaagcaaagcgtagcataat

SEQ ID NO: 61402 - DNA, 406 bp, Zea mays
  unsure at all n locations
  Clone ID: LIB3069-041-Q1-K1-A10
agaatatagtactagatcctcaccactgggttcatcaaagagtgcaagcaataggatgactgatccatcactgggtaaagtagattcattccacaaggaaaaggacatgatcaagatcgaagaaaggcttccttctggagctcgggttataatccaatctgcacctttgtgtgaagatagtgatggcagcaatgaatcactgtaaagggctgtgttacatatgttnttcttctttttatttcattttactgagaatgacatttgttggaatttggtgcttgagtgtggcatagctcttggagtaggttcaaaggtattgattttgtaaactgtgaatgtgatagtcaacattttctcacaccttgaagaagagaatactgtatcttgctttaaaaaacatacaaaa

SEQ ID NO: 61403 - DNA, 260 bp, Zea mays
  Clone ID: LIB3069-041-Q1-K1-B8
taccgagatgacccagcatcacttgtacattttcaactatctcacaaaaaactgtcaacccgaatcatttcatctgctgcttgggctctaacaatcatgaactgatcagcaattactcactaaaataactcaatcacttctaacatacctatgacacagacattgtcttcatcaattaccgctgaaatcacgtatgaatgtaccatgtatttacatacaaagttagtagttttatttttcaataatttagataatttttt

SEQ ID NO: 61404 - DNA, 202 bp, Zea mays
  Clone ID: LIB3069-041-Q1-K1-C5
cccacgcgtccgcccacgcgtccgcgacgaggagcttttagtccagacaacaccctactatatggactgaggataaatgctgattctaaaatatgtaggtgcatttcagcgtagtgtactatacgaacgaattaggaactagctgaaggctttacgtgtactcttatagtcttatttctagtagggcaggagttggtgactt

SEQ ID NO: 61405 - DNA, 327 bp, Zea mays
  Clone ID: LIB3069-041-Q1-K1-D1
tggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaagtcccgcggcttcggcttcgtcaccttctccacggacgaagcgatgcggaacgccatccagggcatgaacggcaaggagctggacggccgcaacatcaccgtcaacga

SEQ ID NO: 61406 - DNA, 322 bp, Zea mays
  Clone ID: LIB3069-041-Q1-K1-D5
cccacgcgtccgatagccacctgtggtcagcagctgctgccgtgttgttagaataaagttggtggcgatcgatcgatctgtggtgatgagtgtccctatctgtgtgtttgtgtttagttccagtcgtctgtgaggaagtcagttatgtttgagtgagaggggtacttcgctcttcggtgaacactgtacttgtcatgaggagagttttcatacccggagtgtacgaactctgtactgtactcggatccttcctttttcatcgaagtgggttttattttatcaaccgtatctatactcgtggttttgctattaaaaaaaataa

SEQ ID NO: 61407 - DNA, 380 bp, Zea mays
  Clone ID: LIB3069-041-Q1-K1-F9
tattctcatgtcctgagccccgttccgcaatgtaaaccctagtgcccatcagggaccttggggcctacgatgcgctcatgacgggtgcgcgctcataccatgagctgcagccgacaataccaaccgaccatggctacccgcatccagtttgagaacaactgtgaaattggcgtgttctccaagctgacaaatgcttactgtctggtatcgaatggatggtcagagaacttctacagtgcctttgacgctgatctcgcatatgccaatcctgtggtcaagacctccattggtggcactagaataaactgccgactttgtgttggaaacaagaatggacttctattgccacatactacaaccgaccaagagcttcaacatct

SEQ ID NO: 61408 - DNA, 200 bp, Zea mays
  Clone ID: LIB3069-041-Q1-K1-G4
agcgaacagagcactgaagcagagcgagcgagctgtcttgccaaactctcacggccgacggcacaatggcgagctatatagcgctgttactgcccctgctactgctggccttgccggtggccacgcgcctggcgtacgccatctgctcattcgagaagatcccggcgatgcgtgcgtacacttcatacagaggacctgcc

SEQ ID NO: 61409 - DNA, 373 bp, Zea mays
  Clone ID: LIB3069-042-Q1-K1-A6
taaaatattgccagtcccgcagtctagatggccctacgccgccagctcgccctcgccgtgctcgccctggcggcaaccacagccgcggccaactccggcttcgcggactccaacccgatccgtcccgtcaccgaccgcgcggcctccgcgctcgagtccaccatcttcgccgctgtcggccgcacccgcgacgcgcttcgcttcgcacgcttcgccatcaggtatggcaagagttacaagagcgcggcggaggtccagaagcggttcaggatcttctccgagagcctccagctcgtccgctctaccaaccggaaaggcctctactaccgcctcggcatcaaccgcttcgcggacatgagctgggaggagttcc

SEQ ID NO: 61410 - DNA, 372 bp, Zea mays
  Clone ID: LIB3069-042-Q1-K1-C3
ctctcccctcctctcctcccgtctcctaccccgaaccaaccaaacctcaccgaatcgcaacgacagcgagaacgtccaaacgagcgcgattctccggcgataaccaagagcgcgggcacgcaaagcggcgaagcgggaaggaagcagtaacgatggggcttgactattacaagatcctaggcgtcgacaagggcgccaccgatgacgacctcaagaaggcctaccgcaagctcgccatgaaatggcaccccgacaagaaccccaacaacaagaaggaggccgagaacaagttcaagcagatctcggaggcgtacgaggtgctgagcgacccgcagaagcgcgcggtgtacgaccagtacggcgaggagggtc

SEQ ID NO: 61411 - DNA, 370 bp, Zea mays
  Clone ID: LIB3069-042-Q1-K1-G3
tagagacagacgaggacgagcacaagcgcttgcattaggatcaagtgagaagacacgataggaaaaaccgtgatgggtttcatgaaatgttggaagaacatgttgctgatggcacacttaatgcacgaactcggtggcgtgagtactgttcacagataaaagatttacagtgctacttggatgtagcatcaaacacatatggctctacaccgtacgagttatttgatgacgtgatcaacgtacttggccgacagtctcaagaagaccagatccacatttaagaaacggtgtaatctggagagattactatgacaactttatgggccttagacgaattccaaactgctactctggacgatgatgctcttaa

SEQ ID NO: 61412 - DNA, 368 bp, Zea mays
  Clone ID: LIB3069-043-Q1-K1-A5
cctctacatttcttctctctctgctcctccgcctccgcctgatccatccaagacagggatcgccatgtcggactcggaggagcaccacttcgaatcgaaggccgacgctggggcgtccaagacctacccgcagcaggctggcaccgtccgtaagaacggcttcatcgtcatcaagaaccgtccctgcaaggttgtggaggtttctacctccaagactggtaagcatggccacgccaaatgccactttgtgcgcatagacatattcaatgggaaaaagcttgaagatattgttccttcatcacacaactgtgacattccgcatgtgaaccgtactgagtatcagctgattgatatttctgaggatggat

SEQ ID NO: 61413 - DNA, 432 bp, Zea mays
  unsure at all n locations
  Clone ID: LIB3069-043-Q1-K1-B5
ttgcagtagtaaccatgaatttactaaggtgtgataacaacagtatgtaaatactctggcgcgacattagttcgacaggaaatgttccaattctttcttcggttgaaatcaagaacaagtcaggtacagtgaaaagttcacaacggaagtggagggcaaattcactgcaccatgggatcagggttcccggcagcaagaatatcaagcaacgagttctggggctccagctcgtcgtgccacaggggtagcttgtcgccagggtagaagttcctattcacgccatccgcatttattgtaactgtacggacaactcctccgctagcaccatcacgggccatagcaagggaaactaccttcaccacaaatttctctgcctcttnctggctcattccctctttccattcatgatcaagaagtgcataaagataactg

SEQ ID NO: 61414 - DNA, 85 bp, Zea mays
  Clone ID: LIB3069-043-Q1-K1-B6
aaaaaaaaaaaaaaaataaaaaattaaaattaaaaaaaaaaaaaaaaaaaaaaaaaaaaaaaaaaaaaaaaaaaaaaaaaaaaaa

SEQ ID NO: 61415 - DNA, 358 bp, Zea mays
  Clone ID: LIB3069-043-Q1-K1-H9
tatcccactagtagcatactgcgtccttcctgctatctgtttactcaccaacaaatttattattcctgcgattagcaattatgctggggcgttcttcatcctgctttttgcttccatcttcgccactggtattttggagcttcgatggagtggtgttggcattgaggattggtggagaaatgagcagttttgggtcattggtggcacctctgcacatctctttgctgtgttccaaggtctcttaaaagtgctagcagggatcgacacaaacttcacggtcacatcaaaggcaaccgatgatgatggtgattttgctgagctgtatgtgttcaagtggacaactcttctgatccccccc

SEQ ID NO: 61416 - DNA, 69 bp, Zea mays
  Clone ID: LIB3069-044-Q1-K1-F1
aaaaaaaaaaaaaaaattaaaaagacggtcttatataatagaaaccaagctaacgaacacgggcaggct

SEQ ID NO: 61417 - DNA, 301 bp, Zea mays
  Clone ID: LIB3069-044-Q1-K1-G8
aggcaacttagtgttactcagatgtttcttggacttgtgcttctactttcgtggatcgggataatcaacaactgtgaacaatagattgtactgtgtgtgtgtccatcttgttgcttagatgcaccagctactacctgcttgtcatccttgtgtggaagaagagctctataagttgtcactgagtattcctggaatgcagaacttatgggctgtgacgagatcatgtacatattatttggaaatgacttttttgatgcaaaacaaaattgtctaaaggtacatacgctgggcttgtcaaaac

SEQ ID NO: 61418 - DNA, 223 bp, Zea mays
  Clone ID: LIB3069-044-Q1-K1-H10
caaactaaactcaaccatgggttcaattcaactaaagccgttgagatttttaaaaatcgttcgtcacaatgaacatttttaacccatttaaaccatcatgggggcacatgattttaacaaaacaccgttaaaagttagttttgcaaaaccaggaaggcgaacttgggggaacatacacgccctgggtgtacccaaggattaggagtggaccccatgaaaagtt

SEQ ID NO: 61419 - DNA, 288 bp, Zea mays
  Clone ID: LIB3069-045-Q1-K1-D6
cccacgcgtccgcggacgcgtgggtttgattggatgaaacccaagacatcggcaaaagcatgcatgcacactagggtaggtctttgccaaccttggaagcatagtttcttgaatagtttctcttttttttcttctttcttcctagtattttcttcccttctcttcgcatcatatgatgattccttagtgtctagctgctgtttttgtgtaaacctctgtaagtttcctgttccatcacatatgagtaaggcctttttgtgtctttttatctaagtaaaaaaatatgat

SEQ ID NO: 61420 - DNA, 58 bp, Zea mays
  Clone ID: LIB3069-045-Q1-K1-G10
tcgcccacgcgtccgcggacgcgtggtaaatttcttagggaagttgtagtttttccgc

SEQ ID NO: 61421 - DNA, 443 bp, Zea mays
  Clone ID: LIB3069-045-Q1-K1-H4
cccacgcgtccgcccacgcgtccgcccactcgtccttccacgcgtccgcccacgcgtccgtacatttcttctctctctgctcctccgcctccgcctgatccatccaagacagggatcgccatgtcggactcggaggagcaccacttcgaatcgaaggccgacgctggggcgtccaagacctacccgcagcaggctggcaccgtccgtaagaacggcttcatcgtcatcaagaaccgtccctgcaaggttgtggaggtttctacctccaagactggtaagcatggccacgccaaatgccactttgtcgccatagacatattcaatgggaaaaagcttgaagatattgttccttcatcacacaactgtgacattccgcatgtgaaccgtactgagtatcagctgattgatatttctgaagatggatttgtgagccttcttacttc

SEQ ID NO: 61422 - DNA, 330 bp, Zea mays
  Clone ID: LIB3069-045-Q1-K1-H6
gaatacaatttgatgttgtgagctctcatttgtaccagcttctgcttgattcctatctcaccctttattgatgggattaggaggaattcctgccaccaaggacaacgggatttgccattttggcgctgtctggacttaacactgaagctgctgatctttctcttgtactggtaatagataggtttatacctggaattaatcgaataccatatttttttttgaaacacatactaatttatttgctttctataccattgaaattttgtcatgtattgttggtggaagtactattgtgctttgaaggaattgaaagactttgataaagaaaac

SEQ ID NO: 61423 - DNA, 155 bp, Zea mays
  Clone ID: LIB3069-045-Q1-K1-H8
aaaaaaaaaaaaaaaactaaaaaataaatataataaaaaaaaaaaaaaaaaaaacaaaaagggaaaaaaagggcggacaatatggagagatccatgctaacatacccatccatgcaacgggatcgccgttctatagggccccctaaattcaatcg

SEQ ID NO: 61424 - DNA, 325 bp, Zea mays
  unsure at all n locations
  Clone ID: LIB3069-046-Q1-K1-D5
ggcgttggagacgccacaggtcctgatctgagcgcgcaattggttgcttcgaacgaagtcccagtccatggttgatcagctgagcattttgcatattcattcccttcttgcagttctgtgaatagcgagggtgtgtgcttcattggaagttgaatcgctcgaagtgtcatggtttatcgtttccggagtagacatccattttgtttttcagcttgtcatcgggcatgccatgtatatttgcttggtattgtgttcttgtttaaaatttccagtcttgtgtatattggatttgtttgtcgctggagatcttangattgttgcaata

SEQ ID NO: 61425 - DNA, 341 bp, Zea mays
  Clone ID: LIB3069-047-Q1-K1-A5
tacgggtgtgagaagactacttattcggttttcaaaacagacaccaatagagcaaaaggggttatctgacacaagcgtcatgtccacctatgcattttataaatcatcattctctgatccatctactctcaaacatatcactgagttctcacccaggacctactactcctggatatgacacactaacactccactaaccgtctatagtgcacctcagagcattggatatcgccctgaccgtgccaagtacttcgatgaatactctgagcataatgaatcatacctgaccggtgaattacatggtgactacggatggaacactcatgaactatcacctgacc

SEQ ID NO: 61426 - DNA, 414 bp, Zea mays
  Clone ID: LIB3069-047-Q1-K1-B6
tccggtgttccaagctttcttacgccttttacaaggccttcgctattaccagcgctgggtcggtaaatgccggcgctgccaagaccaccgtccccaatccggccaaggcctacgacggcaagtcatagaaggcagcggctgacacgccaaagaaggccgctgctgctgggaccaagcgcaaagtgcccgagaagaacgtcgtggcgaagccgaagaagttctccgtcgccaaggccaatgccaagcccaagaccctgaaatgccctgcctacaagaaggcacggaaggcctccgcatgagatgggttgctttaggtctaagctctgattgatgctggtgtcagctaggtactgtacaaactatgtgtgtgcccaaagtgtctcatgcggtgtgctatgtgcttaagaagttcta

SEQ ID NO: 61427 - DNA, 145 bp, Zea mays
  Clone ID: LIB3069-047-Q1-K1-C5
tactttccactgattggcgataggtccgttttccttttgtaaaagtggccgtgtgactgtattgtgcattcacagaagatgtatcggacattcttaagtttttgattttgtttctctgtaacaatgtatcaaggcacgatggtct

SEQ ID NO: 61428 - DNA, 173 bp, Zea mays
  Clone ID: LIB3069-047-Q1-K1-C6
aaacagcgttcatgatatcccatgcacgttgtcctcatggaatttgtactggcgaatgaatagcacagcctgcagctattcaccccatttgcctgccctcatgattttagagcaggcgaatgctctaaaatggtgatgatggtgttctctctatatcggtcacactagaacat

SEQ ID NO: 61429 - DNA, 410 bp, Zea mays
  Clone ID: LIB3069-047-Q1-K1-D3
cccacgcgtccggccctgcccatctctttcgtgctcctaccccccgccttcttccgcccgccgcctcagccctcaaggcttttccttctcatcttcttctcaggccggggacgggcccgacggggacagggacaaaaggtggtgcgatcttgttgggcacactccgcctccgcgcgcgggaagagagagagagagagagagagagagagagagaaggacggagggtggcagggccgccgcgccggtgagccgacccccagccatggcattgccggctccccccgtccgcctggcgctgctgctgctcgtcgcgctgccattctgcgccgcgcatcccgggccgggggccttcaacgctcctcgccactttcagacgcccgcgctccactctgatggatttggcttggtgg

SEQ ID NO: 61430 - DNA, 456 bp, Zea mays
  Clone ID: LIB3069-047-Q1-K1-E12
ttcgactccacgcttgagccaagcgttcgtacggcttctagaagaccactgaaggggtttcggggatgctgctgatggtgtgccttgtggaggtttcttctgctccaaagagacaagaacaaatactggaagaagaactacattctcccgataacaagccacttattgtgagagacgggaacagatggctaatgcaggacatagattgtagcgggttgtgcaagacgaggtgcactgcacattccatacccaacttgtgcactaaggcgtgtggcacatgctgagtgaggtgtaagtgtctcccacctggtacatctggaaatacgcaactatgtggagcttgctacactgatatgactacccatggcaacacgaccaagtgcccttagagaaactacccattgcgaaatgtgtgcttcattgattatgcaccgaacttcaagtgtactagtatgt

SEQ ID NO: 61431 - DNA, 422 bp, Zea mays
  Clone ID: LIB3069-047-Q1-K1-G5
tacggctgctacacgacgacactatggcatttaacgcctacacaaacaccatctatcatgccactcatgatgtgggcttctgtcactgccaatgcactcaaactctcttctgtctccaaacctcatctcttgcctcctttatctttctccagatgcttatcttccgtcttggatggacttaagtacgctcattcacatgaatggctcaagcaccaatgctcagtcgcccccattgttatcactgaccatgcccagtaccatcttgtagaggttgcctatgtggagctgtcagaaccacatgacacagtttccaacaagtctggcttctgatcccgttaaactgttaaagcaacaagcgatataaacccttcaatctcgcatgagatcgcctatgtcaacaaaaagcttacaaaaactccttc

SEQ ID NO: 61432 - DNA, 426 bp, Zea mays
  Clone ID: LIB3069-048-Q1-K1-A10
tacatgcagcgccacatcgctactcttaatgtttcaatagacttgggatcaaatgtgcaagggtacttcgcttggtctctgctggacaactttgaatgggtcgccggcttcaccgaacgttatggcattgtctacgtcgaccgcaacaataactgcacgcgctacatgaaggagtctgccaagtggttgaaacagttcaacgccgcgaagaagcccagcaagaagattcttacgccagcttagaaatcgggggcctcatgatgtgggtgcagcccataaaaaactggtgtgtggtttggaaccgaaaattttctggctttttccgccacgagaggttctggaggcatactctccagcaccgtggctaataacgcattgttccaattcagtctggccttgtcatgcatgcaatatataaagtgatgg

SEQ ID NO: 61433 - DNA, 161 bp, Zea mays
  Clone ID: LIB3069-048-Q1-K1-A7
tatttttcgggatagctgtggctggacgattctatttcggaacacgaatgtcctagggaaaggggtcttatgcagatggattagggcctgtgttgcttgggggcttcacacttgctttaataactgggtgcatcctccttctggatgggcagagtcaattc

SEQ ID NO: 61434 - DNA, 323 bp, Zea mays
  Clone ID: LIB3069-048-Q1-K1-D2
tttttcttttattttttttttgtgcttcgattggtcatgttgatctcgagagcaagatgccatggccaaccatgaggtactcgtttcacggagatggtatatgatataggtgatcggagtgatattttacatggtgcatatagtaacttgtcgaactgagaatgttttacctgtgatgtacatcggacttggaagctttgtatcattgatacaccttttcaatggtggcgaataaatttacagcagatgttttcaataacctttttaaaaaaaaaaaactgccttaaggactaaagttaccatagaacaaatttaattaaaac

SEQ ID NO: 61435 - DNA, 90 bp, Zea mays
  Clone ID: LIB3069-048-Q1-K1-E3
aaaaaaaaaaaaaaaaaaattaaaaaaaaagttttatttaacaaaaaaaaaaaaaaaaaaaaaaagaaaagaattaaaagaaaaaaagag

SEQ ID NO: 61436 - DNA, 435 bp, Zea mays
  Clone ID: LIB3069-048-Q1-K1-E7
atcgcctacgagaacgccgcctacatctagatcttcgtcaacaacgtctggaagttccagttgggggggttctacaactgctggaacacgttcgtgggcgaccacacgacgcatgcgttcgtgttcaccgacaatgcacatgacgcgagcgtggtggtggtgtcgttccggcgcacggagcccttcaacatgcgggactggtccacggacgtaaacctgtcgtggctgggcatgggcgagctgggccacgttcacgtcggcttcctcaaggcgctgggcctgcaagaggaggacggcaaggacgccacgcgggcgttccccaaagccgaccccaacggcgtcccgggcaaaccgctggcctactacgcgcttggcgaggaagtccaaaagcaactgcagaagcacccgaacgccaacgttctggtcaccggccac

SEQ ID NO: 61437 - DNA, 227 bp, Zea mays
  Clone ID: LIB3069-048-Q1-K1-F1
ggtttgttttttaagtttttttgggtttttcttttttttttttttttttttttttttttaaacttaaaccaaaaaaacccttaatttactttttttaaatcgtaaactttttttttaaaagatccaaatttaaatactcttgcattctaattcaaaactcttttataatgccacctaaatttaaattaatggccctcattttaaaaaattatgaattttaaaaacct

SEQ ID NO: 61438 - DNA, 260 bp, Zea mays
  unsure at all n locations
  Clone ID: LIB3069-048-Q1-K1-F10
tattgttcaagaaaagttgcttcaaaaaatgtttgctgataacattggatcgcagtttaacgtagcctgtataggttaaacgtttgcctgtangtgatggcatatggatcgctcgtcataaaaaaaatcttacagaatatgttctagattttattggtgaaaggaaaaatgttgcagatttaggtagttcaattagagacaatcgattcaaagatcagaaaacaaggctgcaggtactgtttggactttcattgactaca

SEQ ID NO: 61439 - DNA, 428 bp, Zea mays
  Clone ID: LIB3069-049-Q1-K1-D11
tcggagcgaacagagcactgtagcagagcgagttatttgtccggccaaaccctcacggccggctgggcaatgccgcgccatctcgcgctgctcctgcccctgctactgctggcctcgccggcggccacgcgcctggcgtccgccgactgcgcgggcgagaagttcccggcggggcgtgcgtacgcgtcgtgcgaggacctgccgaagctgggcgcgtcgctgcactggacgtacgacgcgttcaagagctccctgtcggtggcgttcgtggcggcgcccgcggcggcgggcggatgggtggcgtggggcctgaacccgacgggcgaaggcatggccggcgcgcaagccctggtggcgctggcggaggccggggccgcggcgcccgccgtgcggacgtacaacatcaaccgggtacgtcccgctgggca

SEQ ID NO: 61440 - DNA, 107 bp, Zea mays
  unsure at all n locations
  Clone ID: LIB3069-049-Q1-K1-D3
cgggtccgacccacgcgtnccgaaaaatgcaaaaagaaaaaattattaaaaaataaatttttaaaattctaaaaaacaaaaaagaataagaaaagaggaaaaagggt

SEQ ID NO: 61441 - DNA, 437 bp, Zea mays
  Clone ID: LIB3069-049-Q1-K1-F4
cccacgcgtccgaagcccttgagctcagtgtctctgacattggtggtggctatgagctttatgttgatgaagccaaaccaagaggcgatggccagcgtggtggtggtagatctggtggccgttctggtgggagatttggtgaccgttctggtggccggcgtggtggtggtagatttggtgaaagatctgggggcagggatggtggcggcagattcggtggccgacgtggtggtagggatggcggccgaagacgtggtggccgtggctttggtaacaagcacagcgctggcacttccagtgcaagaaagaagactacttttggtgatgattgatgatgaacgcggaggatgcggcaaaaggatccaatgaaattgtgtttttttggtcttggttgggtaccgtaactggaatttggtattttttggctactatttact

SEQ ID NO: 61442 - DNA, 308 bp, Zea mays
  Clone ID: LIB3069-049-Q1-K1-G1
tcgcggacgcgtgggcggacgcgtgggtgatcactcatcatttactcgcctactactgtggattggtatgccattatagacttggtgctgcgaaagactgctttggtgatttgtgggtttgttgctgtgtaaaaagatcctcatggcttccagaagaccatgaaggtttggatctatcatgtaattccttgttatctgccaattatgtatggactatggacatgtgttgcgctgttcaactcactacaaataagtaatcgatatattccctaaaaaaaaaaataaaaaaaatttaataaataatataa

SEQ ID NO: 61443 - DNA, 368 bp, Zea mays
  Clone ID: LIB3069-049-Q1-K1-H4
taatgacaataacaggaatgctgttattaactctgaatctgcctccagagagctatagttcagacacaggcaacttaattgatgtgaacattgagcctgctgactcagcccttagtgcacatgctaagcgcacaaaggagttccatttctgttcaactgattttcctgaacccagtaagtctgtgccttatacgttggccactacctctttgtctgcagcagcttctacaaaccaaactggtgatgttcccatgtccagtacacctgctgctgcttgtttgccctctggtaatgtgcatatgcatgaagtcgttactacttatacaccggtacctattacgcctgtcttggctacaactatacacttt

SEQ ID NO: 61444 - DNA, 373 bp, Zea mays
  Clone ID: LIB3069-050-Q1-K1-C12
aaaaacaactcatcgatgtgagtatacaccaacgaatggctgaataacacagtaggacgatggaatgaaggaggtagaacagaataacaccatgcattgatgccctgctatctatggcgccgggtgagtgacaaggctgagaaaattgaactctgctactatagcgtggaaaatgaagagcaacaaggaatggaaattaacgggccgggactcttccggtgtacaaggaaggaacgtactccatcagttcatggtgttaccgtagctcgacgacccgccgagaatgtgcggatgatgtcctccggcaccggcaccgtacagccccgtgggaggagccatcgacatcgaggtgccggtgccggcgcccgaacca

SEQ ID NO: 61445 - DNA, 53 bp, Zea mays
  Clone ID: LIB3069-050-Q1-K1-E12
cacctgaaggagatcatcccggaggagtgggagcaagcagcagccgtcggtgg

SEQ ID NO: 61446 - DNA, 283 bp, Zea mays
  Clone ID: LIB3069-050-Q1-K1-F9
tccgggcctacatttcttcatcggctcgtaaactcctcacctaggagacctgatgcgggggggtttacgaccgggcgggggcggaattcatgcctccggatttacaagggccgtcggtgagcgcacccgacactgcgctgattgctgtgctcgttcagcactagaccttacctactgctaaaccaactacatcggcggcgtgcctgcaaccatataacatatgtctttccgaggcctctggcgacgtcctcggaattcctaacactgaccgtatgccttcacg

SEQ ID NO: 61447 - DNA, 230 bp, Zea mays
  Clone ID: LIB3069-050-Q1-K1-G5
cggacgcgtgggtgcagttggtgtatacatttatccctagccctgacccaaagataagcttggggtagatatgaaaagagcttgtcgtttgcgtgcttactcttgtgtggagtgctcgagtggcgatgagtgtatgtattgtgaaagggatacgggatgtggctagatacatgagttatcatgtctaaatccacacgtatgatgatcatccgggtttatgtacattcatg

SEQ ID NO: 61448 - DNA, 315 bp, Zea mays
  Clone ID: LIB3069-050-Q1-K1-H2
gcgcccacgcgttcgcggactcgtgggcggacgtgtgggctttatcattggttttggaacctgcggcgggaaggttctgccggcacttccctgagccaacacgtcttggtatcagatctccggagtctcaacgatctcagctatcagagagttgtctcaacggtctcaactatcaaagagttcatgccgctatctagcaaggctgctatgtaactgaacgatatgaatatgggttgatttcctgggctgttgaagatgaggagactgatgctctgttgcgcaataaaatcgcttcaccattttaaaaaataaatt

SEQ ID NO: 61449 - DNA, 440 bp, Zea mays
  Clone ID: LIB3069-051-Q1-K1-E5
ccttcccttcccttcccactcccattctctttctctcaccccttccgtctacccgcgcaagcggcacacgaactagcagccacctttcacgtcccccaccctctggttcatgtcctgctgctccccatgtcgcctccactcgagctcgactacataggcctctcgccgccggcggcagccgccgccgctgaaaacgacgaactgaagggtactgagctccgcctcgggctgccagggtccgggtcgccggaccgccgtgtcgaggctgccaccgcgaccaccctggacctgctcctggacaagggcgccaagcgcgggttttctgacgaggcgcccccgacatcgcctgttgccactgccggaaagggaaagaaggtggcacatgaggagtacgacgagaagaacgtggcagcgaccccgcaaacggccgccaaagcaca

SEQ ID NO: 61450 - DNA, 400 bp, Zea mays
  unsure at all n locations
  Clone ID: LIB3069-051-Q1-K1-F10
aaaaaaataaaaaaaggggnnacgggcgggggttaaaaggggaacgggaaaaaaaaaaaaaacccccccaagaaaccctgggcaagggcggaggctaccaccacggccttttttttgcgggttcttaaaccagaaatccccccctttggggtccttaagggaccgcgggaagaaccccaaaaaaacaaaaaaaaaaaaaaggggggggcccccaaaagaaaccaagcttaaggacccgggcaggcgacaaaaaaacttttctaaaaggggacccaaaacaaaaccaccggccggggtttgacaaaccccggagggggaaaacccgggggaacccaaaaaaaccccttggagaagatcaccttttgcaagtggggacacaaaaaaaagccccccaaacccc

SEQ ID NO: 61451 - DNA, 442 bp, Zea mays
  Clone ID: LIB3069-051-Q1-K1-F4
aaagccaactgcaccatcaaaacatccttttcagatccacagctccctccaaaagaacgagagcggcgggtgccaatgccgaggctcatgaagcgtattgcaaaccgtcttaaggattctcagaacacctttgcaatgctgagtacatttaatgaagttgacatgaccaatttgatgaagcttcgttctgattataaagatgaatttgtcacaaagcatggtgtaaaattgggtcttatgtcttgctttgtcaaggctgctgtttctgcacttcaaaaccagccaattgtcaatgctgtcattgatggtgatgacatcatatacagagactacgtagacatcagtgttgctgttggcacttccaagggccttgtggttcctgttatccgagatgctgataccatgaactttgctgacattgagaaagggataaacaaccttg

SEQ ID NO: 61452 - DNA, 446 bp, Zea mays
  Clone ID: LIB3069-051-Q1-K1-G3
gcctcaagggggtttaggatctccacctacttgtattggtggatccgtcagggggtttcagagagcattggccgacaactcgagatcgttcaggctccctacttatttgcacgagaggttggtagccattcgcggcgcaaagtacgcgtttagaagaccaaggaattgctccgacagtaaggaccttaccggggtccttcacattttccagaagaaagtgcacaacgcctccagaggctgtgcacaaggtaatttaactgaatcaacaggggttcccttcctaaaccggcttactggggatacacttcataggtacctagaggatcaaaacgttgcaaatgatccgtggcacggatttgaagaaaggtacctcaaggaggaagttaacagtcttataaattcaactctcaacgagcgcgagagggacattattcgattatatcatg

SEQ ID NO: 61453 - DNA, 422 bp, Zea mays
  Clone ID: LIB3069-051-Q1-K1-H2
ggggacggtaccggcgccgctcctccagctttggggcctgcgcacgctcgtgctctcggggacggcctctcgggcgagagcccgcggtcggtccgggcgccgctgctccacctggacctgcgcgggaaccggctgtcgggcggggtgccgccgctgccgggcacgctgtcgtacctgtcgctggcggggaaccgtctctcgggccccgtggacggcgtgctgcggcgcctgccgaggctgacgttcctcgacctcggccggaactggctgtcgggcgaggtcccgggcgaggtgttcgcgttccggcgcatcgcgtacctgcagctgcggaagaacgccttctcgggcgagctccggcccgcggggcgcgtgccggcgggcgccacggtggacctgagccacaacgcgctgtcggggcgcgt

SEQ ID NO: 61454 - DNA, 447 bp, Zea mays
  Clone ID: LIB3069-051-Q1-K1-H7
aagcaactgtttcttccagtgctgtgcacattttaactggtatcaacattgtctgcacatggaaatttactggcgaaatcagtccagaatcagaagatgtcgatggaacttcactgtatcaggcatcactaggccacctcagtattcgaaatactgacaaaaatacagagttccctccagcagaatcttggataactgaaggagattacatctcgtggtcaaaatgctctaacggatctgaactcgtgaatctgaaaatcagctggaagctgaagaaccctgatcaaccacaaccaccattcagcaagtacaatatctatgtggagaagttaacggcagattcagacttgaaagttcccagtcccaaaagctatcttggagttgctagtgtcgatgccttctatgtgtcgggcttagaggtctccaacgaagtcaccggtctgaaat

SEQ ID NO: 61455 - DNA, 432 bp, Zea mays
  unsure at all n locations
  Clone ID: LIB3069-052-Q1-K1-D10
gcgagtaattntgcatcagctgcaagngaacgttttgcccgacttactggattgaagcaggcaggggacatagagaagttagagatgtcagcaacgccgaccacaacagtgtgtatttcatcggtagagcaacagggagctgcttctttaagtgcgaagattaccaatgcttctgtttctgaaggacagaagaatcctggaaattatatgccttctgccatttcaattcccgtggggagccatgttctgggcctgggcgcaacaagtattgaagaaacaactgccactatgataactcaggctcctgcagtttcaaaatcagaacgaagaaaacttccaagaggcagtcaacaaggtattcagtttgagagttcagcatcaaaaacaaagatggtatcagctgtggaaccagcacctgcaaatgttgaatgc

SEQ ID NO: 61456 - DNA, 403 bp, Zea mays
  unsure at all n locations
  Clone ID: LIB3069-052-Q1-K1-E11
gattccgngaacgatttacaccctttcaagctctgcgaccaggtcgcanatgctggtctggacgcttgccttgctgaggaccctgacagcaaggttgcttgcgagacctgcaccaagaccaacatggtcatggtctttggtgagatcaccaccaaggccaatgtcgactacgagaagattgtcagggagacatgccgcaacattggtttcgtgtcgaacgatgtcgggcttgacgctgaccactgcaaggtgcttgtgaacattgagcagcagtcccctgatattgctcagggtgtgcacggccacttcaccaagcgccccgaggagattggagctggtgaccaggggcacatgtttgggtatgcgactgactagacccctgagctgatgcccctcaaccatg

SEQ ID NO: 61457 - DNA, 406 bp, Zea mays
  Clone ID: LIB3069-053-Q1-K1-A4
aagcaagcagatctaatctccaggcagcttcgcgacagagtgagtgagtagcacgacagggacaatggcttccctgaaggccgcgaatcccagcggagttgcggcgcagggcaaggagccggcgcccaagctcagcgagacggcgacgaagccgtcagccgcgaagagcggcggcgttaagaaggctgagcagaagccccgggaaaccaaaaggaaggtgaagagcagcaaaccggcggcggcggccaaaaagtgacgtacagtacagtacgtgtggagtgtaatggagcttcccatgcatgagtgaatccatgccatgttatgaatctagtccttcctttcttgtatcttccatgtgacgcggcgtgtgcgtcccctcatgtgtgatgatgccagatgaatacta

SEQ ID NO: 61458 - DNA, 305 bp, Zea mays
  Clone ID: LIB3069-053-Q1-K1-B9
cttagaaaaaagactcaccatcgattcattttcccttcccgatagttctgaatcgatagggtcattctcgagagcagggggacgcgcccaccgcgatggctcgaaccaagcaccatgccgtgaggaacacagtgtataatcccatgattaatctccatttcgatcgctcatgtggtgcgagtacctcctcgactccggtgagcgcgtgcgtgcagacatcagttccctccttttgcctttcttgagggctgctcttacttgcttgcatgctgtttgatggtatgcaagaaatggctgcttggacc

SEQ ID NO: 61459 - DNA, 305 bp, Zea mays
  Clone ID: LIB3069-053-Q1-K1-D4
tactacgccaaggtgcttgacaaggtctttccccgtgcgatggaggtcctcgcgggcgtggtgcataactgcaatctggggcaggcccgcattgaacgtgagcgcgaagtgatcctacgagagatggaagaggttgagggacagtctgaagaagttatatttgatcatctccatgcaactgcattccaatatacatcccttggcagaccaatcttgggttctgcagataacgtcaagtcaatcaccaaagaagacctcgagaactacattgcaactcattatacagcttctaaaatggttatcac

SEQ ID NO: 61460 - DNA, 334 bp, Zea mays
  Clone ID: LIB3069-053-Q1-K1-E6
tttcttattattgttttttcttttttttatttcttaccccggattttttaacgggggtggggcgcccggaggaaaaacctgaaactttttttccctctttataataagaacttaccgactgcttccataccatctgataggaaaaaccatcaacctttgctgtataaaccaacacttgataccaaaaaatttcaagaaccaacccttctttatcagggtgccaaacaagttcccaaccagaaaacaaaacgggagatcttcttcaatttttaagaaccttatatttttccacattcccggggccttcccaaaggcctgcccatgggtgaacccc

SEQ ID NO: 61461 - DNA, 86 bp, Zea mays
  Clone ID: LIB3069-053-Q1-K1-G8
cccacgcgtccgactgaaacgagttatttatgatcttaaggctgcatacagcatgagagtctattttaaacggcggaggggcccac

SEQ ID NO: 61462 - DNA, 412 bp, Zea mays
  Clone ID: LIB3069-054-Q1-K1-A1
tctactccttctccgactcgtgcgctgtcaggatatcaaggacgcattctactaattggccagtattcttggtcttctctgcgaatgggactgggcactcctgtggcatggctgagatggctgctcctgttgactatcacaaggacatggacttctggtgtcaggataaacggaccggctgcttacctgtgagatggcacactgttaaagatataccgactggttttttgcagcatatcacactgcagaataatgaaaacaagcctgtgactcacagcagagatacacaggaaataccatacctgcctggaatatctgtgatcaagatcttcatagacctcagagtgagggactgcctgtctgatgatgttatgacatatgaggcagaacaggcgcaaatgaagccgcacag

SEQ ID NO: 61463 - DNA, 432 bp, Zea mays
  Clone ID: LIB3069-054-Q1-K1-E6
cccacgcgtccgtacgtgccttatccttcaggtatgtctcatgttgactttgcttttggaatggtactgttggcttcattgctggaatgctggttataatcaacctttactgctctatattggtctttttttggtttgcacaaccagggtggttggttttctgaatcaatcaatccatttcctcggacacaagataatttttgtatgttacacttcccaaaattgcaattaattcagaagtctgcctactttcattcagttagttctcagcaacactgaaaggatatgaatcagtcaacccgatagatgtttatctggttattccaaacaatctgacatcacatctgtttctgcaggcgagataaggaaaatctgaaatgctatcaccatttaaaacattggctcctggaagttcaggagtcgttcttaaac

SEQ ID NO: 61464 - DNA, 344 bp, Zea mays
  Clone ID: LIB3069-054-Q1-K1-F8
ctgtttgttcataggcttgtggtattcttttgataccatatctgatatattgcacccgtccattttgcagcatttcaaatttagcaaaatcttaacctgcagtggacttgcaagttgcacataactatcatcgcatcggcatgccagggtgtatttcatgttgataaccggggaatgagaagacaacgatagtgtagagctggtaaccatcacctagttttttcttctttggtttacatgtataattatgcctcctgacacctttttgggtttcagtgtatcatataccagtgtacaggttcggacctgaacattaatttaattgatagtggtcttgtatgttt

SEQ ID NO: 61465 - DNA, 278 bp, Zea mays
  Clone ID: LIB3069-055-Q1-K1-A1
gaaataaggtaagaaggttataggttcggtatcaagaacaaaacatcaagtacaagaccaagtttgtaactagatcttccagaatgtgcaaatgagtgtcaacttcctcgtgtcgctcttgaaaaagaattggcataatgtgacatgcttgtacctgaagagcactatgggaaaggtgtaccggctgttctaaattttccaattaggcttagaattctcaggagactctaatgcttggacacttgccatttttcctaacattcatttttttgatccac

SEQ ID NO: 61466 - DNA, 108 bp, Zea mays
  Clone ID: LIB3069-055-Q1-K1-A4
tgatatgtacatctggaaaacggaccgactatacaagctccctgaattctggcattgtgcgtggaagaaaaaaaaactaaaaacggcgaacaacaccaaaactacctt

SEQ ID NO: 61467 - DNA, 83 bp, Zea mays
  Clone ID: LIB3069-055-Q1-K1-H1
aaaaaaaaaaaaaaaaaaaaaaaaaaaaaattaaaaaaaaaaaaaaaaaaaaaaaaaaaaaagagagaaaaaaaaaaaaaaaa

SEQ ID NO: 61468 - DNA, 94 bp, Zea mays
  Clone ID: LIB3069-056-Q1-K1-B6
aaaaagaaaaaaaaaaaaaaaaaaaataaatttataaaaaaaaaaaaaaaaaaaaaaagggtgagaaaatttaaaaaaaaaagaaagagcacaa

SEQ ID NO: 61469 - DNA, 398 bp, Zea mays
  Clone ID: LIB3069-056-Q1-K1-D8
gaacaagatatggtgactggtgccatctttcgatttcacagttatcatgctggaagcaggggagttgtcttgtcttccctcgtgcaaccatatgtttgatcgtggtcccaaaaagaaaagaaaagatggctcgatggtttatcccgcatctgccgattcaagcgactactttagctatcaaaagcaaaaccacggtagtagagatagccttggaactgcacatttctattaactggacatgtataaatagttctcgtgagcgcacaccatgtaatcgtcgaaattcatccatgtgttgtgacattttttgagcacagttgaacatgtggtggagcctggaagcaagtcaaaataaaaaaaatgtctgataatgctataagataataactgttaattaa

SEQ ID NO: 61470 - DNA, 57 bp, Zea mays
  unsure at all n locations
  Clone ID: LIB3069-056-Q1-K1-E10
gaancccgggcgacccacgctccgaaaaaaaaaaaaaaaaataaaaaaaattattta

SEQ ID NO: 61471 - DNA, 166 bp, Zea mays
  Clone ID: LIB3069-056-Q1-K1-F3
tcgccacgcgtccgcccacgcgtccgcccactcttacgtccacgcgtccgtgctcatgtcttggctccgcgtttggaatttgcgttttcaatccggtattgaaggtataataattaacaactagtacggcggcaacaaaaaaaagaaaaggacaaaccttgaaacc

SEQ ID NO: 61472 - DNA, 411 bp, Zea mays
  Clone ID: LIB3069-056-Q1-K1-F5
tactggtcgaataatcaaaggacaggatgtatctcttcccaagagcaaatatgaagaggaggtgttcattaataatcacacgagcgtgtggggttcatggtggaaagatcatcaatggggctacaagtgctgcaagcagactatcaagaatagttactgtactggcttggctggaatagaagctgccgaagcatcagcagatctaatgaaggccaatatggctcgcaaggaggctgcagaagatgagcctgtacagcatgaagagaagcgattagccacttggggaaccgatgtgcctcaggatcttattcttaacgagaagaagctccaggaatctctaaagaaagaaactgcgaagaggaaagaagagaaagatgaaaggaagaggaagtataacgtgaagtttaacga

SEQ ID NO: 61473 - DNA, 136 bp, Zea mays
  unsure at all n locations
  Clone ID: LIB3069-056-Q1-K1-G12
agcatgagtgtncggtggtagnttctgtgtcctttgtaaaaacttgggnnatagttgatcgcgtgtgagcaggccgtcatgcctcctccagtctnctatgaacaagnctaagctataatagtatttntgctatcct

SEQ ID NO: 61474 - DNA, 369 bp, Zea mays
  Clone ID: LIB3069-056-Q1-K1-G7
cccacgcgtccgcccacgcgtccgcccacgcttccgcccacgcgtccgctcccagctgctcaaactgtaagtggtgggccaccatcatatatttgtcgactcagtggaaagagcgatgtggattggtctttctggttggaggcaaactcttctgaaagtctgagagtcgatgtcgcagtacttgatcagtaccttgttgatagtacaaagaaactcaagagcctcttcccaagttgggccgggctgtttgtataaatatggaatgcaaggtgccctttgttgggtctgccggaaattatccagaaaaaaaaaaaaaaaaaaaaaaactaatataaaaaaaaaaaaaaaaaagtaacaaaaataaataaa

SEQ ID NO: 61475 - DNA, 343 bp, Zea mays
  Clone ID: LIB3069-056-Q1-K1-G8
cgcgcctttgcgcactggcacgtctctgatggtatggaggagggcgagttctcccgtgcgcgtgatgatctggctgcgctcgataaggactacgacgaggtcggtgctgaatctgactagggtgaggactgcgactagggtgacgagcactagacgctctactggcgcagcgtcgactggcttgtgtgccactgctatactgtgatctgacctgagtggctcctatcgtgttatgtttctgtcggttcttatctatctgtcgttctgtgggctacaacttacgttgtacgactttattccaccgctatgctactgggttattaagttttggcgttatcgcttt

SEQ ID NO: 61476 - DNA, 443 bp, Zea mays
  unsure at all n locations
  Clone ID: LIB3069-056-Q1-K1-H6
tcggctcccaagcttactccctccatctcttctgccgtgctctgccccagcatcgggcgggcatctccctgagctccggcgcgcgcgttccttcctgttgcgcctctctccgtcgaagctccctgctgctcgccatggcatcttacagtctctcgctcggcccctgctcctgtctttgcttggcgtacggcctcagtagctcgccctccccgtccagcagcaagcagctgctttcccctcgccatgaacgccgtcgatcccctgctgcagttcctacacatggtctggtcgtcgaccgctcgcgtcacctgctcgtggntatgtgaaaccagcgagcctgttctcacggcgtagcttcctcgcgacatcgttcagcccgtggaggtacgtcaattgatcacgtgatgtggaagacaaggatcggattgatcttcagataatgc

SEQ ID NO: 61477 - DNA, 418 bp, Zea mays
  Clone ID: LIB3069-056-Q1-K1-H7
catggctccgatcaaaagaactacactaattcgtgcggttcatccatgccctgcaagggcgtaggaggaagcctcaccatcgtcccaatacctgacctgctttcatcatggctctggatgttcggagcggccatagctgcagcagtgcctctttacagaaggttcagagcattagaagataacgtagagaagacggcggaagcggcgatcgaagtgatcgactcggtggcggaggcgaccgagaaggtcgccgacgaggttgcgcaagcgttccccggcagtgaaactctcaagcaggcagcctccaagattaagacgatcgcggatgagatcgaagaatatgccgacaaagctgatgccctgattgaaaaggttgacgagaataagaaagaggtggattcaatcgtcgaccctatac

SEQ ID NO: 61478 - DNA, 214 bp, Zea mays
  unsure at all n locations
  Clone ID: LIB3069-057-Q1-K1-G11
gggtgaaaaacatacggacttctagtatatgagaagaggaatcctaatcgtagtaatgatatcttagtagatatgtgcttactctcttgttaattttttgtcttgagaggactatatatactgataaagtgataatttattcagagaataaaaaatgggctccatgctttgtctaaaanaaaaaaaaaaacangctaaaaaaactaaataaaaa

SEQ ID NO: 61479 - DNA, 1097 bp, Zea mays
  Clone ID: CPR9097_LIB3068-057-F6
cccgccccttggcttttgcttggttgcatcgggccggtcgagccggagaggaaaagctagctagcagctaccagctctcggccggcggtggtagtctgcctgcagctggggttagctgcaagggttgggagctagccatggggaggggtcgggtggagctgaagcggatcgagaacaagatcaaccgccaggtcaccttcgccaagcgccgcaacggcctgctcaagaaggcgtacgagctctccgtgctctgcgacgccgaagtcgcgctcatcatcttctccaaccgcggcaagctctacgagttctgcagcggacagagcattaccaaaacacttgagaggtatgaaaaaaacagttatggaggaccagatactgctgtacagaacaaggagaacgagttagtccagagcagtcgtaatgagtacctcaagctgaaagcgagggtggataatttacagaggactcagaggaatttgcttggtgaagatctggggtcacttggtgtcaaagagcttgagcagcttgagaagcaacttgattcatccttaaggcacataagatccacaaggacacaacatatgcttgatcagctcactgatcttcagaggagggagcaaatgctgtgtgaagcaaataagtgccttagaagaaagctggaggagaccagcaaccaggtgcatggccaagtgtgggagcacggtgccaacttactcggctacgagaggcactctcctcaacagcaggccccatcacatgttggcaatggtttgttctttcatcccctggaagctgcagcagagccaaccctgcagatcgggttcgctcctgagcatatgaataacttcatgccaacatggctaccctgaagatggatcttgaggcaaaggaaataaataaagatgcggtggcagcatcatactctatgcaagctaagagtgacagctgtgtttcagtcacatatatgatctagtctgtgtgtcaatgtgtcgaaaaacatgtctgtgattttgttatatgaatgtaacgcgcaatgaaacatacaggactagctgcttgcttgccaaaaaaaaaaaaaaaaaaaaaaaaaaaaaaaa

SEQ ID NO: 61480 - DNA, 121 bp, Zea mays
  Clone ID: LIB3069-004-H10-F1A
ccccccccctctgtcacgccccgtaggcacttccctagccattaccacatattctatccacacttcatgcacacagaatcataccctatgcaccattcagcgccaagctatcgtccaaaca

SEQ ID NO: 61481 - DNA, 220 bp, Zea mays
  Clone ID: LIB3069-004-H10-R1A
cggccagtgtcgggtggatcgaccagcggtggcagcagcagtgatgcagcgtgggggagctttgaatgtaacgtatgctttgaggctgcctcgagagccggatagtggctctttgtggccacctcgtgtgctggccgtgcctttacgggtggctgcacgtccatgcacattcggcaggatgcccggtgtgcaaggcgcttggtggggggaggcgagcttg

SEQ ID NO: 61482 - DNA, 426 bp, Zea mays
  Clone ID: LIB3069-006-C11-F1A
aaattttttttttttttttttttttttttttttttttttttttttttttatttttttgttatttttaatcgtgatttttttcctttattttaaatttttaatcaaaagtcctctctataaataagggatcaaaagatgacagtctcttcttactaaaaaatccgggggaaaaaaaaaaaaaaagccgaaaaaaaaaccgggggggaaaaaaaaaaaaaaccgggaaaagggcaccggggaaaaaaaaacatagcgaaaaaagggggccccccaaaaagcgaaaaaaagcaggggaggcaggagccgggaaagaaaaagcacccggccaaaaaaaacaggtggcgaaaggggagccattacagggaggaaacggccgtgggaaagagcaaaaaatgggggggccacacaggagagggggggattagc

SEQ ID NO: 61483 - DNA, 476 bp, Zea mays
  Clone ID: LIB3069-006-C11-R1A
ggcgccaacaaaagaggaagagtcaggccgaatggggtgcgagtcaagacgatgtaagcagaggatctgagatagggagtcggtggtatgtggctacgcacaccttgtacttactgctaacaattcgtaaaaaaatggttttgttcaggatcttgatgatgagtctggtgggatgcgaggatcaggcggcagaggtacgaagcgcaccgcaccgcggaggtgcacaatttgtccgaaaggaggagaagggacaggatcaatgagaaaatgcgcgccctgcaagagctcatccccaactgcagcaagattgacaaagcctccatgctggatgaagcgattgagtacctcaaaaccctccagcttcaagttcagatgatgggcatgggaagtggactgtgcattcctcccatgctgctgccgcgagccatgcagctgcaaattccttcaattgctcatttccatcatctcggcatggg

SEQ ID NO: 61484 - DNA, 115 bp, Zea mays
  Clone ID: LIB3069-008-C6-F1A
agagaccaaccgtgggcatacttcacgactatatgtagtccccgcaccgaagtgagggcgcgtcgtgagcatgacacaatggaagcaccgtgacatctatgaacgcacaatctac

SEQ ID NO: 61485 - DNA, 320 bp, Zea mays
  Clone ID: LIB3069-008-C6-R1A
gcggatttggtgcgttggtttggttttggaacgcgtgtagtcgatgccgagatgtgtttgcctggtagcgtggtgagagaccatgcaatggtttgcaaggagctttaggtcggtacagaggagattgtacgtcatctgcgccttgcggggtcctacgtcattcgccccggtagttgacgatgccacagaccattgtggggcaaagtggtggccaataccatgttttggtagttattgctgacgggcaggtcacaagaagtgtagatactgaatttggtcagttaagcacccaggagcaaatgacagttgatgctattgta

SEQ ID NO: 61486 - DNA, 251 bp, Zea mays
  Clone ID: LIB3069-017-C5-F1A
ggcttcttctcgtcatggtgtcgggaggaggcggaggcttcgagggtgatgccgccgctgcggtttgaggcgtttgctgaacggaggacgtcatgtacacggatctgtggaacctctgcgccggtcctctggtctcggatctcagtgtctgggataaggtgtactacttccctcaggtccattatcgagcaggtggaggcgttgaccaaccaggtggctgagcagcacattcaattttacgatctcccgtg

SEQ ID NO: 61487 - DNA, 384 bp, Zea mays
  unsure at all n locations
  Clone ID: LIB3069-017-C5-R1A
gagagcagcgcgagcaacaaggacgtttggcactgacagaagcacgtccagccacgtctgcaagagatgccttcgtgggttgacctgtgagtatgtggcgagacgccattccacaccatgcaggtccttggctacaagctcttgtgttggaggttgacgggtcatatcctgaccagaaagccaaagcaaagattaccactaccagtaaagcaacaaatagcagacctacgactgatgcactggcaatatcaagtcaagaatccagcaagctaccagtgncgggagacagtcatctgcatggcgccgcggcgccgagaatccaccgtggagtgctggtatcagaggctgtcagtgtcttgcagggggagtgcacgcgtggccttg

SEQ ID NO: 61488 - DNA, 493 bp, Zea mays
  Clone ID: LIB3069-031-G7-F1A
gaaaccagaatgtgcgtcgtccccctcttctcgtttcattccgttccgatccgattcattcctgtagagagagagagagagagaggaggcaggcagcgctttacacggctttcagcaagcctttactacatttttctccacctttcagttcccacatatttttttttttcagttgctgactcttttcactgctgtttcggtttcacagcggttcgagagaataaagttttaaaaaaaggaaaataataacttggaagtttgctactgataagaacagctgctgcgcgttcgtcctagaagatcgattgacggtttgggagagtatttgatggctcatgcacgcccaggagctactgcatccggccgacccgctcggcggcggcgcgcatgacgccgtcgacgagctgcggcatgcagaggtcggccccgccggcgacgccgcacccggcgcgcacgcccacgctcggcatgtaccgctgcacctccgtgcgga

SEQ ID NO: 61489 - DNA, 68 bp, Zea mays
  unsure at all n locations
  Clone ID: LIB3069-036-H9-F1A
cttacaacgcacctctatacatcctacncngggcacaacccgcacctccgtcaaagcacacacaggac

SEQ ID NO: 61490 - DNA, 447 bp, Zea mays
  unsure at all n locations
  Clone ID: LIB3069-036-H9-R1A
ntncgagaggcacctgatctcttcttcccgctctctctaccacaccgtcccatcaccattgctgccacgagagtgacngggagagggcaggtggcgagccggnggacatgggcgcccggggccgctgcagctcgccggcatcgagaacacagcatcaaccgcacgtgcccttctcacgcgcggaagggctgctgacgcacgcccacgacatccccgtggtctgncacgcagaggctcgccctcatcgtcttccccactaacgggccgctctacgactactctagccattcgaccatggcccgcattcttcaccgttaccagcgtcactcatctgaagacacggcagtacttaancccagtattgaacaccaggccaattcggcagctgcatatgtccggttaaaatccaaacttgatgcagttcagaagactcacacgcacctgtta

SEQ ID NO: 61491 - DNA, 560 bp, Zea mays
  Clone ID: LIB3069-005-C12-R1A
gcctcttgcctcttgcgccttgctagcttgcttgcctccctgctccctcctcctccctcttcctcgtcgcttctctgattcttcctggcctttgccggagcaaggctaggcgcgaggagagggtgctgtgctcagccagaggtcatcggcgctacgcagcgcactgcctgttgtgctgcactgccggagtatcaggggaaaacgctgaaatcatggaaatcaccttattgcatgatgaatctgatgcaggaagcaccagtttgctaccgccattgttgtcatatggtccaagatcaatggttccaatacaagtaccatcgtcatcagaccttgagagtatcctgtcaccagatccagtctgcagtgatcttcagttgaaagagataaactacaatgctgcagcaatggatgaaagcactgagctccttcacttgattcttggtggcaatgatgaaggatacaataccacaactgaattacaagtttgggatgttctggacttctatgtctcagaaaacttctcggctctccaatttgatagtttgatgggttttacaaat

SEQ ID NO: 61492 - DNA, 194 bp, Zea mays
  Clone ID: LIB3069-006-E1-F1A
gtggttgtggttgttgtggtgtttttttgttgttgttgtttttggtgtttttgttgtgtgtggtttgacgggaaaaagtgcgagcgtgttgggcaacaatctggggagccctagcgaggtacacttggggcacgtgttggttgatggctggagggattaaaaccgacaggggcaactggaaacataaacagggc

SEQ ID NO: 61493 - DNA, 562 bp, Zea mays
  unsure at all n locations
  Clone ID: LIB3069-006-E1-R1A
cccacgcgtccgcccacgcctccgcaaaaccctcgccctcccaaaaactactcacgtctcgccgccccgccgtatcaccctttctcggcggccggcctcttctcttcacggactcgcaggtcatcgagatgtcgtcggcggaggcgaaggccgcggcgaaggcggtcccggagtctgtgctgcgcaacgcaaggcngaggagcagtgggcagcggacaagaaggagaaggccctcgcagacaggaaggaggcgcttgacagccgcaagatcatatttgctcgcgccaagcagtacgcccaggagtacgacgcccaggagaaggagcttgtgcagctcaagcgtgaggctcggttgaaaggtgggttctatgtgagcccagaggccaagcttctgtttgtggtccgcatccgtggtatcaatgccatgcaccccaagacccgcaagatcttgcagctcctgcgtttgaggcagatcttcaatggtgtctttctcaaggttaacaaggcaactattaacatgctacggagggtggaagcatatgttgcgtatggatacccaaac

SEQ ID NO: 61494 - DNA, 408 bp, Zea mays
  Clone ID: LIB3069-006-F3-F1A
accctaaagactgtatttttttaagagggtagtttgaaaaacaagttggaattgggaatttggggggaaagtcttagggcaaacttaacaaaaatcccgctttttcgaaatttcaaatggggggtgaaaaatctgaaggggccctggggttcccaaaccttagaaatcccagggggggcaaaaattcccccttcccaaactgaagggggaaaaaaaaatggggggaaaacccggggaaaatttgctgttaaaccggggggccccccacattttgcaaatggggggcccccaaaagggggggtattcccgaaaaatcccggggttttccccccccggaaaagggaatccgttttcagggggcttacccccggaatgggggaaaaccccctttaaaaaggggtttccccc

SEQ ID NO: 61495 - DNA, 551 bp, Zea mays
  unsure at all n locations
  Clone ID: LIB3069-006-F3-R1A
ggacgctgcngngnacgcgtgggagtttggtaagttactctttatataggcctaccactattttcgtcctgcagatgttatcaaagtcaggcttcaaatgcagcttgctgggcaaagaggaaacttagttggaatggtacttaaagtcacagcacctacaggtttcatatttcacacttcttctgatgttaaattcatttcctagttatatgtgtattgtgaaatatgttagggaacaatatttacacaaatggttgaaagggaagggactcggtcactctacctgggacttgcaccagcgttggcgagagctgttgtctatggtggccttcggtttggactgtatgagccctgcaagcatgtctgcagttatgcatttggttcaacaaactttgcttttaaatttgcatctggagtcattgctgggggccttgcaactgctttaacaaatcccatggaagttttgaaggtgaggctgcagatgagtaaaagcagtaccaagtacataagagagatgagaaaagttatagcgcacgaagggtttaaagcac

SEQ ID NO: 61496 - DNA, 503 bp, Zea mays
  Clone ID: LIB3069-008-E12-F1A
ttttttttttttttttttttttttttttttttttttttttttttttttttttttttttttttttttttttttttttttttttttttttttttttttaaaaagggcggggacagtactacagcccaaattgcatcccaacggggaaatttagttacaaacccgggggccaatctctacccatcgccaaaatcacagggtcagcttcacccgggggtacaacaaacaagttttccacgggggccccccggagacagacatccaaaatcgggcagatttcaaaaaaatacagggtctaaaaccccccaagggaaccgaagggcccaaggcgcttaaaaccacccctgaaacgggccctgccgggggcccaaaccccctcccggcttggggtccccccttcctcccgggccccccggggttcccctttttcccaagccttccccttcttttaaagcccttaaaagggccccttttaagcccccttatttggaggaaaagtttcatct

SEQ ID NO: 61497 - DNA, 569 bp, Zea mays
  Clone ID: LIB3069-008-E12-R1A
ggaagaccccatggattgtcaatccagagtttgaggatgacccagacctatatgttctgaaacctttgcagtatgtggggattgaagtatggcaggtcaaagctggttcagtttttgacaacattttgatttgcgatgacccagactatgcaagacatgttgtagatgaaacttttgctgcaaataaggaggctgaaaaggaggcctttgaaggagctgaaaagaagaggaaggctagagaagaagaggaagcacggagggcacgggaggaaggggagagacgaaggcgggagagggatagggaccgcggcagggaccgatacaaggatagatataagcgtcataggcactacgactaccatgacgagctatagatcctgtattcttttgaaatctgcacgatattggatgtctgtctacggagagcgcacgtgcaaaacttgtatgttgtactcacggatgaagctgaacctgtgattttcgcgatgggtagagattggccatcgcgtctgtaactagatttcccacgtgcgatgcaatatgagctgtagtactgttctcgcactatt

SEQ ID NO: 61498 - DNA, 566 bp, Zea mays
  Clone ID: LIB3069-008-F12-F1A
gtacaatgcaaataagattgcaaaagatccatatgtacagcaacccaatgtaccaacaacaacaattttaaccatgacaccagaccacatttatatgtaaggttccaccggtacactctttattcatccttaaacacagaatctagatgccgcctctcaatctcaggtctaaaaccaatgaaccagacataatctcacaatgccaactacagatcgcatggatcagaacacagttatgttcgtcatcatattctattggcccatgtttccaagaagtcgctccactgcagcatgaacatttccagcagtggcggccaaggctcggatgttctcctgtgtgtcaaaaaaacccatttcttggagctgagctaattgtgttgcatacagttcttctggtggcacattaggagcatttggaacacctaggccaccaccagcaccaagcccactgaacatgttcatcaaggtgttgaggttcacattgcctgcaccagaggctgattgtagtcgctcctgtcccagtttgtgttggccaagttgtgacatcaaagactgctggaatgaaa

SEQ ID NO: 61499 - DNA, 542 bp, Zea mays
  unsure at all n locations
  Clone ID: LIB3069-008-F12-R1A
cgacggcngagaccgtgggcggacggtgggcggacgcgtggggtctcctgatacattgcagcaattaatttcattccagcagtctttgatgtcacaacttggccaacaacaaactggacaggagcggacacaatcagcctctggtgcaggcaatgtgaacctcaacaccttgatgaacatgttcagtgggcttggtgctggtggtggcctaggtgttccaaatgctcctaatgtgccaccagaagaactgtatgctacacaattagctcagctccaagaaatgggtttttttgacacacaggagaacatccgagccttggccgccactgctggaaatgttcatgctgcagtggagcgacttcttggaaacatgggccaatagaatatgatgacgaacataactgtgttctgatccatgcgatctgtagttggcattgtgagattatgtctggttcattgggtttagacctgagattgagaggcggcatctagattctgtgtttaaggatgaataaagagtgtaccggtggaaccttacatat

SEQ ID NO: 61500 - DNA, 133 bp, Zea mays
  Clone ID: LIB3069-009-A9-F1A
gaagcggcagtgcagcccatgaggggagacatacataggtggcatacagacacagatcacaggactggagaatcatgcagagatctctcatctcagccaagatcaggaacgatggaggaggcctcggcggcgg

SEQ ID NO: 61501 - DNA, 391 bp, Zea mays
  unsure at all n locations
  Clone ID: LIB3069-009-A9-R1A
cccacgcgtccgcccacgcgtccgcccacgcgtccggatttttttaggcggctgctggcctgcctgtctccactggaagctccggattacgtaggaaaggggcgggcggcatgaggatccagtgcgacgcgtgcgaagccgcggcggccacggtggtgtgctgcgccgacgaggcgcgctgtgccgcgctgcgacgtggagatccagccgccaacaagctcgccagcaagcaccagcggctcccgctcggcgacgcccggcgctccccgccagcctcccgcgctgcgacgtgtgccaggagaggccggccttcatcttctgcgtcgangacagggcgctcctctgccgcgactgcgacgagcccatccacgtccccggcacgctctccggc

SEQ ID NO: 61502 - DNA, 512 bp, Zea mays
  unsure at all n locations
  Clone ID: LIB3069-009-B7-F1A
ttttttttgtaatgccacnttgaaccaataacatagatcgttgtgttcttgctcattaaaaaaatacaattaaaaactcagttacaggcgtctctccgcgtgaatcgataagctcaaggatcgaatccctntgtcggttatgcctgaagtgtaatatgaaagtacactctacaatgtggantatatcttcacgccttccaatctggcactctgttgtatacccatacnccanttttgagtattcgtctatcaccgccatgtatatgatncctgaactgatcaatactatcgtctgaaaacgggttctacgggcctctcaanagcttatgcaggcaacaaagttcagctgacatggatatccttcctcgcgtttgcatctgtttccaatccggtgctccatggtaaactcattccaccgggagaaatcatctatcaccaaacataagagtgttgatccgatcaataccgatgtctgagatgggttcgatgggcctctcatcctctagtgcagg

SEQ ID NO: 61503 - DNA, 546 bp, Zea mays
  Clone ID: LIB3069-009-B7-R1A
gcaaccggcgaccccatcgtgactgggccccctcatcgaggtctccctctttcgccgcccgtgaccatggccccaagcagtcggaggtgtacggcttcgttggatccatcaccaccgtcattgccaccgccgtgtacctcgcctgggcatacacgcccgagcccgtcctccagtcactcggcatcacctactaccctagcaagtactgggcactggcggtgccatcgttcgtggttgtgaccgtggtgctgtccatgggcatctacatgggcctcaacttcgctgccactcctcctccgacttccttcagtactatcttcgatgaaaagagtagggagcacacagccttttttcctgcaacttgaggatgagaggccatcgaacccatctcagacatcggtattgatcggatcaacactcttatgtttggtgatagatgatttctcccggtggaatgagtttaccatggagcgccggattggaaacagatgcaaacggcgaagaagatttccatgtcagctgaacttttgtggctgcatatgctat

SEQ ID NO: 61504 - DNA, 479 bp, Zea mays
  Clone ID: LIB3069-029-E10-F1A
ccacaaaaatattcaggggaaatacatcaagatggtacaaaatgtcattatggacctaatgggtacaatgatatagcaaaaaatataacttatgtctcaaatccctgaaaatcatcaactgcttaaaaaacagcaaaattgtctatggtgtaatcagtgcaacaaaatccacacggaatgctcaatgagcgaaggcaggatgatatccagtggctccatcttactgcctctgatgatgcaagaaagcaatctcccgtgctaaattgaggatttgaggtgacagaaaatcaatgtgctctaggaatatttgctattggttgggaattaaactgggtcacatgcttgacatgccaaccatgtgacccagtttaattcccaaccaatagcaaatattcctagagcacattggttgggaattaaactgggtcacatggttggcatgtcaagcactttaaggacgtccccgaattcaaaatcat

SEQ ID NO: 61505 - DNA, 392 bp, Zea mays
  Clone ID: LIB3069-029-E10-R1A
tccacttcccttccacaacggaataacaaagtggatacactactatgttcatgcaagtccagatgccatacatggtatttacaggacttgaagactataaagcacgaggcacacaagcaagtccttactacacagtcactcattacacagagtttgctgagaccaaggacactgtgcttattcgaggagatgttgtttttaccagcaaactaaccgattcagaggcaaagcctcttctagagactgctcactcgttctacctgaatgatgtgagatacagactcgtggagcgcttcaacaaagagactcatgattttgagttcggggacgtccttaaagtacttgacatgccaaccatgtcgaccagtttaattcgcaaccaatgtgctcta

SEQ ID NO: 61506 - DNA, 585 bp, Zea mays
  Clone ID: LIB3069-030-B7-F1A
cgctcagacatctgtcattcatcaaacagacccatcaacattattgtcctaaacaaaggagtcctacaagcagtgctgcaaacaagatccgaaacacatctcagagcctcagacactgaccaaaataccaatgtgtgctcaaccctccctgtagggaaaggtctcagaaaagctatcatgacatcctcacaagaaactcagtgttcctgtttaacaatattcctagtgttgtcagccctcagccgtacatttggcatgttatttcatttcttgcatggccatgaacgacaacaaaacagctcccaagatgcaaacagaatgggttcggtaataacaacagtacagtaataccaaatgggcacaacccgttgcctcattcaggactaagagcgacgttacttgtcagtcaatggaaataaccaaggacctgcccacccacgttctgcctgattgcttcctcatgatccaaaacaccattcggagtagtaatcacaacatagccccaccaactgtacagcacattgtgtgggaacaggtcagcaaaacctgaacggagtatgctgtagttctgaactaagctggggg

SEQ ID NO: 61507 - DNA, 524 bp, Zea mays
  unsure at all n locations
  Clone ID: LIB3069-030-B7-R1A
gggagttngancatcccaacacgccagtgtgctatccagtatgctaggtttgcatataatcctgtcgtgtcccttggatggttatatccccccagcttagtttcagaactacagcatactccgttcaggttttgctgacctgttcccacacaatgtgctgtacagttggtggggctatgttgtgattactactccgaatggtgttttggatcatgaggaagcaatcaggcagaacgtgggtgggcaggtccttggttatttccattgactgacaagtaacgtcgctcttagtcctgaatgaggcaacgggttgtgcccatttggtattactgtactgttgttaataccgaacccattctgtttgcatcttgggagctgttttgttgtcgttcatggccatgcaagaaatgaaataacatgccaaatgtacggctgagggctgacaacactagggatattgtttaaacagaacactgagttttcttgtgaggatgtcatgatagcttttctggagaactttccct

SEQ ID NO: 61508 - DNA, 552 bp, Zea mays
  Clone ID: LIB3069-030-G11-F1A
gggaagtaccgacgaacattacattacaaaatactggtaacaactaaaaacgaccctaggcatttaccagtctccacctgctacattcttaccttaactactctggaccaacatgcgccagtttactggcttaacactggccgtactccttcgcggtcagataatttacatagtttcagctctctcaggtactgctgagcccctcctctcccagatggtgcagcaatatcaccttcacctgcaaccggccctgcacatggggtaccaagaccaaaaactagaccatggcagccgcctgccctcctagctcccgatatgcccaaagttgacaccgttctgccgtctaatgtgctccggtacaagcctgttgatgaggtccggggaggcatttgctagctcatgtttgaagttaaagagcggagggaatggacggccgtttggtagacgtgcattcggcgcccgcagctcatcaaagaagggatgagcgcatgcatcaagagcagagcagcgaagacttggcgaatactgaaggagacgggaagcaaggtcaat

SEQ ID NO: 61509 - DNA, 418 bp, Zea mays
  Clone ID: LIB3069-030-G11-R1A
cccacgcgtccgcccacgcgtccgcccacgcgtccgcccacgcgtccgcccgaagccgagccagcgaaccaccccgcccgcagccgcaagcaagcagccaagcagtgtgaactgaccgtccgttccgtccagcccaccatggaggcgccgccggtaccggagctcatggatctggacgcgccccctcccgccgcagccgacgccgcagccgcgggcccggttccccctgccgtcagcgacaagaagaaggaaggggaagggggagacactgttacgggccacatcatctccaccaccatcggtgggaagaacggcgagccgaagcggaccatcagttacatggcagaacgtgtcgtgggtacgggctcatttgggatcgtcttccaggctaagtgtttggagactggaaagaccttcg

SEQ ID NO: 61510 - DNA, 465 bp, Zea mays
  Clone ID: LIB3069-031-B5-F1A
acggagtacatactagtattccaaagggagtcaaagctgccacagcaactgagattacagggggtggtggtactacatataacattaccagccgttcattaagcttacaacatcatgaacataaaaaagcatccacaatcctggcaatgccagcgagaaatcgaatggacataaccttaataaaacagaggtccatgacttagagcaagggtcacggtatcgttaccatgatatagggggaacagaatagaacagccgacgaacaacccaggcaattgaagcatgaactcttcaactggataaacggtcacttgtcaacacaaaaattccaacccgactcggacgggttcaatggccaatacaatctaaacaactggggttagaagcaaccagacaatcgcgtcggcacaaagctgaaacaccagaaggtgccttcccctcagccatatcctcgtcccggttatc

SEQ ID NO: 61511 - DNA, 361 bp, Zea mays
  Clone ID: LIB3069-031-F1-F1A
gcccgcaagcaaaaaaatgcgggatttgattggcccaaaatcggtttcggaaagcagattacccaacccggggctgaaagactggggtttgggaaaacagccccacgcccaaaatacacaggggtcaggggtgaattttcggggaggaggcctgaaccccgggggatgaaccccgaatttccacctgaatgacccgacgttgcgtttgggcttgctttggaccaccgcctcgatcctgtcgaagacccccggggtcaacagggggatgacatctagggccttaatgttccccaaaatcgggctttctttgggggccccagggttcacaggcgaaaaattggggttcaacgggcacccaggg

SEQ ID NO: 61512 - DNA, 411 bp, Zea mays
  unsure at all n locations
  Clone ID: LIB3069-031-F1-R1A
cggacggcngagaccgtgggcggacggtgggcggacgcatggggtgcgcgtcgaaccccaatgtctcgtctgtgatcactggagccaccaaagaaagccagattgtggagaacatgaaggccctagatgtcatcccactgctgacgccggaggtcgtcgacaggatcgaggcggtggtccaaagcaagcccaaacgcaacgtcgagtcatacaggtgaaaattcggtgttcatccgacggagttcaggcctcctccacgaaacttcatccatgatccgtgtgtattctgggcgtggtgctgtgttcacaaacaccagtctgtcagtcctgtgttgtgtattctgctttccgatacagattttggaccaatcaaatcctgcattgtgttgcttgcgagcaaaaaaaaaagaa

SEQ ID NO: 61513 - DNA, 577 bp, Zea mays
  Clone ID: LIB3069-039-B8-F1A
gagctcgaaaacatcttattctctatcaatttaccgtttatctgatagtgcaggataaaagttagagaagctttcttgacgaaacacaagaaagcttcagaatacaaataacacagcctccgctgtgtgcagtttgcacaccttacagtacgagccaagttatgcgcgtgctcgtaatgctccgaagcaaacctagcaggcatccagatccctgcatggaggaggtttcggctctccgtgcaaggtggtgttccccccggcaggccacagttttttcgctctgggtgctgtgtacctcgagggggtgtttcacctcttctaagcatctcaacaatctcaacaactcgttttggagtgaggtcctcatagtagttatatgtgtaacctctgagcctttcgagtagtcagccacagcaatcataggagcattcacacagcaacccatgcactccatttctccaacaggaaataaaccatcactggtcacctcatttcgtttaactccaaggtgctccaacaacgtctcttcgatttcacgtgaaccacgaatcatacaaggtgtagttccacacaccag

SEQ ID NO: 61514 - DNA, 507 bp, Zea mays
  Clone ID: LIB3069-039-B8-R1A
cccacgcgtccgcccacgcgtccggcggaagacaggtcgcttgttctacttctacctggcctcgcaggcttcgcaaggcggccacacgccgatacctcctccttcacccgctccgtcgtcccccccagccggccacgccaccatgctgccaccggccgcgcgccttgcggcccgccgcctcctcggcctcgcctccgcatctgcgtcggaagccgccggccgccgggtagcttcctctccgatcgcttccgcaggctactccgccgccgcgtccaggggctccgtctccagcaccaggcccttctccacggctcttaactaccaccttgattccccggagaacaagccggacatgaaatgggagttctcacaggcgaatatgaagaaggtcaatgagattctgtctcactatccaagcaactacaagcaatctggtattattccgctggttgatcttgcacagcagcaacatgggtggatgggtgccagtttgcagcaatgggatgc

SEQ ID NO: 61515 - DNA, 109 bp, Zea mays
  Clone ID: LIB3069-039-E1-F1A
cctcttcttctcttttttctcttcctcttttccctttttttgggcgcgaaatcaaaagtgtttggtttggcctaaaagggggaaaatttataaagggattgggggcaaa

SEQ ID NO: 61516 - DNA, 501 bp, Zea mays
  unsure at all n locations
  Clone ID: LIB3069-039-E1-R1A
gggctctgaagaattgtctgctgagctctctgtttccctgcaaagatgcttgttgggtggtaaaagtggtgctggtgctgcaattgatctgtcatccctaattgttgttgatggaaaggtctgctgggatctgtacattgatgggcttgtggtcagttctgatggtaatttgctagatgcgctacntgttgcgataaaggttgctttgagtgatacaggtataccaaaagttaatgtttctgttagtgctgcatctgatgaggaacctgaagttgatgtaagtgatgaggaatttctgcagtttgacacatccggtgtgcctattattattacattaaccaaggtgggtcggcactacatcgttgatgccacctcagaggaagaatcccagatgagttctgcagtgtcggtgtcagtcaacaggcatggccagatatgcgggctttacaagagggngagggcagggctggatccaagcgtcatcttcgacatgatatctgt

SEQ ID NO: 61517 - DNA, 527 bp, Zea mays
  Clone ID: LIB3069-040-F10-F1A
cacaactaaagtgttgcgccacctttattagttatggtacacgcttctctgcgctcgtttccagatcatgcaagggacaggatgtgggcacaacgcaagcacacccacaagaaaggcaaaacacacacgactgccgctcagtgttacaacttacaagcgtatcccagccaggttatgtactatgcacattgcattgagctacggcattatatggaaacaaccaaactgttcgttccaatgcatctatagtccttcagtatcgacggccaccaccagtcgacaaaagcactctagttgctttcttacccttcttcccagcgccatttgctttctgcatctccgagttgtcagctgcagtcacggctctactggaagatatgatgctggcaaatgataatgcgggtgtcgctaacggcccttggtctctcgaggtttcactttggccatttgcatccccagttccgagtcttaagggaggtgagtcttgagcagatgcaaaacccaagcgtgttacatcagagaaaagc

SEQ ID NO: 61518 - DNA, 598 bp, Zea mays
  unsure at all n locations
  Clone ID: LIB3069-040-F10-R1A
gggacgttannnagcaaactataagtttgttgtattggatactgggaattaccagattgattcaatggatcctgataagatgcttcagtgggaagatattatctgtggtaagatactatagcccttctgaggtacaatgccctatttgcttggaaagaccattgtgcccacagatcacatcatgcggacacatatattgctttccatgcattttacgttatctaatgatgggcaaagatgattatagaggtgagtgttggaagaagtgtcctctgtgtttcatgatgatatcatcaaaggatttgtatacaatacaaattactcaagtccagaatgtccgtgctggtgacgttgtcacatttacacttctgagcaggtcaagaaattcgctcactccttccatcaaaagctcctccagtgaaagttctacaacagatgaagagcattataatgttttctcaaagtttattttgacatctgatgtggagttgtctgttcgagatgcaaaattggatcttagtaattggttgcatatggctgactttaggccttggttgatgacttggaagaaacttccaatttgtttctggctgccttt

SEQ ID NO: 61519 - DNA, 534 bp, Zea mays
  Clone ID: LIB3069-041-A7-F1A
gtattgtaactcacagttataatgatacaacaaatggtacaaatgttacaattacaataacaaggtaacgccaaatgtggcggcaattacatgcactatgactgatcctgtaacttattcgtattttctcaatggtatcaaccggaaaacgacacacaaatagttgcacaaaatccactttgcccccggtagttccacagactttcactttgccaccatattgttcattgcgtcgcacctcactccattgtggctttgtgcttccacagtggagagttcctgtacgtatcaaacaatagctgctacaatgccgatgcacctgccagtgagtatgcaatactacagcaagctgacatgctagtgccatagtgccatgcatcgcaattgacacagttatttgatacagggactcgcttctgcagaacacaaataccacaatggagcaaaggtgcgacggaaatgcacagcgtagtggcaaagcaaaaccatgctgaactgcaggggcgcagagtgaaatttacccaagtaaatgag

SEQ ID NO: 61520 - DNA, 458 bp, Zea mays
  unsure at all n locations
  Clone ID: LIB3069-041-A7-R1A
cccacgcgtccgcccacgcgtccgcccacgcgtccgcccacgcgtccgagatgaggtaggtgcagaacacggtccattcatggatttgaaagcgagattcatggacttcanacagagaaactatgtggagaatttttcaaattaccaaaatcttgctgagcagcaaacgccaaagttcatggtgattgcttgtgctgactccagagtctgccctaccgctgttttggggtttcagcctggcgaacatttacggttcgtaatgtggcgaatttggtaccaccatatgagcatgagggatcagagactagtgcagcactagagtttgctatcaatacactcgaggtagagaatgtgctggtggtaggccacagtaggtgtgggggcatccaggcactaatgagcatgaaagatgattcaacatcaggaagcttcattaaaaactgggttttcaatgggga

SEQ ID NO: 61521 - DNA, 69 bp, Zea mays
  Clone ID: LIB3069-041-F8-F1A
agggaaggatcgagcctcgagagcggccgccggcttcacggtcgttgttccccggcgggcgggtgcggg

SEQ ID NO: 61522 - DNA, 566 bp, Zea mays
  unsure at all n locations
  Clone ID: LIB3069-041-F8-R1A
ggacggcctngnccttggctacttcatattccgtaatcagctttttaatgtatatgcgccaaagtatgatactggagggaaattttggcccgttgtgcacaacacaacgatattctctctggttgttctgcatataattgctattggagtatttgggataaagaagcttccccttgcgtccagtttgctacttcccctaccaccgctgacccttctgttcaacgaattctgccggaacagatttctgcctatctttgaagcatactctaccgagtctttgctaaagaaagatagagaagaacagagcaaaccagatatggcggagttcttcagtaatcttgtaacagcttactgtgacccagctctgaaacctttccaacgcacttctaactccgacgaacgcaccgagccgctcttggcctctctgtctagctccagataagctgtggatggcagctgactccgctgtgtgaatttcgatttgatttaagtgtttagatacggctagtagtataggtataattttatgctacattgtaagagtagaacttttgacagacatatag

SEQ ID NO: 61523 - DNA, 345 bp, Zea mays
  Clone ID: LIB3069-042-A5-F1A
caaataactcccgtaagcaccgtaatagactccacattaagcagcagtggacgtgcgctaaggcggcgcggatggaggtgtgtggagcattaacatgcggaactggagcgtgcaggcgggcacggttatcggggagtccggcgagtatgcgtagaagcgcgaagcggtgagactatatttggtggtgcgcggtgcagctcgatgcgtgtatctttgagcgtgcagtcgtgccagtcagaagggggcaattaagacgttctcaccctagcgagtaatcgcgtcgggggcgatgtagctgggagctgtcgtgggagaaggatgggctgtcgttgcaggttcctgcta

SEQ ID NO: 61524 - DNA, 431 bp, Zea mays
  Clone ID: LIB3069-042-A5-R1A
aactcccggtcgagaactacttcgtggtcgcggggcgcggcgccgtggaggccatctgcctcgccgtcgtcaccgacttcggcggaggctccggggctgggaacgagggcagcggcccggccatcatcctcggcagcttccagcagcagaactacctggtggagtacgacctggagaaggagaggctggggttccgccggcagtcatgcacgtcgtcgccgtcgtgaggtctcacgagtcggcatggcggggatcggagtggaggccagtaattactccagagtccagtccacgtaacactccaaattccaattccaaaagctggctgcttgatcttttgttagtgctcgtgtactgctaataaaaaactaaatttactgtcatctactactactattaagttattgaaagacgtggcttgctttgggttt

SEQ ID NO: 61525 - DNA, 470 bp, Zea mays
  Clone ID: LIB3069-030-Q1-K1-H12-F2A
aaaaaatctgtacagtgcattgattttgataagtgtgatatcgggaatgggaaattgcattacaagagttcacattactctaatcaagaggctttcttatatttgtgtctggccgcccaccccatataaactatcagattcacgaagcttatccctgcaattaaccaaaagaaccggtcgagatggccttaattcacattggcagggatccatccaggatctgctccctgagttgtaatggacgacaccaatgtcagtatgatggagcttatatagtttcccagtgagactgtaataagtgcaagtgcactacataaactcctaatgcgatctggggcctgatcgtaaaagaactgagctggaccaatacaggtaaacacctcattagcgcccaccaagaaatattgcggtatttgccaaagaatgctcattggaacagtggccttctgatgaatgagaccttcagacct

SEQ ID NO: 61526 - DNA, 558 bp, Zea mays
  Clone ID: LIB3069-030-Q1-K1-H12-R2A
cggacgcgtggtgccgcggtccattccgtctgaagaccctactcctacctaattatttttctctgtcgcgacgtgaaatgccagcgcgcaccttcttgatccgtaccggctgatcccgtggaccggacttggggttgggggaggccctctgtctccatggatgaggcagcatggctgctgttgcaagacgagggtggaggtggggaccaagaagctctcctacttacactttcacaggatgttggcctttacacaggtgatggatctgttgatgtcaaacggcgccctgcgttgaagggcactacaggcaattggaaagcatgctatttcatcctagggaatgaatgttgtgaaaggctggactactacggaattgcaaaaaacctagttacttatttgaaagtgaagcttcatctacgcaacctggaggctgcaagacatgttaccacttggcaagggacatgctatctcactcaccttggtggaggcatcttagcagactctcgttgggggaaatactggactattgctgccttctaatcgggttactttattggc

SEQ ID NO: 61527 - DNA, 650 bp, Zea mays
  unsure at all n locations
  Clone ID: LIB3069-052-Q1-K1-D2-M1
gtttatgaagacagaggccagtcacaaggcgatagcagcaggtggtggcaagatgacggtgctccactctccggttggagttaggagcatcgtgacctccttggtggctttcttcatcctagccagctccatcgtgttcctcctcgacagaggccaggaagagcaagtgcaagtggcagtcgagcatggacgccaagaagtgcaggtgaagctggaatccgggctgcaagaaccggcgataagagggacaacccaagagggggacgccagcaacgaggagtgcaactggtccaggggaaggtgggtctacgacaacgtgtcccgcccattgtacagcgggctcaagtgctccttcatcttccccgaggtggcctgtgacaagtatggcaggaaggatgccatgtaccagcactggagatggcagcctcatggtcatggatgcgacctcccaagatttgatgccatcaagctgcttgaaaatctgagaaacaagagaatggtgtttgtgggcgactcagtcaacaggaaccaatgggtctcttctgtgtgcatggtggaggcctcaatacctgacgacaggctcaagatacgcaccttcaatggctcactcatctcctttcaggcattggaatacaancgcacgatagatt

SEQ ID NO: 61528 - DNA, 420 bp, Zea mays
  Clone ID: LIB3069-052-Q1-K1-D2-N1
ttgttttgcaacatacctgagatatatagaaaccgtacaaatgcaccgacaactaaacatagaaatagactacaaactcgttcttcattacactataacacatatttatgcatacgatatggcactattctatgatcccgatgcaacgcacgggcatacacctacatatatataaggggcaaaacgaacctgactgacagttatggacatcatttttgcacgaggtagccatataaaaactcgctccagacataaggaactccggggaggcaccagcgcgtgcaatccgtggaactggatgggtctgcaattagctctttcgatagaggagaaaactgtttcctgcacaccgtaggacgcccgcccttgcggaatggagacagctacgcgatgtgcagcatctgaacatgtatgcctttc

SEQ ID NO: 61529 - DNA, 471 bp, Zea mays
  Clone ID: LIB3069-022-Q1-K1-C8-3Aa
cgctgcaactaaaggccataacgagatcgtcggattgttgctcgagaacggagctgatgtgaattccttaaattattgcggccagacagcattgatgcaagcttgtagatacggacattgggaagttgtgcaaactcttctgctttttcgatgcaatgttacaagagctgattatttatctggaagaacagcgcttcatttcgctgctgtgaatggtcacgccaggtgtattagacttgtcttggctgattttttacctagggataaacttaactctctttctgaaactggtgttgtcactgcaaagaacaaatctgagcaaagcgcattgtctaaatttgtgaataaagcggctgatggggggataaacagctattcacaaggctggcttggatggattatttgattgtgtgcagcttttgcttgatcttgaggccaatgttttcgatgggacattttattttggaacat

SEQ ID NO: 61530 - DNA, 656 bp, Zea mays
  unsure at all n locations
  Clone ID: LIB3069-025-Q1-K1-A10-135a
gtatcttcgatgtcgatgtcgatggggtgcacctcggcaccgcagctcgccctggcctcggccaccaccaccacctccttggcgtgctccggcagcttcgcctcctccaccgtcacctccaccgtgaccgccgcgggctccttgttcctgtacgccatgtacagcgccatctgcgcgacgccgaagacgaagcccagcacgttggggaacgccacgaacacgtccctcttcagcgcgccgtacgcgaaccagatcacggcgctcagcaccaggaagaaggagagcgagatgggcatgaactccacgctcttggtccggaccacctgccgcatgatgctgagcggcgcggcgaatacgctgagcgcgacgctgacgcagatccatccgagcacgcgcacgcggaggccggcgctggagaccaccatggtggcgagcgcggcgagtccaaagacgccgacgttgagccccagcagcatcttggccgtgagcgccctggcggccttgggcgcgtacaccaggtacgcggccaggtacgccgnctcgatcacgcacccgacgccgttgatggtcaccagcagctcggcgccggacttgagcagcgcgtagaagatccacagcatgcagctgaacagcgtcaccacgtacggggtcgactg

SEQ ID NO: 61531 - DNA, 583 bp, Zea mays
  Clone ID: LIB3069-025-Q1-K1-A10-136a
acacgacctgatggccagccttatgcgagcacaactgcacaagtctacaccatcagtccatcacacagcttaccagcttttactagtgacatgcatactactacagtaggtcacagtggactacagtctacagaagcgtgattatgactcaactgaaatgtaatttaccaagtatgttcggaaatattcactacgctaataaaagagaaagatgtccaagctttacaccgagacgtgccctttgcatatgtactcccatgtctgaaagctttggctccgatcctacgagtgagcgagcgcccgttttgaaaatggcatcgctacttacaatatctccaaatggggcttatgatcgcacgaacggtttttaattacttcaggatcttgaattgatcttcttcaagcttaatcctttggtttctgggacgacgaggatcacaaacacgagggagagcactggtatgacgccgaacaggaaaaatatattggctggcccgaggagctccttcaagggtgaaaacgcaaatgtcaccagagcgttcgagccgaaatttgttagtactgcgaggctgatcccacgccc

SEQ ID NO: 61532 - DNA, 692 bp, Zea mays
  Clone ID: LIB3069-035-Q1-K1-H2-137a
tacgttgagcgagcgcccgttttgaaaatggcatcgctacttacaatatctccaaatggggcttatgatcgcacgaacggtttttaattacttcaggatcttcgactcgatctcctccaggctcagtcctttggtttctggaacgacgaggatcacaaacacgagggagagcactgctatgacgccgaacaggaaaaatatattggctggcccgaggagctccttcaagggtgaaaacgcaaatgtcaccagagcgttcgagccgaaatttgttagtactgcgaggctgatcccacgccctcttgtccgagtggaaagatctcagataccattagccaactaattggaccaaatgagacctggtaagcaccgacatatagaagtaacgcgccgacagcaacaaaggggaagttgttcaggatcttgtagtaagctgccagtaggaagagtgacaaagcaattccaccaacacctcctatcaataatgggcgccttccaacatcgtcaactttaaataccgcaacacctgaagtattgaagcagcataatatagaacactcggttgacctgttatctgctgaaacagaaccagacctccgccaatagtgaaggccttcaagctagctccttcaaatacatcccaaacgtttccttcagcttcctgtcctgcgtaggcagccttaatagagaca

SEQ ID NO: 61533 - DNA, 676 bp, Zea mays
  Clone ID: LIB3069-036-Q1-K1-B11-138a
ctgttggagctgctgtgcccgcagaccgtctcctgcgccgacatcctcgccgtcgccgcccgcgactcggttgcacaactgggaggaccatcgtgggcggttccgctgggcaggagggacgcgaccacggcgagcgcgtccctggccaacagtgacctccctgggcctaccagcagcctcaacggcctgctcaacgctttctccaacaagggtttgagcagcaccgacatggttgccctctcaggtgcccacaccgtcggccgggcgcagtgcaagaactgccgggcccggatctacaacgacaccgacatcgacgcctccttcgcggcgtcgctgcgggccagctgccccgcgcaggccggcgccggcgacggcgcgctcgagccgctcgacggctccacgccggacgctttcgacaacgcctacttcggcgacctgctctcccagcgcggcctgctccactccgaccaggcgctcttcggcggcggcggcggcggcggcggcggcgcgacggacggcctggtcagcgcctacgcgtccaacgccggccagtggggggccgacttcgcggcggccatggtcaagatgggcagcatcagcccgctcaccggcacggacggcgagatcagggtcaactgccggagagtgaattaattatttattacagccacgttga

SEQ ID NO: 61534 - DNA, 196 bp, Zea mays
  Clone ID: LIB3069-05-Q1-K1-E2-139a
atagctaccgatggaaaagaacagcaggctaaatatttgttgtatgggattgggtggacaaggttagatttgtcggtgtgtagcagtaaccctagcccttttctttgagaacaaaaaaaaaaaaaaaaaaaaaaaaaaaaaaaaaaaaaaaaaaaaaaaaaaaaaaaaaaaaaaaagaaaaaaaagaaatacaaaa

SEQ ID NO: 61535 - DNA, 564 bp, Zea mays
  Clone ID: LIB3069-05-Q1-K1-E2-fa
attgtgatggcaactttatttcatcaatggttgcacaaacaaagcaagaaagcaacattactagaacaaacaacaagctccaatcaggatttatccttaattgatgtgaataattagaaccattttgacaaaacataagccacagtttacaaagatcagcaatcatgtctacattgacaaatcattcaggggatcacaatttggaataaaactttattacgcgtcagccagaaaatagccaacatggtaacatgggaaactgagcatcgacggcgccaaactctctgagaagtcccaagttccgctcaagcgtctgcttccacaaggacaaaaactggcctgtccccaagcttgtctcggcccttcagttctggcaattcaatgacacaagcacactcaacaacctttgctccaacacgttcaataagtttgacagctgcacatagtgttccaccggtagcaataagatcatcgactacaagagcccggtcgttggcctgtacagctccgacatgcatttctatcttgtcagttccatattccaaaaatactctttggagatca

SEQ ID NO: 61536 - DNA, 193 bp, Zea mays
  unsure at all n locations
  Clone ID: LIB3069-050-Q1-K1-E7-140a
ccgctctcctctcacagnacgctgcaggattggggttctcgtcgtcgaagagcggtacgacgagtcgtgcataggcgacgcgtgcatcccgggcgggccgtagtagtcctgctggtagtaaggctcccggcccggcgtgcgtaccgatgtcggtacacgcaccacgttccgctgcgtggcggtgacctgagcg

SEQ ID NO: 61537 - DNA, 457 bp, Zea mays
  Clone ID: LIB3069-051-Q1-K1-D3-4Aa
cctagtctgtttggcgcaaagatcaccggcggaggctccggcggcacagtatgtgttgttgggaagaactgcgccaggagcagtgaagagattgcagagattcagcacagatacaaggctgagaccgggtatctgcccattcttttcgacgggtcgtctccaggagctgggaagtttggttacctgaagatccgacgtcgttgtccctagtggctgattgggaaacgaagaacttcagttcgagctttgtcacatatcactcaattgttaagaacctcactccaactctccaagccattgtagaacatagaggcgtattgccacttgcgatgattcgtcgttcacacacaaaatattatcatgtgctacaccaaattctggaagctactagaaggaaaatgtggaggaatataaaaagaaaactcttgtttgagcaggatgtaaagtctaagtgggt

SEQ ID NO: 61538 - DNA, 634 bp, Zea mays
  Clone ID: LIB3069-051-Q1-K1-D3-5Aa
ccccttggatatctgctacaaactcttcaatacaggggaaaacactttacagagcttgtcaactcaagccatacaaaaaagtttcttgctgcgagccatgtgtcatgagtcatgcgagccttggactatcagatttatgcgcttgccgctatcaatgcggaggacatcattttttaggcccagcttcacctgattggtatcgacagaaaaccatctcaaaagaaccccgaggtggaccactgctgggatcattttgaatagcagaggggttgtcaccaaactgagtgcagcggctccaagaagaagcaggtatagctcgccctcgatgagatggatactcgaagcacggcttaagagaacaaaagcaaactctgctatttgtgcaagagacatgccgacaagaagagatgttttgttgctatacccaaacccttttacgacaatagcaacaataaatgtctttacggtgatcaccaaaattaccgctgcaaggagtatatccacatgggtccacaagacatggacattaattagcatcccaatgctggcaaggaaaagagcagcgaataagctgcggataggttcgatttgttcaagagtatgttgcgcaaggactgtcgttgatatcattact

SEQ ID NO: 61539 - DNA, 434 bp, Zea mays
  Clone ID: LIB3069-052-Q1-K1-F8-6Aa
ccggggcgaaattggcatacgctactcacgagggctcaacaaagggggacttatgactcgctcagaacggtattttaactaactttattttcggtcgacgtcgatgctcctccaggcgcagtccctttggtttctgtaacgaccaggatcacaaacacgagggagagcactgctatgacaccgaacaggacaaatatattggctggcccgaggagctccttcaagggtgaaaacgcaaatgtcaccagagcgttcgagccgaaatttgttagtactgcgaggctgatcccacgccctcttgtccgagtggaaagatcgcagataccattagccaactaattggaccaaatgagacctggtatgcaccgacatatagaagtaacgcgccgacggcatcaaaggggaaggtggttcaggatcttgaggtaagctgc

SEQ ID NO: 61540 - DNA, 683 bp, Zea mays
  Clone ID: LIB3069-052-Q1-K1-F8-7Aa
gtaaatttaactcttgaagcaaagagcagcaacgaacgcccgccgcctagcaaaagcagactctttttttcgcctccgggaagggaaaaaaagaaagaaatggcaagggaaaagacacgacactccgagtgctccctctcgctcatcgatcgatcaggtctgtggccgccgtcgcgcatcacttgctggagggctctccctccacggccagcggcacggtgctcgccatggtgcggtacttgagcgcgtacagcatctccaggtaccgccgggtctcgcgcctctccaggttggacacgtacttccagaacccgtacacgccggtgagggtcatcagcctctccgagtagagcttccaggtgtacttctcctcgatacgctggagcccgccctgggagatcttgctccagtggctcgggtccgcctggcacttgtcgaagaagtccacgagcagggccgacgccttgtcgccctggtaagggtcgatgtggtagccagacacgccgtgcacgatgatctcggccggaccgccgtaggctgtggcaaacgtgggcaggccgcaggtcatggcctcaaccaccgtcagcccgaaagcctcgtagaaagcaggctgcacgaaggcgcccttggtgtcgcagatgtagcggtacagctcgccgttgcggacgcggttcatctgggcg

SEQ ID NO: 61541 - DNA, 718 bp, Zea mays
  unsure at all n locations
  Clone ID: LIB3069-003-Q1-K1-E2-TGA
cctaagggcanacagccaaatgccccaccacagcgtagcccctcctcactgactcgcctgcaaaaaccacttgcaaaccacacaaaccgaaaacgccagctcccctgcctccatttttagcaacttttcccttctgtcttcccatcacagtcacccttcttgcccccacgcagccgagcgtgcctacccctcctcgacccttctctggggccgccgttggacgctcatggagaggagtcgtccgggcgccgcgccgaaaccatcgccagaggaggaggtggcggcggagggccatgcgcatggtgacgatgtgacggggcaggaggaggaggaggaggcgacgccagtggtgctcaagaagggcccgtggacggcctcggaggatgccatgctcatggaccacgtccggcaccacggcgaggggaactggaacgcagtacagaggatgaccggcctgctgcgctgcggaaagagctgccgcctgcgctggaccaaccacctccgccccaacctcaagaagggctccttctcccccgacgaggagctcctcattgcccagctccacgcgcagtttggcaacaagtgggcgcgcatggccgcgcacgtaagcaccctatcctttgccctggataacaaatttatttatggcgagtggcggcaacctgctgatgtgactgacgtttgcgaagttcttcctcgagcgaattccgagcttact

SEQ ID NO: 61542 - DNA, 444 bp, Zea mays
  Clone ID: LIB3069-004-Q1-K1-E8-TCA
tctgcttgtgctcagctccagctcactggctggccaccgagacttctggacaggaaactgcaccatcctcttctcccagcaagggggctccagagactgcccacccaggaagtctggtggcctggggatttggacagtgccttggtaatgaccagggctccagaaagagatgtccttgtggctgggggcccctgtgcctgacattcctcctgactctgcggtggagctgtggaagccaggcgcacaggatgcaagcagccaggcccagggaggcagcagctgcatcctcagagaggaagccaggatgccccactctgctgggggtactgcaggggtggggctggaggctgcagagcccacagccctgttcaccagggcagagcccccttcagaacccacagagatccgtccacaaaagcggaaaaagggggccaggcccccaaa

SEQ ID NO: 61543 - DNA, 354 bp, Zea mays
  unsure at all n locations
  Clone ID: LIB3069-004-Q1-K1-E8-TGA
taggtgacactatanannnnnnnncccnnnnnnncggncnctaaattacatcgtcngggctacttgttcatctcctattcttcaagccgtaggcaccccggtcgctagtccgtggtacagcgcaagaaaagaggaagctgagtcatggaagccgctccacatgtcacgcacttctgcccgcggcctgatctcctgaagcatcagctctggtttaacagacacattgttacggcgtaaaaaccctccttcgtgtgcttattcagcatcagcagcaactcttgttgcctaggcaacagctgtaagtttgatcttgttttagcttctcaacttggatcttgagctcttttgatgtac

SEQ ID NO: 61544 - DNA, 326 bp, Zea mays
  Clone ID: LIB3069-004-Q1-K1-F8-TCA
gacagaggataattttttttggcgccctgtgggaaaaacaggaagtggtggatgcaggagtgggctaaactttggggaacccttctcttagaggcccccaagcccatccgtttggggggtcagcatgatttttatacacagtatatttttagggagggctccactgcttagtagccacaaaactcccaacccttttgcttttttttaatgccacgggaggatctccttggccatctcccaggaatgtttgcccttttaagtctgttgcacttctaggagggagtcaccaggcctcagtcattcggccaagaaaactgatatttttg

SEQ ID NO: 61545 - DNA, 620 bp, Zea mays
  Clone ID: LIB3069-025-Q1-K1-G6-TAA
gcgacgaatgtttctctgtttgttctcagattttcgatgtctgttcacggttccagcatatgcctatatcccatattacagaccggcccagccagccatcaattggcccattccggcccagttactcggacgctgccgcgcttgatacgtcgaggccgagctgagacatcgcctccttctgtcttcgccgtcagatccttcttggccatggttcttgtgtcttccggtacagcagagctgacattcccccggtcttgaaacgcggcttgcccccaagccggtgcataaggaaaacgcgccttcagtgcatcaacatcttcccacgtagccattgcggtgtccattccagaccatgcaactttgacttgagtcaccatagaaccaccacgccggattaatcgacgttgaagaacctgtatgggcacctgaagtgaatcattagtctcaggtagtaatggaacgatgtgctggggacggttgacagccgactggagttgagatacatgaaaaagggggggaatctgagaggaagcgggcaactgaagcttgtaagcaactggcccgaggcgctgtaaaatttggaaggggccgaagaaccgaaaagcaagcttttgatgggc

SEQ ID NO: 61546 - DNA, 610 bp, Zea mays
  Clone ID: LIB3069-028-Q1-K1-E5-R4A
tccttcctggattctggcgtacgcaagtgatgccactttctcactattgaacttctcccatttcttgccgttgaatgtcttgtaaaatggaactatctgctgtggatccgtcatattgatgaatgcatatcccacgttacatttattcttaaaatcaattggaaggtagatgaaatcataagttcctcggtgattctcatcaatgacagccaaaagcagcttactggtgtacttgttaggaatgttttttatcatcagtgtggtgcgcgagtcttcacccttagctatgcggtcaaggtccagctcaaactgcttcttgttttcagactgggcagcatttccatcatgcctgcggctccttatgcgatcattagtggcgtcatatgaggtggagacgtgcatcataggattccttccgttggtcgcatgaagaatttgctgaattgatggaaacccggcacttatggcagagaacatggtctccctgtaatttcctctggcagatgcaaatacagagagatctgatggatacagctgaaggctgccaggaaaccctacgctttcaggggatctggatgaaaagagtgtgcatttgcaaacccaccacact

SEQ ID NO: 61547 - DNA, 375 bp, Zea mays
  unsure at all n locations
  Clone ID: LIB3069-029-Q1-K1-D11-TCA
gacctcaccgctnaaggcattcttccnccgcagcgtgatcaacggagcgcactacatctgccacagtggcggccactgccccatggacacctacatgcgtcccatgtgccaggagtgtgggcttctcaaatgccgccaggctgccatgcatcaagagtgtgtcctgtcagaagaacagatccgcctgaataatctgatgctgtaagaggaggaacaggctcatgccacatccttgccccccagggcttactaacccccccaaatcctgccccagttaactccggaacaactggggatgatcgagaaacttatctcttgccagcatcagtgtaacccgggctccttttctgaccggtcttcgaattaacggccttg

SEQ ID NO: 61548 - DNA, 479 bp, Zea mays
  unsure at all n locations
  Clone ID: LIB3069-055-Q1-K1-A9-F4A
ctacngcgggtggaaggccgccgctgttggggccaacagccaggccgcgcagtccatgctcaagcaggactacaaggacggcttgacccgcgaggaggccgtcgccctcgcgcttaaggtcctcagcaagaccatggactccaccagcctgactgccgagaagctggagctggccgaggtgtttctgcagccgggctccggggaggtacagtaccaggtgtgctctcctgaagcgctggggaagctgcttgcaaagtccggcctgacacagccaacacccgaggcataatgctctgttttgctgtggcttgtgatgcctactactgctcttagacatggtttaagcatttgtgcttctgttgtgtgaacttgaatattcgacgattatgtggtctaattttatgttgagcatcctagatacgttaatgtttcatctgtaactgtggattgccttgaactggttgcaaaatggtgatttc

SEQ ID NO: 61549 - DNA, 350 bp, Zea mays
  Clone ID: LIB3069-055-Q1-K1-A9-R4A
cgcacgcaggtgggagtcgatcttgtacatcttctcggcggagcgcgaggtctggaggagcttggaggtcaccttcttctcgccgacgaggaccacgccgtcggccgctaggatcccgagggctgacccggcgttgccgatcgcctccatcgcgtactccacctggtagagacgcccctccggcgagaagatcgtcgtgcggctgtcatagcggcgagacatcgcggcggcggcgagatggggtttgcgtttgctggattgaggtggtgacggcgagattggggcttgcgtttgtggaacttgagggggaggcgactcgggaggaataacaccgcgagcggacgcgtggg

SEQ ID NO: 61550 - DNA, 468 bp, Zea mays
  Clone ID: LIB3069-028-Q1-K1-E5-F3D
tgggaggaggacgaggaggtgcagagccccctcgccttcaagaagccccgcctcctcatgaccgcgtgaaaccgctgcgcgcgcgggcggcggatctcatctcatcacccgtccaagattttggtctgcagctgccgagttcagcggtggaagtggaacacactattcgttcattcatttcgtatggtgccagtagcgctattgtttgatttttgtggctgctcctcttgtacagtaccgagtgcgagaaaagatgcatagtcatcgtatacataccaatacaataccgtacctataggtcttcctattcctgtggaagagtagaacttgtatccttattagctgtcagttcatacacacttggttctcattaccagagatcattggtgaattagtggttttgtatcataagcttattgtaaatgatggattggagattagtatggaatcagataccccatttgttcc

SEQ ID NO: 61551 - DNA, 675 bp, Zea mays; identical to SEQ ID NO: 5510
  Clone ID: LIB3069-003-Q1-K1-G12-R4C

SEQ ID NO: 61552 - DNA, 686 bp, Zea mays; identical to SEQ ID NO: 5511
  Clone ID: LIB3069-003-Q1-K1-G12-R4D

SEQ ID NO: 61553 - DNA, 583 bp, Zea mays; identical to SEQ ID NO: 5512
  Clone ID: LIB3069-025-Q1-K1-G6-R5B

SEQ ID NO: 61554 - DNA, 578 bp, Zea mays
  Clone ID: LIB3069-025-Q1-K1-G6-R5C
gggccgaagaaccgaaaagcaagcttttgattggcccgagttgtgactgatgattgtacgtacggttgtaacttcaggtactcctgatcgccgacgctaaaaatccgttcagaacgtcgtttatccgcctgacgtttcatgcggtcctgggcacgtaacagatgttgctgaaccaacttggataccacctcacgatcgtgaagccaagtagacagatctgaaacagtcactgcactccctggttgcaagccgaagtgccgagggggctgtccatataacacctcaaatggagaacaattcagagctgaatgaaagttggtattataccagaactctgcaacagctaaccattggtaccatttgctgggacaggcgtgcacaaagcatcgcaaataagtttcaatgcactagtttacgcgctccgtctggccatcggattgtgggtgataagccgaactcatgcataattgggtgccactgagagtgaataattgctgccagaacagacttgtgaacactctatcccgatcagatactatattgtccggcataccatgaagcttatagatattatccaa

SEQ ID NO: 61555 - DNA, 204 bp, Zea mays
  Clone ID: LIB3069-025-Q1-K1-H6-R2BA
tgttcggctgcaccaagagtatctccttcctgaaggccttgtataggcacccacaccaaggcattatcaagcactcagctcacttgacagaacactggcccaaaactaatcgtgctcctggcctgcttgctcaaaggagcctaacactggcttctcgaaggcatcatggaccgatgtatggtccttgattctacaagggactcc

SEQ ID NO: 61556 - DNA, 122 bp, Zea mays
  Clone ID: LIB3069-025-Q1-K1-H6-SP6A
atcgtaacaactaattgtactgttgccactggggcaaaacatggcatgtttttagccactacactaaaatcccctcaaaaaaggccctttgacatttcccggggctggacacgacccaaaaa

SEQ ID NO: 61557 - DNA, 663 bp, Zea mays
  Clone ID: LIB3069-028-Q1-K1-E5-F3C
aaaatcatgctcacaaatcaaagttgagcatagcttttctggaggagcaggatcttgcttcgcagagcaatattcaggagaacagatgcaaaatgccgtagctcaccaacttaagaactctccacctgggaccattgggaagttagatactaagagttgggacagcagcactgttcataatttatattctccagttagaccgcaacacgataaatcacaacatggcttctctgtgaatcctcctcagaagttgtcatcgcctatcagaattgaatctacacagcagcatagtaatcaaactgcttttggtgaacatagtggatctcttggtcatggcaactttggaggtgggctgcaagccttccacccgcactcactgccagagtgtcacaatggtatttgcaatggctataactccatgacattaaatgcaaggaattctaacttcagatttactgaaggaatagactacaataatcacaaagttgaccacagtgaccttcatggtcattcctctgatcaaaatgaagcaattagagttgctggaattggaagttgcccccttcatggacatcactatacctggagtaactcaaatggttttcctcaaagcccctctgctccaatgatgtgggctaactttcagcaaccagtgcatatgca

SEQ ID NO: 61558 - DNA, 728 bp, Zea mays
  Clone ID: LIB3069-028-Q1-K1-E5-F4B
tgaatctacacagcagcatagtaatcaaactgcttttggtgaacatagtggatctcttggtcatggcaactttggaggtgggctgcatttcttccacccgcactcactgccagagtgtcacaatggtatttgcaatggctataactccatgacattaaatgcaaggaattctaacttcagatttactgaaggaatagactacaataatcacaaagttgaccacagtgaccttcatggtcattcctctgatcaaaatgaagcaattagagttgctggaattggaagttgcccccttcatggacatcactatacctggagtaactcaaatggttttcctcaaagcccctctgctccaatgatgtggcctaactttcagcaaccagtgcatatgcattgctaccctgctatgcctcctcacatccggcgcagtgctgcccatcctatggaccaacatcacttgggttcagctccaaacagtgttggtggttttgcaaatgcacactcttttcatccaggatcccttgaaagcgtagggtttcctggcagccctcagctgtatccatcacatctctctgtatttgcatctgccagaggaagatacagggagaccatgttctctgccataagtgccgggtttacatcaattcagcatattcttcatgcgaccaacggaaggaattctatgatgcacgtcttcaccttatatgacgccattaatgatcgcataa

SEQ ID NO: 61559 - DNA, 529 bp, Zea mays; identical to SEQ ID NO: 29079
  Clone ID: LIB3069-028-Q1-K1-E5-F4C

SEQ ID NO: 61560 - DNA, 472 bp, Zea mays
  Clone ID: LIB3069-028-Q1-K1-E5-R5B
tacttcattttgcttctgttctcctgaatattgctctgcgaagcaagatcctgctcctccagaaaagctatgctcaactttgatttgtgagcatgatatttcacccttgttgaggtcattcagtgcttcttgtgctgctctgatatcatagaattctacaaatttcttattgcagcttgtaggagacttgtaaatctccttgacatcgccataaacactaaatttttggagaagatcatggctggagatggaagagtcaataagagataccaccagtgttccattgttgggatctttgtttggaacattttccttaggaagggaaaattgaacatcaagtttcatcagccccagaggtttgttatggactgctctcactgcgtcctgtgcagctctaatgtcatagtaagacactgtaacaattccatggctcttgcaggatgtgtcgaatgtctgtacgtccccatattgc

SEQ ID NO: 61561 - DNA, 460 bp, Zea mays
  Clone ID: LIB3069-028-Q1-K1-E5-R5C
cttctgttctcctgaatattgctctgcgaagcaagatcctgctcctccagaaaagctatgctcaactttgatttgtgagcatgatatttcacccttgttgaggtcattcagtgcttcttgtgctgctctgatatcatagaattctacaaatttcttattgcagcttgtaggagacttgtaaatctccttgacatcgccataaacactaaatttttggagaagatcatggctggagatggaagagtcaataagagataccaccagtgttccattgttgggatctttgtttggaacattttccttaggaagggaaaattgaacatcaagtttcatcagccccagaggtttgttatggactgctctcactgcgtcctgtgcagctctaatgtcatagtaagacactgtaacaattccatggctcttgcaggatgtgtcgaatgtctgtacgtccccatattgc

SEQ ID NO: 61562 - DNA, 489 bp, Zea mays
  Clone ID: LIB3069-029-Q1-K1-D11-F2B
aacaaaagttttatttctattagtgggagccctggccggtgagaggtgacaaacactgtcaagaaacaggaggtaatgacggtccatgcaagatgcaacagacactacgtaagagtggatgcagaggaaaggggtacacttggtctctcgccctcatatttttacgccttgttctcctccttgccgggaggaaacttggggaacttgggaaagaaggggttcttttttatgaaggggagcagcttcttgaacttctcagggtccgtctcggggttctgtgtcttgtgctcagctgcagcatggtagatcggggtgggcgtcgggtgaggtggcttgtactccggcacgggcgagtggcggtacatcggcaccatgggcttcttgtggatgtgagggatgatcaacatgggcttcttgtgcaacaggtgcttcttgaacaaatggtagaagaggaaagcagaggcgcactcctttgatgggtagtgcacc

SEQ ID NO: 61563 - DNA, 459 bp, Zea mays
  Clone ID: LIB3069-029-Q1-K1-D11-T7B
cccacgcgtccgcggacgcgtgggctgctaccgagttaagtatattctgagctcgtctgcagccaaaagcttccatttgcattgcgatgggggctctacctcgtggcctgctagctggcatctgcgccgtcttgttagcagcagtggttgcccttgcccatggtgcggaacaggaaacagcgtcaatggtggtcggcttggccaagtgcgccgactgcaccaggaagaacatgaaagctgatgcggcattcaacggccttcaagtggctgtcaagtgcaagaacgccgacggcgtcttcgagaccaatgccctcggtgaggttgacaagtccggcagcttcagcgttcccctcccggctgacctcctccgcgaggacggcgagctgaagcaagactgcttcgcgcagatccacagcgcggacaacaagccatgccccggacaggagccgtcttggatcg

SEQ ID NO: 61564 - DNA, 267 bp, Zea mays
  Clone ID: LIB3069-029-Q1-K1-D11-TAA
aggggccggccttttattcggggctggcttacaacaggagttttcttaatgttaatggacccccggccggggaaaggagagagacactttcaagaactaggtggtactgaccttccacgcactttccaacggactctacgcaagattgcatgctaaggaaagcgggacaatgggtctctcgcccctcaatgtttacgccttgctctcctctttgccgggaggaaactgggggaacttgggaaaaaaggggttcttttttatgaaggg

SEQ ID NO: 61565 - DNA, 251 bp, Zea mays
  Clone ID: LIB3069-029-Q1-K1-D11-TGA
agacgaggcgacctacactgtgttgaaacatgaggtcatgacggtccttgctagatgcgacagacactacctaagagaggatgacagacgactgggatacacttggacgttatgactgatcatgctacacgcagctgtccttcttgacgagaggaaacttagggaacgtggcactgaaggggttcgcccttaatgaaggacaccatgttcttcaacttgtcaggaggcaactcggggaactggggaaagaa

SEQ ID NO: 61566 - DNA, 313 bp, Zea mays
  Clone ID: LIB3069-037-Q1-K1-B1-F4B
ctacgggctggcggcgggggtgttcacgcggagcctggacgcggccaacaccctgtcgcgggcgctgcgggcgggcaccgtgtgggtgaactgctacgacgtgttcgacgccaccatcccgttcggcggctacaagatgagcggcgtcgggcgggagaagggcatctacgccctccgcaactacctccagacaaaggccgtcgtcacacccatcaagaaccccgcatggctgtaaatcacatcctccgtccttgcccgcacggcgctgcgccggttctcggagaacgtgacgaataaaacaaacggtttggtt

SEQ ID NO: 61567 - DNA, 306 bp, Zea mays; identical to SEQ ID NO: 5506
  Clone ID: LIB3069-037-Q1-K1-B1-F4C

SEQ ID NO: 61568 - DNA, 240 bp, Zea mays; identical to SEQ ID NO: 5513
  Clone ID: LIB3069-037-Q1-K1-B1-R4B

SEQ ID NO: 61569 - DNA, 254 bp, Zea mays
  Clone ID: LIB3069-037-Q1-K1-B1-R4C
acgcctggtcgacgtcggcgtcgtccatgacgatgaaaggggacttgccaccgagctccagcgtcaccggcttaaggttgctcctttccgccagctcgagcacgatctgccccgtgcccgtcgatcccgtgaacgcaagcttgtcgacacccatgtggctggagagcgctgcgccggccgtcgggccgaagccggacaccacgttcagaacaccctcggggagcccagcctgcaaccggaccgcgtgggcggac

SEQ ID NO: 61570 - DNA, 539 bp, Zea mays
  Clone ID: LIB3069-037-Q1-K1-D1-F4B
attgctgcgcttttctatgataatacattttcgatatttgacttggatagtccagaccccttggcaaatgcccttcttcagccgcagtttcctggtacccttgtcttggagcttgattggttgtcaacccgaacaaggaaggatgaaccacttatgttatgcattgccggagctgatagtagcttccgactgattgaggttaacattgatgctaagggcagttctatttcgaagcccgtagctaccgaaagagaggtttaggccaatgccattttgtttgccagtattatttccaacggcccatgctttggtaaggctttgcgaatgattcttcaacttggggtgaagccttcttggtttgaatgcaataatagtgataaattaactggggaccagctttaaggtagcaccaacatttggagatcttcgtagttaccatgattgagacaacactccctcctattggtgacgccgttgtggctgaattgctccttaaagtgttggaaccatacagaaaggagggttgcatttctgatgat

SEQ ID NO: 61571 - DNA, 636 bp, Zea mays
  Clone ID: LIB3069-037-Q1-K1-D1-F4C
cgatctatgataatacattttcgatatttgacttggatagtccagaccccttggcaaatgcccttcttcagccgcagtctcctggtacccttgtcttggagcttgattggttgtcaacccgaacaaggaaggatgaaccacttatgttatgcattgccggagctgatagtagcttccgactgattgaggttaacattgatgctaagggcagttctatttcgaagccagtagctacgaaagagaggtttaggccaatgccattttgtttgccagtattatttccaacggcccatgctttggtaaggctttgcgaatgattcttcaacttggggtgaagccttcttggtttgaatgcaataatagtgataaattaactggggacagctttaaggtagcaccaacatttggagatcttcgtagttacatgattgagacaacactccctcctattggtgacgccgttgtggctgaattgctccttaaagtgttggaaccatacagaaaggagggttgcattcttgatgatggaagagccagcctatattcagctatagtgaacaagggagcttgtgcaagatttgcatttgctgctgcgaattttggtgatttccaagaagcacttttctggctacagct

SEQ ID NO: 61572 - DNA, 689 bp, Zea mays
  unsure at all n locations
  Clone ID: LIB3069-037-Q1-K1-D1-R3E
tagcttgtaccaaatacaaatgcttacgtatgtataaacagtgccaaccattggcacctacgatacagcactgcatgtctgttcctgcctcctgccatcagattctgccacatcagcagtcccgatgccatgtctggacgtctggtacctaccaacagacagaacaaaaagcttcgcatcagtctgccatgcgacaaggcgtgcgattcagtcagacgtcggttcggcgtccatgcagagatgaaccagcttctgctggtactgcccgaagacctcactgactgcgatcaggtcctcgtcggccacattcttggaagggaaccggaggttctccgtctgctccggcgtcggcgtcggcgtcagtgctaacacggaagtgtcgtcctcgggctctgattctgataaggcttgtgagtaggtctcgtggcaggctagcaagaacatggctgcggtatctgggcgctggctcttgcggagtgtatccaaagcctctggcagtgctccagcagcaacgtataggataagagctctccacatattgtgctcaccacgaagaacataatcggcccacctctgcagcacccttgcgtagtcagatccatgcanatggcttgcggccaaagtagctgcatcattccaacacccagcatcttgaagctggaacatgcttnctgatatctttcaacagc

SEQ ID NO: 61573 - DNA, 641 bp, Zea mays
  Clone ID: LIB3069-037-Q1-K1-D1-R3F
acatagctcgtaccaaatacaaatgcttacgtatgtataaacagtgccaaccattggcacctacgatacagcactgcatgtctgttcctttctcctgccatcagattctgccacatcagcagtcccgatgccatgtctggacgtctggtacctaccaacagacagaacaaaaagcttcgcatcagtctgccatgcgacaaggcgtgcgattcagtcagacgtcggttcggcgtccatgcagagatgaaccagcttctgctggtactgcccgaagacctcactgactgcgatcaggtcctcgtcggccacattcttggaagggaaccggaggttctccgtctgctccggcgtcggcgtcggcgtcagtgctaacacggaagtgtcgtcctcgggctctgattctgataaggcttgtgagtaggtctcgtggcaggctagcaagaacatggctgcggtatctgggcgctggctcttgcggagtgtatccaaagcctctggcagtgctccagcagcaacgtataggataagagctctccacatattgtgctcaccacgaagaacataatcggcccacctctgcagcacccttgcgtagtcagatccatgcaaatggcttgcggccaaagtagctgcatcattcc

SEQ ID NO: 61574 - DNA, 567 bp, Zea mays
  Clone ID: LIB3069-037-Q1-K1-D1-R5B
ctcgcggcaggctagcaagaacatggctgcggtatctgggcgctggctcttgcggagtgtatccaaagcctctggcagtgctccagcagtaacgtataggataagagctctccacatattgtgctcaccacgaagaacataatcggcccacctctgcagcacccttgcgtagtcagatccatgcaaatggcttgcggccaaagtagctgcatcattccaacacccagcatcttgaagctgtgaacatgccttctgatatcttccaacagcaccagagaagatgtgtgccagatagcgatttgtccgttctaaccatattggctgcaacaacccttcactgcaagttcatgccaggattgtgagactgcagatgacagcacaactgctcttaatgcatttgggtaaaaatttgatccttcagggggcgttgaaagtaacaatgaaaccgcagcctctaagttcccgagagagacaagctcatgaacatgcttttgcaaagcatcttcaccatcgagcttgtcatgcccaggtatcctttcacttgcattgaaccatagttgctcttga

SEQ ID NO: 61575 - DNA, 661 bp, Zea mays
  unsure at all n locations
  Clone ID: LIB3069-037-Q1-K1-D1-R5C
tctcgtggcaggctagcaagaacatggctgcggtatctgggcgctggctcttgcggagtgtatccaaagcctctggcagtgctccagcagcaacgtataggataagagctctccacatattgtgctcaccacgaagaacataatcggcccacctctgcagcacccttgcgtagtcagatccatgcaaatggcttgcggccaaagtagctgcatcattccaacacccagcatcttgaagctgtgaacatgcttcctgatatcttccaacagcacagagaagatgtgtgccagatagcgatttgtcccttctaaccatattggctgcaacaaccttcactgcaagttcatgccaggatngtgagactgcagatgacagcacaactgctcttaatgcatttgggtaaaaatttgatccttcagggggcgttgaaagtaacaatgaaaccgcagcctctaagttcccgagagagacaagctcatgaacatgcttttgcaaagcatcttcaccatcgagcttgtcatgccaaggtatcctttcacttgcattgaaccatagttgctctngattaaatgccatngagcttaattggccataattcgcagcatttttcgtgaccttttcagaagcagatctctctcttgaagctatccgattaaatct

SEQ ID NO: 61576 - DNA, 686 bp, Zea mays
  Clone ID: LIB3069-054-Q1-K1-A9-F4B
gcaggctagcaagaacatggctgcggtatctgggcgctggctcttgcggagtgtatccaaagcctctggcagtgctccagcagcaacgtataggataagagctctccacagattgtgctcaccacgaagaacataatcggcccacctctgcagcacccttgcgtagtcagatccatgcaaatggcttgcggccaaagtagctgcatcattccaacacccagcatcttgaagctgtgaacatgcttcctgatatcttccaacagcacagagaagatgtgtgccagatagcgatttgtccgttctaaccatattggctgcaacaaccttcactgcaagttcatgcatggattgcgagactgcagatgacagcacaactgctcttaatgcatttgggtaaaaatttgatccttcagggggcgttgaaagtaacaatgaaaccgcagcctctaagttcccgagagagacaagctcatgaacatgcttttgcaaagcatcttcaccatcgagcttgtcatgccaaggtatcctttcacttgcattgaaccatagttgctcttgattaaatgccattgagcttaattggccataattcgcagcatttttcgtgaacttttcagaagcagatctctctcttgaagctatccgattaaatctggagctttgttcagaatcaagatgtaaacttg

SEQ ID NO: 61577 - DNA, 656 bp, Zea mays
  Clone ID: LIB3069-054-Q1-K1-A9-F4C
gctggctcacgctcctaatcttttctgctgaggaatcgctcgctctggagcttacaacaggactctaactccatttggttttcagaacgaggatagaacactctgggaggcaacaaacacatatgtcgagatgagccctttcatgtctgcaaacaaaatcaagaaaccaattttacttatccatggagagcaggacaacaattctgggacattgacaatgcagtcagaccgattcttcaatgccttgaaaggtcatggtgcactgtctcgtttggtaatacttccttttgagagccatgggtactctgccagggagagtatcatgcacgtcctctgggagaccgataggtggttgcagaactactgtgtaaatggtactagcaaggttgactcagtgtcagaggctgacagtaaaaacaaaacattgtcagctagtggtggcagtgcagcccgtgaaggtctaaaccctgaggaactctcatcattaccaagatcgcttctgtgatcaacttcagttggtgttcatgaaacattccctggacagcaagcctaaagggaaaaaatagtgtatcgttgcacttctaccttaaccgactaccagggatgccttgattggcctcatatttgtttcgattgctgcaggtgatcatgttact

SEQ ID NO: 61578 - DNA, 90 bp, Zea mays; identical to SEQ ID NO: 5507
  Clone ID: LIB3069-054-Q1-K1-A9-R3G

SEQ ID NO: 61579 - DNA, 81 bp, Zea mays; identical to SEQ ID NO: 5514
  Clone ID: LIB3069-054-Q1-K1-A9-R3H

SEQ ID NO: 61580 - DNA, 277 bp, Zea mays
  Clone ID: LIB3069-054-Q1-K1-A9-R5B
aaacccaagccctccaaacagggttgaagcaccagatctcctggggcttggttctgctgagtttcgcacgccactcggtaactcagaggatccttccttcattgaacttgctctgctgtacacacccggatgatctcttttaggaggtattggaagtgcagctagcaaactaagacccgatgctgacatgactgtagatgagcgcacaaccttaggtgcctcaattctaggagactccggttgccaagccaggggtcaagaaacaaccctaacaatt

SEQ ID NO: 61581 - DNA, 467 bp, Zea mays
  Clone ID: LIB3069-054-Q1-K1-A9-R5C
tgaatcataccctgggggcaggtgtaagtttgctgtaagttgaactccatccttccgctggtatcttatcatttccttatacaatgaagtacgctgaggatatgggtgggggaaatttgttatcttaacttgattcttttctggccaagtctgcaagtaatattgtgtgttttctgtttttgattctttcgacgtaagtatctttaactgatcaaggagcagttccccgtcagttttgtctgacatcagtgcaacaacagtttcatagtacttttccctgtcgctctcccatatacgctctttactcccagtatttatatcaaacaaatcgaggaatggaacatttccttctggtgtggcacccatcccattcaacaagacataaatatttccgtcttctttcttgatctttgcgatgacatatgttcccatcacagttcttcgcatcattggtgcccacgcgtacg

SEQ ID NO: 61582 - DNA, 624 bp, Zea mays
  Clone ID: LIB3069-054-Q1-K1-C12-F5B
tcttttgtgaattacacaacatagtatcttcctttacagaagcttactgggaataccgacttaagccatgggatatggctgctggcgtcctgatagtagaggaagctggtggggtggtaactcgcatggacggtggagagtttacggtcttcgatcgctctgttcttgtttccaacggacttgttcatggacagcttttggaccggatcggccctcctactgaagaccttaagaagaaagggatcgacttcttgttgtggttcaagcctgacaagtacccgactgacttttgagctgcaccaagggcaccactcaccagccattggtcactataataaagcaccacatcatctcatcttagggatggggggggctatagctactacaatcacaacagctgttataccgtatgcaccagcgccaggtctaccatcaacagtgacaatggaaacatgatttgatttaaacaacatttgcagctcctctctgagatgattgacctggctgaacaacttagcagtatgtggactgctggtagacggcccattcttgcctggctttgcactcttggtcaagaacttgaaagcaccaaagattgcatcccctaagtcgggaaggccaaac

SEQ ID NO: 61583 - DNA, 495 bp, Zea mays
  Clone ID: LIB3069-054-Q1-K1-C12-F5C
gctgctgacatgtccacattggacttggtattacagaagcttactgggaataccgacttaagccatgggatatggctgctggcgtcctgatagtagaggaagctggtggggtggtaactcgcatggacggtggagagtttacggtcttcgatcgctctgttcttgtttccaacggacttgttcatggacagcttttggaccggatcggccctcctactgaagaccttaagaagaaagggatcgacttctcgttgtggttcaagcctgacaagtacccgactgacttttgagctgcaccaagggcaccaccaccagccattggccaccataataaagcagccatcatttttttttgggggggggggggtccttcaagaagaaacaataatgtttttagttcaatagcactgtacttgtaatggcaatacgatgtacagttctttgactcgagtttcaagagagccaagctcctgaaagaacagagcttcacaagtg

SEQ ID NO: 61584 - DNA, 479 bp, Zea mays
  Clone ID: LIB3069-054-Q1-K1-C12-R5B
cctccctcccaagtatgaggtggtctttgaagttcttggtgacaacttccaaaatgactgattcactcaacttgtctgtgtcggtcaccaggtctgcaacacctttatagtggatattgcgtggcttattaacagcttccattataacatcggccccagcttttgcggcggcctcgatgactccgagcagctcggcggcggggatcgggccggtggtaggggcggccaccttggggtacctggccggcggcgcggcctgctcggacgccaccgccatgatgtgccgcgccttgctggtcctggagccgagcgcacggaggcggaggggccgtgacgtcggcgagttcttgacgccatccttggggaggagggcagaggaggtggaagtgggggcgagaagataccgtgccatcggcgctcagagaaagggcttgatgcttcgattcccggcttctgtctcgtgtgtgcgtgcgcgctcc

SEQ ID NO: 61585 - DNA, 480 bp, Zea mays
  Clone ID: LIB3069-054-Q1-K1-C12-R5C
gtcttcctccccagtatgaggtggtctttgaagttcttggtgacaacttccaaaatgactgattcactcaacttgtctgtgtctgtcaccaggtctgcaacacctttatagtggatattgcgtggcttattaacagcttccattataacatcggccccagcttttgcggcggcctcgatgactccgagcagctcggcggcggggatcgggccggtggtaggggcggccaccttggggtacctggccggcggcgcggcctgctcggacgccaccgccatgatgtgccgcgccttgctggtcctggagccgagcgcacggaggcggaggggccgtgacgtcggcgagttcttgacgccatccttggggaggagggcagaggaggtggaagtgggggcgagaagataccgtgccatcggcgctcagagaaagggcttgatgcttcgattcccggcttctgtctcgtgtgtgcgtgcgcgctcc

SEQ ID NO: 61586 - DNA, 648 bp, Zea mays
  Clone ID: LIB3069-054-Q1-K1-G5-F3A
atcagggggatactacattacttgatgcagcctcaggtgatgatgaaaagatcaatgaggagcaagaggaggctgagttagcagttacgaaattttctggaaatggtgcgggggtcatgtctgctgctggtactattgctagcacattcgtattggtttttgttgctgaatggggtgataaatcatttttctccacaattgcactagcagcagcttcatcccctctgggtgtcattgcgggatcactagctggtcatgccattgcaacattgattgcagttcttggtgggtctttgctgggaacattcctgtctgaaaagattatagcatacattggagggagcctattcttggcctttgctgcgattaccatagttgagatagtgacttgaaaagggagttccagcttccacaattcataaaaagtactgatcttttgtcagggcaatgaaaaatcagcttgctgatcgtaatggtagtacattgatgtgttaccgaacatgattgtccacaggaacttcattgttcgcatgggacgtcctaggcttgcgtatagtagttagcttctggtgatgagaattattgcttctttatccaagaacaatgtttttgtcatcatcatgatttgtagtgcaaacactgatagtc

SEQ ID NO: 61587 - DNA, 596 bp, Zea mays
  Clone ID: LIB3069-054-Q1-K1-G5-F3B
gggctactacattacttgatgcagcctcaggtgatgatgaaaagatcaatgaggagcaagaggaggctgagttagcagtatcgaaattttctggaaatggtgcgggggtcatgtctgctgctggtactattgctagcacattcgtattggtttttgttgctgaatggggtgataaatcatttttctccacaattgcactagcagcagcttcatcccctctgggtgtcattgcgggatcactagctggtcatgccattgcaacattgattgcagttcttgttgggtctttgctgggaacattcctgtctgaaaagattatagcatacattggagggagcctattcttggcctttgctgcgattaccatagttgagatagtgacttgaaaagggagttccagcttccacaattcataaaaagtactgatcttatgtcagggcactgaaaaatcagcttgctgatcgtaatggtagtacattgatgtgttaccgaacatgattgtccacaggaactttattgttcgcatgggacgtcctaagcttgcgtatagtgtttagcttctggagatgagaatcactgtttctttatccaggaac

SEQ ID NO: 61588 - DNA, 482 bp, Zea mays
  unsure at all n locations
  Clone ID: LIB3069-054-Q1-K1-G5-R2A
tgcaaattacatcncttcgcatttccaccacacagcatttttttcccagtactatatactaaaatgagtcattgataaattctgcagtttcatgtgtttgataggcactgttagcagctagaagttctggagctgtcatttttctaggcacatttggagctcttgcggtaatgaccattatatctgtagttcttggtcgagcattccactatgttgatggcatcattccgttcagctttggtggtactgatttcccagttgatgacattgctgcggcatgtctcttggtttattatggggttactacattacttgatgcagcctcaggtgatgatgaaaagatcaatgaggagcaagaggaggctgagttagcagtatcgaaattttctggaaatggtgcggaggtcatgtctgctgctggtactattgctagcacattcgtatgggttcttgttgctgaatggggtgataaatcatttttc

SEQ ID NO: 61589 - DNA, 617 bp, Zea mays
  Clone ID: LIB3069-054-Q1-K1-G5-SP6A
acgaaaagactgattcatatacttgtatataatgtaagaggaagttcaaaagctacatggaattcatagttttcctcccagtcccatcttccgaccaacctgactatcagtgtttccactacaaatcatgatgatgacaaaaacattgttcttggataaagaagcagaaattctcatcaccagaaacaaaacactctacgcaagcctaggacgtcccatgcgaacaatgaagttcctgtggacaatcatgttcggtaacacatcaatgtactaccattacgatcagcatgctgatttttcattgccctgacaaaagatcagtactttttatgaattgtggaagctggaactcccttttcaagtcactatctcaactatggtaatcgcagcaaaggccaagaataggctccctccaatgtatgctataatcttttcagacaggaatgtttccagcaaagacctaccaagaactgcaatcaatgttgtcatggcatgaccagctagtgatcccgcaatgacacccagaggggatgaagctgctgctagtgcaattgtggagaacattgatttatcactctattcagcagcaaataccaatacgaatgtgctagcaatag

SEQ ID NO: 61590 - DNA, 514 bp, Zea mays
  Clone ID: LIB3069-031-G7-R1B
cttccggtcttctcttctccactaccacccgcccgcccgccttctcctccaccactgccccgtcgtggaataggggcaagttcaggcatctcgcttctgtcctggtcgaggggatcggagaagaatgggctcggaggcggactgcgacaggatcaggggcccgtggagccccgaggaggacgacgcgctgcggcggctcgtggagcggcacggcgcgcgcaactggacggcgatcgggcgcgagatcccggggcggtcgggcaagtcgtgccgcctgcggtggtgcaacagctgtcgccgcagtggagcgccggcccttcacggcggaggaggacgcggccatcgtccgcgcccacgcgcgccatcggcaaccgctgggccgccatcgcgcgcctcctccccggccgcaccgacaacgccgtcaagaaccactggaactgctccctcaagcgcaagctcgccgccgcgtccgccccgggcgggttccttccgacgtcgacgcgcgccccgaccc

SEQ ID NO: 61591 - DNA, 683 bp, Zea mays
  Clone ID: LIB3069-004-Q1-K1-E8-R5A
tctgcgcctgcaattttagtgactggggtacccctgggtcgcacagttttactattgagaaaatcaaggttcccatccatctgcaatggttcagtattgactccatgtgacgttgcatcagcaggatccttctttgtcctgtgcttgagcttctgccgcttctgccttttcttggtatcaacagaaggaagtgaattgagatcaacacctatattttcatctccttcatctgctataactgtattgatatcaatgcctatatttacatccttttcagtcgccacctcagcagcagcatctgtccctcgggatctctttgtgcccttgtcactaccattcaccttgagaatcgcctgtgcagcagaaaccacatctgacccctttttaaggagatcatggacagaggtgcacccggaagccttggcgatgtgggccattatcccagttggcatctcgcctttcttctttctacagaagctgcagttgcagatgcccctgcacttaggacagatccagtcctccttgccggccgcctcctcggcactctcgccatacctgttaaggaggcacttgaggcaatacttgactgggcacggacccttcttcttgacttgcttgcacgccgctgcgaagtctgttgtcttctggcggcattggtggcaggtcttgccattctttggatc

SEQ ID NO: 61592 - DNA, 685 bp, Zea mays
  Clone ID: LIB3069-004-Q1-K1-F8-F4A
gctaattctacagccaaaagttcaatcagtggttcacctgcaaaggatgttggttctgctgaaaatgaaaaatcatatggacttgatgttgttgttgagataatgactgcattagaaagatctgcatatgaagctcttggaacagattttgggaaatataaccagaaactgcgacaactacagttcaacatcaagaatatctctaaacttcgcaggaggctgatggacaaggagcttgatcctccagttcttttaaccatgtcccccgatgaattaaaggctggcttgacttcagcagagaaaacatctgaaccagaagaatcaaggaaattgcagatgactgatacaagatgtcaaagatgcagcgaaaagaaagttggcatatctgatattatccatgcaggtcatggagaccgctatcagttggaatgcacttcctgtggctacacatggttttcgtccagagatgccatcacaacacttacagaggatgccccaagcactgctgggaatgtgggcactgcccccttggcaacagcaaagttcgaggtcgttgagaagaagctcacgagcccacgggaccaatccggcaagcctgcttctgatgctctgcagaagagcactggagcttacatgccaactatggagaggcagaggtcgtttgctaagaccaagctgttggatg

SEQ ID NO: 61593 - DNA, 473 bp, Zea mays
  Clone ID: LIB3069-004-Q1-K1-F8-R3A
aactaccgaaacgaagacaaccattacgaggtggtagcaggtcaagaaaagggcccctgttttggtgcaagggagggttcatcccctgttttggtgcgggggtggatcacccatatggacaagtatgtatctctaaatcctgcaaagaccaatctgcatcatgaatactgctctacccacgtttcggcgcgggggaggtttcattcaacagctggatcttaacagacgacttctgcctctccatagttggcatgtccgctgcagcgcttttctgcagagcatcataggcaggcttgccggattgatcccgtgggctcgagagcttgatatcaacgacctctgactctggtgtgccaaaggggcagtgcccacattctcagcattgctagtagcattgtatgtaatggatgcgattgactcatagggacgaacaccatgtgtacacacatgaagtgcattccaactgatagcgg

SEQ ID NO: 61594 - DNA, 649 bp, Zea mays
  Clone ID: LIB3069-004-Q1-K1-F8-R4A
actaccgaaacgaagacaaccagtacgaggtggtagcatgtcaagaaaagggcccctgttttggtgcaggggagggttcatcccctgttttggtgcgggggtggatcacccctatgtacaagtatgtatctcgaaatcctgcaaagaccaatctgcagcatgaatacggctctacccctgttttggtgcgggggagggttcatccaacagcttggtcttagcaaacgacttctgcctctccatagttggcatgtaagctgcagtgctcttctgcagagcatcataagcaggcttgccggattggtcccgtgggctcgtgagcttcttctcaacgacctcgaactttgctgttgccaagggggcagtgcccacattcccagcagtgcttggggcatcctctgtaagtgttgcgatggcatctctggacgaaaaccatgtgtagccacaggaagtgcattccaactgatagcggtctccatgacctgcatggataatatcagatatgccaactttcttttcgctgcatctttgacatcttgtatcagtcatctgcaatatccttgattcttctggttcacatgttttctctgctgaagtcaagccaccctttaattcatcgggggacatggttaaaagaactggaggatca

SEQ ID NO: 61595 - DNA, 423 bp, Zea mays
  unsure at all n locations
  Clone ID: LIB3069-025-Q1-K1-G6-R3A
acccgtggaggaggagnactaggtaactagctagcgagnnncgcganaaaagaaacacgnngggacacttgttgtggcacaggcgtgcacaaagaaaggaggatggtttcaatgctgttccctcgggaatatgatgctgctctggctagtgggacaacagccagatttatgcataattgggggcaatgtgaagggattgatcgtgaccaaaacggacagcggatgatttccagttttaacagatactatattgctcggtataccctgttgcgttcagatattatccaagaaaaaaaaaaagggcggccgccgactagtgagggtgggccagcgccaaaaaaagaccatatttggagaagcgagctaccaccaccagaatgcaatgcatggtttcggactttggtaacccttaaatgaagccca

SEQ ID NO: 61596 - DNA, 423 bp, Zea mays
  Clone ID: LIB3069-039-F10-R4A
gacgggcagagaatcagaatgacgactcgctataaaatggaacacaaggtattccattcaaaggctgaagaatgaaactgaacggattgttgtcgacaatgacaattctgccaaaatcttttgacacgcgagtaagatctttcacatgttctctatattccgtggtaacagttgatgggcgatagagacgaagtctgaatctattgtgaagatctattcggtcaactaaaggtctagcataaccttctaaacctgctgtaaaaaggataagatctgcaaattcactagttttccgcaagaactcatgcaaaccagggcgctcaaaaacagtcacatgattcaccttttgtttgccttcaacatccttatcagacgatatacattccatatcaaagcaatcggacgcgtgggcggacgcgtggg

SEQ ID NO: 61597 - DNA, 345 bp, Zea mays
  Clone ID: LIB3069-040-Q1-K1-F10-F2A
caaaaacaaaggggtggccccccctttattagttagggaacccccttttttgggctggtttccaaatcatgcaggggacaggaggggggcacaacgcaggcccccccacaaaaagggcaaaacacacccgagggccgttaagggtaacaactaacaggggtatcccacccgggttatgtcctatgcacatggcatggacctacggctttatagggaaacaaccaaccggttggtcccaaggcattaatagcccttaagaatcgacggccaccaccagtcgacaaaagccctttagtggttttttaaccctttttccaagcgccattggttttctgcatctccaag

SEQ ID NO: 61598 - DNA, 498 bp, Zea mays
  Clone ID: LIB3069-040-Q1-K1-F10-R2A
cggacgcgtgggaagcaaactataagtttgttgtattggatactgggaattaccagattgattcaatggatcctgataagatgcttcagtgggaagatattatctgtgtaagatactatagcccttctgaggtacaatgccctatttgcttggaaagaccattgtgcccacagatcacatcatgcggacacatatattgctttccatgcattttacgttatctaatgatgggcaaagatgattatagaggtgagtgttggaagaagtgtcctctgtgtttcatgatgatatcatcaaaggatttgtatacaatacaaattactcaagtccagaatgtccgtgctggtgacgttgtcacatttacacttctgagcaggtcaagaaattcgctcactccttccatcaaaagctcctccagtgaaagttctacaacagatgaagagcattataatgttttctcaaagtttattttgacatctgatgtggagttgtctgttc

SEQ ID NO: 61599 - DNA, 292 bp, Zea mays
  Clone ID: LIB3069-043-B3-R6A
ggtaggagtatgctgggttgctttactgaatcccaaatctgcatgatacgtttcttagagctctcaattaattctgaacttggaactgaaagtgagactgaacttttccccaaaggtaagcgttcttcatttacaagaactgcaacagcagatgtcatcagtggcagaagtgctgtaacaccaaaaacaaatcttacaccataagtatccactaaagaaccactgaagtatgcactcacgactcctccgaaggctgaggatccccaaccggacgcgtgggcggacgcgtggg

SEQ ID NO: 61600 - DNA, 571 bp, Zea mays
  Clone ID: LIB3069-003-Q1-K1-G4.F2
gccagaattatatattgcactgctcagatcaactttcagatgacaaacattccatacagtcaaaaggcgccacggcgcttaaggacctactcgaaaggagcttaggacgaggtgaacttggtgacggccttggtgccctccgagacggcgtgcttggcgagctcgccgggtagaacgaggcggacggaggtctggatctcccgggaggtgatggtgggcttcttgttgtagcgggcgagcttggccgcctcgccggcgagcttctcgaagatgtcgttgatgaaggagttcatgatggacatggccttggaggagatgccgatgtccgggtgcacctgcttcagcaccttgaagatgtagatcttgtacgtctccacgctcttcttggccttcttccgccccttcttgtcaacaccgccttccttgccggcggattttcccgccgggagccgcttctccgccttcggcttcttcccagcgggggccttctccgccggggccgcgggctcctcctctgcgggcttctttgccgccggcttttttctccggcttgggtgccctcgggtccctc

SEQ ID NO: 61601 - DNA, 619 bp, Zea mays
  Clone ID: LIB3069-003-Q1-K1-G4.R2
gcatttctcgattacgattcccaatccagcaaaccctaccagccttttgcaaactcagagagggacccgatggcacccaagcggagaagaagccggcggcgaagaagcccgcagaggaggagcccgcggccccggcggagaaggcccccgctgggaagaagccgaaggcggagaagcggctcccggcgggaaaatccgccggcaaggaaggcggtgttgacaagaaggggcggaagaaggccaagaagagcgtggagacgtacaagatctacatcttcaaggtgctgaagcaggtgcacccggacatcggcatctcctccaaggccatgtccatcatgaactccttcatcaacgacatcttctagaagctcgccggcgaggcggccaagctcgcccgctacaacaagaagcccaccatcacctcccgggagatccagacctccgtccgcctcgttctacccggcgagctcgccaagcacgccgtctcggagggcaccaaggccgtcaccaagttcacctcgtcctaagctcctttcgagtaggtccttaagcgccgtggcgccttttgactgtatgggatgtttgtcatctgaagtttgatctgagcagtgcaatatat

SEQ ID NO: 61602 - DNA, 683 bp, Zea mays
  unsure at all n locations
  Clone ID: LIB3069-004-H10-F3A
aacatgcccgagggtgagattcctcaccgcccaactggtcagaggcctgccccagccccccaggccgatgctaacaacaactttgccaatgccaatccaaatgcgaatccatggttcatgggcacaggagtccctttggctaatgcgcgctgggggaactacgcattctcagctgctttcgggggactattccctatgcttagcttccaagttcatgggtttccagatgctgctgcttatgcgcagcctgctgggttccactatgggtatggccatgggcatggattccatggcggccatatgggacacgcccatggcgtccaccgacaagcaccattggggcaacagcagcaggcagatatctacttgaaggccctgctcttcatgattggaattctagtgattgcaagcctcattgcgttttaaaatttgttggcaacgtctaccaggaggcctgctcgtcacggctgggacgtggaattctgggaatgcaatcctcctgacatgtcagagtccgttgatagcttgacatttgtgatggcatattggcccatgaaccgccagaatttcagtgtgtttgtactatagnctggcgctgaatgttgcataagttattattctgtttgcatgaagtggtcatagaatatgtattaatgtctagataagtacttacgtttcgtaac

SEQ ID NO: 61603 - DNA, 555 bp, Zea mays
  Clone ID: LIB3069-004-H10-R3A
gctgcgcataagcagcagcatctggaaacccatgaacttggaagctaagcatagggaatagtcccccgaaagcagctgagaatgcgtagttcccccagcgcgcattagccaaagggactcctgtgcccatgaaccatggattcgcatttggattggcattggcaaagttgttgttagcatcggcctggggggctggggcaggcctctgaccagttgggcggtgaggaatctcaccctcgggcatgttctttgaccttgggtcaacacgatccttgccgcgtccataaaggggaacaagcttgtcttcctccacaagagccttgcacactgggcactctggcgaatgtgcatggatgtgcagccaccggtaaaggcatggccagcagaagaggtggccacaaagagtcactattggctcttgaggcagctcaaagcatatgttacattcaaagctccccccagctgcatcattgctgctgccaccgctggttgattcaccgacattggctgacattttgcaatttgttgggggtcaaccaagcttgtgtgctcgtc

SEQ ID NO: 61604 - DNA, 726 bp, Zea mays
  Clone ID: LIB3069-008-C6-F3A
ttttgcaatttcagtttgtcaacttcactgcgatcatgtcaaaaaagataagtcaaagcaaaaaggagacagagttcgccctttcagcactaatggaaattccattgcaatacaaggcaacattagagcttggaattttaggacgtcgaattggagagtcacctgagcggattccacttcctcctccttttgcaagttatagcacagtttcaagagcagaaccatctcgggcaaatagttatcgaagtgtgccttcacatccaagggaggagccagctgtaaattcaactatcacagcatcagttacatccccatcagctgccgaaagtagagttttagaaccccagatgtgcccagtttgcctttccaaaccccgggacatggcatttggttgtggccaccagacatgttcagaatgtggaccgcaagtcacagattgccccatctgtcgaaggcccattgacacgagagtaaaattgtactaattatttttgggtggaactaggtttaactgaagcacatgccaggagtagaatccactaaaataaatctctatttgactgttaacgatgtagtgtgaattaatttaataaatcagacgtagagaaaaggaggatacttgttctttgcttgtatcctgttcctacattgtgcgttgatagatgtgaggctacttccattatctgatactggacaggcgccctacttcgctgcggcgattacata

SEQ ID NO: 61605 - DNA, 630 bp, Zea mays
  Clone ID: LIB3069-008-C6-R3A
acttgcggacccattctgaacatgtctggtggccacaaccaaatgccatgtcccggggtttggaacggcaaactgggcacatctggggttctaaaactctactttcggcagctgatggggatgtaactgatgctgagatagttgaatttacagctggctcctcccttggatgtgaaggcacacttcgataactatttgcccgagatggttctgctcttgaaactgtgctataacttgcaaaaggaggaggaagtggaatccgctcaagtgactctccaattcgactgtctaaaattccaagctctaatgatgccttgtattgcaatggaatttccattagtgctgaaagggcgaactctgtctcctttttgcttcgacttatcttttttgacatgatcgcagtgaagttgacaaactgcaaattgtcaaaagacctagctgggatattggcatcaaatcccttcatcatatccgatggaccatctccaactccaacatgaattatagacaatggcattcggctagcttgtacaatagcatcaactgtcatttgctcctgggcgcttaactgaccaaattcagtatctacacttcttgtgacctgccgcgcagcaatgattactaaaacat

SEQ ID NO: 61606 - DNA, 606 bp, Zea mays
  Clone ID: LIB3069-009-Q1-K1-H3.F2
agtacgaagcatatttggttgccattctcgctgattcggtcagacgattcgagccatcggccaagtacacaaatactcactgcacaggtctttctccgttctactacggaaagaccgctcgctacaactactatattgtatacccagtgagaggaaagatgagtacaattggcttggtgattcctctctgtagatacgagtcctacatcaagtgatagccttcttatcgggtgaaccagaagactggggagaagaaccagtcgccgcaactggtgcgtcgtgggagcagcacccaccggggccgtgatggtggtggtgggtggtgcttcttgggctgtggctgccggagcagcttgcgcatgtcgaacgcgtcctccccatcggcatagtacttggcctcgatgtcctggatctggtacccgagggtagaggtgtagaagttgaaggcagcgcggttggatcggcggacgtggagtgacacgtactcagcgccgaagacctggtccatggcggcctgcgcggcggacatgagctttagtggcgagcccgagcttgcggtgggagcggaggaccgcgagggaggtgatgttggccgtggcagggctc

SEQ ID NO: 61607 - DNA, 628 bp, Zea mays
  unsure at all n locations
  Clone ID: LIB3069-009-Q1-K1-H3.R2
ctcctatcgtcggngnaccaccgaatccaccgcatcgcagagacgagtagaggttagatttaggctgaggtaagatggtgtgcatccggcaggcgaccatcgaagacctgctggcgatgcaggcgtgcaacctgatgtgcctgccggagaactaccagatgaagtactacttctaccacatgctctcgtggccgcagctcctcttcgtcgccgaggactacggaggcagcatcgtcggctacgtgctcgccaagatggaggaggacccctccgagccctgccacggccacatcacctccctcgcggtcctccgctcccaccgcaagctcgggctcgccactaagctcatgtccgccgcgcaggccgccatggaccaggtcttcggcgctgagtacgtgtcactccacgtccgccgatccaaccgcgctgccttcaacctctacacctctaccctcgggtaccagatccaggacatcgaggccaagtactatgccgatggggaggaacgcgttcgacatgcgcaagctgctccggcagccacagcccaagaagcaccaccaccaccaccatcacggccccgggtgggtggctgctcccacgacgcaccagttgcggcgactggttcttc

SEQ ID NO: 61608 - DNA, 362 bp, Zea mays
  Clone ID: LIB3069-011-Q1-K1-F6.F2
atgcaaaccaccaactcaaattccagcaacaaatgaggcatgctccagcgtcaaactcagaatttggaacataagtgatcaacaacaaagtgttgatgattcacaaataaacaaggccttggtgggttacatgacgcagttcctacagaagcagagcagcgccgacagagaaaccagcaacatctaactacaacacaaggcgaacatcaacacaagagaagcctacaaagggcgagcgtgcaagcctaggaggaggtgaacttggtgacggccttggtgccctcagagacggcgtgcttggcgagctcgccggggagcacgaggcgcacggaggtctggatctcgcgggaggtgatggtggg

SEQ ID NO: 61609 - DNA, 363 bp, Zea mays
  Clone ID: LIB3069-011-Q1-K1-F6.R2
cccaccatcacctcccgcgaggaccagacctccgtgcgcctcgtgctccccggcgagctcgccaagcacgccgtctctgagggcaccaaggccgtcaccaagttcacctcctcctaggcttgcacgctcgccctttgtaggcttctcttgtgttgatgttcgccttgtgttgtagttagatgttgctggtttctctgtcggcgctgctctgcttctgtaggaactgcgtcatgtaacccagcaaggacttgtttatttgtgaatcatcaacactttgttgttgatcacttatgttccaaattctgagtttgacgctggagcatgcctcatttgttgctggaatttgagttggtggtttgcata

SEQ ID NO: 61610 - DNA, 542 bp, Zea mays
  unsure at all n locations
  Clone ID: LIB3069-022-Q1-K1-C8-F12A
acatccttaggtagnagccctagtctgttggcgcaaagatcaccggcggaggctccggcggcacagtatgtgttgttgggaagaactgcgccaggagcagtgaatagattgcagagattcagcacagatacaaggctgagaccgggtatctgcccattcttttcgacgggtcgtctccaggagctgggaagtttggttacctgaagatccgacgtcgatgtccctagtggctgattgggaaacgaagaacttcagttcgagctttgtcacatatcactcaattgttaagaacctcactccaactctccaagccattgtagaacatataggcgtattggcacttgcgatgattcgtcgttcacacacaaaatattatcatgtgctacaccaattctggaagctactagaggaaaatgtgaggaatataaagaaactcttgttgagcagatgtagtctagtggtctccgcgtgcttgctgcagagtaaccaaactccaaggagaagtgctctgggctctggcaagtggtatgtgatgaagacga

SEQ ID NO: 61611 - DNA, 390 bp, Zea mays
  Clone ID: LIB3069-022-Q1-K1-C8-F2A
acatggcttgcgacgaccatgcatctcttcttcccagcgattttagcctgtatctttccttatttatagtctatacggtacaggcgaatatgaccacattgaggtgggatctatgtgctcctctcgtacagtcctaccaaaacacacacaggagcactgtcatcacgcacctactaaatccgatcctaactgacaacatcagataacgactgacaagggcaccaacgtctacacgaggccatcaaacggccagaaaccatcctcgacttaatcacataccacatgccacagcccagagcacatctacttggagttaggaacactgaagtaagaacaccgtgaccactacactacaattgctctaacaagagattctttatattcctcaca

SEQ ID NO: 61612 - DNA, 565 bp, Zea mays
  unsure at all n locations
  Clone ID: LIB3069-022-Q1-K1-E8.F2
gataccaattgtcagcataacataatggcaaatgattcaacacaatccacaaggnaaataaatagagtttacatgtccgatttaaccacaaaattgaactgagtcctgcactcaagcatatcagccacacaagcatacttagaatatagcagtgaaagacgagctaagcaacaagtccaccgaataacacgtctcagaacagttgccacagagagctcactgttttgactcccgctcacggttccactgctcaatcttggcccttcgctcctcgctgctttccctgaccgggctccttccacgcctcggggggctaccatgcctacgccttcctccatcatcatacctctcatacctgccgcctctacccgctccatncatcgtacctgtcatgcctgccgcctctacctgctccatcatcatacctgtcatgcctgctacctcttccccgtccaccgccgccgccgccgccacggnactcgtcacgatcacgnggtggtgatagtcctcacgatagcccctcttttgcggtggagggcttcggcttctcgcatggtacctcctg

SEQ ID NO: 61613 - DNA, 574 bp, Zea mays
  unsure at all n locations
  Clone ID: LIB3069-022-Q1-K1-E8.R2
cccacgcgtccngaaattgacaggaatattacttggtgatcctataagataatgtgctgtgaaccctgatttgttttagctgcttgtgttcgttttgtctacttagtcttgcacactgaggacctttatcgaggttgtcagtctgcaagttgaatcatggcggagcacttggcttcgatctttggtaccgagaaggacagggtcaactgccctttttacttcaagattggggcttgtcgtcatggggatcgctgttctcgtctgcacaacaggccaactatatcgccaactcttgtgcttgctaacatgtatcagcgccctgatatgataactcctggagttgatgctcaaggccaacctattgatcctgagaagatgcaggagcattttgaggacttctatgaggacatctatgaggagttgggcaagtttggtgagattgagaatttgaatggtttgtgataaccttgctgaccacatgattggggaatttctatggttcagttcagaagaggaagaacaggcagctgcagcatacaatgctcttcagggggcgcttttactctgggcgcct

SEQ ID NO: 61614 - DNA, 526 bp, Zea mays
  unsure at all n locations
  Clone ID: LIB3069-031-G7-F2B
gaaaccagaatgtgcgtcgtccccctcttctcgtttcattccgttccgatccgattcattcctgtagagagagagagagagagaggaggcaggcagcgctttacacggctttcagcaagcctttactacatttttctccacctttcagttcccacatatttttttttttcagttgctgactcttttcactgctgtttcggtttcacagcggttcgagagaataaagttttaaaaaaaggaaaataataacttggaagtttgctactgataagaacagctgctgcgcgttcgtcctagaagatcgattgacggtttgggagagtatttgatggctcatgcacgcccaggagctactgcatccggccgacccgctcggcggcggcgcgcatgacgccgtcgacgagctgcggcatgcagaggtcggccccgccggcggcgccgtacccggngcgcacgcccacgctcgccatgtaccgctgcaccttcgtgcggatcagctcctgcatcgccttcatgaacacggggc

SEQ ID NO: 61615 - DNA, 617 bp, Zea mays
  Clone ID: LIB3069-031-G7-F3A
ggaccacacgctgcggcggctcgtggagcggcacggcgcgcgcaactggacggcgatcgggcgcgagatcccggcgcggtcggtcaagtcgtgccgtctgcggtggtgcaaccagctgtcgccgcaggtggagcgccggcccttcacggcggaggacggacgcggtcatcgtccgcgcccacgcgcgcctcggcaaccgctgggccgacatcgcgcgcctcctgcccggccgcaccgacaacgccgtcaagaaccactggaactgctccctcaagcgcaagctcgccgacgcgtccgccccggcgggttcctccgacgtcgacgcgcgcccgaccaagcgcgtcagcctctcgcccgacagcccgtcggggtcggggtcagggtccgggtccgggtccgggtccgaccgtagcgacctgagccacggcgccggccaggtttaccgccccgtggcgcggtccggtgggttcgagccggcagactgcgcgatgagccgtccgctgcacgaagaggaggaggaaaaggaggacccgctcacctccctcaggctctcgcttgccggcacggaccagcggttccaccacgaccgcgcccacagccagttccaggagctcccg

SEQ ID NO: 61616 - DNA, 602 bp, Zea mays
  unsure at all n locations
  Clone ID: LIB3069-031-G7-R2B
cttccggtcttctcttctccactaccacccgcccgcccgccttctcctccaccactgccccgtcgtggaataggggcaagttcaggcatctcgcttctgtcctggtcgaggggatcggagaagaatgggctcggaggcggactgcgacaggatcaggggcccgtggagccccgaggaggacgacgcgctgcggcggctcgtggagcggcacggcgcgcgcaactggacggcgatcgggcgcgagatcccggggcggtcgggcaagtcgtgccgcctgcggtggtgcaaccagctgtcgccgcaggtggagcgccggcccttcacggcggaggaggacgcggccatcgtccgcgcccacgcgcgcctcggcaaccgctgggccgccatcgcgcgcctcctccccggccgcaccgacaacgccgtcaagaaccactggaactgctccctcaagcgcaagctcgccgccgcgtccgccccggcgggttcctccgacgtcgacgcgcgcccgaccaagcgcgtcagcctctcgcccgacagcccgtcggngtcggngtcagggtccgggtccgggtccgggtccgaccgtagcgacctgagccacg

SEQ ID NO: 61617 - DNA, 316 bp, Zea mays
  unsure at all n locations
  Clone ID: LIB3069-035-Q1-K1-E2.F2
gggggggccncttgggctgtgggacagtggtgctaaaaggacagcacaatttttttttttatttacacgcagattatcattatttgtggggggggggttttcttaatctgggacacgccttccgtcgacgcccagttgaccattacaaggatcctaagacgaggggaactttttaacggccttagtgcccttggaaacagggtgtttggggagcttccccggggggaccaggcccacccaggtctggatctcccgggagggggaggggggcttcttgttgttgcgggccagtttggggggcttgggcccgagcttt

SEQ ID NO: 61618 - DNA, 535 bp, Zea mays
  unsure at all n locations
  Clone ID: LIB3069-035-Q1-K1-E2.R2
ttcggcggngnaanaagccggtggccaagaagcccgcggaggaggagcccgcgacagagaaggtggagaaggctccggcggggaagaagcccaaggccgagaagcgcctcccggcgggcaagtccaaggagggcggcgagggcaagaaggggaaaaagaggcgaagaagtccgtggagacctacggggagtacatcttcaaggtgctgaagcaggtgcaccccgacatcggcatctcgtccaaggccatgtccatcatgaactccttcatcaacgacatcttcgagaagctcgcggccgagtccgccaagctggcgcgctacaacaagaagcccaccatcacctcccgcgagatccagacctcggtgcgcctcgtcctccccggtgagctcgccaagcacgccgtctccgagggcactaaggccgttacgaagttcacctcgtcttaggatccttgtaatggtcatgtgggcgtcggcggtaggcgtggctcagtttatgtgatactgctagcgatggatgatgatgatctgcgt

SEQ ID NO: 61619 - DNA, 338 bp, Zea mays
  Clone ID: LIB3069-035-Q1-K1-H2-F13A
gcggcggcggcggcgcgacggacggcctggtcagcgcctacgcgtccaacgccggccagtggggggccgacttcgcggcggccatggtcaagatgggcagcatcagcccgctcaccggcacggacggcgagatcagggtcaactggcggagagggaattaattatttattaccgccccgttgattggatttgcttcttgggggaatggaattaccggccttttttgccaaaaagccaaaaaaaattggaatggaaccttaacttaatattataccaaaggtggttaataatccataataattcgtgcatatataatatatatatagcatacatgtact

SEQ ID NO: 61620 - DNA, 755 bp, Zea mays
  Clone ID: LIB3069-036-H9-F3A
tgccttagaagagtaaaggcagctgttaggagaacaattgagttcactaaccataaaagaactccagcaactggagcaacaactggacagttctttgaagcatattaggtcaagaaagaatcagctcatgttcgattcaatttccgcgcttcagaaaaaggagaaagcacttacagatcaaaacggtgtcctgcaaaagttcatggaggcagagaaggagaaaaacaaggctttaatgaacgcgcagctccgggagcagcaaaatggagcatcaacaagctccccatcactttcaccaccaatagttccagattccatgccaactctaaatatagggccatgtcaacatagaggggcagcagaatctgagtctgaaccgtctcctgctcctgcacaagcaaacaggggcaacctgccaccatggatgctccgcactgtcaagtaacaggtgaggtcttcccagtgtagttttgcagctgatctcgacagcaacacacctgtcaccgaaatgcttcggtgaccttagatatcaaccgatgcacgatccatctcgatcctgtgatcgaataccggcgtaggtactactaataaagtcaggccccgtcaaatgctttacatggtgattgaagtctggagcttctcagcaccaccatatattgtgttcagttcttgtgtttattgccatagctaccctttttttctctgatctacgagctagacgtagctttgtgcttggagattccactactatgttt

SEQ ID NO: 61621 - DNA, 717 bp, Zea mays
  Clone ID: LIB3069-036-H9-R3A
ggttgcccctgtttgcttgtgcaggagcaggagacggttcagactcagattctgctgcccctctatgttgacatggccctatatttagagttggcatggaatctggaactattggtggtgaaagtgatggggagcttgttgatgctccattttgctgctcccggagctgcgcgttcattaaagccttgtttttctccttctctgcctccatgaacttttgcaggacaccgttttgatctgtaagtgctttctcctttttctgaagcgcggaaattgaatcgaacatgagctgattctttcttgacctaatatgcttcaaagaactgtccagttgttgctccagttgctggagttcttttatggttagtgaactcaattgttctcctaacagctgcctttgactcttctgaagtgcatcaagtttggattttaaccggacatattcatctccccaatttgcctggtcttcaatacttgggttaagtactgccctttcttcaaatgagtaacgctggtaacgctcaagaatgccttccatgctggaatggctagagtactcgtagagcttccccttagtggagaagacgatgagcgcgacctctgcgtcgcagagcacggagatctcgtgggccttcttcagcagcccgttccggcgcttggagaaggtcaccttggcgttgatcttgttctcgatccggcgcagctgcaccggccccc

SEQ ID NO: 61622 - DNA, 633 bp, Zea mays
  Clone ID: LIB3069-036-Q1-K1-B11-F14A
gtagtcatgccttacggcgactcggttgctatcctaacatatctcaaatttaaaaaaaacatctgtttcccactcatggaacaattctcgaatgaaaacaccttctacagcttaactcaagaaatcaaatgcagctcacttcttagaagaggtagcggttgttttatttgtgcttgattgggggtcatttgccatcctggaagaagaagcaccatctatggcaatgttccccaactctacggccattgcctctctttcttctttctctttcttttgcttctctgaaacaccatcacctggactccgtgctgactctggccgtgttttaggttgctgtcggaggggaccaacatcaagccatggatgctgaagcaattgagcagctgtagggcgcttctcaggaacaaaatcaagtattggaacaagaaaatctgccatcccattagcatttatttcagtgaactcgtacttctccatcagcaccttgttgagaggccagaaccgcaagcgtcggatgtgccgcaaatccccataccgattgaagaaatcacgtgaataccgaccacccaacgcaatctttcgaggcatcattcctagcaactccatcatcagtgcgaggtgatcctcatctct

SEQ ID NO: 61623 - DNA, 283 bp, Zea mays
  Clone ID: LIB3069-036-Q1-K1-B11-F15A
aacaaaatcaagtattggaacaagaaaatctgccatcccattttcttttatttcagtgaactcgtacttctccattttcaccttgttgagaggccagaaccgcaagcgtcggatgtgccgcaaatccccataccgattgaagaaatcacgtgaataccgaccacccaacgcaatctttcgaggcatcattcctagcagctccatcatcagtgcgaggtgatcctcatctctgtcaaaattatcgccactatgtggatcgaatagcacatccccagtggcaagc

SEQ ID NO: 61624 - DNA, 517 bp, Zea mays
  Clone ID: LIB3069-037-Q1-K1-G10.F2
agaaaacgggtttcctattcctttggaatgacataaagcaacttgagcgagcagatcacagccaatcacattgcccgcttacaacctacacatgacaacatcggatccgcctccaaaccctatgccttcttgggggacttggcggccttcttgggcgacttggcctccttgctcccgccgctggacgccttctccgccgtcttcttgggcagcaggaccgggttgatgttgggcaacacgccgccgtgggcgatggtcacgccggtcagcagcttcccgagctcctcgtcgttgcggatcgccagcagcacgtggcgcgggacgatgcgcgtcttcttgttgtccttggcagcgttgccggcgagctccaggacctcagcggcgaggtactccaagacggccgcgaggtagacgggggcaccgctgccgacgcgctgcgcgtagcggcccttcttgaggtagcgcccgatgcggccgacggggaactggagcccgggctttacggacctcgtcaccg

SEQ ID NO: 61625 - DNA, 679 bp, Zea mays
  unsure at all n locations
  Clone ID: LIB3069-037-Q1-K1-G10.R2
tccgcccacgccgtccgcccacgccgtccgcccacgccgtccgcccacgcgtnccgcccacgcgtcgcggcattccntcccatctcccaaaacctcctcagacccgagaagcgcagctgcggccatggacgccaccggcactggagctggagggaaggcgaagaagggagcggccggtcgcaaggccggcgggccgaggaagaagtcggtgacgaggtccgtgaaggccgggctccagttccccgtcggccgcatcgggcgctacctcaagaagggccgctacgcgcagcgcgtcggcagcggtgcccccgtctacctcgcggccgtcctggagtacctcgccgctgaggtcctggagctcgccggcaacgctgccaaggacaacaagaagacgcgcatcgtcccgcgccacgtgctgctggcgatccgcaacgacgaggagctcgggaagctgctgaccggcgtgaccatcgcccacggcggcgtgttgcccaacatcaacccggtcctgctgcccaagaagacggcggagaaggcgtccagcggcgggagcagggagccaagtcgcccaagaggccgccaagtcccccaagaggcatagggtttggaggcggatccgatgttgtcatgtgtaggttgtaagcgggcaatgtgattggctgtgtatctgcttcgctca

SEQ ID NO: 61626 - DNA, 500 bp, Zea mays
  Clone ID: LIB3069-042-Q1-K1-H12.F2
aagataaactttctggtccattcatcaaaagttgtgcacatcgaattaattagctagcccgcattgccctaaatgaaaatagaactaacagagatcaataaattaaggtaaattaacaacagtagtgcaccatacttgctactccagttttggttgctcttcaagctagagtgcatgcagtttgggtgttccgttcattcgtctctcaaagtctcaatgcagcttgaagtatatagcgggcctagaagttgtggctccaggtctcgttgaccggcggcagccggccgccgaggcactgccttgtcaggtcggtggcgcagctggcggtgcggctggcacctgctgcggctgctgtggcgcacagtggaagctgcagctcctcgacctgacgaccgccaccatcgacaccgaggaagtccctaatgaggcgccggtggccgacggtggccacccgagccgttcagagcgaggccaaagctgaccggcgtgccgtccgcgag

SEQ ID NO: 61627 - DNA, 530 bp, Zea mays
  Clone ID: LIB3069-042-Q1-K1-H12.R2
ccccgcgtccgcatgtgctacaaataaataaattaaaaccaaaagaccccggcgcggaggtgatcgcgctgtcgccgcgcacgctggtggcgacgaaccggttcgtgtgcgagatctgcaacaaggggttccagcgggaccagaacctgcagctgcaccgccggggccacaacctcccctggaagctccgccagcgcagcagcctcgtcgccccgtcgtcggcggcggcaggctccggcggcaggcagcagcagcagggcgaggccgcgccgccgcgtaagcgcgtctacgtctgccccgagcccacgtgcgtgcaccacgacccggcgagagctctgggggacttgactgggatcaagaagcacttctcgcggaagcacggggagaagcggtggtgctgcgagcgctgcgggaagcgctacgccgtgcagtcggactggaaggcgcacgtcaagggggtgtggcacgccgcgagtaccgctgcgactgcggcatcctcttctccaggaaggacagactgctcacgcaca

SEQ ID NO: 61628 - DNA, 478 bp, Zea mays
  unsure at all n locations
  Clone ID: LIB3069-044-Q1-K1-G9.F2
ggggncccgggggggggggggggggggcgaaaaaacgccccttaaccccccttttggggggggaactgggctttttaaaagcccccggggggggggggttcccccgcctccccggggggggggggggggggggggttttctgggggggggggggggccccctttgggggggggggggggggggggggtttttttaaaggacccggggggggggggcgggggggctttgggggcccccaccggggggggttttggaaatggggggtttttttggaatcccggggggtccccccccccccggggggggggggggatttgggggtaaaaaggctcggggtttttggggttggggggggtttgtgccggccccgcgtttcggggcctggcccggggggggttttttccggccggggggggggggggcggtttttttggggtgtgggccccgagaaaaaggggggggggggtttggggggggc

SEQ ID NO: 61629 - DNA, 656 bp, Zea mays
  unsure at all n locations
  Clone ID: LIB3069-044-Q1-K1-G9.R2
tccgcccacgcccgtccgggcatccgcaggggagcttggttccgtnnccaggcaaccaaaaagcaagttgggccccgccgcgcagnaggaagaagagagcagaggaggatggctcgtacgaagcagaccgcccgcaagtccacgggaggcaaggccccccgcaagcagctcgccaccaaggtccgtccgtctgcccttctctacccgtttcggatccgctgttctgttctctagggttcccttctgagacgcgccggcggttgtgctgtggttgcaggcggcgaggaagtcggcgccgacgaccggcggcgtgaagaagccccacaggtacaggcccggaaccgtggcgctgcgcgagatccgcaagtaccagaagagcacggagctgttgatccgcaagctgcccttccagcgcctggtgcgcgagatcgcgcaggacttcaagacagacctccgattccagagccacgccgtgctggcgctccaggaggccgccgaggcctacctcgtcggtctcttcgaggacaccaacctctgcgccatccacgctaagcgcgtcaccatcatgcccaaggacatccagctcgcccgccgcatccgtggcgagcgcgcgtagccatcatctccggggatctgatgaatgtctagttaccaaa

SEQ ID NO: 61630 - DNA, 615 bp, Zea mays
  Clone ID: LIB3069-049-Q1-K1-E1.F2
aacattatcatattagccagctattacattataaatatataaaccaaatagcactaatgataggatacaaaatgtgcctgcatcctgaacttgatcatgaacacgcagttgtatttcagatttttttttcaagggctgcagatttcacgtttcaatgcactcacagaaatttcaagtatcatacttgttccatgtcagacacagttctgcagtcttaacaacgtgatctggaacaatgcccatcaaacacaacgtgacgtggaacaatgttcatcagtcttaacagctcaaatagacgcagatcatatcatccatcactacccctaccagataaattgagccacgtctaccaacaccacccagcctagtactatgagcctaagaagaagtgaacttggtgacggccttggtgccctcggagacggcgtgcttggcaagctcaccggggaggacgaggcgcaccgaggtctggatctcgcgggaggtgacggtgggcttcttgttatagcgcgccagcttggcggactcggccgcgagcttctcgaagatgtcgttgatgaaggagttcatgatggacaatgccttggacgagagccgatgtcggggtgcacctgc

SEQ ID NO: 61631 - DNA, 655 bp, Zea mays
  unsure at all n locations
  Clone ID: LIB3069-049-Q1-K1-E1.R2
gnaccgagcgattcaccacagcttctcaccaccgctaccttcgatggcacccaaggcggacaagaagccggcggcgaagaagcctgcagaggaggagcccgcgacagagaaggcggagaaggctccggcggggaagaagcccaaggccgagaagcgcctcccggcgggcaagtccgccggtaaggagggcggcgagggcaagaaggggaaaaagaaagcgaagaagtccgtggagacctacaagatctacatcttcaaggtgctgaagcaggtgcaccccgacatcggcatctcgtccaaggccatgtccatcatgaactccttcatcaacgacatcttcgagaagctcgcggccgagtccgccaagctggcgcgctataacaagaagcccaccgtcacctcccgcgagatccagacctcggtgcgcctcgtcctccccggtgagcttgccaagcacgccgtctccgagggcaccaaggccgtcaccaagttcacttcttcttaggctcatagtactaggctggggtggggtgttggtagacgtggctcaatttatctggtaggggtagtgatggatgatatgatctgcgtctatttgagcctgtaagactgatgaacattgttccacgtcacggtttgtgtttgatggggcatt

SEQ ID NO: 61632 - DNA, 57 bp, Zea mays
  Clone ID: LIB3069-05-Q1-K1-E2-F16A
tgtttgtggggccaccccccccccttttttcccccccccccaaaaaaaaaaataccc

SEQ ID NO: 61633 - DNA, 296 bp, Zea mays
  Clone ID: LIB3069-050-Q1-K1-B2.F2
aatggctctttggttttaaattttgctcgcctaaggttttgattcggagccctggactccttttttttcggcccaactggtttgcctggggcctggggccccgattgctggccatggcgcgtttgtttccttcccctggtttcgccccttctggtccgggggggcggggccgcattcaggccctctttcccctgttgcggggcccgagctggatgtcctttggcctggtggtgacccttttggcctgggtggggccgaggttggggtccttttttggacccaccaggtacgcctca

SEQ ID NO: 61634 - DNA, 577 bp, Zea mays
  unsure at all n locations
  Clone ID: LIB3069-050-Q1-K1-B2.R2
cctccgccgacacacacgctgcggggggnactggnaaccggnaggtcnnggtcttgaagtgcctgcgctgatctcgccgcaccagtccgctgggaaggggcagcttccggtatgagccagctccgtgcctcttctggtaccttgcggatctcgcggagcgcgacggtgccggggcgaaacctgtgcgggttgttcacgccgtctgtggccggggccgactttcgcgccgccttggtggccagctgcttccgcggcgccttgccgccggtcgacttcctcgccgtctgcttcgtgcgcgccatcggagagagctgcgtgaggcgtacctggtgggtctcttcgaggacaccaacctctgcgccatccatgccaagatggtcaccatcatgcctaaggacatccagctcgcgcgccgcatcaggggcgagagggcctgattgctgctctgtcttcctgtttctgtagtgtctgaactaggggatggaatctatcgcttcttgtcctgcaatcgtgtactgatgttctaggcaaatcagtttggctgttatgaatgtgattcagtgctttgattcataac

SEQ ID NO: 61635 - DNA, 306 bp, Zea mays
  Clone ID: LIB3069-050-Q1-K1-E7-F17A
ctgtccatggttgatgggtggggccagctcagcgacggcgttgatttttggctagagcagaggatgggcgagctcgactagggcgctcggggaagcggtgccaaggccgacgctaggaagggcgatgcaacggcgctggccaccggcgaggacgcggtcgggtggaggttcgagcaggggacagatgtcgtggcaagagatggaggcgagggcttggggatccagagtggagaggatggtgtgctctgctgctgggtggagagggcggttggattatgagcctaggtgagcgggagacgtagggat

SEQ ID NO: 61636 - DNA, 357 bp, Zea mays
  Clone ID: LIB3069-051-Q1-K1-D3-F5A
gtgcacagccataggcggtcgaagtcgtccacacggacgacgagccggtttctagcgccagcgccgccgacgcagctgcagcatcatcggcccatgccttcgacttactctacagacgactacaacggaccacagggccaggcaatcagtcgaacacaaaacacgacaaggacaactccgatggggacgcaaggaggacaaagtgtagaccaaagctgcgcaagcgaaaacgaccagacgacaaccacgcgagtgctgctgcagggcgggaaatgacactacactacagcggggggaaacagcaacgaacgcaagcgggaacgcctgaggagggacaccggacagaaaggaaggaaa

SEQ ID NO: 61637 - DNA, 142 bp, Zea mays
  Clone ID: LIB3069-052-Q1-K1-F8-F18A
ggctagcccaaccatactctctcttcccagcgatgtagccgggtttttcctgagaatagtcaccgggaacggaggaatctgtccacagagaggcccatccacgcctcccctacacagggcgaccagaacgaacccagagaca

SEQ ID NO: 61638 - DNA, 241 bp, Zea mays
  Clone ID: LIB3069-029-E9-A10P1+A
ctgccacaggatggcgttgactgcatttgccccagtcctcgaattgcaccacccgtactggcacttgagctccgcgcaccatgtcccgaccggcacgttcggatcacacagttaagtaccggatgccttgtgggaaccgaccccgcgacttagggatggaccgagggaaggagacggggacaatgccggcgcagactcggcatgtgatgaacatgggatggcaaggaaaaatgcgtcggga

SEQ ID NO: 61639 - DNA, 719 bp, Zea mays
  unsure at all n locations
  Clone ID: LIB3069-029-E9-A11P1-A
accgcggtgaacagaatgctccaaatgatcaaaacaaacttttccgtgtgtgaatcacattccgactgcaaaatgccctcagaacattgggggcccaatctactgggaacctattttaccgcaatattggcactaaaagttcacgcccaataaaatacagcaatatctttagaaatttgcttcaaaaacaaatgaagtgtaaaaatcgatgttggagaatctggctaatcttgctccattggcacttgtggtacgtcccatttgtcttcctcgataggcttggtaatgacggagataggtgacaaagtatgcaaatttgtatctttttcacccctgttgcagctccctcgaagctcccttcgaatttctggagtaactaaatagtgtttctggtgatccaacaaacgtgcaagtttctccttatcctttttctctaactcgttcttgtatctttccacaaatgcaagcagtgattgatgccatataacaggcatgatcctctcatcatcaacaaaacgcatgaaatgggcaagcactgcatcaagtgcacggtatggcaaagcatatttcttgtctagaaatagcttgatgaagtaacttgtagtgccacagtactccatctctgctagttntactagagctacacttgcatggagaaatggaatggaaactttttggataatactcccaatatcactgtttcgcgtagggtgcaattc

SEQ ID NO: 61640 - DNA, 183 bp, Zea mays
  Clone ID: LIB3069-029-E9-A12P1+A
ctagagaatcccatccacacctcttgttcagaagaaaaggctccaattttttcagagaggacctggacctggacctgggattaaggcgggaaggcgtgaccttaaaacaggcattgataacacccaccaccctaacacgcgcttagtactccagtagcagtagtacgctagcaggagtgagta

SEQ ID NO: 61641 - DNA, 77 bp, Zea mays
  Clone ID: LIB3069-029-E9-A9P1+A
cctctagaacactaataagggtggctattgcgcgagataagctgtctgaattcacaaactgctcccttttttgcggc

SEQ ID NO: 61642 - DNA, 152 bp, Zea mays
  Clone ID: LIB3069-029-E9-B10P1-A
gcggccgccaccgcggtgaacaaatactgccaataatcactgcttcgcgtagggtgcaattcctttcccgacatttttgtagcaaaatacccttgataaatgccgggggcttataaagggccttcttcagcgactgataaagtgcaaaatgc

SEQ ID NO: 61643 - DNA, 96 bp, Zea mays
  Clone ID: LIB3069-029-E9-B12P1-A
caatttctttcccgacagattggtagcaaaattcccttgttaaatgccgcaggcttataaagggccttcttcagcgactggtagagtgcaaaatgc

SEQ ID NO: 61644 - DNA, 494 bp, Zea mays
  Clone ID: LIB3069-029-E9-B8P1+A
ctagagaatcccatccacaccttttgttcagaagaaaaggctccaattttttcagagaggacctggacctggacctgggattaaggcgggaaggcgtgaccttaaaacaggcattgataacacccaccaccctaacacgcgcttagtactccagtagcagtagtacgctagcaggagtgagtagtaataattacgtatcagaagaaagaaagaaagaaagaaagaaaagagttttggcttcttctcccaagtcgcatcccatcccatgcatcagaccctgaagttcttgccctcgaaggtctggccgaactgccaggtgctcggggcggcgttccaagaggtggaggtgcggcggtcgctggcggtgacgcggaaggagagcgcctggccgacgaggatggcgttggactgccagttttggccccagttcctggacatgggcagccacccggtgctggccgccttgacgctcgcgcggaacaagttccccgggc

SEQ ID NO: 61645 - DNA, 592 bp, Zea mays
  Clone ID: LIB3069-029-E9-B9P1+A
gacctcgagaacaggtacaatgcgggattttggcgtgtatggggaccgaattctaaaaattgcttacgtttttatcaatttataagagaatcaacgctagcggaattagatattgtcgctgattccccgaactatgatggtaaactgcttccgatccaaacaaaatttgaattaacaagagaaatttatacatccccagtatccgaatattattatggggctattaataactatgatcaaaatggtatccaaactgaacggcagataaggcaaccacatgttatggacttctttaacaccatggccatgtttacatcatataatagacgggaatattattggtcaggacttgaaatgacggcttatttcacaggatttgcaggacctcaagtgacattccctttagctgggactagaggggatgcagctccaccatttaatgttagaagtgttaatgatggaatgtatagaatattatcggcaccattttattcagcacctttcttaggtacctttgatgagtgctatccaacatatttggatcaaaaaattgatgaaataaaattaaaagcctttacccgttatcaaatta

SEQ ID NO: 61646 - DNA, 405 bp, Zea mays
  Clone ID: LIB3069-029-E9-C10P1+A
gacctcgagaacatgctcagcgccgcgttgttcacgccgtacccctggctgtacaggttgccgtacccgtttgcgccgcccatggtgcccgaagcgtcgctgccgccgtataacgtggcgtgcgcgctctgccagccgccgccgccgccgccgacatacacgccgggaatgcgggcggtggcgggggagagcgtcatcgccgcggccaccaccagcagaagcagaggcagaagcggcgccggcattgccgccatcacactccctgagtccactccctcgcctgccggtacaggaagcaggacgggcgctgtcagagtcggtgctgcgggcccaggcaggcaggcgggcgagcgagcggtggcgacggcggcacaggccgggcccacgcgtccgcccacgcgtccg

SEQ ID NO: 61647 - DNA, 300 bp, Zea mays
  Clone ID: LIB3069-029-E9-C12P1+A
cttatcgataccgtcgacctcgagaacagatgcatgggatgggatgcgacttgggagaagaagccaaaactcttttctttctttctttctttctttcttctgatacgtaattattactactcactcctgctagcgtactactgctactggagtactaagcgcgtgttagggtggtgggtgttatcaatgcctgttttaaggtcacgccttcccgccttaatcccaggtccaggtccaggtcctctctgaaaaaattggagccttttcttctgaacaagaggtgtggatgggattctctag

SEQ ID NO: 61648 - DNA, 573 bp, Zea mays
  unsure at all n locations
  Clone ID: LIB3069-029-E9-C12P1-A
gcattttgcactctaccagtcgctgaagaaggccctttataagcctgcggcatttaacaagggaattttgctaccactctgtcgggaaaggaattgcaccctacgcgaagcagtgattattgggagtattatccagaaagtttccattccatttctccatgcaagtgtagctctagtaaaactagcagagatggagtactgtggcactacaagttacttcatcaagctatttctagacaagaaatatgctttgccataccgtgcacttgatgcagtgcttgcccatttcatgcgttttgttgatgatgagaggatcatgcctgttatatggcatcaatcactgcttgcatttgtggaaagatacaagaacgagttagagaaaaaggataaggagaaacttgcacgtttgttggatcaccagaaacactatttagttactccagaaattcgaagggagcttcgagggagctgcaacaggggtgaaaaagatacaaatttgcatactttgtcacctatctncgtcattaccaagcctatcgnaggaagacaaatgggacgtaccaacagtgccca

SEQ ID NO: 61649 - DNA, 612 bp, Zea mays
  Clone ID: LIB3069-029-E9-D10P1-A
cagcggccgccaccgcggtgaacaaaaactgccagaacgagctccgggttattcattttcatttttgggtcaagtatgtttcacctttagttgtggcaggtacaaagtcgggtgatctaccatttcttacccagttacgctaaagacagtatgctacatgtccatgctgaatgccctcttggaatgctccaatggatcaaaacaaacttttctcgcttgtgaatcacattgcgactgcaaaatgccctgataacattgggggcccaatctagtgggaacctattttaccgaatattggcactaaaagttcacgcccaataaaatacaacaatatctctggaaattggcttcaaaaacaaatgaagtgtaaaaatcggtgttggagaatgtggctaatcttgctccattggcacttggggtacgttccatttgccttcctagataggcttggtattgacggcgataggtgacaaagtatgcaaatttgtgtctttttcacccctgttgcaacttccttgaagctgccttcgattttctggagtaactaaatagagtttctggggaaccaacaaacgtgcaaggttctacttatcctttttgtctaactgggtc

SEQ ID NO: 61650 - DNA, 263 bp, Zea mays
  Clone ID: LIB3069-029-E9-D11P1+A
aggctactgaatcccgtccaaacctgatactcatatgaataggctccaatctatttacggaggacctggacctgcacctgagattaagggggcaaggcgtgaccttaaaacaggcattgataacacccaccaccctatcacgcgcttagtactccagtagcatgtagtccgctagcaggagtgagtagtaataattacgtttcagaagaaagaaagatggaaagaaagaaaagagttttggcttcttctatcaagtcccatat

SEQ ID NO: 61651 - DNA, 345 bp, Zea mays
  Clone ID: LIB3069-029-E9-D11P1-A
accgcggtgaacagtttttgaagcaaatgtctaaagatattgctgtattttattgggcgtgaacttttagtgccaatattgcggtaaaataggttccgagtagattgggcccccaatgttctgagggcattttgcagtcggaatgtgattcacacacggaaaagtttgttttgatcatttggagcattccaagggggcattcagcatggacatgtagcatactgtctttcgcagaagtgggtaagaaatggttgatcatgttactttgtagctgcgacaactaaaggtgtaccatacttgaaccagaaatgaaaatgaataacccggagttcgtttggttttttt

SEQ ID NO: 61652 - DNA, 292 bp, Zea mays
  Clone ID: LIB3069-029-E9-D12P1-A
accgcggtgaacaagcactgcatcaagtgcacggtatggcaaagcatatttcttgtctagaaatagcttgatgaagtaacttgtagtgccacagtactccatctctgctagttttactagagctacacttgcatggagaaatggaatggaaactttctggataatactcccaataatcactgcttcgcgtagggtgcaattcctttcccgacagagtggtagcaaaattcccttgttaaatgccgcaggcttataaagggccttcttcagcgactggtagagtgcaaaatgc

SEQ ID NO: 61653 - DNA, 135 bp, Zea mays
  Clone ID: LIB3069-029-E9-D8P1-A
accgcggtgaacagtctttcgcagaagtgggtaagaaatggttgatcatgttactttgtagctgcgacaactaaaggtgtaccatacttgaaccagaaatgaaaatgaataacccggagttcgtttggttttttt

SEQ ID NO: 61654 - DNA, 144 bp, Zea mays
  unsure at all n locations
  Clone ID: LIB3069-029-E9-D9P1-A
cgggccgnatcagggggaaacagtcttggggggaaatctgtaaaaaatgtttgatcatgttactatccagctctttctactaaaggtgaaccatacttgaaccaggggggaatttgaatgacccgtaccgcgattacttttttt

SEQ ID NO: 61655 - DNA, 524 bp, Zea mays
  Clone ID: LIB3069-029-E9-E12P1+A
ttatcgataccgtcgacctcgagaacagaagtaccggaagccgttgatggtgaaccgcaccccgccggacttgcggcacggcacccggcggtaggagacggggacgatgccggcgcggtactcggcgatgtggaggaacatgggcatggcgaggtcgaagtgcgggcggggcgggttgcaccagccgccgtcgtcggaagggagcgcgtagttgggagggcagaagttggtggccgtgaccaggatggagggcctccctggccggcaccaccgccacccgggctgctcctcgcacctgatctcgaagcacgcgccgcagcggagcccctcgtcgaacagcgccgtgctcagcgccgcgttgttcacgccgtacccctggctgtacaggttgccgtacccgcaggcgccgcccatggtgcccgaagcgtcgctgccgccgtagaacgtggcgtgcgcgctctgccagccgccgccgccgccgccgacatacaacgccggaatgcgggcgggtgcgggggagagcg

SEQ ID NO: 61656 - DNA, 518 bp, Zea mays
  Clone ID: LIB3069-029-E9-E12P1-A
acagcggccgccaccgcggtgaacagtaaaagacacagattcgcatactttgtcatctatctccgtcattaccaagccttttagggacgacaaatgggacgtactacatgggccaatggtgcgagaatccaccgattctgcaacatccatctttacactttattagttcttgaagcatgatttctaaacgacatatgctgtattttattgggcgtgaactattagtgccaatattgtggtataataggttcccaggagattgggcccccaatgttctgagggccttttggagacggaatgttatttacacacggaaaagtttgttttgatcattgggaggattccaaggtggctttctgcttggacttgtagcatactgtttttctgagaaaagggtatgaaatggttgttcatgttacttcgtagctgcactgactaaaggtgggccatactcgaaccaaaaatgagaaggaataacccgcccttggtataggctttttaataaaaaaagaacttat

SEQ ID NO: 61657 - DNA, 238 bp, Zea mays
  Clone ID: LIB3069-029-E9-E8P1+A
ctagagaatcccatccacacctcttgttcagaagaaaaggctccaattttttcagagaggacctggacctggacctgggattaaggcgggaaggcgtgaccttaaaacaggcattgataacacccaccaccctaacacgcgcttagtactccagtagcagtagtacgctagcaggagtgagtagtaataattacgtatcagaagaaagaaagaaagaaagaaagaaaagagttttggc

SEQ ID NO: 61658 - DNA, 551 bp, Zea mays
  Clone ID: LIB3069-029-E9-F10P1-A
agttctacagcggccgccaccgcggtgaacactatgcgactaagtatgtaaatgactatcttttttacccctgttgcatgtcctttgaaggttcatttgacttaatggagtaactagatatatccactgactagtccaacgaacgggcaagttaacacttatcctttaggtctgactctgtcctggatctttacacaaatgcaagcagtgattgatgccatttaacaggcatgatcctatcatcatcaacaaaacgcatgataagggcaagcactgcataaagtgcacggcatggcaaagcatatttcttgtctagaaatagcttgatgaagcaacttgttgtgccacagttctccatttctggtagctttactagatctacacttgcatgaagaaatggaatggatactatctgaatcttactgccaataatcactgcttcgggtagggtgtaaaagctttcctgacagaacgagaccaaaattcccttggtaaatgccgcatgattataaaggtacttcttcagggactgctagagtgcgaaatgccta

SEQ ID NO: 61659 - DNA, 719 bp, Zea mays
  Clone ID: LIB3069-029-E9-F8P1-A
tagttctacagcggccgccaccgcggtgaacaggggcccaatctactgggaacctattttaccgcaatattggcactaaaagttcacgcccaataaaatacagcaatatctttagaaatttgcttcaaaaacaaatgaagtgtaaaaatcgatgttggagaatctggctaatcttgctccattggcacttgtggtacgtcccatttgtcttcctcgataggcttggtaatgacggagataggtgacaaagtatgcaaatttgtatctttttcacccctgttgcagctccctcgaagctcccttcgaatttctggagtaactaaatagtgtttctggtgatccaacaaacgtgcaagtttctccttatcctttttctctaactcgttcttgtatctttccacaaatgcaagcagtgattgatgccatataacaggcatgatcctctcatcatcaacaaaacgcatgaaatgggcaagcactgcatcaagtgcacggtatggcaaagcatatttcttgtctagaaatagcttgatgaagtaacttgtagtgccacagtactccatctctgctagttttactagagctacacttgcatggagaaatggaatggaaactttctggataatactcccaataatcactgcttcgcgtagggtgcaattcctttcccgacagagtggtagcaaaattcccttgtaaatgccgcaggcttataaagg

SEQ ID NO: 61660 - DNA, 627 bp, Zea mays
  Clone ID: LIB3069-029-E9-F9P1+A
gacctcgagaacaaataccgctagcgttaattctcttctaaattgattatatcttatccaatctctagatttcggtccccatacacgctctaatcccgtattgtaccagcgtacagcatgatctgtatagttgccaataagcctagttaaatcattataacgactattgatagtcgcggcatcaaatccccacctttgtccaaacactgaaacatctctcaaaactgataaatgtaaatttgcagcttgaacatatactgataaaagaggaacttgataattttgaactgcaaaaagaggaatagcggttgtaagggcactgttcatgtcattgaattgaatacgcatctcttctcttaatgctggattagtaggatctgcttcccactctctaaaagattctgcgtaaatttgataaagattgcttagtccttctaatctagaaatggcttggttcctagcgaattcttctattctttggttaattaactgttcaatttgtacaagaaatgcgtcccattgagagggaccaaaaattccccatatcatatcaactagtcctaacacaaatccagcaccgggaacaaattcactcaaaagaaattgcgttagcgacaaggaaatatc

SEQ ID NO: 61661 - DNA, 342 bp, Zea mays
  Clone ID: LIB3069-029-E9-F9P1-A
gcattttgcactctaccagtcgctgaagaaggccctttataagcctgcggcatttaacaagggaattttgctaccactctgtcgggaaaggaattgcaccctacgcgaagcagtgattattgggagtattatccagaaagtttccattccatttctccatgcaagtgtagctctagtaaaactagcagagatggagtactgtggcactacaagttacttcatcaagctatttctagacaagaaatatgctttgccataccgtgcacttgatgcagtgcttgcccatttcatgcgttttgttgatgatgagaggatcatgcctgttatatggcatcaatcact

SEQ ID NO: 61662 - DNA, 72 bp, Zea mays
  Clone ID: LIB3069-029-E9-G12P1+A
cctctagaaaacacgaaaagtgccgcacctatccccgatcccaacaaaagcgcaggctccatggcgatgtgt

SEQ ID NO: 61663 - DNA, 650 bp, Zea mays
  Clone ID: LIB3069-029-E9-G8P1+A
cttatcgacaccgtcgacctcgagaacagtgccgccgtcgccaccgctcgctcgcccgcctgcctgcctgggcccgcagcaccgactctgacagcgcccgtcctgcttcctgtaccggcaggcgagggagtggactcagggagtgtgatggcggcaatgccggcgccgcttctgcctctgcttctgctggtggtggccgcggcgatgacgctctcccccgccaccgcccgcattcccggcgtgtatgtcggcggcggcggcggcggctggcagagcgcgcacgccacgttctacggcggcagcgacgcttcgggcaccatgggcggcgcctgcgggtacggcaacctgtacagccaggggtacggcgtgaacaacgcggcgctgagcacggcgctgttcgacgaggggctccgctgcggcgcgtgcttcgagatcaggtgcgaggagcagcccgggtggcggtggtgccggccagggaggccctccatcctggtcacggccaccaacttctgccctcccaactacgcgctcccttccgacgacggcggctggtgcaacccgccccgcccgcacttcgacctcgccatgcccatgttcctccacatcgccgagtaccgcgccggcatcgtccccgtctcctaccgccgggt

SEQ ID NO: 61664 - DNA, 625 bp, Zea mays
  Clone ID: LIB3069-029-E9-G9P1+A
cgtcgacctcgagaacagaagacctattaatcaggggaatttttcagcaactatgagtagtgggagtaatttattttccggaagctttaggactgtaggttttactactccgtttaacttttcaaatggatcaagtgtatttacgttaagtgctcatgtcttcaattcaggcaatgaagtttatatagatcgaattgaatttgttccggcagaagtaacctttgaggcagaatatgatttagaaagagcacaaaaggcggtgaatgagctgtttacttcttccaatcaaatcgggttaaaaacagatgtgacggattatcatattgatcaagtatccaatttagttgagtgtttatcagatgaattttgtctggatgaaaaacaagaagtgtccgagaaagtcaaacatgcgaagcgacttagtgatgagcggaatttacttcaagatccaaacttcagagggatcaatagacaactagaccgtggctggagaggaagtacggatattaccatccaaggaggcgatgacgtattcaaagagaattacgttacactaccaggtacctttgatgagtgctatccaacatatttgtatcaaaaaatcgatgaattaaaattaaaagcc

SEQ ID NO: 61665 - DNA, 336 bp, Zea mays
  Clone ID: LIB3069-029-E9-H10P1-A
aaaaaaaccaaacgaactccgggttattcattttcatttctggttcaagtatggtacacctttagttgtcgcagctacaaagtaacatgatcaaccatttcttacccacttctgcgaaagacagtatgctacatgtccatgctgaatgcccccttggaatgctccaaatgatcaaaacaaacttttccgtgtgtgaatcacattccgactgcaaaatgccctcagaacattgggggcccaatctactgggaacctattttaccgcaatattggcactaaaagttcacgcccaataaaatacagcaatatctttagaaatttgcttcaaaaacaaat

SEQ ID NO: 61666 - DNA, 616 bp, Zea mays
  Clone ID: LIB3069-029-E9-H8P1+A
ccgccgacctcgagaacaaaaagagttttggcttcttctcccaagtcgcatcccatcccatgcatcagaccctgattttcttgccctcgaaggtctggccgaactgccaggtgctcggggcggcgttccaggaggtggaggtgcggcggtcgctggcggtgacgcggaaggagagcgcctggccgacgaggatggcgttggactgccagttctggccccagttcctggacatgggcagccacccggtgctggccgccttgacgctcgcgcgcaccacgtcccccgcgccggccacgttcgtgatcagcaccaggttgaagtaccggaagccgttgatggtgaaccgcaccccgccggacttgcggcacggcacccggcggtaggagacggggacgatgccggcgcggtactcggcgatgtggaggaacatgggcatggcgaggtcgaagtgcgggcggggcgggttgcaccagccgccgtcgtcggaagggagcgcgtagttgggagggcagaagttggtggccgtgaccaggatggagggcctccctggccggcaccaccgccacccgggctgctcctcgcacctgatcttgaagcacgcgccgcagcggaaccc

SEQ ID NO: 61667 - DNA, 631 bp, Zea mays
  Clone ID: LIB3069-029-E9-H8P1-A
accgcggtgaacagcttcaaaaacaaatgaagtgtaaaaatcgatgttggagaatctggctaatcttgctccattggcacttgtggtacgtcccatttgtcttcctcgataggcttggtaatgacggagataggtgacaaagtatgcaaatttgtatctttttcacccctgttgcagctccctcgaagctcccttcgaatttctggagtaactaaatagtgtttctggtgatccaacaaacgtgcaagtttctccttatcctttttctctaactcgttcttgtatctttccacaaatgcaagcagtgattgatgccatataacaggcatgatcctctcatcatcaacaaaacgcatgaaatgggcaagcactgcatcaagtgcacggtatggcaaagcatatttcttgtctagaaatagcttgatgaagtaacttgtagtgccacagtactccatctctgctagttttactagagctacacttgcatggagaaatggaatggaaactttctggataatactcccaataatcactgcttcgcgtagggtgcaattcctttcccgacagagtggtagcaaaattcccttgttaaatgccgcaagcttataaagggccttcttcagcgactggt

SEQ ID NO: 61668 - DNA, 270 bp, Zea mays
  Clone ID: LIB3069-029-E9-H9P1+A
cggacgcgtgggcggacgcgtgggcccggcctgtgccgccgtcgccaccgctcgctcgcccgcctgcctgcctgggcccgcagcaccgactctgacagcgcccgtcctgcttcctgtaccggcaggcgagggagtggactcagggagtgtgatggcggcaatgccggcgccgcttctgcctctgcttctgctggtggtggccgcggagatgacgctttcccccgccaccgtccgtattcccggggtgtattgttggcggcggcggcggct

SEQ ID NO: 61669 - DNA, 190 bp, Zea mays
  Clone ID: LIB3069-034-A11-A5P1+A
gcttatcgataccgtcgacctcgagaacacattccaagggggcattcagcatggacatgtagcatactgtctttcgcagaagtggttaagaaatggttgatcatgttactttgtagctgcgacaactaaaggtgtaccatacttgaaccagaaatgaaaatgaataacccggagttcgtttggttttttt

SEQ ID NO: 61670 - DNA, 376 bp, Zea mays
  Clone ID: LIB3069-034-A11-A5P1-A
tacagcggccgccaccgcggtgaacaccccgagcacctggcagttcggccagaccttcgagggcaagaacttcagggtcttatgcatggcatgggaagcaacttgggagaagaagccaaaactcttttcttactttctttctttctttcttctgatacgcaattattactactcactcctgctagcgaactactgctactgaagtactaagcgcgtgatagggtggtgggagttatcaatgcctgttttaaggtcacgccttcccgccttaataccaggtccaggtccaggtcctctctgaaaaaataggagccttttcttctgaacaagaggtgtggatgggattctgtagaaaatacataaaaagctacattag

SEQ ID NO: 61671 - DNA, 199 bp, Zea mays
  Clone ID: LIB3069-034-A11-A6P1+A
tcgataccgtcgacctcgagaacacattacaagggggcgttcaggatggacatgtcgcatactgtgtttcgcaaaaatggttaaaagatgggtgatcatgttactctgtagctgggacaactaaaggcgtaccatactggaaccagaaatgaaaatgaagaacacgcagtatcgctggtgtttgtaaaaaaagcaaaaa

SEQ ID NO: 61672 - DNA, 549 bp, Zea mays
  Clone ID: LIB3069-034-A11-A6P1-A
gccaccgggtaacacttcctgaccggtggcgagggagtggactcagggagtgtgatggcggcaatgttttcgccgcttctgcctctgcttatgctgggggtggccttggcgaagacgctctcccccgccaccgtccacattcctggcgtgtatgtcggcggcggcggcggtggctggcatagcgcgcacgccacgttctacggcggcagcgacgcttcgggcaccatgggcggcgcctgcgggtacggcaacctgtacagccaggggtacggcgtgaacaacgcggcgctgagcacggcgctgttcgacgaggggctccgctgcggcgcgtgcttcgagatcaggtgcgaggagcaccccgggtggcggtggtgccgtccagggaggccctccatcctggtcacggtcaccaacttctgccctcccaactacgcgctcccttccgacgacggcggctggtgcaacccgccccgcccgcactttgacctcgccatgcccatgttcctccacatcgccgagaaccgcgccggcatcgtccccgtatcctac

SEQ ID NO: 61673 - DNA, 103 bp, Zea mays
  Clone ID: LIB3069-034-A11-B4P1+A
gacctcgagaacaggttcacctttagttgtcgcactttcaaagcagcctgatcaaccatttcttccctttttctgtgcaagaccgtatgcttcatgctccttg

SEQ ID NO: 61674 - DNA, 699 bp, Zea mays
  Clone ID: LIB3069-034-A11-B6P1+A
agcttatcgataccgtcgacctcgagaacagtattatccagaaagtttccattccatttctccatgcaagtgtagctctagtaaaactagcagagatggagtactgtggcactacaagttacttcatcaagctatttctagacaagaaatatgctttgccataccgtgcacttgatgcagtgcttgcccatttcatgcgttttgttgatgatgagaggatcatgcctgttatatggcatcaatcactgcttgcatttgtggaaagatacaagaacgagttagagaaaaaggataaggagaaacttgcacgtttgttggatcaccagaaacactatttagttactccagaaattcgaagggagcttcgagggagctgcaacaggggtgaaaaagatacaaatttgcatactttgtcacctatctccgtcattaccaagcctatcgaggaagacaaatgggacgtaccacaagtgccaatggagcaagattagccagattctccaacatcgatttttacacttcatttgtttttgaagcaaatttctaaagatattgctgtattttattgggcgtgaacttttagtgccaatattgcggtaaaataggttcccagtagattgggcccccaatgttctgagggcattttgcagtcggaatgtgattcacacacggaaaaagttgttttgataatttggagca

SEQ ID NO: 61675 - DNA, 620 bp, Zea mays
  Clone ID: LIB3069-034-A11-C5P1-A
gcggccgccaccgcggtgaacagagcacggcgctgttcgacgaggggctccgctgcggcgcgtgcttggagatcaggtgcgaggagcaccccgggtggccgtggtgccggccagggaggccctccatactggtcacggccaccaacttctgcccttccaactactcgctccctttcgacgacggcgggtggtgcaacccgaccagcccgcacttggacctagccatgcccatgttcctccacatcgccgagtaccgcgccggcatcgtccccgtctcctaccggcgggtgccgtgccgcaagtcctgtggtgcgcggctcaccatgaacgggttccggtacttcaacctggcgctgatcacgaacgtggctcggcgcgcgggacgtggggcgcgcaagcgtgaaggcggccaccaccgggtggatgcccatgtccaataactgggctcataactgtcatggctaactgactccttgtcggccaggcgctctccttccgcgtcaccgacagcgaccgtcagacctgcacctactggaacgccgacccgagcacctggcagttcggacagaccttcgagggcaagaacttcagggtctgatgcacgggatgggatgcgactt

SEQ ID NO: 61676 - DNA, 339 bp, Zea mays
  Clone ID: LIB3069-034-A11-C6P1-A
atattttttttttttttcatgttgaaagagaatcccatccacaccttttgttcaaaagaaaaggctccaattttttaagagaggacctgtacctggacctgggattaaggcgggaaggcgtgaccttaaaacaggcattgataacacccaccaccctaacacgcgcttagtactccattaatagtgctacgctagcaggagtgagtagtaataattacgtttcaaaagaaagaaagaaagaaagaaagaaaagagttttggtttcttctcccaagtcggatcccatcccatgcatcagaccctgaagttcttgccctataaggtctggccgaactgcca

SEQ ID NO: 61677 - DNA, 665 bp, Zea mays
  Clone ID: LIB3069-034-A11-C7P1+A
taccgtcgacctcgagaacaatttttgacccagggtgttaacaatctacttacttctcgcccattatccatgctttagactttacaatgtttaaccaatgcattaagggtttgtattccgttaacttattttaaagtcttattactttttatacttatatataaaatccacttttcctattttacatatacaaattgaggatttgtggtaatgtagaaatacttacacttatacatgttagaaccatttacctgcaattcatcttgaattgtaaatgcttcccctttttttacagtcttaatcttatcattccaattagcagaaccatagacccataattcgtttgtatctacaaccactaatttaccaatattactcgtttgtctacgggcaaagtaaatataggaagagtcatatttcacccatgaattacctaggttcagccagccctcacgttcttcccaaacaatataagattcaggtttgttcaatttacgaattacatcactactcgtgctaggtcctctgcgaaggttaatatttacaccttccatgtaagcaattcctaatccttgtgtacccgcatccttgttatgattctctacaaccatatcgtttagactatcttcaatcatcctcttgaaaccctcaaatccacctggtcg

SEQ ID NO: 61678 - DNA, 511 bp, Zea mays
  Clone ID: LIB3069-034-A11-D3P1+A
cgagaacaaagacagtatgctacatgtccatgctgaatgcccccttggaatgctccaaatgatttttacaaacttttccgtgtgtgaatcacattccgactgtaaaatgccctcaaagcattgggggcccaatctactgggaacctattttaccgcaatattggcactaaaagttcacgcccaataaaatacagcaatatctttagaaatttgcttcaaaaacaaatgaagtgtaaaaatcgatgctggagaatctggctaatcttgctccattggcacttgtggtacgtaccatttgtatttctcgataggcttggtaatgacggagataggtgacaaagtatgcaaatttgtatctttttcacccctgttgcagctccctcgaagctcccttcgaatttctggagtaactaaatagagtgtttggtgatccaacaaacgtgcaagtttctccttatcctttttgtttaactcgttcttgtatctttccacaaatgcaagcggtgattga

SEQ ID NO: 61679 - DNA, 156 bp, Zea mays
  Clone ID: LIB3069-034-A11-D4P1+A
gcttatcgataccgtcgacctcgagaacatttttaaaacctagaacgcacatattgggcgcgcacgatctagacgaggcaagctaacccgctgcgcgcgtgcgaaggcgaatatgaagattgtggagatacatgaactggagggggcagacattgg

SEQ ID NO: 61680 - DNA, 629 bp, Zea mays
  Clone ID: LIB3069-034-A11-D4P1-A
accgcggtgaacagcatcagaccctgaagttcttgccctcgaaggtctggcccaactggcaaggtgcttggggcggcgttccaggaggtgggaggtggcgggggtcgctggcggtgacgcggaaggagagcgcctggccgacgaggatggcgttggactgccagttctggccccagttcctggacatgggcagccacccggtgctggccgccttgacgctcgcgcgcaccacgtcccccgcgccggccacgttcgtgatcagcaccaggttgaagtaccggaagccgttgatggtgaaccgcaccccgccggacttgcggcacggcacccggcggtaggagacggggacgatgccggcgcggtactcggcgatgtggaggaacatgggcatggcgaggtcgaagtgcgggcggggcgggttgcaccagccgccgtcgtcggaagggagcgcgtagttgggagggcagaagttggtggccgtgaccaggatggagggcctccctggccggcaccaccgccacccgggctgctcctcgcacctgatctcgaagcacgcgccgcagcggagcccctcgtcgaacagcgccgtgctcagcgccgcgttgttcacgccgtacccctggctgtac

SEQ ID NO: 61681 - DNA, 622 bp, Zea mays
  Clone ID: LIB3069-034-A11-D5P1+A
gcttatcgataccgtcgacctcgagaacaaaaacaaatgaagtgtaaaaatcgatgttggagaatctggctaatcttgctccattggcacttgtggtacgtcccatttgtcttcctcgataggcttggtaatgacggagataggtgacaaagtatgcaaatttgtatctttttcacccctgttgcagctccctcgaagctcccttcgaatttctggagtaactaaatagtgtttctggtgatccaacaaacgtgcaagtttctccttatcctttttctctaactcgttcttgtatctttccacaaatgcaagcagtgattgatgccatataacaggcatgatcctctcatcatcaacaaaacgcatgaaatgggcaagcactgcatcaagtgcacggtatggcaaagcatatttcttgtctagaaatagcttgatgaagtaacttgtagtgccacagtactccatctctgctagttttactagagctacacttgcatggagaaatggaatggaaactttctggataatactcccaataatcactgcttcgcgtagggtgcaattcctttcccgacagagtggtagcaaaattcccttgttaaatgccgcaggcttataaagg

SEQ ID NO: 61682 - DNA, 618 bp, Zea mays
  Clone ID: LIB3069-034-A11-D6P1+A
gcttatcgataccgtcgacctcgagaacaaagaacgagttagagaaaaaggataaggagaaacttgcacgtttgttggatcaccagaaacactatttagttactccagaaattcgaagggagcttcgagggagctgcaacaggggtgaaaaagatacaaatttgcatactttgtcacctatctccgtcattaccaagcctatcgaggaagacaaatgggacgtaccacaagtgccaatggagcaagattagccagattctccaacatcgatttttacacttcatttgtttttgaagcaaatttctaaagatattgctgtattttattgggcgtgaacttttagtgccaatattgcggtaaaataggttcccagtagattgggcccccaatgttctgagggcattttgcagtcggaatgtgattcacacacggaaaagtttgttttgatcatttggagcattccaagggggcattcagcatggacatgtagcatactgtctttcgcagaagtgggtaagaaatggttgatcatgttactttgtagctgcgacaactaaaggtgtaccatacttgaaccagaaatgaaaatgaataacccggagttcgtttggttttttt

SEQ ID NO: 61683 - DNA, 52 bp, Zea mays
  Clone ID: LIB3069-034-A11-D7P1-A
cagcggccgccaccgcggtgaacactttgtggcgactatgatgcgtcgggcg

SEQ ID NO: 61684 - DNA, 230 bp, Zea mays
  Clone ID: LIB3069-034-A11-E4P1+A
gcattttgcactctaccagtcgctgaagaaggccctttataagcctgcggcatttaacaagggaattttgctaccactctgtcgggaaaggaattgcaccctacgcgaagcagtgattattgggagtattatccagaaagtttccattccatttctccatgcaagtgtagctctagtaaaactagcagagatggagtactgtggcactacaagttacttcatcaagctat

SEQ ID NO: 61685 - DNA, 229 bp, Zea mays
  Clone ID: LIB3069-034-A11-E5P1+A
gcattttgcactctaccagtcgctgaagaaggccctttataagcctgcggcatttaacaagggaattttgctaccactctgtcgggaaaggaattgcaccctacgcgaagcagtgattattgggagtattatccagaaagtttccattccatttctccatgcaagtgtagctctagtaaaactagcagagatggagtactgtggcactacaagttacttcatcaagcta

SEQ ID NO: 61686 - DNA, 506 bp, Zea mays
  unsure at all n locations
  Clone ID: LIB3069-034-A11-E6P1+A
ccgncgacctcgagaacaaattcacccatgacgctggtccctaaaagctaccatcggaatttctggagcgacttttttattgttctggcgatccaacaaacgtgcatgcttatccttatgctttttctctaacccgctcttgtatctttccacaaatgcatgctgagatcgatgccatattacactgcatgaccctctcatcatcaacaaaacgcatgaaatgggcaagcactgtttcaagtgcacaggatggcaaagcatatttcttgcctagaaatagctggatgaattaactgagagtgccacagccctccatctctggtagttatactagagctacacttgcatggagaaatggaatggaaactctatggataatactcccaataatcactgcttcgcgtatggagcaatgcctttcccgtcagagtgttagcaaaattgcattgttaaatgccgcaagcttataaagggccttgttcagcgactgatagagtgcataatgc

SEQ ID NO: 61687 - DNA, 238 bp, Zea mays
  Clone ID: LIB3069-034-A11-E6P1-A
aatattttttattagtaatacctgaagagaatcccatccacacctctggttcagaaaaaaaggctccaattttttcagaaaggacctggacctgttcttgagattaatgcggaaaggcactaccttaaaacaggcattgataacacccaccaccttagcacgcactaagtactccagtaacactcctactctaacaggagtgttttggaataatttcgtatcagaaaaatgaaagaag

SEQ ID NO: 61688 - DNA, 624 bp, Zea mays
  Clone ID: LIB3069-034-A11-E7P1+A
cgtcgacctcgagaacagaacacgtttatctgccgcatgaatcatggcaatattcgtatccgcttgtaattgattttattgagagtttacaaataaagcatctacagattcttttgcctctttataaacgatatttgtttcccattccaatttttcacgtttgtctctccattttttctccgctcttttcacacgagctagtgcttctcctactaatggtttctcttcgagaaactctagattccctagtcttgcgtgcccatcttgcgtcttaatcttaaagatcacccatacacctaggtcctcatttaagtctgtacatcctacatcaatgtctaaggagaaatgatgcgaatgatgggcacacttttctccatccctacacgaacaatctaagtcaggattccattcaaggtgtggcgcgcatcgattcggctctccacactttccgattggactttgggctgaaagcggccataaggaacccgtacctggcacatttactgtttcatgttttgcattgtagcgaattaaatagatttctaagtcttgactatcttcgatataccctcttaattgataacgggtaaaggcttttaattttgattcatcgattttttgata

SEQ ID NO: 61689 - DNA, 471 bp, Zea mays
  Clone ID: LIB3069-034-A11-F4P1+A
gcttatcgataccgtcgacctcgagaacacctatctccgtcattaccaagcctatcgaggaagacaaatgggacgtaccacaagttccaatggagcaagattagccagattctccaacatcgatttttacacttcatttgtttttgaagcaaatttctaaagatattgctgtattttattgggcgtgaacttttagtgccaatattgcggtaaaataggttcccagtagattgggcccccaatgttctgagggcattttgcagtcggaatgtgattcacacacggaaaagtttgttttgatcatttggagcattccaagggggcattcagcatggacatgtagcatactgtctttcgcagaagtgggtaagaaatggttgatcatgttactttgtagctgcgacaactaaaggtgtaccatacttgaaccagaaatgaaaatgaataacccggagttcgtttggttttttt

SEQ ID NO: 61690 - DNA, 583 bp, Zea mays
  unsure at all n locations
  Clone ID: LIB3069-034-A11-F4P1-A
agttatagagcggccgccaccgcggtgaacaacttcaacctggtgctgatcacgaacgtggccggcgcgggggacgtggtgcgcgcgagcgtcaaggcggccagcaccgggtggctgcccatgtccaggaactggggccagaactggcagtccaacgccatcctcgtcggccaggcgctctccttccgcgtcaccgccagcgaccgccgcacctccacctcctggaacgccgccccgagcacctggcagttcggccagaccttcgagggcaagaacttcagggtctgatgcatgggatgggatgcgacttgggagaagaagccaaaactcttttctttctttctttctttctttcttctgatacgtaattattactactcactcctgctagcgtactactgctactggagtactaagcgcgtgttagggtggtgggtgttatcaatgcctgttttaaggtcacgccttcccgccttaatcccaggtccaggtccaggtcctctctgaaaaaattggagccttttcttctgaacaagaggtgtggatgggattctctagaaaaaaaaaaaaaaaaaaaaaanag

SEQ ID NO: 61691 - DNA, 142 bp, Zea mays
  Clone ID: LIB3069-034-A11-F5P1+A
ccgtcgacctcgagaacacccaataatcactgcttcgcgtagggtgcaattcctttcccgacagagtggtagcttaattcccttgttaaatgccgcaggcttataaagggccttcttcagcgactggtagagtgcaaaatgc

SEQ ID NO: 61692 - DNA, 427 bp, Zea mays
  Clone ID: LIB3069-034-A11-F5P1-A
ggtactctccttgttttgtttcatctagagaatccgatgcacaccttttgttcagaagaaaaggttcaatttttttcagagaggacctggacctgtaccttggattaagtgcggtaaggcgtgaccttaaaacaggcattgataacacccaccaccctaacacgcgtttaggactccaatttaaggctttccctagccggagcgagtaaaaattattacgtgtcaaaggaaagaatgaaggaacgaaagaaatgagttttggctttttctcctaagtcgtatcccatcccatgcataataccctgaagttgttgccctctaaggcatggccgaactgtcaggtgctcggtgcggttttccaataagggatggtgccgagttcgctctctgggacacaaaatgagatcgcctggccgacaaggatggc

SEQ ID NO: 61693 - DNA, 142 bp, Zea mays
  unsure at all n locations
  Clone ID: LIB3069-034-A11-G3P1-A
ggccgccaccgcggtggaacaggncnnacaggcgcgggcccacgcgttcccgcccacggccgttccgcgggaccgccggntggnngtcggactctcgggggaaatttcccgggacccgggtacccttggcagggccgtccca

SEQ ID NO: 61694 - DNA, 329 bp, Zea mays
  Clone ID: LIB3069-034-A11-G4P1-A
cggacgcgtgggcggacgcgtgggcccggcctgtgccgccgtcgccaccgctcgctcgcccgcctgcctgcctgggcccgcagcaccgactctgacagcgcccgtcctgcttcctgtaccggcaggcgagggagtggactcagggagtgtgatggcggcaatgccggcgccgcttctgcctctgcttctgctggtggtggccgcggcgatgacgctctcccccgccaccgcccgcattcccggcgtgtatgtcggcggcggcggcggcggctggcaaagcgcgcacgccacgttctacggcggcagcgacgcttcgggcaccatgggcg

SEQ ID NO: 61695 - DNA, 153 bp, Zea mays
  Clone ID: LIB3069-034-A11-G6P1+A
aaaaaaaccaaacgaactccgggttattcattttcatttctggttcaagtatggtacacctttagttgtcgcagctacaaagtaacatgatcaaccattttttacccacttttgggaaagacaggatgctacatgtccatgcctgatgccccc

SEQ ID NO: 61696 - DNA, 425 bp, Zea mays
  Clone ID: LIB3069-034-A11-G7P1+A
cggccgcgtcgacggatcggcccgatcggccgcatgccggagacgggaatggagcgggtaatcgctcgtctatcggcattgaaatttgtgaaaatcgtgatggtaattttgaaaaagccttaacccatgctgcgggtctcgttaagtttctcatggctcaccttggattaaagattgggaacgtagtttcccatcaacattggagtggaaagaactgtccacgtccgatatttaatcgaccaggtggatttgagggtttcaagaggatgattgaagatagtctaaacgatatggttgtagagaatcataacaaggatgcgggtacacaaggattaggaattgcttacatggaaggtgtaaatattaaccttcgcagagggcctaccacgagtagtgatgtaattcgaaaatggacaaacctgaat

SEQ ID NO: 61697 - DNA, 367 bp, Zea mays
  Clone ID: LIB3069-034-A11-G7P1-A
cggacgcgtgggcggacgcgtgggcccggcctgtgccgccgtcgccaccgctcgctcgcccgcctgcctgcctgggcccgcagcaccgactctgacagcgcccgtcctgcttcctgtaccggcaggcgagggagtggactcagggagtgtgatggcggcaatgccggcgccgcttctgcctctgcttctgctggtggtggccgcggcgatgacgctctcccccgccaccgcccgaattcccggcgtgtatgtcggcggcggcggcggcggctggcaaagcgcgcacgccacgttctacggtggcagcgacgcttcggcaccatgggcggcgcctgcgggtacggaaacctgtacagccaggggtacg

SEQ ID NO: 61698 - DNA, 250 bp, Zea mays
  unsure at all n locations
  Clone ID: LIB3069-034-A11-H3P1-A
gcggcgncaccgcggggaacactcttctgtctttctttctttctttcttctgatacgtaattattactactcacttttgctagcgtactactgctactggagtactaagcgcgtgttagggtggtgggtgttatcaatgcctgttttaaggtcacgccttcccgccttaatcccaggtccaggtccaggtcctctctgaaaaaattggagccttttcttctgaacaagaggtgtggatgggattctctag

SEQ ID NO: 61699 - DNA, 186 bp, Zea mays
  Clone ID: LIB3069-034-A11-H4P1-A
aaaaaaacgcaacaaactccgggttattcattgtaattccatggaccaggatgggacaccctttacttgtgcgcactaacaaggtaacactatcaaccattttttacccactatgccaaagacattagcttggatgccctgcagaaggcccccttggaatgctccaaatgatcaaaacaaactttt

SEQ ID NO: 61700 - DNA, 130 bp, Zea mays
  Clone ID: LIB3069-034-A11-H5P1+A
ccgtcgacctcgagaacactaacaggtatgccataggcgggattcttgtttgccactgaagcagactcaaccttttgattctgcatgtagggtatgcgccaaccgaagggcttttgtccgtaaaacagcc

SEQ ID NO: 61701 - DNA, 629 bp, Zea mays
  unsure at all n locations
  Clone ID: LIB3069-034-A11-H7P1+A
accgnngctctagaacatctgggaagtattctaattcttttgtcacataaccaactggtagtggcgtgtaatctttataccctctgttaaattcacaaggattctctcttcgtccatctgtatacgatttttcttcatagactgacgcataatcagctggtacggaaggagcttcgttatatcctcgattacgagaagtgtacgcacctccgtattcttcttgatttacagtataatcattacacgttaccgtgttatttggatagatttcctcttctacgcagttgctaaacttcagttcgtctgtattgttctcgatctcatgaatggttacgcaaccttctccatatccctccttgtacgctgtgacacgaaggatatagccacgacccggacagacacgaacttcttgtgacacttctgcttcccattccggaacaacaaggaccgaacgttggttgttttgttcttctacatctacatgccctttcacgttccagcaggataagccattattaaaatcaccatttttaatgacatttctcgcatcatatagggagaatgcagtgaaaatacgcccttctaattcttcaaaaatagccgcattgacacccggaatcacagacagc

SEQ ID NO: 61702 - DNA, 117 bp, Zea mays
  Clone ID: LIB3069-034-F6-D11P1-A
cgtgtagtcgtcgctcagctggctggtcacaacccccgtcagccgacgtgcgctatcgtactatgctgagtcacccgtagacacatatgcctgcgaccatgtacagatacaacagat

SEQ ID NO: 61703 - DNA, 335 bp, Zea mays
  Clone ID: LIB3069-034-F6-E11P1-A
cccacgcgtccgcccacgcgtccgcggacgcgtgggcagcagagagattactacgatccaacagttctagagcaagagagaggaagacacaccgcagagttagcaggctaataacttgcaggagcagcaggaatggcggcgacgcgtcgcctctcttgctttctcctcgccgtgcttctggcaggagtggccgctgccaccgccttcgacgaagcggctgctgccggctttgggcttggccacggcgcgcgtttcgcgcgcaagcatggacgtgctgccgctgaaatgccccagccggagccacaaccttaaaactaagccggagccccatatgc

SEQ ID NO: 61704 - DNA, 566 bp, Zea mays
  Clone ID: LIB3069-034-F6-F11P1-A
accgcggtgaacaaaacccgaaccgaaaccggagccaaagccagagccccaacctaagccagagcctaagcctgagccgaaaccagaaccaaagccagagccacaaccaaagcctgagcctaaaccagaaccaaaaccagagccaaagccagagcctaagcccgaaccaaaacagagccaaagcctgagcctaaacccgaaccaaggccagaacctaagccagagccaaagcctgagccgaaaccgaaaccagatccaaagccagagccacaaccaaagccagagcctaagccagaaccaaaaccagagccaaagccagagcctaagcccgaaccaaaaccagagccaaagcctgagcctaaacccgaaccaagaccagaaccagaaccaaagccagagcctaaacctgaaccaaaaccgaaaccagaaccggagccacaaccaaagccagagcctaagcctgatccaaaaccagagcctaaacccgaaccaaaaccagagccccaaccaaaaccagaacctaagcccgaaccaaaaccacagccagaacctaagcccgagcccaa

SEQ ID NO: 61705 - DNA, 360 bp, Zea mays
  unsure at all n locations
  Clone ID: LIB3069-040-Q1-K1-F10-F2B
gaattgcgcccgacgaagcatgacgccaggccggaagcccgaaaaacgacccgccctaaataaaaagctaaggccgaccccactttttttccctctgaattcctttctagggccaatatataaaaggggcccagcgcaaaaattaagggaccacccttctatgccgattcccaaaaaaagcagggcacagaaggggggcaaaacgcaggcccccccccaaaaagggcaaaccccacccgacggccgccaaagggaaaaacaaacaagcgatccccacccaggnaaagcccaagccacatggcatggacctccgcgattaaagggaaccaaccaaccggtccgtcccaaggcatcaaaagg

SEQ ID NO: 61706 - DNA, 484 bp, Zea mays
  Clone ID: LIB3069-004-Q1-K1-F8-F5A
gggcactgcccccttggcaacagcaaagttcgaggtcgttgagaagaagctcacgagcccacgggaccaatccggcaagcctgcttctgatgctctgcagaagagcactgcagcttacatgccaactatggagaggcagaagtcgtttgctaagaccaagctgttggatgaacctcccccgcaccaaaacaggggtagagccgtattcatgctgcagattggtctttgcaggatttcgagatacatacttgtacataggggtgatccacccccgcaccaaaacaggggatgaaccctcccctgcaccaaaacaggggcccttttcttgacatgctaccacctcgtactggttgtcttcgtttcggtagtttgttttgcagtcatgcatagccagttacctctcgttttattatttgcttgtttgttgtagcactcatcagttgacatgaggacgtagggttgtggcgtttaccagattgatttt

SEQ ID NO: 61707 - DNA, 449 bp, Zea mays
  Clone ID: LIB3069-004-Q1-K1-F8-R5A
ctgcaatttccttgattcttctggttcagatgttttctctgctgaagtcaagccagcctttaattcatcgggggacatggttaaaagaactggaggatcaagctccttgtccatcagcctcctgcgaagtttagagatattcttgatgttgaactgtagttgtcgcagtttctggtatatttcccaaaatctgttccaagagcttcatatgcagatctttctaatgcagtcattatctcaacaacaacatcaagtccatatgatttttcattttcagcagaaccaacatcctttgcaggtgaaccactgattgaacttttggctgtagaattagcatcagcagatgttccagcattctcctttgatgcaagcgggaatactttctatcaatttatcgagccacctatcacgatgagaatgtccagtaagtactttatacttaacaaggg

SEQ ID NO: 61708 - DNA, 220 bp, Zea mays
  Clone ID: LIB3069-017-H3-A10P1-A
accgcggtgaacagaagcgattatacttatttcatcaggctgttgttgatttcatgaccgcctgtaccactgtcctgatccaggccattctttcacgagttacttgcagtacaggttgatgactggagcaatacggatctctgtgtttattgtacgactcaggacgtcatactaccgtatactttgattgatttaacgcccccattgatccagaattgct

SEQ ID NO: 61709 - DNA, 759 bp, Zea mays
  Clone ID: LIB3069-017-H3-A12P1-A
agtactacagcggccgccaccgcggtgaacagattccccctctcccagtcaaagccatccaagccgcaattacttcagggacagggtgttcactggggctagaaggattctgtttttattgcacgacacatgacaacatatccaagtagtccttgattgatttagcagcagggagtaagcgtcttgctaaaagtggctccacagcgatcgtcttgctaaaagtggttgtacaggtgatcgcttgaaggaaactcaggttcaagaaggacacatgagtatccgagaaaaaactcctcaaatcctggaatagcctcgatggttccagacggcgaacgaacggggtgaggaaaagaacccaccggcctgctgtccattgctcctagaagcatcgtgtcgtggatcggctttctccgtgctccacctcgtcggcctcatgccccgtagccccgactccccatctgccgcctccacctcatgggccgccgggtccaccctcgccgtccagcttggcgacatctttaccgtggtggcgacgagctccgcctcctgcaccccctccgcctcctcgccccttccgctgaggcccgcgtcggcgcgttcctgccatagtcggcaaccaataggagcgtaaaactggagctagggattgaagctgttgtaggtacatgtcatatataaatggacatgggcaggcactcccgctgagggtgcttcttggcttcgtctgtagaggcttgctgatatttggcataggatatt

SEQ ID NO: 61710 - DNA, 209 bp, Zea mays
  Clone ID: LIB3069-017-H3-A7P1-A
cagcggccgccaccggggggaacatcaacgtttccatattatccttgattgattaatcagcagggagtaagcgtcttgctaaaagtggctccacagcgatcgtcttgctaaaagtgggtgtacaggtgatcgcttgaaggaaactcaggttcaagaaggacacatgagtatccgagaaaaaactccttacatcctgcagtagcctagat

SEQ ID NO: 61711 - DNA, 463 bp, Zea mays
  Clone ID: LIB3069-017-H3-B10P1-A
acagcggccgccaccgcggtgaacaaaatcaatcaaggactacttggatatgttgtcatgtgtcgtgcaataaaaacagaatccttctaaccccagtgaacaccctgtccctgaagtaattgcggcttggatggctttgactgggagagggggaatcacggccatgaaatcaataccctccctttgagatgataatgattgctttatctgctcaaagatctcaaataatccatgcatcatacccacaaattaacaatatcctatgccaaatatcagcaagcctctacagacgaagccaagaagcaccctcagcgggagtgcctgcccatgtccatttatatatgacatgtacctgcaacagcttcaatccctagctccagttttacgctcctattggttgccgactatggcaggaacgcgccgacgcgggcctcagcggaaggggccagaaaggcgagggggt

SEQ ID NO: 61712 - DNA, 565 bp, Zea mays
  Clone ID: LIB3069-017-H3-B11P1-A
tagttctacagcggccgccaccgcggtgaacagaagtaattgcggcttggatggctttgactgggagagggggaatcacggccatgaaatcaataccctccctttgagatgataatgattgctttatctgttcaaagatctcaaataatccatgcatcatacccacaaattaacaatatcctatgccaaatatcagcaagcctctacagacgaagccaagaagcaccctcagcgggagtgcctgcccatgtccatttatatatgacatgtacctacaacagcttcaatccctagctccagttttacgctcctattggttgccgactatggcaggaacgcgccgacgcgggcctcagcggaaggggcgaggaggcggagggggtgcaggaggcggagctcgtcgccaccacggtaaagatgtcgccaagctggacggcgagggtggacccggcggcccatgaagtggaagccgcagatggggagtcggggctacggggcatgaggccgaccaagtggagcacggagaaagccgatccacgacacgatgcttctaggagcaatggac

SEQ ID NO: 61713 - DNA, 466 bp, Zea mays
  Clone ID: LIB3069-017-H3-B8P1-A
agcggccgccaccgcggtgaacaaaaaaactcctcaaatcctggaatagcctcgatggttccagacggcgaacgaacggggtgaggaaaagaacccaccggcctgctgtccattgctcctagaagcatcgcgtcgtggatcggctttctccgtgctccacctcgtcggcctcatgccccgtagccccgactccccatctgccgcctccacctcatgggccgccgggtccaccctcgccgtccagcttggcgacatctttaccgtggtggcgacgagctccgccttctgcaccccctccgccttctggccccttccgctgaggcccgcgtcggcgcgttcctgccatagtcggcaaccaataggagcgtaaaactggagcttgggattggagcttgtgcaggtacatgtcatatataaatggacatgggccggcacttccgctgagggtgcttctttggcttcgtct

SEQ ID NO: 61714 - DNA, 648 bp, Zea mays
  unsure at all n locations
  Clone ID: LIB3069-017-H3-C10P1-A
tagttctacagcggccgccaccgcggtgaacacatgtcatatataaatggacatgggcaggcactcccgctgagggtgcttcttggcttcgtctgtagaggcttgctgatatttggcataggatattgttaatttgtgggtatgatgcatggattatttgagatctttgaacagataaagcaatcattatcatctcaaagggagggtattgatttcatggccgtgattccccctctcccagtcaaagccatccaagccgcaattacttcagggacagggtgttcactggggctagaaggattatgtttttattgcacgacacatgacaacatatccaagtagtccttgattgatttagcagcagggagtaagcgtcttgctaaaagtggctccacaggtgaacttagcgatcgtcttgctaaaagtggttgtacaggtgatcgcttgaaggaaactcaggttcaaggacacatgagtatccgagaaaaaactcccaagaaatcttcccaaaactgaatgttgccttctaccatcaacaacctttgaaagtctcgggtgtttatttttgtatgttctctacaattatgngtatatatatatatattcatccttttcaagacaatttttataaatataacaacttgattt

SEQ ID NO: 61715 - DNA, 670 bp, Zea mays
  unsure at all n locations
  Clone ID: LIB3069-017-H3-C11P1-A
tagtactacagcggccgccaccgcggtgaacacttcgtctgtagaggcttgctgatatttggcataggatattgttaatttgtgggtatgatgcatggattatttgagatctttgagcagataaagcaatcattatcatctcaaagggagggtattgatttcatggccgtgattccccctctcccagtcaaagccatccaagccgcaattacttcagggacagggtgttcactggggttagaaggattctgtttttattgcacgacacatgacaacatatccaagtagtccttgattgatttagcagcagggagtaagcgtcttgctaaaagtggctccacaggtgaacttagcgatcgtcttgctaaaagtggttgtacaggtgatcgcttgaaggaaactcaggttcaagaaggacacataagtatccgagaaaaaactcctcanatcctggaatagcctcgatggttccagacggcgaacgaacggngtgaggaaaagaacccaccggcctgctgtccattgctcctagaagcatcgcgtcgtggatcggctttctccgtgctccacctcgtcggcctcatgccccgtagccccgactccccatctgccgcctccacctcatgggccgccgggtccaccctcgccgtccagcttggcgacatcttta

SEQ ID NO: 61716 - DNA, 728 bp, Zea mays
  unsure at all n locations
  Clone ID: LIB3069-017-H3-C12P1-A
aagcatctctagttctacagcggccgccaccgcggtgaacatttagcaagacgatcgctaagttcacctgtggagccacttttagcaagacgcttactccctgctgctaaatcaatcaaggactacttggatatgttgtcatgtgtcgtgcaataaaaacataatccttctagccccagtgaacaccctgtccctgaagtaattgcggcttggatggctttgactgggagagggggaatcacggccatgaaatcaataccctccctttgagatgataatgattgctttatctgttcaaagatctcaaataatccatgcatcatacccacaaattaacaatatcctatgccaaatatcagcaagcctctacagacgaagccaagaagcaccctcagcgggagtgcctgcccatgtccatttatatatgacatgtacctacaacagcttcaatccctagctccagttttacgctcctattggttgccgactatggcaggaacgcgccgacgcgggcctcagcggaaggggcgaggaggcggagggggtgcaggaggcggagctcgtcgccaccacggtaaagatgtcgccaagctggacggcgagggtggacccggcggcccatgaggtggaggcggcagatggngagtcggggctacggggcatgaggccgacgaggtggagcacggagaaagccgatccacgacacgatgcttttaagagcaatggac

SEQ ID NO: 61717 - DNA, 662 bp, Zea mays
  unsure at all n locations
  Clone ID: LIB3069-017-H3-C9P1-A
cagcggccgccaccgcggtgaacattttcctcaccccgttcgttcgccgtctggaaccatcgaggctattccaggatttgaggagttttttctcggatacttatgtgtccttcttgaacctgagtttccttcaagcgatcacctgtacaaccacttttagcaagacgatcgctaagttcacctgtggagccacttttagcaagacgcttactccctgctgctaaatcaatcaaggactacttggatatgttgtcatgtgtcgtgcaataaaaacagaatccttctaaccccagtgaacaccctgtccctgaagtaattgcggcttggatggctttgactgggagagggggaatcacggccatgaaatcaataccctccctttgagatgataatgattgctttatctgctcaaagatctcaaataatccatgcatcatacccacaaattaacaatatcctatgccaaatatcagcaagcctctacagacgaagccaagaagcaccctcagcgggagtgcctgcccatgtccatttatatatgacatgtacctgcaacagcttcaatccctagctccagttntacgctcctattggttgccgactatggcaggaacgcgccgacgcgggccttaacggaaggggccanaaagcggagggggtgc

SEQ ID NO: 61718 - DNA, 711 bp, Zea mays
  unsure at all n locations
  Clone ID: LIB3069-017-H3-D10P1-A
tagttctacagcggccgccaccgcggtgaacagcatcatacccacaaattaacaatatcctatgccaaatatcagcaagcctctacagacgaagccaagaagcaccctcagcgggagtgcctgcccatgtccatttatatatgacatgtacctgcaacagcttcaatccctagctccagttttacgctcctattggttgccgactatggcaggaacgcgccgacgcgggcctcagcggaaggggccaggaggcggagggggtgcaggaggcggagctcgtcgccaccacggtaaagatgtcgccaagctggacggcgagggtggacccggcggcccatgaggtggaggcggcagatggggagtcggggctacggggcatgaggccgacgaggtggagcacggagaaagccgatccacgacgcgatgcttctaggagcaatggacagcaggccggtgggttcttttcctcaccccgttcgttcgccgtctggaaccatcgaggctattccaggatttgaggagttttttctcggatacttatgtgtccttcttgaacctgagtttccttcaagcgatcacctgtacaaccacttttagcaagacgatcgctaagttcacctgtggagccacttttagcaagacgcttactccctgctgctaaatcaatcaaggactacttggatatgtngtcatgtgtcgtgcaataaaaac

SEQ ID NO: 61719 - DNA, 687 bp, Zea mays
  unsure at all n locations
  Clone ID: LIB3069-017-H3-D12P1-A
tagttctacagcggccgccaccgcggtgaacactaagttcacctgtggagccacttttagcaagacgcttactccctgctgctaaatcaatcaaggactacttggatatgttgtcatgtgtcgtgcaataaaaacataatccttctagccccagtgaacaccctgtccctgaagtaattgcggcttggatggctttgactgggagagggggaatcacggccatgaaatcaataccctccctttgagatgataatgattgctttatctgttcaaagatctcaaataatccatgcatcatacccacaaattaacaatatcctatgccaaatatcagcaagcctctacagacgaagccaagaagcaccctcagcgggagtgcctgcccatgtccatttatatatgacatgtacctacaacagcttcaatccctagctccagttttacgctcctattggttgccgactatggcaggaacgcgccgacgcgggcctcagcggaaggggcgaggaggcggagggggtgcaggaggcggagctcgtcgccaccacggtaaagatgtcgccaagctggacggcgagggtggacccggcggcccatgaggtggaggcggcagatggggagtcggggctacggngcatgaggccgacgaggtggagcacggagaaagccgatccacgacacgatgct

SEQ ID NO: 61720 - DNA, 693 bp, Zea mays
  unsure at all n locations
  Clone ID: LIB3069-017-H3-D7P1-A
acagcggccgccaccgcggtgaacagcaaccaataggagcgtaaaactggagctagggattgaagctgttgtaggtacatgtcatatataaatggacatgggcaggcactcccgctgagggtgcttcttggcttcgtctgtagaggcttgctgatatttggcataggatattgttaatttgtgggtatgatgcatggattatttgagatctttgaacagataaagcaatcattatcatctcaaagggagggtattgatttcatggccgtgattccccctctcccagtcaaagccatccaagccgcaattacttcagggacagggtgttcactggggctagaaggattatgtttttattgcacgacacatgacaacatatccaagtagtccttgattgatttagcagcagggagtaagcgtcttgctaaaagtggctccacaggtgaacttagcgatcgtcttgctaaaagtggttgtacaggtgatcgcttgaaggaaactcaggttcaaggacacatgagtatccgagaaaaaactcccaagaaatcttcccaaaactgaatgttgccttctaccatcaacaacctttgaagttctcgggtgtttatttttgtatgttctctacaattatgngtatatatatatatattcatccttttcaagacaatttttataaatataacaacttgattt

SEQ ID NO: 61721 - DNA, 546 bp, Zea mays
  Clone ID: LIB3069-017-H3-D8P1-A
cggccgccatcgaggtgaacatatataaatggacatgggcaggcactcccgctgagggtgcttcttggcttcgtttgtagaggcttgctgatatttggcataggatgttgttaatttgtgggtatgatgcatggattatttgagatctttgaacagataaagcaatcattatcatctcaaagggagggtattgatttcatggccgtgattccccctctcccagtcaaagccatccaagccgcaattacttcagggacagggtgttcactggggctagaaggattatgtttttattgcacgacacatgacaacatatccaagtagtccttgattgatttagcagcagggagtaagcgtcttgctaaaagtggctccacaggtgaacttagcgatcgtcttgctaaaagtggttgtacaggtgatcgcttgaaggaaactcaggttcaaggacacatgagtatccgagaaaaaactcccaagaaatcttcccaaaactgaatgttgcctttctaccatcaacaacctttgaagttctcgggtgtttat

SEQ ID NO: 61722 - DNA, 705 bp, Zea mays
  unsure at all n locations
  Clone ID: LIB3069-017-H3-D9P1-A
acagcggccgccaccgcggtgaacactttgactgggagagggggaatcacggccatgaaatcaataccctccctttgatatgataatgattgctttatctgctcaaagatctcaaataatccatgcatcatacccacaaattaacaatatcctatgccaaatatcagcaagcctctacagacgaagccaagaagcaccctcagcgggagtgcctgcccatgtccatttatatatgacatgtacctgcaacagcttcaatccctagctccagttttacgctcctattggttgccgactatggcaggaacgcgccgacgcgggcctcagcggaaggggccaggaggcggagggggtgcaggaggcggagctcgtcgccaccacggtaaagatgtcgccaagctggacggcgagggtggacccggcggcccatgaggtggaggcggcagatggggagtcggggctacggggcatgaggccgacgaggtggagcacggagaaagccgatccacgacgcgatgcttctaggagcaatggacagcaggccggtgggttcttttcctcaccccgttcgttcgccgtctggaaccatcgaggctattccaggatttgaggagttntttctcggatacttatgtgtccttcttgaacctgagtttccttcaagcgatcacctgtacaaccacttttagcaagacgatcgctaag

SEQ ID NO: 61723 - DNA, 715 bp, Zea mays
  unsure at all n locations
  Clone ID: LIB3069-017-H3-E10P1-A
tagtactacagcggccgccaccgcggtgaacagatatgttgtcatgtgtcgtgcaataaaaacataatccttctagccccagtgatcaccctgtccctgaagtaattgcggcttggatggctttgactgggagagggggaatcacggccatgaaatcaataccctccctttgagatgataatgattgctttatctgttcaaagatctcaaataatccatgcatcatacccacaaattaacaatatcctatgccaaatatcagcaagcctctacagacgaagccaagaagcaccctcagcgggagtgcctgcccatgtccatttatatatgacatgtacctacaacagcttcaatccctagctccagttttacgctcctattggttgccgactatggcaggaacgcgccgacgcgggcctcancggaaggggcgaggaggcngnnaggggtgcaggaggcggagctcgtcgccaccacngtaaagatgtcgccaagctggaccgcgagggtggacccggggccccatgaggtggaggcggcagatggggagtcggggctacggggcatgaggccgacgaggtggagcacggagaaagccgatccacgacacgatgcttctaggagcaatggacagcaggcccgtgggttcttttcctcaccccgttcgttcgccgtctggaaccatcgaggctattccaggatttgaggagttttt

SEQ ID NO: 61724 - DNA, 301 bp, Zea mays
  Clone ID: LIB3069-017-H3-E11P1-A
ctacagcggccgccaccgcggtgaacaatatcctatgccaaatatcagcaagcctctacagacgaagccaagaagcaccctcagcgggagtgcctgcccatgtccatttatatatgacatgtacctgcaacagcttcaatccctagctccagttttacgctcctattggttgccgactatggcaggaacgcgccgacgcgggcctcagcggaaggggccagaaggcggagggggtgcaggaggcggagctcgtcgccaccacggtcggacgcgtgggcggacgcgtgggcggacgcgtggg

SEQ ID NO: 61725 - DNA, 689 bp, Zea mays
  Clone ID: LIB3069-017-H3-E12P1-A
acagcggccgccaccgcggtgaacaggtagaaggcaacattcagttttgggaagatttcttgggagttttttctcggatactcatgtgtccttgaacctgagtttccttcaagcgatcacctgtacaaccacttttagcaagacgatcgctaagttcacctgtggagccacttttagcaagacgcttactccctgctgctaaatcaatcaaggactacttggatatgttgtcatgtgtcgtgcaataaaaacataatccttctagccccagtgaacaccctgtccctgaagtaattgcggcttggatggctttgactgggagagggggaatcacggccatgaaatcaataccctccctttgagatgataatgattgctttatctgttcaaagatctcaaataatccatgcatcatacccacaaattaacaatatcctatgccaaatatcagcaagcctctacagacgaagccaagaagcaccctcagcgggagtgcctgcccatgtccatttatatatgacatgtacctacaacagcttcaatccctagctccagttttacgctcctattggttgccgactatggcaggaacgcgccgacgcgggcctcaacggaaggggcgaggaggcggagggggtgcaggaggcggagctcgtcgccaccacggtaaagatgtcgccaagcttgac

SEQ ID NO: 61726 - DNA, 708 bp, Zea mays
  unsure at all n locations
  Clone ID: LIB3069-017-H3-F11P1-A
tagttctacagcggccgccaccgcggtgaacaatatacacataattgtagagaacatacaaaaataaacacccgagaacttcaaaggttgttgatggtagaaggcaacattcagttttgggaagatttcttgggagttttttctcggatactcatgtgtccttgaacctgagtttccttcaagcgatcacctgtacaaccacttttagcaagacgatcgctaagttcacctgtggagccacttttagcaagacgcttactccctgctgctaaatcaatcaaggactacttggatatgttgtcatgtgtcgtgcaataaaaacataatccttctagccccagtgaacaccctgtccctgaagtaattgcggcttggatggctttgactgggagagggggaatcacggccatgaaatcaataccctccctttgagatgataatgattgctttatctgttcaaagatctcaaataatccatgcatcatacccacaaattaacaatatcctatgccaaatatcagcaagcctctacagacgaagccaagaagcaccctcagcgggagtgcctgcccatgtccatttatatatgacatgtacctacaacagcttcaatccctagctccagttttacgctcctattggttgccgactatggcaggaacgcgccgacgcgggcctcancggaaggggcaaaagaggcgagggggt

SEQ ID NO: 61727 - DNA, 533 bp, Zea mays
  Clone ID: LIB3069-017-H3-F8P1-A
tagtactacagcggccgccaccgcggtgaacagggtattgatttcatggccgtgattccccctctcccagtcaaagccatccaagccgcaattacttcagggacagggtgttcactggggttagaaggattctgtttttattgcacgacacatgacaacatatccaagtagtccttgattgatttagcagcagggagtaagcgtcttgctaaaagtggctccacaggtgaacttagcgatcgtcttgctaaaagtggttgtacaggtgatcgcttgaaggaaactcaggttcaagaaggacacataagtatccgagaaaaaactcctcaaatcctggaatagcctcgatggttccagacggcgaacgaacggggtgaggaaaagaacccaccggcctgctgtccattgctcctagaagcatcgcgtcgtggatcggctttctccgtgctccacctcgtcggcctcatgccccgtagccccgactccccatatgccgcctccacctcatgggccgccgggtccaccctcgccgt

SEQ ID NO: 61728 - DNA, 612 bp, Zea mays
  unsure at all n locations
  Clone ID: LIB3069-017-H3-G10P1-A
cggccgccaccgcggtgaacaagctagggattgaagctgttgcaggtacatgtcatatataaatggacatgggctggcactcccgctgagggtgcttcttggcttcgtctgtagaggcttgctgatatttggcataggatattgttaatttgtgggtatgatgcatggattatttgagatctttgagcagataaagcaatcattatcatctcaaagggagggtattgatttcatggccgtgattccccctctcccagtcaaagccatccaagccgcaattacttcagggacagggtgttcactggggctagaaggattctgtttttattgcacgacacatgacaacatatccaagtagtccttgattgatttagcagcagggagtaagcgtcttgctaaaagtggctccacagcgatcgtcttgctaaaagtggttgtacaggtgatcgcttgaaggaaactcaggttcaagaaggacacatgagtatccgagaaaaaactcctcaaatcctggaatagcctcgatggttccagacggcgaacgaacggngtgaggaaaagaacccaccggcctgctgtccattgctcctagaagcatcgtgtcgtggatcg

SEQ ID NO: 61729 - DNA, 657 bp, Zea mays
  unsure at all n locations
  Clone ID: LIB3069-017-H3-G11P1-A
cagcggccgccaccgcggtgaacaattacttcagggacagggtgttcactggggttagaaggattctgtttttattgcacgacacatgacaacatatccaagtagtccttgattgatttagcagcagggagtaagcgtcttgctaaaagtggctccacaggtgaacttagcgatcgtcttgctaaaagtggttgtacaggtgatcgcttgaaggaaactcaggttcaagaaggacacataagtatccgagaaaaaactcctcaaatcctggaatagcctcgatggttccagacggcgaacgaacggggtgaggaaaagaacccaccggcctgctgtccattgctcctagaagcatcgcgtcgtggatcggctttctccgtgctccacctcgtcggcctcatgccccgtagccccgactccccatctgccgcctccacctcatgggccgccgggtccaccctcgccgtccagcttggcgacatctttaccgtggtggcgacgagctccgcctcctgcaccccctccgcctcctggccccttccgctgaggcccgcgtcggcgcgttcctgccatagtcggcaaccaataggagcgtaaaactggagctagggattgaagctgtngcangtacatgtcatatataaatggacatgggca

SEQ ID NO: 61730 - DNA, 706 bp, Zea mays
  Clone ID: LIB3069-017-H3-G9P1-A
acagcggccgccaccgcggtgaacagtatccgagaaaaaactcctcaaatcctggaatagcctcgatggttccagacggcgaacgaacggggtgaggaaaagaacccaccggcctgctgtccattgctcctagaagcatcgtgtcgtggatcggctttctccgtgctccacctcgtcggcctcatgccccgtagccccgactccccatctgccgcctccacctcatgggccgccgggtccaccctcgccgtccagcttggcgacatctttaccgtggtggcgacgagctccgcctcctgcaccccctccgcctcctcgccccttccgctgaggcccgcgtcggcgcgttcctgccatagtcggcaaccaataggagcgtaaaactggagctagggattgaagctgttgtaggtacatgtcatatataaatggacatgggcaggcactcccgctgagggtgcttcttggcttcgtctgtagaggcttgctgatatttggcataggatattgttaatttgtgggtatgatgcatggattatttgagatctttgaacagataaagcaatcattatcatctcaaagggagggtattgatttcatggccgtgattccccctctcccagtcaaagccatccaagccgcaattacttcagggacaggggtgtcactggggctagaaggattatgtttttattgcacgacacat

SEQ ID NO: 61731 - DNA, 501 bp, Zea mays
  Clone ID: LIB3069-017-H3-H12P1-A
acaaaatggacatgggcaggcactcccgctgagggtgcttattggcttcgtctgtataggcttgctgatatttggcataggatattgttaattcgcgggtatgatgcatggattatttgagatctttgaacagataaagcaatcattatcatctcaaagggagggtattgatttcatggccgtgattccccctctcccagtcaaagccatccaagccgcaattacttcagggacagggtgttcactggggctagaaggattatgtttttattgcacgacacatgacaacatatccaagtagtccttgattgatttaacagcagggagtaagcgtcttgctaaaagtggctccacaggtgaacttagcgatcgtcttgctaaaagtggttgtacaggtgatcgcttgaaggaaactcaggttcaaggacacatgagtatccgagaaaaaactcccaagaaatcttcccaaaactgaatggtgccttctaccatcaacaacct

SEQ ID NO: 61732 - DNA, 671 bp, Zea mays
  Clone ID: LIB3069-017-H3-H7P1-A
tagtactacagcggccgccaccgcggtgaacaaaaagtggctccacaggtgaacttagcgatcgtcttgctaaaagtggttgtacaggtgatcgcttgaaggaaactcaggttcaagaaggacacataagtatccgagaaaaaactcctcaaatcctggaatagcctcgatggttccagacggcgaacgaacggggtgaggaaaagaacccaccggcctgctgtccattgctcctagaagcatcgcgtcgtggatcggctttctccgtgctccacctcgtcggcctcatgccccgtagccccgactccccatctgccgcctccacctcatgggccgccgggtccaccctcgccgtccagcttggcgacatctttaccgtggtggcgacgagctccgcctcctgcaccccctccgcctcctggccccttccgctgaggcccgcgtcggcgcgttcctgccatagtcggcaaccaataggagcgtaaaactggagctagggattgaagctgttgcaggtacatgtcatatataaatggacatgggcaggcactcccgctgagggtgcttcttggcttcgtctgtagaggcttgctgatatttggcataggatattgttaatttgtgggtatgatgcatggattatttgagatctttgagcagataaagcaatc

SEQ ID NO: 61733 - DNA, 702 bp, Zea mays
  Clone ID: LIB3069-017-H3-H8P1-A
tagttctacagcggccgccaccgcggtgaacattctccgtgctccacctcgtcggcctcatgccccgtagccccgactccccatctgccgcctccacctcatgggccgccgggtccaccctcgccgtccagcttggcgacatctttaccgtggtggcgacgagctccgcctcctgcaccccctccgcctcctcgccccttccgctgaggcccgcgtcggcgcgttcctgccatagtcggcaaccaataggagcgtaaaactggagctagggattgaagctgttgtaggtacatgtcatatataaatggacatgggcaggcactcccgctgagggtgcttcttggcttcgtctgtagaggcttgctgatatttggcataggatattgttaatttgtgggtatgatgcatggattatttgagatctttgaacagataaagcaatcattatcatctcaaagggagggtattgatttcatggccgtgattccccctctcccagtcaaagccatccaagccgcaattacttcagggacagggtgttcactggggctagaaggattatgtttttattgcacgacacatgacaacatatccaagtagtccttgattgatttagcagcagggagtaagcgtcttgctaaaagtggctccacaggtgaacttagcgatcgtcttgctaaaagtggttgtacaggtgatcgc

SEQ ID NO: 61734 - DNA, 734 bp, Zea mays
  Clone ID: LIB3069-017-H3-H9P1-A
tagtactacagcggccgccaccgcggtgaacaagggtattgatttcatggccgtgattccccctctcccagtcaaagccatccaatccgcaattacttcagggacagggtgttcactggggctagaaggattctgtttttattgcacgacacatgacaacatatccaagtagtccttgattgatttagcagcagggagtaagcgtcttgctaaaagtggctccacagcgatcgtcttgctaaaagtggttgtacaggtgatcgcttgaaggaaactcaggttcaagaaggacacatgagtatccgagaaaaaactcctcaaatcctggaatagcctcgatggttccagacggcgaacgaacggggtgaggaaaagaacccaccggcctgctgtccattgctcctagaagcatcgtgtcgtggatcggctttctccgtgctccacctcgtcggcctcatgccccgtagccccgactccccatctgccgcctccacctcatgggccgccgggtccaccctcgccgtccagcttggcgacatctttaccgtggtggcgacgagctccgcctcctgcaccccctccgcctcctcgccccttccgctgaggcccgcgtcggcgcgttcctgccatagtcggcaaccaataggagcgtaaaactggagctagggattgaagctgttgaaggtacatgtcatatataaatggacatgggcaggcactcccgctgagggtgc

SEQ ID NO: 61735 - DNA, 694 bp, Zea mays
  unsure at all n locations
  Clone ID: LIB3069-025-Q1-K1-G6-R3B
cgatgtgctgtggacggttgacagccgacttgagttgagatacatgaaaaatggggtgaatctgagaggaagcgggcaactgaagcnataagcaactgggccgatgcgctgtaaaattttgtaggggccgaagaaccgaaaagcaagcttttgattggcccgagttgtgactgatgattgtacgtacggttgtaacttcaggtacacctgatcgccgacgctaaaaatccgttcagaacgtcgtttatccgcctgacgtttcatgcggtcctgggcacgtaacagatgttgctgaaccaacttggataccacctcacgatcgtgaagccaagtagacagatctgaaacagtcactgcactccctggttgcaagccgaagtgccgagggggctgtccatataacacctcaaatggagaacaattcagagctgaatgaaagttggtattataccagaactctgcaacagctaaccattggtaccatttgctgggacaggcgtgcacaaagcatcgcaaataagtttcaatgcactagtttacgcgctccgtctggccatcggattgtgggtgataagccgaactcatgcataattgggtgccactgagagtgaataattgctgccagaacagactngtgaacactctatcccgatcagatactatattgtccggcataccatgaagcttatagata

SEQ ID NO: 61736 - DNA, 391 bp, Zea mays
  unsure at all n locations
  Clone ID: LIB3069-028-Q1-K1-E5-F5A
ggccgggaanccaacaanacaccaaatccnncaagcgaccaacggaaggaattttatgacgcacgggtccaccncagaggacgccactaaagaacgcaggaggagccgcacgcatgaaggaaangctgcccagcccgaaaacagaagcagnnngagcaggaccangaccgcatagcnaagggngaagactcgcgcaccacactgatgataaaaaacattcctaacaaggacaccagtaagccgcttttggctgacagggacgagaatcaccgaggaacctatgatttcatccaccttccaattgattttaagaataaatggaacgggggatatgcattcaacaaaatgacggatccacagccagaaaggtccattttacaaggacatcaac

SEQ ID NO: 61737 - DNA, 447 bp, Zea mays
  unsure at all n locations
  Clone ID: LIB3069-028-Q1-K1-E5-F6A
gaggcccgaacgcaagagaccaggaaccattccctgtgggtaacaatgtttgttctcgggccgggaggaacagaggacttancagnggggcggagactaccaaaaaggcaagtccatcaacctctcctaacagaagagagccggctcccgatattccaactcaggacaggcaggcggtatttgctcactaactggaggctgaagggcatgtaataaatcacccccaggttggcggcttctttttcttttgggcctcgccagcaaggggacctgacttgcggagggtgactagctaacgagaaatctgccctgcacgagcccgctgaagattcaccttaaaggaaccatgcccgggggttgccaaacccttgacgccaacgggttcagggggaggggaaaaacccgggagggggaaggggggagggggggtctcagggggggggaaaa

SEQ ID NO: 61738 - DNA, 410 bp, Zea mays
  Clone ID: LIB3069-028-Q1-K1-E5-R6A
agtgcaccaccaccaccaccaccatggacagcaagcctagggcaaccggaccaggccaagggtctacaatgctccaacaaatagctccactacccaggattctatggaggctggccatagtcaccactccatgacatccctgtcttcctcaactacagattgctctacatctccccaccctactggtaatcaaggcaatcaggcctaccagaatcgaccagcggctgctaataccttgcactttgaacagaacggagctatggacgtaaatttaaccgtctactccaatccccgccaagagactggcatagctggacatacagcataccaggtttctgctaatacaggccctgcacataacatgactgaagggcacctgccaatgcggcaaagggctgatagggaggagt

SEQ ID NO: 61739 - DNA, 616 bp, Zea mays
  unsure at all n locations
  Clone ID: LIB3069-028-Q1-K1-E5-R7A
gcgacaactgaanaagaatncctcgcatgtaatgtcatggagttatagccattgcaaataccattgtgacactctggcagttattgcgggtggaaggctngcagccgagctccaaagtngccatgaccaagagatccactatgttcaccaaaagcagttggatactagcggcggggtgaatcaaattctgataggcgaggacaccttcggaggagaatcaacagagaagccatgtggggattaatcgggtggcggcctaccgggagaatataaattatgaacagtgctgctgacccaactctaagtatctaacttcccaatggtcccagggggagagttcttaagttggtgagctacggcattttgcttctgttctcctgaatattgctctgcgaagcaagatcctgctcctccagaaaagctatgctcaactatggatttgtgagcatgatatttcacccttggtgaggtcatacagtgctgctggagctgctctgatatcatagaattctacaaattccttattgcagcttgtaggagactcgtaaatcttcttgacatcgccataaacactaaatttttggagaagaacatggctggagatggaagagtcaat

SEQ ID NO: 61740 - DNA, 409 bp, Zea mays
  unsure at all n locations
  Clone ID: LIB3069-037-Q1-K1-D1-F5A
gggacagcnntaaggtagcaccaacattgggagatcttcgtagttacatgattgagacaacactccctcctattggagacgccgttttggctgaattgctccttaaagtgtgggaaccatacagaaaggagggtggcattcttgatgatggaagagccagcctatattcacttagtgaacaagggagcttgtgcaagatttgcatttgctgctgcgatttttggtgatttccaagaagcacttttctggctacagctgcctcaagctcttcgccacttcctgggtaaatcaacaagtagatcaagagagaagatctcacaatcaagtttacatcctgattctgaacaaagctccagatttaatcggatagcttcaagagagagatctgcttctgaaaagttcacgaaaa

SEQ ID NO: 61741 - DNA, 499 bp, Zea mays
  unsure at all n locations
  Clone ID: LIB3069-037-Q1-K1-D1-F7A
cttccaagaaaggggccgacgaggaccngancgcagncagngagggcnncgggcagnaccagcagaagcnggnncatttctgcatggacgccgaaccgacgggggactgaatcgcacgccttgtcgcatggcagactgatgcgaagctttttgttctgtctgcggtaggtacccagacgtccagacatggcatcgggactgctgatgtggcagaatctgatggcaggaggcaggaacagacatgcagtgctgtatcgtaggtgccaatggttggcactgtttatacatacgtaagcatttgtatttggtacaagctatgtttttttttctttggtgcgcaaagagcgagtgcgcagcgaacttctcttgtggccgagatgagatgagaacagatgccatcgaggcagcagcagacgatatacttacacctgtacacccatgacaggttttggctgaagaatggtattatatgcttaanaaaaaaaaaaaaaaaaatata

SEQ ID NO: 61742 - DNA, 701 bp, Zea mays
  Clone ID: LIB3069-037-Q1-K1-D1-R6A
aaagtaacaatgaaaccgcagcctctaagttcccgagagagacaagctcatgaacatgcttttgcaaagcatcttcaccatcgagtttgtcatgccaaggtatcctttcacttgcattgaaccatagttgctcttgattaaatgccattgagcttaattggccataattcgagatttttcgtgaacttttcagaagcagatctctctcttgaagctatccgattaaatctggagctttgttcagaatcaggatgtaaacttgattgtgagatcttctctcttgatctacttgttgatttacccaggaagtggcgaagagcttgaggcagctgtagccagaaaagtgcttcttggaaatcaccaaaaatcgcagcagcaaatgcaaatcttgcacaagctcccttgttcactatagctgaatataggctggctcttccatcatcaagaatgcaaccctcctttctgtatggttccaacactttaaggagcaattcagccacaacggcgtcaccaataggagggagtgttgtctcaatcatgtaactacgaagatctccaaatgttggtgctaccttaaagctgtccccagttaatttatcactattattgcattcaaaccaagaaggcttcaccccaagttgaagaatcattcgcaaagccttaccaaagcatgggccgttggaaataatactggcaaacaa

SEQ ID NO: 61743 - DNA, 209 bp, Zea mays
  unsure at all n locations
  Clone ID: LIB3069-037-Q1-K1-D1-R7A
gggccgacaaccaatcaagctccaagacaagggnaccaggagactgcggctgaagaagggcattttccaaggggncnggactatccaaggcaaatatcgaaaatgtattatcatagaaaagcacagcaatgcgccctctgcttcgatcaccagaacaacaggagaaaactttatcctcctgatgccttccctgtgagtgctaaaagaag

SEQ ID NO: 61744 - DNA, 75 bp, Zea mays
  Clone ID: LIB3069-054-Q1-K1-A9-R6A
cctgtcactggccgcgccatcgccaacaccggagaaagggattgacggaccaaacagaaccacaaacccgcgcgc

SEQ ID NO: 61745 - DNA, 359 bp, Zea mays
  unsure at all n locations
  Clone ID: LIB3069-054-Q1-K1-C12-R3A
aacgagaagggcaccctnncgngcaaaggacgacacnaggaggtgcganccggnccaaaagncggccaggaacaagtccgnnggaaacaagaacagaccgaccgaagaccgnaaactctccaccgccagggagttaccaccccaccagcttccgcgacaatgaggacgccagcagccatatcccagggctaaagtcggtattcccaggaagcttcgggaataccaagtccaaggtgggacaggtcagcagcagcagacccaagccttcgcactccccggctaaggtcgagaaattcctggaacagattcatatgggccgtccaggcatcatcgggttcaaatccaaaacccgggacgag

SEQ ID NO: 61746 - DNA, 566 bp, Zea mays
  unsure at all n locations
  Clone ID: LIB3069-054-Q1-K1-C12-R4A
agcagtagcagaaangcacgggggcnccagcacaaaggcccgccacaaaannccaccacagnagaagcagcaggcttttcacggaagagaacactaanggacacagaaaagctggggtaaccatgtgcaaagntcgnngntccatctaaagggtcaatgcaccagaggactctgatagggaatcgacaacaaggccgcctacctccccaagtatgaggcggtcttcgaagtacttggtgacaacttccaaaatgactgattcactcaacttgtctgtgtctgtcaccaggtctgcaacacctttatagcggatattgcgtggcttaaaaacagcctccattataacatcggccccaagctctgcggcggcctcgatgactccgagcagctcggcggcggggatcgggccggggggaggggcgggcaaccaggggtacctggccggcggggcggcctgctcggacgccaccgccacgatgtgccgcgccttgctggtccgggagccgagcgcacggaggcggaggggccgggacgtcggcgagtacttgacgccaaccctggggagg

SEQ ID NO: 61747 - DNA, 244 bp, Zea mays
  unsure at all n locations
  Clone ID: LIB3069-054-Q1-K1-G5-F4A
ttgnccacaggaacttcattgttcgcatgggacgtcctaggcttgcgtagagtgttttgtttctggtgatgagaatttctgctntcttatccaagaacaatgtttttgtcatcatcatgatttgtagtggaaacactgatagtcaggttggtcggaagatgggactgggaggaaactatgaattccatgtagcttttgaacttcctcttacattatttacaagtatatgaatcagtcttttcgt

SEQ ID NO: 61748 - DNA, 319 bp, Zea mays
  Clone ID: LIB3069-054-Q1-K1-G5-R4A
cagctcaaggatgtagaaccccatcactaaaccaagagacatgccgcagcaatgtcatcaactgggaaatcagtaccaccaaagctgttcggaatgatgccatcaacataggggaatgctcgaccaagaactacagatataatggtcattaccgcaagagctccaaatgtgcctagaaaaatgacagctccagaacttctagctgctaacagtgcctatcaaacacatgaaactgcagaatttatcaatgactcattttagtatatagtactgggaaaaaaatgctgtgtggtggaaatgcgaagaaaaataatttgca

SEQ ID NO: 61749 - DNA, 339 bp, Zea mays
  Clone ID: LIB3075-003-Q1-K1-H3.F3
atccagttgtggtgtgccaccgtgtttgctcaactcaaaacctgataccttaagtacatccaagcaaaaagatctgtgcacatcgacctgttcttgaaccatagggggaaaaaagacatttgggaggtgcccaactattccagatacgtttccaatgctcaaaactagaaactctatatagcggcgcatcataagccgatttaaaagaattctttttggaactagggggaacatggcaaggatgattttatgatctttaaggtaaaaaaaccaaaaacgaaacatcaagaggataaatatgtcttggtaacctttaataaaagattacttttttgaaaa

SEQ ID NO: 61750 - DNA, 328 bp, Zea mays
  Clone ID: LIB3075-003-Q1-K1-H3.R4
tgacacatacatgcaatcttatgcagtaatctgcacttggtttctcaggtcgtcgccgctgtcatttactctttctcttggtaaggaagttgttgtcgcaattgtgggctagtcttctcacccttagcagcaatattcttctgagaatgaacgcaattagcctcttcgaaacgatccaccccactcgggtacacaaagttcgccttgacaccaccaccaagaaactcctgcaacatctgaggatggtattccaatgtctctctgtaaattaattctcgaacatcatctctggccagcttccttctttcaaactcaaactcaaattttg

SEQ ID NO: 61751 - DNA, 433 bp, Zea mays
  Clone ID: LIB3075-004-Q1-K1-E3.R4
tggttcaggctcaggcttgtggtacctcggagaacatgttgttgaaggctgaaaggtacaggcttaccattgacgacatagttaccaagaagagggttgccactggctctggttattttgaaaggctcgaaagcgagctgtacacggctatccatgctgcatactatggccctgatgtcgactccatggatgtccttcctgattgctttgaagccgaggagagatctgcatatgaaacctctgagctattacaccttgtttcaggccgtgatctttttggtattgttactgtaactgatagtgtcaaagagctgtcagatgtttgtcgtgaaaaactggtaccctctggttgtagatcttcggaatttactcatggtgttttaagaaatgcgaataagaattcaatattctatgaatcctgttgatctgaaca

SEQ ID NO: 61752 - DNA, 141 bp, Zea mays
  unsure at all n locations
  Clone ID: LIB3075-006-Q1-K1-G3.F3
ctgccgcaactccgtttttccgactccaccagctgcagcttctcgatgctgaactcctcctcggcggcaacactgatctcgctggctttctcgtaggnctcctgcaggatgaaccggaccatctgctgcacctgcttaccg

SEQ ID NO: 61753 - DNA, 352 bp, Zea mays
  unsure at all n locations
  Clone ID: LIB3075-006-Q1-K1-G3.F4
ggtgactgnnacagccggcgcgcatcagactgctgcgggcgcagggcgacgtggtgaccggggatgaagaagagcgccggcgacgcgctgctccgcgtcaccaagnacgccaacgcctacaagagggtcctcaagggcctcatcgtgcagagcctgcttcgtctgagggagccggcgctggtgctgcggcgccgagaggcggaccggagcctggcggaggcggcgctggaggtggccaagaagggtacgccgataagccaaggtcaaccttcccaagatcatcatccacggcaaggtctacctgccgccccacaggcaccagccgccacgctcacgggccctcctgctccgg

SEQ ID NO: 61754 - DNA, 297 bp, Zea mays
  unsure at all n locations
  Clone ID: LIB3075-006-Q1-K1-G3.R4
cctggcgtccacgtgttgtcgcagacgatcttgccgtcctgggacgcgagcaccacgccgccggnacaggacggcccgtgcgcgtcgcggctggtcctctgcggcggcaggtagaccttgccgtcgatgatgatcttggggaggttgaccttggccttctcggngtactccttcttggccacctccagcaccccctccaccaggctccgcgccgcctctccgcaccagcacaccagcgccggctccctcacacccaacacgctctgcccccccagcccctcgaagaccctctcgcac

SEQ ID NO: 61755 - DNA, 248 bp, Zea mays
  unsure at all n locations
  Clone ID: LIB3075-043-Q1-K1-B5.F3
gcgggtcggggtaggcctgtncgtggncgttagcaagctgatctggactccctacaagnagcaaggctaaaagcgcagctgctcccagccccagattagagtccctgtacataacgtttggtactaggatctcccctcagctctcacttcactcgtgtaccgcgaaaactgtacactgtaacaaccacattgctgtggttgtgctggctgccgcgattagtcttcgaaatcgaaggaaacatcacccc

SEQ ID NO: 61756 - DNA, 317 bp, Zea mays
  unsure at all n locations
  Clone ID: LIB3075-043-Q1-K1-B5.R3
ccaataacctctatagctgagcaggccaagatcanaagngggcgctccggtgtcccaactttaccttccttcttggnaaagttcatatgagnaaagcaatcaggaacttcccatatccttttctttggtatggggggagagtgagaatgcaagccaaattataagattcttcagagtgtttttccttagagaaaatcccaccatatgacatccccggtcatcacattcgcagagaacataaaacaagaataaatcaacatcatagtacaatgtcttgtgatcaagaaatagcttggccagataacaaagattctgtc

SEQ ID NO: 61757 - DNA, 743 bp, Zea mays
  unsure at all n locations
  Clone ID: LIB3075-019-E9-F3A
ctccctgatgagatcttaaggcacaatgtggatgagagcgccagttccttatagaaataaacatggattctgagaagaatgatgctgaggttcaggcagagggagtattaaattcaagattacagcaaatagtgcatacacttgacaaggtgagatatgttatgagatgcatatttggagacccaaagaatgctcctcctcctcttgtaaggttgtctgggaaaagtctggtatctgccatctggaaaggggacagttcaatagttgctgaactcattcagtcgatggaacctcatgttgaagaagaggtacttagtgatctgaaggccaaaatccgtgctcatgatccgtcagagtctgaagatattgagggaggcacccggaattctctcttgtggctgcgtgatgaattgcgaactctttcatgcacttacaagtgccgtcatgatgctgctgcagatttgattcatttgtatgcttatacaaagtgcttcttccgagtccgggattataagacagtaaaatctccaccagttcatatcagtccgcttgacttaggccccaaatatgctgataaactgggaccaggctttcaggagtactgcangacatacccagaaaattattgcttagcccagcttatctattggtatagccagaattcagaacctgaatctagattaacanngagctagaaaggttgcatgtcgttgccagatgtctcatccttctatgtgaagtct

SEQ ID NO: 61758 - DNA, 679 bp, Zea mays
  Clone ID: LIB3075-019-E9-R3A
atctgtttcataagctcgctcttgtgatggctttgcagacttcacatagaaggatgagacatctggcaacgacatgcaaccttttctagctcttgttaatctagattcaggttctgaattctggctataccaatagataagctgggctaagcaataattttctgggtatgtcttgcagtactcctgaaagcctggtcccagtttatcagcatatttggggcctaagtcaagcggactgatatgaactggtggagattttactgtcttataatcccggactcggaagaagcactttgtataagcatacaaatgaatcaaatctgcagcagcatcatgacggcacttgtaagtgcatgaaagagttcgcaattcatcacgcagccacaagagagaattccgggtgcctccctcaatatcttcagactctgacggatcatgagcacggattttggccttcagatcactaagtacctcttcttcaacatgaggttccatcgactgaatgagttcagcaactattgaactgtcccctttccagatggcagataccagacttttcccagacaaccttacaagaggaggaggagcattctttgggtctccaaatatgcatctcataacatatctcaccttgtcaagtgtatgcactatttgctgtaatcttgaatttaatactccc

SEQ ID NO: 61759 - DNA, 330 bp, Zea mays
  Clone ID: LIB3075-022-A3-F3B
tgacactatagacaaagctaccacttcccatgacacgacgtgacctaagtctcttgcattccacattacttagcctccatcataaggtattctaatatgaacaacggcgttcacctttcagcatcttataccgactcatttcataagctaacacataaaccctcttatcatatctccaatgttttacaacttcacgagccccgtaacgatcccttacactttaacccgctttcttgtgtacatccatagctcttttaaccttaatatacttactcacgtccacctcttcaacttttaaatgttcatcgctggacttgactaaaaaaacat

SEQ ID NO: 61760 - DNA, 449 bp, Zea mays
  unsure at all n locations
  Clone ID: LIB3075-034-Q1-K1-A6
ctattattgtacccatggatttgtgttcatttgaaggtgattcttctgttgccatcgcggaggcactctatgagatggttgagggttttgtgctgcagcatcaagttatactcttctgtcttggagaaactttcacagagctacctcctatttaccctctggttgatttgcctataaatactagggcaagcgctgcagattttggtggttcagttcctaaacctgggcttgaagtcaacttagtcgacnctgttccttgncnaatatcatttgagaggggcaaagaacggcacttctgctttttagccatagctcatggaacttctggttggattcttcttctagaagaattacctctaaaacgggaacgaggaattgtccgtgtcatggcacctttggcaggatctgatccaagaatagatacaaagcatgggaagtggttacatcta

SEQ ID NO: 61761 - DNA, 240 bp, Zea mays
  unsure at all n locations
  Clone ID: LIB3075-034-Q1-K1-A7
ccttgtcgtgttggagggtgcggtttcctggtgcggatgtgagggaagccnngaggggcagggaaggaatgcagaggtcgcggaaggcccttctgcggaggacggcggcggcgcaggtgcatagcgcattggcggaggctgctggtaacgggaggaagaggcgtctgtacggcttttccgtctccttcgtcgtcaccttgtgggtcgccgggctcctgttccattccttgttcggccacg

SEQ ID NO: 61762 - DNA, 426 bp, Zea mays
  unsure at all n locations
  Clone ID: LIB3075-034-Q1-K1-A8
gaaccttggccggaaatcactaacattccattgctcttttaatcctgccatagacaaggagcatgccaagtgcatggccgggatactggctcactcaccttgtctgaaccggatatcccttgctgggctcacagagctacctgactcggctttgagcacgctgagagtgtctggatcatctctaaaatccttttcattgtactgctggtctggcataacagatgatggtctagcacacgtggctattgcgtgcccgaacannnnagaggttgaacttcaaagctgctttaacactacagatgctgccttggaaagtctttcaaaaggctgccgtggtttgaagagtctaaaccttggttcttgcatgggcattacagaccaaggggtttctgccatcttcagcaattgtccaaacatctgcacgct

SEQ ID NO: 61763 - DNA, 284 bp, Zea mays
  Clone ID: LIB3075-034-Q1-K1-A9
cccacgcgtccgcggacgcgtgggcgacatgatggcgtgcacaaacaatgcgatgagagccttgttcctcctggtcctcttctgcatcgtgcatggtgagaaggaagagtcaaagggcatctatgcgaaagcgtccgggcctggtgggtccttcgacatcaccaagttgggcgcctccggcaatggcaagacagacagcacgaaggcttggcaggaggcatgggcattgtcttgcggcggcactgggaagcagacaatcctcatacccaagggtgacttccttg

SEQ ID NO: 61764 - DNA, 295 bp, Zea mays
  unsure at all n locations
  Clone ID: LIB3075-034-Q1-K1-B1
cccacgcgtccgagacaatgcaatgagagccttgttccttttagcgctcttctgtgtcgggcatggtgagaaggcaaagtgaaaggacaacgatgcaaaagcgtccgggcccggtgggtccttcgacatcaccaagttgggcgcctccggcaatggcaagacggatagcacgaangctgtgcaggaggcgtgggcatcagcgtgcggcggcaccgggaagcagacgatcctcatccccaagggcgacttcctctgcggaccactcaacttcacaggcccatgcaagggcgacgtg

SEQ ID NO: 61765 - DNA, 338 bp, Zea mays
  Clone ID: LIB3075-034-Q1-K1-B3
cttggaaagagggggtaacaaaacacgggtgctcattcttgcactaccacaccatgtaagggcgtggattcatttttggccgcggggagaccctcatcaatgatctatactagctccatacgaatggtgataatccacaaatagcatttgtattatgaagaatgtatgtgaccactgacctgtgagacaaatactgatatgtatttaaacacggttgtgatgcccaaatgcttggagaaacaccctacaaattcaaaagtgcactagaaggaagaaaaaacactgagagctcaagcaacaaccaatgatcactacttgcccccacttgatatatttta

SEQ ID NO: 61766 - DNA, 316 bp, Zea mays
  unsure at all n locations
  Clone ID: LIB3075-034-Q1-K1-B4
ctgaccatcaacggacacaggaccatcgtctggcaaggatccctggtgttgatcaagagcgagggccaacattcttacgggggcgagatcctcccgaattgcttggtgctggattttgtgacgaacgtccacatccgctggatcacacttctcaacaaaaagttcttgcacctaaacatcttcgagtgcaagaacatccttatcgacaaaatgactgtcttggtcccgctcgacaggcccaacacagactgcatgcacatcnncnncnccagcaacgtgaccatcatgaactccaccatcggcatgcgctactact

SEQ ID NO: 61767 - DNA, 453 bp, Zea mays
  unsure at all n locations
  Clone ID: LIB3075-034-Q1-K1-B6
tcgcaaacctgcagtcatctcctccaccaccaccaccaagctcaacaacagccagctcgcgaggataatgaagagccggagcatggcatcatcggccgcgctcttggtgctagccctcgcgctagtggcggccaccgccccacaggtagcggaggcaaagaagaagagagcggcggatagcggcgaggcggcggaggcgaagaacatccaggacgacttctgctcgacgctgtgcgagggcaagaaggggaccgacctggtcntgnncaaagagtcctgcgctctctcccagcagtccaacctggtgctgtacggcaggatccagtgcaagggcaagtgcaccgagcagaatggcatcacggcgccggccatgaaggtctgccaggaggagtgcgacaaggcgtacgtggtgaaggcggccgaggtcaccaaggcctgcaacgtcacctgcgc

SEQ ID NO: 61768 - DNA, 456 bp, Zea mays
  unsure at all n locations
  Clone ID: LIB3075-034-Q1-K1-B7
gcaatcaccggggcaagcgaaccctcgatttgcgtccccgctctctgctagcgcccctggaagaggagcgaagcgatgtctatgtcgaagacgggtcaggccgcggagaaggatgagcagcagcagtcccgagggatagcactgatgcagggcatctgcgccgtggtgtaccgcaaggccgataacacgccctgccccatcaagcagggtctctacttgggatctgttggagcagcattcaataaggacgctctcaanantttgaacatcacccatatcttgatcgttgcaaagtcactggatccagtatttccagctgaatttaattacaagaagatcgaagtacttgatatcccagacactgatctgttaaagcattctgatgaatgctttggtttcatagatgaagctataagctctggaggcaatgttttggtccattgctttgctgggcgg

SEQ ID NO: 61769 - DNA, 434 bp, Zea mays
  unsure at all n locations
  Clone ID: LIB3075-034-Q1-K1-B8
gcacgagcctgcctgctacctcaccttgaacgcgcagccgccgcctgcgccacgcgtgaagaagcagccgcctgcgctccgcccgaatcaccgcccggagctccgcgacttcggcggcgtcacgcagcctcaggcaacacgggagcgcttcagcgtcgtcgtcgtcgtcgttgcggccgttctacaacttcatgccgctgccggttggtccagttcgctgtgagaggcccctgagcgagatcaaggcccacggctccnacagcntcgacctggaactgaagctgtaagggagcgcatataactggaaccctcactccctctgttgtatgttccttcctgcagcgggaacagcgctcgtcgtcgtccagaagaagactgtggcggcgtgtttggttttgtaacctgaaacaccgccatgtgcatcagaatctgcg

SEQ ID NO: 61770 - DNA, 444 bp, Zea mays
  Clone ID: LIB3075-034-Q1-K1-C10
atctctcactccaaaagaattcagatggccctattgatggccaacccaatggtagtcacaaagaattagctgtcacatgggttcataaatgcttccagggaatattgactaatgaaacaaggtgtctgagatgtgaaactgtgactgatagagatgaaacattgtttgacctgagcctggacatcgatcagaatagttcactcaccagcttgcttaagaacttcagctcaacagagactttgaatgcagatgacaagttcttctgtgacaaatgctgcagtttgcatgaagcacgaaaaaggatgaaaataaaaaaaccaccaaacattctagtaattcatctcaagcggatcagtggtattgagcagctttagcgctacaaatagctattataccgagtggttttcccactggagcttaaccttgtaatacaggtggttattc

SEQ ID NO: 61771 - DNA, 427 bp, Zea mays
  Clone ID: LIB3075-034-Q1-K1-C11
attccgttcccctggacccgatcgagatggagtcggaagctgacagagccgcggcgccggcgccggcagttgccgcggagaccagcgacgacgccatccaggaggagtctccagccacggccccttcctcagacggaaagcccggatcaggggcggcggcggccccggcgcctgaggtggaggtgcagctgttccggctcgggcgtccggtggccgtgttccggtcggagctgggcgggtatacgcaggaccagctggaggtgggcgacatcctggagcagcacggcctcaagtccgtcttcgccttcgaccctgccggccgcaaacgcggcgtcgccatccggttcaaccctcgcaacggccgttcgctgctgctgtacgcccctggttccaccatctttctagaccgggagcccaaagattcttt

SEQ ID NO: 61772 - DNA, 457 bp, Zea mays
  unsure at all n locations
  Clone ID: LIB3075-034-Q1-K1-C2
gcgaacgcgtgcatgcgcagacgttgaggtcgagggacacggtatctctgagcttcatgagagagcgacccgccaccgtcacgcttggccgcaagccgagaagagtgccgggccgggagaccggacgataattgatccgtagcagattcgctaatggcggagacggcggacatggagcggatcttcaagcggttcgacaccaacggcgacggtaagatctcgctgtcggagctgacggaggcgctacgggcgctggggtccaccncnaccgacgaggtgcagcgcatgatgggcgagatcgacaccgacggcgacggctgcatcgacttcaacgagttcatcaccttctgcaacgccaacccggggctcatgaaggacgtcgcaaaggtcttctgatccattacatcttcgtccatacgattcaatcgatgatgaacctgcttatatacacacacac

SEQ ID NO: 61773 - DNA, 418 bp, Zea mays
  unsure at all n locations
  Clone ID: LIB3075-034-Q1-K1-C3
ggccacataggaacattcaagttatctgtgttactgatggtgagcgaatcttgggactgggagatttgggttctcagggaatgggaattcctgtaggcaaacttgctctatacactgctcttggaggagttcgtccatcagcttgtttgcctatcacaatcgatgttggcacaaataatgagaaactgcttaatgatgagttttacattggactccggcaaaaacgtgcaactggcgaggagtatcatgagcttattgaananttcatggctgctgttaagcaaatctacggcgagaaagtcctcattcagtttgaggacttcgcgaatcataatgcttttaatttgcttgcaaaatatagcaagagccatcttgttttcaatgatgacatccagggcacagcatcagtggtccttgc

SEQ ID NO: 61774 - DNA, 265 bp, Zea mays
  unsure at all n locations
  Clone ID: LIB3075-034-Q1-K1-C5
tcgcctgcattcaagtttgccccacaaatcctgtaaactttaatgttgacaatgttggggtggctaatctacttgggggtgggttgcacaanttcttctgtggttccgtggcgttgcgttctagagaaatatgtaatgcttgttcggttatgacatcaaaaggngcggtagaagtgcaatatgtatcgctaaaaattgctaccttttcattcacatttcacactggttatacctgtcaaagatctatgcccttcttttctattga

SEQ ID NO: 61775 - DNA, 446 bp, Zea mays
  unsure at all n locations
  Clone ID: LIB3075-034-Q1-K1-C6
tcgcggacgcgtgggcgtcggtgcgctcaacgggggtcgcgctcctgccgggcgggcctaggggcaggatactcttgatgcctgagccatgttgaggatggccgtgcgtttccattctctacggccggcgtcatctacacctgggtcaccggcgtgagcttgattgtggcggcaatatgctacgcgtggatgctaccaagcaagggggatggccaggctgcagtgctggtggtgaacatgcgccggaacangatngcttnnntcnnncaggcggcttggctcctgtatcacgttggggtcgatgcatcggcgctgctcttcaccgatgaggttgacatggatgggctaataatggaccagcgagttagcttgcttgtggtggggcaagatgttttgaaatcaaaagcttgaggggcttcagtttgtacaaccctgacccataccta

SEQ ID NO: 61776 - DNA, 427 bp, Zea mays
  Clone ID: LIB3075-034-Q1-K1-C8
gtgggctagctccctggcctgctcgattaacaaccccgcctccccgtcttgctcatttggatgttactgctgacacattggaaaaggacacggaaatgtggcagcaacgagtagaaaaatattggagtttgttgggcccaaaggtaaaaccagacactattagaaacatcatggacatgaaagcaaattttgggtcatttgctgctgcactcaaggaaaaagacgtatggttgatgaatgttgtgccacatgatgggcctatccccctcaacataatctattatagatggctgataggcagcaatcatgactggtgtgaagccttctcgacctatcctcgaacatatgatcttctccacgcatgggcagtcttctccgacctcgataaaagaggctgcagtgctgaaaacctgctcctcgaaatgga

SEQ ID NO: 61777 - DNA, 218 bp, Zea mays
  Clone ID: LIB3075-001-Q1-K1-H7
gactcctaacacactcatgggatgcatgcccactgcacacatatcactaatggctcacctgtcataattctgatgcatttttaacctgggctactgctcctattactcaactttctatcatcctcctaccctgtatactcgctctctcgatcctacccttattagcataaattccaaaccccccaatgaattccatactatttcaatatctctacttt

SEQ ID NO: 61778 - DNA, 426 bp, Zea mays
  Clone ID: LIB3075-001-Q1-K1-H8
ggctcgaccgacgcgtacggccaagggctggcatgatcttctacaggaaaggtcctaagccccccaagaagggccagccagagggtgctgtttatgagtatgaggacaagatcaactttgcagtgttcccatctctccaaggtggccctcacaaccaccagattgctgcacttgctgttgctctacagcaaactatgtcgcctggcttcaaggcctatgcaaagcaagtgaaggccaatgctgttgcaattggaaactatctcatgagcaagggctacaagatggtgactgatggaactgagaaccaccttgttctctgggatctccgtccccttggcttgactggaaacaaggttgaaaagctatgtgatctttgccacatcacattgaacaagaatgctgtctttcgtgacagcaatgcattgt

SEQ ID NO: 61779 - DNA, 115 bp, Zea mays
  Clone ID: LIB3075-002-Q1-K1-A10
gcctttcgtactacatatatgtgctgcatcaatcagtttgttcgactaggtattattctgggtcggggaaatacctcacggggggaggagtataacaagccgatctataccgcac

SEQ ID NO: 61780 - DNA, 310 bp, Zea mays
  Clone ID: LIB3075-002-Q1-K1-A12
acgctccgttagcacgagctgcagggagggagtttggattagaaacagagctaccggcacaatgggcagctttctaaaatcggacgtcctggcgctcaccgccatcgttactgttgggtaccagctgctgctcttcatcatcacagatctcctcctgttcgataaggtcaccgatttctcacgcagtacaaattttatcataatcgccatcctaacattaacttttaatggagcatgtcattttcatcacattgtgctcacaatgcttgtcaccaatttgtgtcttccactaagattatttttattcatt

SEQ ID NO: 61781 - DNA, 372 bp, Zea mays
  unsure at all n locations
  Clone ID: LIB3075-002-Q1-K1-B10
acctagagtcaatttggtgaagcgcaagctaaagagctcaaagtaaagcaaggccagcttgctaaggcaaagacagaagtagacatgaatccaaaccttattgaggttgctcttggtgtgagagctccaaaacaaaagcagaaggaagagatccctgaaattgagccatggttgtttttgtttcctttttgaatgatgtttttaaggttctatgttgtgattgaacataaagtaatttttattggtggtttcaaggatgcaaaaattntactttctgccacatatgaagatgtctctgtggagaaacttaatttggacaagatcaccatatatgttgaacatccagaaccatatgatccacctgctgagcct

SEQ ID NO: 61782 - DNA, 148 bp, Zea mays
  Clone ID: LIB3075-002-Q1-K1-B11
aaactaatcaatcactctctctcttctcattctctcccttcaccactctttacctctaactcaatcccattcttttcataacataaattcctctaacacaactctcatactaccacttttccacacatacccaaccaacacactaaca

SEQ ID NO: 61783 - DNA, 302 bp, Zea mays
  Clone ID: LIB3075-002-Q1-K1-B12
atcctatcctaccacttctctaaccacacaccaactcttccctaacaactacagaatactcgcccaactttaataccacctcaacaccatcccacaactgtacacgaatcaaaatcttctacctcaacataaaaggtaactaccaccagtaccttgcttagatcaaatcttattcatacaccaaacattcttcatacagcaccatcaatccctacaaaaatgctcatgacatcgctctttcatactctactaccacccaccccattaagccttccccttctcttaacattctcaacttctac

SEQ ID NO: 61784 - DNA, 61 bp, Zea mays
  Clone ID: LIB3075-002-Q1-K1-B9
acacaaacacttgggctttagaggaatatacatttgcactttaatcaagcacttcatagtc

SEQ ID NO: 61785 - DNA, 416 bp, Zea mays
  Clone ID: LIB3075-002-Q1-K1-C10
acgaaatttgtcggtactgaaggtgaagatttccaactcccagagggtagacagagagaacttggttggactttttccttccgggtgaaccaaacatcaatatcatcaggaacactcatcaagtggacaaagggcttttccatcaatggcacggttggtgaagatgttgtttctgagttgagcagggccatggagaggcaggggctagatatgaaagttacggcattagtcaatgatacagtcggcacattggctggtgggagatatatggataccgatgtagttgcagctgtaatattgggcactggtacaaatgcagcatatgtggagcatgcaaatgcaattcctaaatggactgggttactgcctaaatctggaaacatggtaattaatacggagtgggggagctttcaaat

SEQ ID NO: 61786 - DNA, 289 bp, Zea mays
  Clone ID: LIB3075-002-Q1-K1-C9
acgcccgattttcgctatcgctgttagcatctatgtcagtttctccattgctgcaatgtacggggtcggagttgccgctctgggggtgctgagcacaattgcaactggtcttgctattgatgcttatggtcccatcagtgacaatgctggtggtattgctgagatggctggaatgagtcacagaatccgtgagagaactgatgctcttgatgctgctggcaacaccactgccgctattggaaagggatttgccattggttcagctgctcttgtgtctctggcgcttttt

SEQ ID NO: 61787 - DNA, 298 bp, Zea mays
  Clone ID: LIB3075-002-Q1-K1-D10
cttcaatacccccaaaatgctatcatatttttcacagctcatccacttcctctatcgtatgtttaataaaaaagggatccatataaatcaaaaatctaaaattttatctatcttatcatctaataactataaaaactatcaataacaaatccatacatactttcttatcttatcctactttaaccaattaaactactctaaccgtacactcatcacacaattatttactttcacacaaattccttaaaaaccttctttcttatcccattactttttttatccaacacattaaaacttt

SEQ ID NO: 61788 - DNA, 424 bp, Zea mays
  Clone ID: LIB3075-002-Q1-K1-D12
gactcagacacgctgcccctgaacgtgtcacgagaaatgcttcaacaacatagcagtgtcgagaccatcaagaagaagctgatccgcaaagcccttgacatgatcaggaaacttgctgaagaagaccctgatgagtacagcaacaaggataagacagatgaagagaaaagcgagatggaggagaagaagggccagtacgccaagttctggaatgagtttggcaagtcaatcaagctgggtatcatcgaagacgcgactaacagaaaccgccttgcgaagcttcttagatttgagagtaccaagtcggatggcaaacttgccttccttgacgagtacatctcacggatgaagtcagggcagaaagacatcttctacatcacgggaaagcagcaagagcagctggagaagtctccatttctcgaga

SEQ ID NO: 61789 - DNA, 174 bp, Zea mays
  Clone ID: LIB3075-002-Q1-K1-D9
gccgccgctcccgatctacaacctttggaaatcctttccttatctggtcatcttcgctcgggtataataatatggatgccgatgcactacttaacaaggacaatcacatataaaatgatcagaaggcatatcatgttaacttgcttaattaccattccaacatggttgaaacct

SEQ ID NO: 61790 - DNA, 437 bp, Zea mays
  unsure at all n locations
  Clone ID: LIB3075-002-Q1-K1-E12
gtgaagctttttatcagtggtgtggttcacaataaagaagatgctggaacaaaatcgtacggtcgtgttccagcggagataaataacatggaaaaagactcctttgacctgtacattcctggaaatggttctggtcatgatctgcctgaaacgaaggctgcaaaacagaaagttgcagatatggctgctaaattagcctcagagcttatgccgtctgatgttgccaaggcattatggggtacaaccaagagttcttcaaagataaataaagaagttcaggagcttttaaggcttaccttaagcaaggcccgagtcaagctgaccgatgatnacctttttaaccggatcattatggacactaacagcatggatccatttaatggtctctatgtgggagcatttagtccatatggaccagaaattgtgcagcttcgtcg

SEQ ID NO: 61791 - DNA, 185 bp, Zea mays
  Clone ID: LIB3075-002-Q1-K1-E9
ataacacatgtgagctcgaccatgggatccctctctaataacatcatggtcaaaaacggcaggcttaaaaaaatcggcggcggcacaaactaccgaccccctaaagtgccacccagacccaacatcaccaccaactacaactgcaaatggctcaccactagagccaccttttactgtcagaccaa

SEQ ID NO: 61792 - DNA, 401 bp, Zea mays
  Clone ID: LIB3075-002-Q1-K1-F10
gcacacgtacgggaggtaagaaagttgagttagatgatgtacctgtcgagggacctgttctaaagtgggaagcactgattgtataggttgctagtccaaatgcatatcatcccaaaaacagaaaagtcaagctcaatgtgactgtgaacgaattgggactttcactacatgctttccgtcagttgcgtcaagttgttagaaagaggtataattctcctaaagatgatctcacaatcatcagtgaactgttttaacaccgggaatacaacataaaatactcgtttaagacactctctactctaatataatacccaatgaaagctgacaaacttgatcaacattccattaattcttatgataaatgaagacttaacgctaatccacaatttatggaactattt

SEQ ID NO: 61793 - DNA, 307 bp, Zea mays
  Clone ID: LIB3075-002-Q1-K1-F12
cggacgcgtggggtcgagtatagcggcgccaacaacaagaccatggctatatgcacgaacgccaagggcagcaggaagggttgcctcaaggagcttgcatgcttctagaccctccatcgactgacccatctctctagttataatttttctctcgtccttgcattgcccattagatgctatccattggtaacgcacaacagtaaaacgacagacatccgacagctatattatgttcgacggtgtaacaccctgaatttgagggtataaaatttcttctccaaataccaaccaaatttaggggttaaaa

SEQ ID NO: 61794 - DNA, 272 bp, Zea mays
  unsure at all n locations
  Clone ID: LIB3075-002-Q1-K1-F9
aattccctaaccgacccactcgtaactaaacactattactataacaacataaaataactttgattaaaaaaccaaacctaccctaaaaacgcgacggttaaaaaatactgcaggacaaacctcctccccctttaaaatatccaacctttcttcccccacaattcaacttacttactcttttttaatctcccctaaaaccaattcacttaccccatttttccaaccatccctcttcaaaaaccctacacttacccaatttaatcnactttcaa

SEQ ID NO: 61795 - DNA, 78 bp, Zea mays
  Clone ID: LIB3075-002-Q1-K1-G10
tggaaccttatttcaatcaaccaaatgtctttctttaccaaataaaaaaaaaaaaagactcataaatataaagtgctg

SEQ ID NO: 61796 - DNA, 164 bp, Zea mays
  Clone ID: LIB3075-002-Q1-K1-G11
acgatattccttaaaaatggagtacaagggattgttgagaactgcttttgttcatgatattaatgtagatgatgaatatttgttgcaaaaaaaaaaaaaaaaaaaaaaaaaaaaaaaaaaaaaaaaacattaaaaacaaaataaaaaaaaataaatcaagacac

SEQ ID NO: 61797 - DNA, 217 bp, Zea mays
  Clone ID: LIB3075-002-Q1-K1-G12
ctcaatttctgtatccctatctaatttcttttactcacccatctaatcatcaaccggacggtttaaaactaacgtgcggcagacacactacactccaaacctttccatctaaatataaattgctacttatcacttcctacacatattacactttttaccataacacttttcctccatcaacatcccctctctatcttcatacctcactaccccttct

SEQ ID NO: 61798 - DNA, 304 bp, Zea mays
  Clone ID: LIB3075-002-Q1-K1-G9
acggatttagttggagttaacaaagacagctacttgatactagatacattgccttcagagtatggctcgcgggttaaggcagtggaggtagatgagaaacctactgaggattacaatgacattggcggacttgagaaacagattcaagagcttgtggaagcaatagtgttaccaatgacacacaaggaccgatttcaaaaattgggcatttgtccccccaaaggggttcttttgtatggacccccttggaccgggaaaacgctcattgctcctgcatgcccttcacaaactaatgcaacatttc

SEQ ID NO: 61799 - DNA, 345 bp, Zea mays
  Clone ID: LIB3075-002-Q1-K1-H10
acgctccccttcccctgcttctcaagcactctctctgcctttccccagccacccccgtagcgagagggagggcggaagaggatgagcgcgtgcagcttcataaagtgcgtcacggtctgggacggcgccgtccgcaagacctgcatgctcatctcctacacctccaacaccttccccaccgactatgttccgacagtgtttgataacttcactgccaacgttgtcgttgatggtaacactgtcaacctcggcctctgggacactgcaggtcacgaggattacaacagactgagaccactgatctatcgtggagctgactgttttcttctggctttctcactgatc

SEQ ID NO: 61800 - DNA, 249 bp, Zea mays
  Clone ID: LIB3075-001-Q1-K1-H5
gaggccaccgtataccgaggcccacacccgcatgagtcctcagcagcacggcgcgtgactgtgaccacactccgtgggaagcaccgccgcggtgagcccatcaccgtcgtcaccgtctactactaccccttggcagtccacgtccactccgtcggcatcgacttctgcctcgtctgagactccgtcgtcatgttcgtccactgtcacgacaccactcttcccatcacgcttgacatcatgctccagcac

SEQ ID NO: 61801 - DNA, 249 bp, Zea mays
  Clone ID: LIB3075-001-Q1-K1-D5
acgtcttactataacctttctccctccttcacctttctccttttcttgccactgcaaaggagctttttctacaatagcatggcgattgcataccctgtcctgtacgtcaccctcttgtcttcaaattacctcaagaaagtgtcgctcttctcccggactcgcatctactccctggcttccatctccggattctacctcctcatcccttcccacagcacccaaacataccacatcaactgcttcaacccc

SEQ ID NO: 61802 - DNA, 237 bp, Zea mays
  Clone ID: LIB3075-001-Q1-K1-D6
acccacaccacacactcaatttcaacaaccccaaactcacattattttctccatttctcattaacttcctctggcgtatttttaaaaatctggggacccatataaaacacaaattcaatattctttccatcttatcattttataacttcaaacatcaccaataacatattcttccatactttcttatcatatcccacttctaccatttcaccttcttattccctacacttattacac

SEQ ID NO: 61803 - DNA, 209 bp, Zea mays
  Clone ID: LIB3075-001-Q1-K1-D7
tataaacttttattatccataataattccaggtccaatcctatgtaaactaacactgcctaatcaaaatttatataaattatgaatcttttcgcccaccaatctctaatatgctaatcttcttcagtcgtcactctcccgtctctaatctactgcctctatccaatcatttcacctcttgcagctctccccccttcatctaaatcctca

SEQ ID NO: 61804 - DNA, 193 bp, Zea mays
  Clone ID: LIB3075-001-Q1-K1-E11
ctttctttaacatataaactcttttcgttttttacaatgaaactatccataaaaggcttctttcaattaaaagtttgccgatccatattacttcaataaatttatccaaccactcaattactaccaaaaccacatttcaaaatcttacaagcatattttccatttcttataaccaaacttccacttatattaa

SEQ ID NO: 61805 - DNA, 425 bp, Zea mays
  Clone ID: LIB3075-001-Q1-K1-E12
taccggtctcgattcccggttgttcggccatacggaccaccattctcaccatcggattcaatgttgaaactgtggagtacaagaacatcgggttgactgtctgggatggcgggggccaggacaagatcaggccactgtggaggcattacttccagaacacccagggtctcatctttgttgtggacagcaatgatagggaccgtgttgttgaagcaagggatgagcttcaccgaatgctgaatgaggatgagttgcgtgatgctgtgttgcttgtgtttgctaacaagcaagatcttccaaatgctatgaatgccgctgagatcactgataagcttggactgcattcacttcgccagcgtcattggtacattcaaagcacttgtgctacaacgggtgagggattgtatgaaggcctggactggctg

SEQ ID NO: 61806 - DNA, 454 bp, Zea mays
  Clone ID: LIB3075-001-Q1-K1-E7
gaaacagggcactgggtttagagcccttcggatctagtattgtcgttcaccggcggctaccagtccaaaccctagaacgttggcgagatgaggtcgttgcgagcggcgcagaccctagtctcccgttcccttttctcagcgcgccatctaagcggcgcagcctcccccgccacggccgccgccgcgggcgcgcggtggtgcgcagcgccggcgccaccgtcccgttcgccgcttccatcctcgagggtgatgcctgtcggggttgccggcgcaatatccttctcccttaccttcgctactgtagcggcggctgaggccaatgccaatgagcgaccgcaaccggatcttgtgccgcagaacgtggtgctgtaccagtaccaagcgtgccccttctgcaacaaggtcagagcctttttagattatcatgatataccatttaaagctgtggaagtta

SEQ ID NO: 61807 - DNA, 250 bp, Zea mays
  Clone ID: LIB3075-001-Q1-K1-F10
catcccccgcaggccaaacacgaagccaccttttacattttgctcgatacaaaatcacaaccgtagggactaaactacgggcagctttacccatctcaaacatctttactctcccacacaatctatctaattactctggttactacaagaatactaccaccgccaatcctcccatcgcatcacttctctctaataaataatccatagaacatactcagacttatctactcaagaacaatatactcactcc

SEQ ID NO: 61808 - DNA, 260 bp, Zea mays
  Clone ID: LIB3075-001-Q1-K1-F11
acgctcttcctctcctccatctctcaacgcctgaagctcaccgcacctcccctcctcggcgcggatcccccactactgcgggagaaaatggctgacgctgaggatatccagcccctcgtctgcgacaacggaactggcatggtcaaggctgggttcgccggcgacgacgccccgagggccgtcttccccagcatcgttgggcgcccgcgccacaccggtgtgatggtggggatggggcagaaggatgcctacgttggcga

SEQ ID NO: 61809 - DNA, 122 bp, Zea mays
  Clone ID: LIB3075-001-Q1-K1-F12
cccacgcgtccgaagatatctaggcctttgtttcatcctttgggactggttggttaacttgtttgcatgtttttcttcgtttgtaatttgaatgacaatcaatgaatttattgtgtagttgt

SEQ ID NO: 61810 - DNA, 456 bp, Zea mays
  Clone ID: LIB3075-001-Q1-K1-F7
acgaggaactgcaagatctgatacccaaaatacaggtaatggcgagatcttcgccgctcgacaaggacactttggtgaagcaggtacgagcaacatttgatgaagttgttgcggtcaccggcgatggcacaaacgatgctcctgcgctacacgaagccgacattgggcttgcgatgggcattgctggcactgaggtggcgaaagagagcgccgacgtgatcattctcgacgacaacttctccaccatagtgactgtcgccaaatggggccggtcggtgtacatcaacatccagaaatttgtgcagttccagctgacagtcaacgtcgttgcgctcatcgtcaacttctcttcagcttgcctgatagggagcgcgcccctgactgcggtgcagctgctctgggtgaacatgatcatggacacgctgggagctctggcgttggccacggagcccccca

SEQ ID NO: 61811 - DNA, 303 bp, Zea mays
  Clone ID: LIB3075-001-Q1-K1-G11
tatataaaccactggtttctccatcaatggttcaaccatacagaaccgctcattataaaagtttgctcactcaacaaaaaatcctcttattcaattgactcaatactatcaacttaactctaaaatcctatttaaagcacaaacttcaccctttattcacacatttacactctataccatattcatctcatacacctattcaaccttcttcaaccactccaaactccatccataaataatcttaaaattactccacacaattaaccctcttcactaaaatcacttacaccttcaatagcttca

SEQ ID NO: 61812 - DNA, 420 bp, Zea mays
  Clone ID: LIB3075-001-Q1-K1-G12
ccggaattgccggcccggcccgaccgacccgcgcgtgaacaccgttcccaaccaagattcctcttacccagggctaaggatcaatcggggtgctaaagctcactggcagcaggacgttacgcttcagccctttccagcgaaagataaatggctactgatcgcttggcacacatattacacgtgtcacgatgacagttggcctcgatgaagcgccccgctgtatcttcatactcaactgcccctgcctggagaagtccaattggtgctctgtcagatggtggcacgtgagtggtgaaaatctcattgatagcaaacaaaaggctcctctttcacaagtttctggtcagtgatttatgactcacggttcatttttcctctattgataacaaaaatgtgaatttgtggactatttctgcttat

SEQ ID NO: 61813 - DNA, 51 bp, Zea mays
  Clone ID: LIB3075-001-Q1-K1-G6
tcacttttccctgttctttaaccatttacaattctactgcactccatctct

SEQ ID NO: 61814 - DNA, 425 bp, Zea mays
  unsure at all n locations
  Clone ID: LIB3075-001-Q1-K1-G7
ggctggggagcccacggcggtggcgccttctccggcaaggaccccaccaaggtggaccgcaggggcgcctacgtggccaggcaggccgccaagagcatcgtggccagcggcctcgcccgccgctgcctcgtgcaggtgtcgtacgccatcggcgtgccggagcccctgtccgtgttcgtcgactcgtacggcaccggcacgatccccgacaaggagatcctcaagatcgtgaaggagaacttcgacttcaggcccgggatgatcagcatcaacctcgacctgaagaagggcggcaacaggttcatcaagaccgncgnctacggccacttcggccgtgacgacgccgacttcacctgggaggtggtgaagcccctcaagttcgacaaggcatcggcttaaggttgggagtgttcactgtggacatg

SEQ ID NO: 61815 - DNA, 408 bp, Zea mays
  Clone ID: LIB3075-001-Q1-K1-H1
acgcggacgcgtgggtgcggcggtccctccccctcctcctcgcgcggcaggtggcgcggcagggggggctgagcaacgtgcgggagtccaccgtctacgggggcccacgcccgcaggagtcctcggcggcgcggcgcgtgacggtgaccacactccgtgggaagcaccgccgcggggagcccatcaccgtcgtcaccgcctacgactacccctcggcggtccacgtcgactccggcggcatcgacgtctgcctcgtcggggactccgccgacatggtcgttcacggacacgacaccacgcttcccatcacgctcgacatcatgctcgagcactgccgcgccgtggcccggggcgcgccgtgcccgctcctcgtcggggatctcccattcagctgctactagttcttcg

SEQ ID NO: 61816 - DNA, 296 bp, Zea mays
  Clone ID: LIB3075-001-Q1-K1-H10
cggaccgcacacgaccggttagacctccgtatgcctatctaaattgttatgcgcacccatcggatcagatgttgggtgggtcataaagccttcgtcggcgaaggctagaattcttaggaagaccctatgcggtgggatgagacaggttggagttctttgtgcccctgcttatgttgctgatcatgacaccgttcgaaagcttgtcgatgatcacacgaatgctaaagccttcatgtccttaccaaaattaaacactttaccgtggattcatcttccgtcgacaccaatatggcgtt

SEQ ID NO: 61817 - DNA, 448 bp, Zea mays
  unsure at all n locations
  Clone ID: LIB3075-001-Q1-K1-H11
cgcggttgccaccttgcccgccggcaccaaccgagtgctacacgtcgctgtcgggagtgaggccgtgcgcggacgtcctcacccacaacgaggtgccaccgatgccacccacggtcgcctgttgtgatggtctcaggtcactcgtcaccaacgcgtccatctgtctatgccatatcgtcaacggtaacatcaacaagctcctaccggcgcccatgatacccgtgcgcatggtggcgctcccccgcttttgtgttgtccgcttcccacgagccatacttcgccggtgtatcagagggcatttgccaccgatgaacccttcgncttcaccagaggcatcaccgtcgaaaccaccatctacatcgccagcagcatcaccatcggaatcaccaccagcagcatcgccaccagaatcgncgtcgacaccaccaccagagtccgtcgactacac

SEQ ID NO: 61818 - DNA, 359 bp, Zea mays
  unsure at all n locations
  Clone ID: LIB3075-001-Q1-K1-H12
ctccccttcccctgctcctcgaccacctcaacgagcttctgctccgacgacgacgacgtggcggcgcatccacatggcggacgacgccgtcgccggcggagcggccgttcgctgcgcagggccggcgccggcctcgctgtcttctagcaggaagcagcagcagcagcccgacgacgccggctgcggcagcagcgacgaccactaccagcacgacgtgatcatgctgaggcggacgaggagcgggcgggcgttcccgccgncgatctccgtgatcggcaagggcgggcggccgtggctctgcctgcgggcgcaccgcgagggtggacgcctcgtgctgcgggagatgcgcctgccgtcgc

SEQ ID NO: 61819 - DNA, 422 bp, Zea mays
  Clone ID: LIB3075-001-Q1-K1-D12
acgcaaaatttcaagaaccccaaaaggttatgatatttttcagtgctcatggagttcctctggcgtatgttgaagaagctggtgatccatataaagcagaaatggaagagtgtatcgatcttatcatggaagaactggaaaaaagaggaataacaaatccgtgcatacttgcttatcagagccgagttggaccagtggaatggctgaaaccgtacactgatgagacaattattgagcttgggcagaaaggggtaaagagcctgcttgctgttcccattagttttgttagcgaacacattgaaactttggaagaaatcgatgtggagtacaaagagttggctttagaatctggcatcaagcactggggacgggttccagcactaggttgcgaacccacattcatttcggatcttgctgatgct

SEQ ID NO: 61820 - DNA, 452 bp, Zea mays
  Clone ID: LIB3075-001-Q1-K1-H3
tccaaggcgagcccggcgctgtcatccgcgtgaagaagggatctggaggcataactgtgaggaagacagggcaagcgatggtggtcggcatctacgacgagcccatgacccccggccagtgcaacatggtggtcgagaggctcggcgactacctcgtagagcaaggcctgtgaatggattcatttaacctcgctcgcttgtccatggttcgcagcaacgataccaacacccgcattatttaattggtagcctcctctagctacgcacgcatttttagtctcctacacgcccttggattgtgcgtggctctgttaatcatctctcatccttcgtctgccatttctcccctgagatttttgttccttgttggtaccatgcattttggcaaataattttgtgattccacttccaaattaaagtttggttgtcgtatggtttgtaaacccagaaca

SEQ ID NO: 61821 - DNA, 210 bp, Zea mays
  Clone ID: LIB3075-001-Q1-K1-H4
acggccagcagccatgagatggtatgcatcggtagcctcctgagggcgctggtgctgcgtgccgcgtcgtctgcagacaggcgccggcggcccaggattctgtgtggccgcgcgacggatgtgcgcgtgacgccacggcacggacacggctggtgcgggttccgggcggtcacgggaaggatgatgctggactcctctgagtctgcctct

SEQ ID NO: 61822 - DNA, 418 bp, Zea mays
  Clone ID: LIB3075-001-Q1-K1-A1
cccagccgaagcgcgagctgagcaaggcggaggcggcgatggagcggctgcagcggatctggggcgcctccggcatggggcagccgccgacggactcgccgcttctcgactcctccgagcaggtctacatctcctccctcgcgcttctcaagatgctcaagcacgggagggccggcgtgcccatggaggtcatgggtctcatgctcggcgagttcgtcgatgactacaccgtcagggtcgtcgacgtcttcgccatgccgcagagcgggactggggtcagcgtcgaggccgtcgaccacgtcttccagacaaacatgcttgacatgctcaagcagaccggcaggccagaaatggttgtaggctggtatcactcacatcctggcttcggttgctggctatcaggcgttgatatcaatac

SEQ ID NO: 61823 - DNA, 419 bp, Zea mays
  Clone ID: LIB3075-001-Q1-K1-A10
acgggcaaagtgtatgacatccccaagggccacatcgtcgcgacatcaccatccttcggggacaggctgccccacatcgacgggagccctgactcatatgaccctgaccggttcggtcccggaagggaggaggacaaggctgcaggtgccttctcgtacatctccttcggtggtggcaggcatgggtgcctcggtgagcccttcgcctaccttcagatcaaggcgatctggacgcacctactgaggaactttgagttcgagctggtatcgccgttcccagagaacgactggaacgccatggtggttggcatcaagggcgaagtgatggataactaccagaagcggaagcttgtcgcggacaactaacattgtggtcgccagtctctatctcttaaatgcttgctagcttctttttgatt

SEQ ID NO: 61824 - DNA, 417 bp, Zea mays
  Clone ID: LIB3075-001-Q1-K1-A12
acgtttgaaacagttaagaattcatatataagagtgcatatatatatatataattctgccgagagaaaggtaatggaggcgggacgcatgttccagccggccatcatcctgcttctcctgctcattgtgaccaccgatgtggcgcatgcggcgagggaatgctagaaggacagccagcgattacttggggcatgcatggcgtccgacaactgcgccaacgtgtgccacggtgagggcttctccagccagaggtgcagcacctgtcgccgacgctgcatctgcactaagtcgtgctaaattaacctacatccggcagttcgatggtggacgtttaatctatgtattggcttactagattgttcttcccctaacaatcagaaaactcacctgctggcatgtacgtagaagcggatatgc

SEQ ID NO: 61825 - DNA, 89 bp, Zea mays
  Clone ID: LIB3075-001-Q1-K1-A3
acgaattattgcaaatactcgttaagccttgtttagttattttcatttcatttggattaaatgccgttgaaagaaattaggaggagaag

SEQ ID NO: 61826 - DNA, 190 bp, Zea mays
  Clone ID: LIB3075-001-Q1-K1-A6
ccactcgttcattcattctatcattacaattcccaacctaaccttcttccccatatcccggatgaaccttaaattctacagggacctcattaacccttccatatacttctatctcatatatcatcaccaaaccattcatctcttcaaccacatttttaccacatatccttttaaaatcatttccaaccac

SEQ ID NO: 61827 - DNA, 228 bp, Zea mays
  Clone ID: LIB3075-001-Q1-K1-A9
aacgcctcgaaggagtgaggaggtggtgtgaatcgctcaagaaagaagcggcttctgtcgtcgccgccgaacgcgcttaagccattcggtggggtagcaccagtggaagacgtggtggcggacaagttcgtgacggttgtgaaggaggcgatcaagaagcatgaggcggatgacgagaatgatgaggcaatgcggaagtttcagggcagtcgtgtgaggaccgcgttt

SEQ ID NO: 61828 - DNA, 454 bp, Zea mays
  unsure at all n locations
  Clone ID: LIB3075-001-Q1-K1-B12
cgcccgcagggcctcgtggcggatcatctcctccatcgagcagaaggaggagggccgggggaacgaggcgcacgccgcctccatccgcgcctaccgctccaagatcgagaccgagctcgcccgcatctgcgacggcatcctcgccctgctcgactcccacctcgtcccatccgccggcggcgccgagtccaaggtcttctacctcaagatgaagggtgactaccacaggtaccttgctgagttcaagtctggtgcagagaggaaggatgctgcggagagcaccatgaatgcctacaaagctgctcaggacattgctcttgcagatctggctccaacccaccccatcaagcttggccttgctctcaacttctcagtggtctactacgagatcctgaactnccctgatcgcgcctgcaaccttgcaaaacaggccttcgatgaggcgatctctgaa

SEQ ID NO: 61829 - DNA, 174 bp, Zea mays
  Clone ID: LIB3075-001-Q1-K1-B4
catattcaagttctactacaacttctcctacgacctttatgaaaccttctcggccgttaacacaatattgcgggagcccacctacaccaatttcctctatctcaaatcttatctcttcttcactctctgacacaccttcacctacgaagacacctacaaataccttcccaatac

SEQ ID NO: 61830 - DNA, 367 bp, Zea mays
  Clone ID: LIB3075-001-Q1-K1-B6
acgggacagcgacatattcaagtgctacgacagctgctccgacgacgtggaggaggccgtcgcccgcctcaacggactcgtgcgggagcccaccgacgccaagttcctcgagctcaagtcgtggctctcctccacgctcggcggcacctccacctgcgaggacgcctgcaaggacctgcccaagaccagcgacaaggacgacgtcgtcaacttcagcctcgacttcgagaagctgcagcgcgtcacgctcgacctcatcaccgaggcgtccggcaccatgtccgcaagcatcgccctgccacccttcaacgccggagcgccctcctacggcgcggcggcgccttccgggggctccgccgatgccccc

SEQ ID NO: 61831 - DNA, 295 bp, Zea mays
  Clone ID: LIB3075-001-Q1-K1-B7
tgtatagctatccgctcttgggatggccatagcaacagttgtgaccgtggcagaaagtggtgaataacaatggatggggctggtgaaaagaaaattaggacctctactgttgaaataaacgacgaatcaagagggcgtccattccaaaaggccaagattgagataatcttgggaaagagcgacaaatttgatgagctgatggccgctgctgcagaagagaggggcgaagtggaagatggtgaagagcatgcttgaaaacagtaccgatgacaagctgctgctgctgtgctctgtt

SEQ ID NO: 61832 - DNA, 243 bp, Zea mays
  Clone ID: LIB3075-001-Q1-K1-B8
cttgatcatctacaacataacagaagaatttatacctgctacagaaaatatttgatgcgagtgtgtttacaacattcggggagtcctacatcaacaatctaatcaattcctttattatcatcataatgttctgattacaaaaatcaacttagatctacatcaataaactttcgttgctatccatgtttctgaccaatttcaatcaatctatctttcactttcatacacttattcttctattaa

SEQ ID NO: 61833 - DNA, 318 bp, Zea mays
  Clone ID: LIB3075-001-Q1-K1-B9
acgcagacgcgtgggcttgagaggaatatacatatgcactggaatcaagcagttcatggtctcgctgcgaatgtacgcaagaggtggctggacatggacagtgaactatttgaagagtgccagcagcagtatatggataaacaagcaaaagccaaagagatgcatgagcaacgagaatcatcatggagacaattggaagctgttgttgctgccaaggctgctggggatgacatggttttggtcaactagatccatgttccttgcatcactgaaaaacatgtgtgccaagtttgaacacatattttgcccctacagcca

SEQ ID NO: 61834 - DNA, 147 bp, Zea mays
  Clone ID: LIB3075-001-Q1-K1-C1
tatcttatctctaaacataatcattttttactcccatatcattcacacataaatcccgactttattataaacttggctggcaccacacatcaatatcatcactaacacatcatcaactcacacaaattactacctcatcaattatac

SEQ ID NO: 61835 - DNA, 423 bp, Zea mays
  unsure at all n locations
  Clone ID: LIB3075-001-Q1-K1-C12
ctctgtcgtgcttctgggaagggagacgagttctctacagcttcttgcgcctctactgctgacgggagggaagggagtagatctggtgatctgcggcaacgtagttctcaacagtttaaatccgcgagagtagagatgacaatgacccgcgtgtagatggttttcaaacccgtacaagcggatttaatactaaatccatccgtacacattatccattgtgataaagatgcacaacattttcatagtgtaaaaattttatattagtcgtgttcatagtcaaaagtgacttangacactcacacgattaatttatggaactaaacttaatctgtcatatgcatcgtattttgggtgttattattaattgtgatctcttacttaatngtgttggtatctacttatacttagtaactggtnataaaa

SEQ ID NO: 61836 - DNA, 406 bp, Zea mays
  unsure at all n locations
  Clone ID: LIB3075-001-Q1-K1-C7
atccggagcagccgcagtcccaccgacccctccttcggtcgccctccatctcctcgccgctggctctcgtttctcttgggaggtaatcaagatgagccgtggtggtagtgccggtggtggtcaaagttctctgggttatctctttggaagcggtgagccccccaaaccagcagtggcaccagctgcaagtgctccacctgttgagaaaccatctgctgcaaagactgatgcggccaagcaggttgctgctggggttaccagtcaaaccaataactaccacagggctgatggtcagaacactggcaacttccttacggaccgtnctttaaccaaggtccacgctgctcctggcggtggctttttccttggctacctgttccgtggcaactgatgcccctgctggtgc

SEQ ID NO: 61837 - DNA, 112 bp, Zea mays
  Clone ID: LIB3075-001-Q1-K1-D1
acccacctaccaattcacaaccccattccattattttttcactctcatctattccttgcgtattttaaaactgggagcctataaacaacatctacacttatccatcttatca

SEQ ID NO: 61838 - DNA, 292 bp, Zea mays
  Clone ID: LIB3075-001-Q1-K1-D11
acgcccacgcgtccgcccacgcgtccgtgcgtatactggagctgatgcaggtacaagtggttcaggtggaggatccggtggggcgagtgcaggtaccagtgctaccgtgggtgctggtgtctccggaggtgccaaagttggtggtggcgtaggaggaaatgcaggaggaagtggcaacgtctatactggaaccggtgccgatgcaggcgtttctggtggaggatccggtggcgccgatgctggtattggagctaccataggtgctggtgtctccggaagcgtcaaatttggt

SEQ ID NO: 61839 - DNA, 399 bp, Zea mays
  unsure at all n locations
  Clone ID: LIB3075-033-Q1-K1-H1
cccacgcgtccgcccacgcgtccggttgcctgaaaccttcgtttccggtctggaatgttgccgatgtcaaacatgtcagctaatccttcacagcttacaattttctatggcggatcagtatgtgtgtatgactcagtgccaccggaaaaggctcaagcaatcatgcttatagctgcagctgcagcggcagcggcagctaccaaaagcagtgctgcccctactgttaaacctncaatggtggcctgcagccctggtggcccaacaagtggcggttcttccgggcctacaccggcttcattactggagaacacttttggagcaactgggccaccttaaggtggtgcttgacctaacttgatttgccaactttaagctgatcttcccattggcaggaaggac

SEQ ID NO: 61840 - DNA, 447 bp, Zea mays
  Clone ID: LIB3075-033-Q1-K1-H10
gccgcgagatcgagaatgtccatctctatgcggctcgcgatccctgctcctgccgtcaccgccgccgcgccgacgcggctgagggtgcgagcggcagcggcggggaaccgcggctctctctacgtcgcgcgcgccgtcgtacgggcggagacgggcgcgctcaggggatgcgcctggctgccaccgaagccgctgggagcgggccagccgtaccggagcaggggggccgtcgacgcgtgtcactcgtcggcgcacctcagcgcgcgcaccatccagtggatctccgacggagccagcgcagtgctattagttgctaaaggcactgccatacacaaatctttccttgtgccattgtttgctcttcaggcaccttgcagcataatctcatggatcaagggtgactatggtcagtggactgcttttcttgctttcgtggtgcgtctattc

SEQ ID NO: 61841 - DNA, 259 bp, Zea mays
  Clone ID: LIB3075-033-Q1-K1-H11
tgacggtcgtctcgccgatcgcgccggacctcctggcggcgttcgagcgcaagttcccgggcgttcacgtcgaggatgcggaggggctcacgtagcacatgtgcatcacgctgacgcacgctagcggcggacagctaggacgttgcagtcggctaatgcaagctgtcaataacaagtcggtcgggttcattctgaccaacctggacgcgaacttcttggaccccgacacggggctggacgctgcccaataacactcctt

SEQ ID NO: 61842 - DNA, 451 bp, Zea mays
  unsure at all n locations
  Clone ID: LIB3075-033-Q1-K1-H12
atttgaaataattgggaataaatagttcgtgaatccctgaagcgtgcatatatatattcctgccaagataaaggtgatggagtcgtcacgcaggttccagccggtcgtcatcctgcttctcctgctcattgtgtccaccgatatggcacatgcaatgaaatgcgagaagtacagtgagcgattcgttggggcatgcatgatcgcagacaactgcgccaatgtgtgccgcggtgagggcttcttggccggcaggtgcagcaccttccgccgacgcttcatctgcactaagcagtgctaaacaagatcgctcgatcgctcgccatgcatcgacaacctattcttaataacgttcattatctcngtcttatttatgacgaatgtcatgtatgttctggtgactgtcatgtatattctgatgactgtcatgtatcttggtcatgtatgctcaaag

SEQ ID NO: 61843 - DNA, 253 bp, Zea mays
  Clone ID: LIB3075-033-Q1-K1-H3
ggaccttcggcgcccgttcaggatccacatcttcccgagcgagttcttggttgacctcttcctcttcggaccacctccaaggctcttggtgtagcttgccactctcaccaatcaagttttcatgtctgatctcgacattcacatcccaactgccttcgatcccttcgctgaggccaatgctggggactctggtgcggcagcagggtcaaaggactacgtacacgtgcgcatccagcagcgtaatggtcgcaag

SEQ ID NO: 61844 - DNA, 311 bp, Zea mays
  Clone ID: LIB3075-033-Q1-K1-H5
cccacgcgtacgtccacgcgtccggtcacgcgtgcggctccttctgcactggcggcggtggctacatctcgatcggtgggtctctgcctcacactcacacacacgaacggcgactgccatgaaacacgccgcgaagctcccgtaccgcggtgcatcgacgtcacagcaccgactctcccacgctatcccgaagacgccgacgcgtaagatcacgatcgctcacgtcttggcgccggaagttatcaaaacaagagctccagactttcgtaagggcgttcagacgcttaccggaatgccatcgttccaaaagg

SEQ ID NO: 61845 - DNA, 369 bp, Zea mays
  Clone ID: LIB3075-033-Q1-K1-H6
tccacgcgttcgtgagagtcccgtatggagtggagaaggagttcttcagatactgggttttccttgttttctgtaggcgcattaccacatccatggtgtctgcaatggtgttactggcaagtaagacattcttggaccctgtggctccactacacaaatatggtgatggctccatatcaaatatactgaccactacctgccattatgaggctctcacgtatgtaagcttgcctgttcaaacactggccaaatgcgccaaaagaatccctgtcttaacctgggccacaatattattgaaaaaaaattttgttgaaaacaataactcttttcctgccgccgtaattatgctttcgcaatggttaatttata

SEQ ID NO: 61846 - DNA, 57 bp, Zea mays
  Clone ID: LIB3075-033-Q1-K1-H7
tcggaaccacagaccacaaaggaggggacacacattcacacacagaccgtatacgcc

SEQ ID NO: 61847 - DNA, 315 bp, Zea mays
  Clone ID: LIB3075-033-Q1-K1-H8
cttcctccacttgccttcgagttcgtgattcgtgatttcgccgccggaaagccgagggagagggagcgatatggggtgcgtcggagacacgatggagtcgatccgctccatgcagatccggcaagtgctcatgcagatcatgagcctcggtatgattgttacctatgcattaatcatatggaagggcttgatagatttcacggggagcgagtcaccacttgtagtggctgctctaattagcatggagcctgcatttaaaaggggtgaaatcctgtttttgcatatgagcaaagatcctattcgcacaggagaaat

SEQ ID NO: 61848 - DNA, 62 bp, Zea mays
  Clone ID: LIB3075-033-Q1-K1-H9
taccaattcccaattcgacggacgactcacgcgtcctatccttcacgactatcaccaaactc

SEQ ID NO: 61849 - DNA, 402 bp, Zea mays
  Clone ID: LIB3075-034-Q1-K1-A1
cggacgcgtgggtccagacaaatctcacctgtcttgatatattgaagaatgcatggagcgctatatggacccttcaggctgtttgtagagccataattgctctgatggcccaccctgaaccagacagcccacttaactgtgattcaggcaatctcctgcggtccggtgatatcagaggctatcaatcaatggcccgcatgtatacaaggctggcggccatgccaaagaaaggttagccgtagaacatgtgccaggccaagagcctattgtccatgcatggctacatgttgtcaggtctgccttgtgctgtctgtatgaactttgtggttcttgattcatgaaatactaaccgttcgtgtgttgcgtgtgtgtctggggtaatgagaggacactcgggttctc

SEQ ID NO: 61850 - DNA, 321 bp, Zea mays
  Clone ID: LIB3075-034-Q1-K1-A10
tcgtgcccgcgtgcagtgccgtccaggccacggcatgagcgtcggcagcttgggtcgctactccagcgagggagacgtgacacgggggcacgttcgcgacatgaccttcacgggcaccatgaacggcgttcgcatcaagacatgggagaactccccttacaatagcaacgcctctcacatggtcttagagaacatggtcatgagggactgtcataaccccatttatcataaatcagaagtactgagcctactacaactgcgagcgcaagtacatggccggggtgactttcaatgacattgacttcaagaacatcaagggca

SEQ ID NO: 61851 - DNA, 386 bp, Zea mays
  Clone ID: LIB3075-034-Q1-K1-A12
cggacgcgtgggcggacgcgtggggcctgccgctcgccgccgcggacgtggccggcgcctgccggagcggcaacagcagcagcaccaccaccaccaccaccgtcgactccttcggcggcgacgtgcaggcgccgcccatgcaggccatgccgctcccaccgtccttctgcgccagcggcgccgtacgcttccctttcagcagctaccccgtgacgcacccgtattacttcttcgggcaggccgcaacagggtgccatatgctgaagctgccaccgacgacggtgactgtggctcagagcgactcagactcctcgtcggtcgaggatctgtcgccgtcgccgtcgccgtcgcggcgggcgacgtgtcagcgacgagatccggcacgt

SEQ ID NO: 61852 - DNA, 441 bp, Zea mays
  unsure at all n locations
  Clone ID: LIB3075-034-Q1-K1-A2
tgcagagctccacggggatcaccatctccaactgccacttcaccaaccacaacnacntcgggctcttcggcgccagggacgggctggccgcaggaccagatcatgcagatcaccgtcgccttcaaccacttcggcaggggcctggtgcagcggatgccaaggtgccgctggggcttcttccacgttgtcaacaacgactacacgcactggctcatgtacgccattggcggcggggacgcgccaaccatcatcagccagggcgaccgctacatagcaccaccaaacatcgccgccaaaggggtcaccaagcccttccccgaaaaaagggggtggaagaactgggtgtgggacacggaggacgacctgttcatgaacggcgccatcttcaatccgtccggcggcgcccccaagcaggtcgacaccaacgagtgggtaaaggcc

SEQ ID NO: 61853 - DNA, 343 bp, Zea mays
  unsure at all n locations
  Clone ID: LIB3075-034-Q1-K1-A3
cggacgcgtgggcgcatgcgcgttaccttttacaactgcaaacactacaaccataagaaggggcgtcctcttctgtgggtgcgtagcactatctattgtaagtgccctcggacgtttgccagcaccctttcttctagaactaattacagctactaacatcacaaaacatcttcaatgacaacctcaactgcatgctgcatgcccaaatgttcctctttgattacacacatactggtgctattataatcaaggactctaatgaacaangnncnctatatccaaatataccttacaatctaagctcatatgtcatttcaatcctacaaaatcttgggaccattat

SEQ ID NO: 61854 - DNA, 260 bp, Zea mays
  Clone ID: LIB3075-034-Q1-K1-A4
cttgtaaagtgtttgtggcgttacaaggcttctccttggtgaactaccacacctgggaaaggctttatttcttttgtaccggggagtggcttgcatctatgttatatactggtgccatagtaattttcagaagcacagtgaagagtttttattattttcatttttgttgtactctgacatgtgagccctataagtatggcaattttggcacggttttgccgttgaaaaaaaaaaaaaaaaaaaaaaaaaaagagggtggg

SEQ ID NO: 61855 - DNA, 378 bp, Zea mays
  unsure at all n locations
  Clone ID: LIB3075-034-Q1-K1-A5
gttaggagcttaattgcctctgctggtgggttcaggaagttctatgcggattgggcaggcttatactgaacaggggcgtgcctgtggttcaagccaatgaaactaacttctttgccgaagaatgggctgagtctgactactactacgacgacgacggcggcatggactattctgaaaactcattgccttcggatttcgtgtctttggtcgatgtatggtacaaaggccatgcgctctactcgaaggtcanatgggggaattcccaactcagacagtgccaatggatggttctacaactacccgttccggatcgacctgtctcaacactcggctgaaaacaacgagaacaacaacggagatgtattcctatccactgtc

SEQ ID NO: 61856 - DNA, 410 bp, Zea mays
  Clone ID: LIB3075-033-Q1-K1-G8
cggacgcgtgggcggacgcgtgggcggacgcgtgggcgagcagaggtcgacaagacgagacaagagaatgcctgtgagcaggatcgccgtgggcgctccgggcgagctgtcccaccccgacaccgccaaggccgccggggccgagttcatctccatgctcatcttcgtcttcgccggatcaggatcgtgcatggccttcagtaagctcacggacggtggcgccgtcactcctgccggcctcatcgccgcgtctctggcgcacgccctagccctcttcgtggccggctccgggggtgccaacatctccggcgggcacgtgaaccctgccgtgaccttccgtgcctttgggggcggcaacatcaagccttctaaggcccttgtctactgggtggcccaggtcctgggcttcg

SEQ ID NO: 61857 - DNA, 306 bp, Zea mays
  Clone ID: LIB3075-033-Q1-K1-F1
cttgagccaagcgttcggctataaggcggtacgctgtccatgggttactatcggcccgacttcaatggcttccagttctttatcaccaccgtatactaaaaccggttgcccaagaagctgtacgggcgccacgtggtgttcggcaaggtggtgaaagggattgacgtcgtgcgcaagatcgaagcctagggccagctcaccggcgtgcccaaggccaaggtcgtcatatccaacagcggtcagctgacagcgcctgcctccgccggccatcgtgacctgtgatcgatgacgaggagaacgacttac

SEQ ID NO: 61858 - DNA, 305 bp, Zea mays
  Clone ID: LIB3075-033-Q1-K1-F10
ccgccgccatgttggttcttgtccgtctacagatttctctttctaccctttatgttctctctttcttctctggtttcaatatttggagcttttgttctgcgttggacgatgatgatttgctcatatataccatcaaactctgaacaatcatacgctatgttgattgcacaaagcttccgtgagtctgatgcgatcttctgcctctaatcccgtttttgtttattcgtcttcttccatttttcgtttctttgttttctgaattaatttattcccgatgcaataaattagagtctctgatgcgcttc

SEQ ID NO: 61859 - DNA, 218 bp, Zea mays
  Clone ID: LIB3075-033-Q1-K1-F12
cgcatcgcagtaccgatccgcaattcgaggcacgcctcacgcgtccacaacacacggcgatggcgaaggtcggcttttggaagggctacgcgtcatgtccgttttgtttctgctcctctgtgggaacatcccatccatgactcgctgcccttcgcattgctctgcgattccatgcagtacatcgatccttctcctaatattcaaaggctctataaaga

SEQ ID NO: 61860 - DNA, 368 bp, Zea mays
  Clone ID: LIB3075-033-Q1-K1-F2
ggaactcgaacaaggaacgatcggctaatcgatatggctggatgtgttgccagcggcgtggccgttccgcctttgatgaagctagttgttgtttctactgcctgaggtgaacaaaccttatacgacacactacaggacgcctacaccatgagacaatactacaagatgtgtgtgaacggactggacatatagtcagacagccagaaggcgaagtacttccacataggcacgcatgtcttgaacatcaggaaccacaagggatcccagatgaccaagctcatgcacagtaatgaccgcatccacgacgacaataatgcgcgcacgtattatcaccgctattacgtgcacctgcaggaggacgaagcaca

SEQ ID NO: 61861 - DNA, 250 bp, Zea mays
  Clone ID: LIB3075-033-Q1-K1-F3
cggacacgtgggcggacgcgtgggcagacgcgtgggctgacgcgtgggcgaacgcgtgcatgcgcagacgctgaggtcgagggacacggtatatgtgagcttcatcagacagcgacccgccaccgccacacttggacggaagccgagaagagtgtctggcccggagaccggacgataattgattcgtagcacattcggttatggtggacacaggtgacatggagcggatcttcaagtcggtcgacaccaa

SEQ ID NO: 61862 - DNA, 362 bp, Zea mays
  Clone ID: LIB3075-033-Q1-K1-F4
ccggcatccacgagaccacctacaactccatcatgaagtgcgacgtggatattaggaaggatctgtacggcaacatagtgctctccggtggcaccaccatgttgcctgaggtcgctgacaggatgagcaaggtgatcactgccctggctcccagcagcatgaagatcaaggtggacgctcctccagagaggaagtacagagtctggatcggaggatccattctggcatccgtaaggaccttgcagcagatgtggatcggcacatccgagtacgacgagtccgggccatgcatcgtacacaggaaatgcttttaattatctgggtccaatacatgcataacgtggcggaagccgtaccggcgc

SEQ ID NO: 61863 - DNA, 414 bp, Zea mays
  Clone ID: LIB3075-033-Q1-K1-F5
cttcccaactcgctggtgatggacttcgtgaacaacggggaggtgtccggggtcacgctgctcaactccaagttcttccacatgaacatgtaccagtgcaagaacatgctgatcaaggacgtgaccgtgacggcgcccggggacagccccaacacggatggcatccacatgggcgactcatccgggatcaccatcaccaacaccgtcattggcgtcggcgacgactgcatctccatcggccctgggacctccaaggtgaacatcactggcgtgacctgcggccccggccacggcatcagcatcggcagcctagggcggtacaaggacgagaaggacgtcacggacatcaacgtcaaggattgcactcttaagaagacaatgttcggcgtccgcatcaaggcgtacgaggacgcc

SEQ ID NO: 61864 - DNA, 424 bp, Zea mays
  Clone ID: LIB3075-033-Q1-K1-F6
attttccaaagaaaagaggagagaaaagccaagttgcagcaacatttcgctcagcttgcaagaatggttggacctgcgaactctatgatccccactggatatccacaagtttattttgcccatccaagtacccatatccctcaaggtcctccaagacaaggttttgtgtatccacccatgggccttagtcatgaatggagaccaagtatgttccccccagcaccaaatctccagcaaatacattcacccgtgatgccaaattcgccaaggcattacagaagcaaccgaggaaggatgggtgggaatatgatgcctcttcctcatgcagttcatacaatgaactatatgacacattcacagccagctaaagaattcatgtctttgcctcgacagcgattcaatcatccgaagtacttctcaaatg

SEQ ID NO: 61865 - DNA, 254 bp, Zea mays
  Clone ID: LIB3075-033-Q1-K1-F7
tttatgatcaatggatctctaaaacagtttctgaggaaaaaagacaggacaattgatcgccggaagagagtaatattagccatggatgctgcatttggcatggagtatttgcatgggaagaatatagtccattttgacctgaaatgtgagaatctactggtgaacatgagggatccgcagcgaccaatttgcaagatcggtgatcttggactgtcaaaggttaaacagcataccttggtatctggtggtgttag

SEQ ID NO: 61866 - DNA, 51 bp, Zea mays
  Clone ID: LIB3075-033-Q1-K1-F9
ccttacgcacgcacgtaccaattcccaattcgacgcacgccccacgcgtcc

SEQ ID NO: 61867 - DNA, 132 bp, Zea mays
  Clone ID: LIB3075-033-Q1-K1-G10
cacgaccagcatagtatctaggtgaacttgcgacttggaacacagcatacggcgattggcagaagcttttaaggggctgggcaaccctttgagaattattgaaggggttggggcttcctccggcccaaaatt

SEQ ID NO: 61868 - DNA, 229 bp, Zea mays
  Clone ID: LIB3075-033-Q1-K1-G12
ccggaattcgacggatcgctccaggcgtccgcagcaaagtcatgagatgaatgaggtcattgagcttgcaatcaaacatgcaggactgtctgagagactagctcttgcacaaccaaagggtgtccgtctttatggacctacggtcacaggatcgacattgttggcacgtgcggttgctcatgacactgactgcaccttaatcagggtgtctgcttctgagttggttcat

SEQ ID NO: 61869 - DNA, 431 bp, Zea mays
  Clone ID: LIB3075-033-Q1-K1-G3
cccacgcgtccgcgcagagataggcgtcttcgtactcgcctacctccgcggctcaaacctttgccccttctcccaattcccgccgccgctccatcccgtaacgcgacaccatgagggagtgcatttcgatccacatcggccaggccggtatccaggtcggaaacgcgtgctgggagctgtactgccttgagcatggcattcaggctgacggtcagatgcccggtgacaagaccattgggggaagtgatgatgctttcaacaacttcttcaatgagactggtgcttggaaagacgttccccgggctggttttggtggccctggacccaatggcaatcattaagggagaaccggcaccttacggcaggtttttcaaccttagcaggttattaatgggaaggaagattcaacccacaactttggccgtgggcac

SEQ ID NO: 61870 - DNA, 430 bp, Zea mays
  Clone ID: LIB3075-033-Q1-K1-G4
gcagcctccaataagagccagccagagaaactaataaaactctcgccgccgccatccgagcgaacaagccaaccgaccccgtgcccaaggcaatccgccgccgacgtaccaccaccaccgcaggagcgagatggagatgaagaggatcctcttcgccgtcctcgtcgtcatcgccgcctcggccaccgcagtgctggcctccaccgaggccgccgccgcgggcgccccaactgcctccgagtcgtccgccgaggctcccgctggcgctggcgctggcgctgccgcttgcgccggcggcttgggggccttcggcagcagcggcgcgcccggcctcggcggccggcccggcgggcttcttttcttccttcttggcttctaacttcaattaacctgttccttccgtccgtccccccgcttggccaacaatgga

SEQ ID NO: 61871 - DNA, 413 bp, Zea mays
  Clone ID: LIB3075-033-Q1-K1-G5
gccggcgtcggctccgccatcgagtacgccgtctgcgccctcaaggtggaggtcatcgtggtcataggccacagccgctgcggcgggatcaaggcgctcctctccctcgaggacggcgcgcccgacaagttccacttcgtggaggaatgggtcagggtcggcgccccggcgaagtccaaggtgctggccgaccacgcctcggcgcctttcgaagaccaatgctccatcctggagaaggaggccgtcaacgtgtcccttgaaaacctaaggtcctacccgttcgtcaaggaagggcttgaaaaagggaccctcaagctggtcggcggccattacaacttcgtcaatggaaagttcgagacatgggaaccctaagtggccttacgtaccaaatccgcccaaccggcctaatttgc

SEQ ID NO: 61872 - DNA, 432 bp, Zea mays
  Clone ID: LIB3075-033-Q1-K1-E9
cccacgcgtccgcggacgcgtgggttctcaaactagcggaactttggaaaggccttgtagtgctaccctgcctctcttcctcggtagaggtgtatggggtccgatcaaccccatggcaaatgggtaacacgacttgtgggtaaagatgcgcaacctctacagagtgtaaaactggtatatcagacatgctcacgtgcatgagcgactcagacactcacatggttaacttatagaattaaactcaaattgtcatttgcattgcattgtgggtgttattatcaattgtgatctcatatttaattgggttggtatctacttataccaggtaactgctaatacaattttgacgaacactaaaagcaatgctcagctttaaccatctcctttggtaagccttacacttacatgagttcccaccttttttgagttcat

SEQ ID NO: 61873 - DNA, 391 bp, Zea mays
  Clone ID: LIB3075-033-Q1-K1-G7
gccagcggagcggacggcgacggccgcggcgggttcgtcgacgtcggccgcctctacgccgacgaggagagggacttgctcgtcaccgtgcgcgtcccgccgtcacgcgggaccatcgcgctcgtccggccgagctgcacctaccgcgacgcggccaccacggagatggtgcgggtggggggcgacccggtgacgctgctccgcgcggcgagcccggtgagcgcggcgatgtccctgcaggtggagcgcgagtggcaccgcgtccacgccaccgaggacatggccgcggcgcaggccgccgcagaggagcacgactacgcccgcgcggcttcgatcctcgaggcccgccgccggctgctggagtcgtgcgcgtggctgtcctcggaccagc

SEQ ID NO: 61874 - DNA, 111 bp, Zea mays
  Clone ID: LIB3075-033-Q1-K1-D2
actcctctgcagacacatctgttcgaataagccttctgatttctacggatcgatcccttgataatgacatggtggtttcgagccatcgtccatgatggccaagtgcgaccc

SEQ ID NO: 61875 - DNA, 427 bp, Zea mays
  Clone ID: LIB3075-033-Q1-K1-D3
gcccagttggatcgacttggtagaccaatcggaggtgatgctggggctcagttgtacacaatcttggatatgtgtcgtgcatttgaccgtgtctttaaagagcacttggacggagggcggccaggtggagatcggatttatggtgtctttgacaaccagttacctgcagcactgaaaaagcttccatttgaccggcatctttcaatgcaaaatgttcgtaaagttatttcagaagctgatggttaccagccccacttgattgcccctgagcaaggatacagaaggcttatagatagttctttaagctactttaagggtccagctgaagcgtctgttgatgccgtccatttggtcttaaaagagcttgttcggagatcgattgcagcaacagaagaattgaagcgattttcaacacttcaatcggata

SEQ ID NO: 61876 - DNA, 104 bp, Zea mays
  Clone ID: LIB3075-033-Q1-K1-D4
ggcatgcttgaacgcctcggttcaaaaatcactgtagatgctacggctcaattgatcactatcgacattgtctctgttgaatctgaccgtgtctctatagagca

SEQ ID NO: 61877 - DNA, 430 bp, Zea mays
  Clone ID: LIB3075-033-Q1-K1-D5
cccacgcgtccgatcgagctttcgttatcctcctcgatcttaattacaggtcatagctaagcaggtctgacaggatgtcgtggcagacatacgtcgatgagcacctgatgtgcgagatcgagggccaccacctgacctccgctgccatagtcggccacgacggcgccgtttgggcccagagcaccgcattcccacagttcaagacagaggagatgaccaacatcatgaaggacttcgacgagcccgggttccttgccccgaccggcctcttcctcggccccaccaagtacatggtcatccaaggcgagcccggcgctgtcatccgcgggaagaagggatctggaggcataactgtgaagaagacagggcaagcgatggtggtcggcatctacgacgagcccatgacccccggccagtgcaacatggtggt

SEQ ID NO: 61878 - DNA, 357 bp, Zea mays
  Clone ID: LIB3075-033-Q1-K1-D6
cggacgcgtgggttcgaataacacaggtgagcgcgacgatgggatccctcgctaataacatcatggtcgtgggcgccgtccttgcggcgctcgtcgccggcgggtcgtgcgggcccccgaaggtgccacccggccccaacatcaccaccaactacaacggcaagtggctcaccgctagggccacctggtacggtcagcccaacggtgccggcgctcctgacaacggcggtgcgtgcggcatcaagaacgtgaacctgccaccctacagcggcatgacggcgtgcggcaacgtccccatcttcaaggaccgcaagggctgcggcttatgctacgaggtgagatgcaaggaaaaacctg

SEQ ID NO: 61879 - DNA, 280 bp, Zea mays
  Clone ID: LIB3075-033-Q1-K1-D7
ggctgacgcacggttagcgcaacatgtggagaaaggaaatgaggatggtttgatgataagttcaatatcatcatgcgcaaatctgttgggcaatcattatggatgcaggaactggcttctcagctcaagtatatgagctatcttcacactttcttcataaggagtggatcatggaacaatgggataaaagtttctacatcagttctgttgctggctccaacaatggaagttctattgtagtgatgtcaaaaggcacaccatatacacagtaatcttataa

SEQ ID NO: 61880 - DNA, 308 bp, Zea mays
  Clone ID: LIB3075-033-Q1-K1-D8
cccacgcgtccggccacgcgtccgtccacgcgtccggcctggcctgggctggccgcctccgaccaccgtacgtcctgcaccgcgtcgccgacggccggcctctgcccagcccgggctgcctgcgagggcttctgatggccctcgacgccgtcctttcctgctagtgcccagctttattgcagatccaggcctctgatcctcgtcttctttcacctctccaacatgaaggtcaacaccaagatcaagctggagccggtcatggcgccgtcgtcgtccctgccgcggagcgccagcgagctacccgaccc

SEQ ID NO: 61881 - DNA, 436 bp, Zea mays
  unsure at all n locations
  Clone ID: LIB3075-033-Q1-K1-D9
gatcgggcaggttttccagggaccagctcaacgacgacttctgcgactgccccgacggcaccgacgagcccgggacatctgcatgccctgaggcgaaattctactgcaagaatgcaggccacactccagtcacgatcttctcgtcacgagtgaatgacggcatttgtgattgctgtgatgggagtgatgaatatgacagcaatgtcacctgtaagaacacttgctgggaggctggaaaggtggcaagggagaaattgaagaagaaaattgctacatacaaaaatggtgttgttattcggaaacaggaagttgaaagggcaaaagaggcttttgctaaagatgaagcagatttagcaaaattgaagggcgaagagaaaatgctccaaggacttgttgataaactcaaagagcanaagaaattaatagagaatgcaga

SEQ ID NO: 61882 - DNA, 321 bp, Zea mays
  Clone ID: LIB3075-033-Q1-K1-E1
aaggccgccaacatcctgctggacaacaacttcgaggccatggtggcggacttcgggctggccaagctcacgacggacaccaacacgcacgtctccacgcgcgtcatgggcaccttcggctacctggcgccggagtacgcgtccagcggcaagctcacggacaggtcggacgtcttctccttcggcgtcatgctgctggagctgctcacggggcgccgccccatcgataccaccaactacatggaggacagcctcgtggactgggcgcgcccgctgctgagcgccgcgctggcggggggagacgggcttcgccgagctcgt

SEQ ID NO: 61883 - DNA, 420 bp, Zea mays
  unsure at all n locations
  Clone ID: LIB3075-033-Q1-K1-E10
aggagacgtcttccggcgacgagaacaactacgtgagcgtggccgccgactacgagaaggccgtgggcgccgtcatcgcggcgacgccggacaacaagctccgcgctatggcgttcgcgttcgacggcgcggcggcgccggacccgggccggtgccccgccgtcgacaagcccttctgcgagacctacgccaagacggagaaggccttcagcggaaccatcgcctacggggacacgcccaagagcaagctggggatcacggacgccgtgctcaagctgaggctcgccaccgacgccaacatcaacaaggcctacgcggagggggacaaggacaagatcgcaaaaatccttgctgcatacggccaggcggacgacgcggtcgctgcggccccgcctcccgagaagctcanagtcatggaga

SEQ ID NO: 61884 - DNA, 428 bp, Zea mays
  Clone ID: LIB3075-033-Q1-K1-E11
cggacgcgtgggcggacgcgtgggggattgtgaggtaaagcgtgatggcagcgccaccggcgagggcccgagccgactacgactacctcatcaaactgctcctcatcggtgacagcggagttggaaaaagttgtctcctgttacggttctcagatggatcattcaccactagctttattaccactattggcattgacttcaagataaggactgtcgagttggatggcaaacggattaagttgcacatctgggacactgcaggccaagaacgtttccgcacgattactactgcttactacaggggagcaatgggcatcttgcttgcgtacgatgtcacagacgagtcatctttcaataacataagaaattggatcagaaacattgagcaacatgcttcggataacgtgaacaaaattctggtggggaat

SEQ ID NO: 61885 - DNA, 167 bp, Zea mays
  Clone ID: LIB3075-033-Q1-K1-E12
cggacgcgtgcgctgacgcgtggtggattgagaggaacagcgctgaggaagtgttaccggatagggcccgagcacggtacgattacctcatgcaactgatactgatacgagatagctgagtcagacatgggacgaaaatgataaagctctgagagagcgattaacac

SEQ ID NO: 61886 - DNA, 418 bp, Zea mays
  Clone ID: LIB3075-033-Q1-K1-E2
tgagcactttcattgctcataaggtggagatgcaagaccatgaatgtgcatgcttgagtagttcaagtgcagacaccttccgtgcagagcaagcagcagactcgtgttagacacactgttgatcgacacagtacatgctgacagccttctggcactgattcattcatgcaccggttcagtcctgggttgaatgttcatgagtcatgaaccaaacacgttttgggcatatagctatgttcgccatggtactctttacgcgggtcttgagttcaccggtgttgatgccagaaaagacaatgataacaatgatattcagatttaggcatctgagaaaccagatactaagatattgacaggaacatgatggctctgtggacatgacacgaatgtgattaatgggactgaaacatgttctgat

SEQ ID NO: 61887 - DNA, 243 bp, Zea mays
  Clone ID: LIB3075-033-Q1-K1-E3
cttagataagtagtaaggctctaaaatgtcacaaaaatccacaaggccctcaagtagtagtagtaggtggtgtactctagctagcacgaagtggatagatcatgcaagggcgcagtcgactacgggtctcctgacatcagtgtcctacgggtatctcaaggaccatgaaaacatcgtatactgctgcaatcatgttgtcgtacttcggaaggacttccatggtgtcaagaatgccaaggcctt

SEQ ID NO: 61888 - DNA, 427 bp, Zea mays
  Clone ID: LIB3075-033-Q1-K1-E4
agacttcattgaaagtgtgattaagaagaaccaaagcataaatgggcatcacaagaacataaccttcaggtgtgccgatgtgacatctaacgacttgaagattgaagataactctggtgatctgatattttcaaactggctattaatgtatctttcagatgaggaggtccaaaagcttgtggggaaaatggttaaatggttaaaggtcggaggccatattttctttagagaatcatgttttcaccaatctggagattccaaaaggaaggtgaacccaacacactatcgagaaccaaggttttataccaaggtatttaaagagggccattcatttgatcaagatggaagttcgtttgaactttttctagtgaccttgtaatgcatttgggcttatggtcaaaaccagaagaattaaaacccgatatgc

SEQ ID NO: 61889 - DNA, 206 bp, Zea mays
  Clone ID: LIB3075-033-Q1-K1-E5
cgacagctatattatgttcgacggtgtaacaccctgaatttgagggtataaaatttcttctccaaataccaaccaaattcaggggttacctcttgtctctctctctcttttccttttgattaaaagtaagtgaattaggcgagggtttaattatttattttgtcaaaacttatgtgagtcatgaaatgttgcatcatgctgagcct

SEQ ID NO: 61890 - DNA, 427 bp, Zea mays
  Clone ID: LIB3075-033-Q1-K1-E6
gaagaccaggatgcttttgctatccaaagcaaccagcgtggaattgctgctcgtgacagtggtgcttttgcatgggagattgttccgattgaagtttctgttgggagaggaaaaccacctgtacttattgagaaagatgaaagcctggataagtttgacccagcaaaactgaagaaacttcggccaagtttcaaggagaatggtggtacccgtaccacttgaaatgcctctagtataaatgatggggcggctgcattaagtttggtgagttggccaaaaggttaagaacttggccttgaagttctttgaaggatccaaagattttccaaatccagttaaggttccgaacctgttaacaccaacccaagacttggcaatcccaaaggttttttaaatgcctgatttaaagtcatccaatgtggatttt

SEQ ID NO: 61891 - DNA, 412 bp, Zea mays
  Clone ID: LIB3075-033-Q1-K1-E7
gaagaacaagaagtaccttgcagttgctgcgccagatgagggtgcccagacccttctggttcaggccattgaggcttttggtgggaagtgcaaccctgaggcgctgaaggaggttcccgttgtcctcaaagccctctacgatggagatatcctggacgaggaaaccatcgtggactggtacaatgatgctgtcgcagctgggaaggactcccaggttgtcaagaatgccaagccgttcgtcgagtggctccagagtgccgagtctgatgaagatggtgacgacgagtgaagaagccacgctgctctactgctaatggccaaacttgataatattatttcaataagtttgttttgcttgcctggtgtccgcgtttaaaactgttaattgtcgtgtggcgcagcatactcttat

SEQ ID NO: 61892 - DNA, 444 bp, Zea mays
  Clone ID: LIB3075-033-Q1-K1-D12
attgggactgtacaaaatatgttgtgcatggctgttgataccaacggaagcttggtgtgctaaagggtggagcacctgcaacagtggataaaccaaaacgacgaacaccagcatttacaggaagaagttcaggacaagataaatctcatcgttcaagaagcatgtccactagcccacatcgtccacgtgttcgtggaaggtctccagccttcaatatgttaacttctgcctttgagaacacgagcaataccaggaacctttccacccctcccattgttgtgagaaagcctttctcaaaatctggatgtcctgaacactcaagggtgtcacccaaaaaatcagctatcagttccctcaccaggtcttttgaaggtcacatgaaaagtacaataccaaattcagtaaaagtgagccctgagctaaagaaggcgacacaggaagaag

SEQ ID NO: 61893 - DNA, 303 bp, Zea mays
  Clone ID: LIB3075-033-Q1-K1-E8
gatagggatcttgacacgcctatcacagaggctgggtttactggcattggtgttggtgcagcttatcatggacctcggcctatgtatagagttcatgacatttaatttctcgatgcaagctattgatcatatcattaattcagctgccaagtcaaattatatgtcagctggtcagatatctgatcctattgattttagaggaccaaacggagctgctgctggagatggtgctcaacacttacagcgatatgcaacttgggttggacaagttccaggacttaaaggtcctaaaccatactcttc

SEQ ID NO: 61894 - DNA, 77 bp, Zea mays
  Clone ID: LIB3075-004-Q1-K1-A8
ttcccggtcgactcactcatcctccgcaagtgacctatatcaccatatcacattactccatacatatttcatcatac

SEQ ID NO: 61895 - DNA, 221 bp, Zea mays
  Clone ID: LIB3075-004-Q1-K1-A9
gactagttctagatcgcgatctagaactagtttcgtctccaccgaggccgagacgaaggcgaggaacttgcctttgggcgcgacgttgtaggcgtaggagcatcagaacacgtacatgtcggatatgtgctatagatgtttactggggaggatgatctgcaccgagtgctagtccttgacagacgggatagagatgcttcatgatgcatattacgcgggcc

SEQ ID NO: 61896 - DNA, 380 bp, Zea mays
  unsure at all n locations
  Clone ID: LIB3075-004-Q1-K1-B1
cggacgcgtgggctggcggcgacacatttttttatccactgacaccctcccgacctccatcaggtccctcgtcgtcgccccatccagaaccgaggttctggccgctgcgttctccctcttgtgcttcgacccgctggtggcgattagtgctcgcgtcaaccgccttgtccaccccctctaattccccctccgcaagccattgcctcgtagatttcttcgcgctgccactgtcgcctccggaatttccacccgccattgttgccgtgagagggacctcgccgggatcggngtgccgctcgaattgagtaggtcgaggagctcctctacgcctcgacgagcgtgtccgcgacaccaacactagggatggagcccctgtcgac

SEQ ID NO: 61897 - DNA, 283 bp, Zea mays
  Clone ID: LIB3075-004-Q1-K1-B10
gtccattcgagctaactaattaagtataaaatgacccgtgccagcagcaatagcagcatgcggggttttacgctggagctgggcagtctacgactgctgattctagatggtattgctcatgcagaagaggagttagtgcctgctgatgataatatctccgtcgccactgctggcacggccgtgcacgatggcgagacgacttagcagtgcgcgaccctggtgagcgttgatgaagcgtgccatagcgcatgcgatacgcacgccatcagtcactacgaccact

SEQ ID NO: 61898 - DNA, 493 bp, Zea mays
  Clone ID: LIB3075-004-Q1-K1-B11
ggtctctcttcctggtccaagtgatcttgccaagttacgagcagcgagcagagatcaaagcaggcatcggcaatggggaacatcgggcagtccttccaggccggcaaggctgaggcccagggcgagtaccaggcggagcacgcggcgcagtgcgtcaaggacaccgtcgcagccgcggccgacagtgcgcagctgcagcagcaccgccccaccggcaccgttgagcaggtggcgcacacgggccagggcgtggcggcaggcgtcaaggacacggtggcgggcgcggcggttggcgtcacgaacacggtggcgggcgtggcagcgggcgtcacgaacacggtcacgggcgccgtggcgggcgtcacgaacacggtgaccggcgcggcggctggtgtcaaggacaccgtgaccggcggccactgatcgacgacccaagaatgcttcatgcatggccaagtgttgagggtttgaggccaaagatggcttgaatttc

SEQ ID NO: 61899 - DNA, 505 bp, Zea mays
  Clone ID: LIB3075-004-Q1-K1-B12
tggggttctacaatctcgctttgctatagtttgtgggtcggctcgtttgtggggtgaagggacgctccatgatattatgatggcttgcatcatactgcataatatgattgttgaagacaaacgggatgagtacggaggagaacaagtttacaacttcgacgatatgggacaatatctttgcaactactacgacatgggacaaagggtgatagtgtcacacaattcttcacctgaactcgatgcattcattaaaaaaatacaaaaatatcaagaacaaggaaacccactatcagcttaaggcagacctgatcgagcacttgtggcaaaaccattctgagttatataaaattgattaatgtgctatttatttatttttatctactttatgtaataagaacaaagttgtgcagtaaacatggttactgtttatttccacttcaattgcctgcaatcatgtgtggagttacgtgttcacaaaaggtgaggataatctataaatcaaata

SEQ ID NO: 61900 - DNA, 439 bp, Zea mays
  Clone ID: LIB3075-004-Q1-K1-B2
ccaggctggaggtggttcaagctttcactcgagctccagtggcggtcagtttggtgatactgggagcttccatggcagtgtccgcaacaatcagacgggggacaatgcgagctttccacccagctccagcaacaatcaatctggggatggtctcagttttcatgaaaggttctatggatcacgtggaagggaccagagcagaacaagcaatgatggattccgtgccaggagcagaagtcctcctggcaagcccgtggaagtttccaactggtgattgcatccactaggtgcaatccaatttttgcgatggtgacgaaaccaagtagaagatggcaccctaacaagttatattatttccttttcttatcctgcttagatcccaagatgtgatggtctgaaccctaacggcttctgctatcttgattgacgtctgggagac

SEQ ID NO: 61901 - DNA, 278 bp, Zea mays
  Clone ID: LIB3075-004-Q1-K1-B3
tgcgcttctcgacatgtccaccgacgacctcttccagctctttcccgcgcgcgcctacacaaggttccggaaacatctgaaaagggagcccattgcactcatcaacaaacttcgccaagcgcaaaatgatcctcctcctggtcaaaaacctgagccagtcaagacacatcttcctaacatgatcattgtccccgaaaagaatggaagcatttgtggggtctacaacagccatacccatcaccacgtttagatcaaacctgacatgatacgtcactacc

SEQ ID NO: 61902 - DNA, 207 bp, Zea mays
  Clone ID: LIB3075-004-Q1-K1-B4
cacgcatccatcaaagaaacaagatcacacatacaatacctctctagctcgccaccaacaatggcctgcgatgtactccatcatgctcgccacaactgcacttgctacgtcttttgtgattgtttcgtgctccacccctctcaccttctacgtcttctatatgctccaaacctttccaccttttccttaccctcaacattgtcacca

SEQ ID NO: 61903 - DNA, 448 bp, Zea mays
  Clone ID: LIB3075-004-Q1-K1-B5
tgaaaacagccgagcgatctcctctccctctccctctccgatccattctccagcgcagcgaagtaaacatgtctgaccgggcaaagatgtcgtggcaggcgtacgtggacgagcacctgatgtgcgagatcgagggccaccacctcgcggcggcggccatcgtcggccacgacggtgccgcctgggcgcagagcacggcgttccccgagttcaagaccgaggacatggccaacatcatgaaggacttcgacgagccagggcacctcgcgccgacaggcctgttcctcggacctaccaagtacatggtcatccaaggcgagcctggtgccgtcatccgtggcaagaagggatcaggaggcatcaccgtgaagaagacagggcaggcactcgtcgttggcatttacgacgagccgatgacgcctgggcagtgcaacatggtggtggaaag

SEQ ID NO: 61904 - DNA, 344 bp, Zea mays
  Clone ID: LIB3075-004-Q1-K1-B6
ctaggagtggcaaggggaaggaggttttgggggatggaggaagtaagggaaaggggggggggagggtgaagaaggctgtaggcatgaaggaagaaaggggtgaccataaggttgcagggtttatatttatgtgcaatgcaaatactaagaaggagtgctaccagaatcgcttgtttgggatgcctgatcggaagattggaatggtcaataagataatgccagggatgaagctgtttctgtatgattttgacctgaatcttttgtatggagtgtacaaagcagcatcacatggtgggctaaaccttttacaatgagcatttaatgtgaagttccttgcacatgtt

SEQ ID NO: 61905 - DNA, 163 bp, Zea mays
  Clone ID: LIB3075-004-Q1-K1-B7
tctcgaccatccctgcaaattaccgctatggctcccaagatcctagtcatccttgtgggcctggtcttattctcaccggctgctctggccgccttccatgtgatagatatgctggccaataagtccacttacattcaacttcctgaagcttctgcataacacc

SEQ ID NO: 61906 - DNA, 348 bp, Zea mays
  Clone ID: LIB3075-004-Q1-K1-B8
cgacaatttcctaagggctgctggctgttaggagtccagttacatggacgacaaccgcctcagctcaagatagtcccaacggaagatcctgcaatttttccacattttgcagggaaagaagaggggtatgtccgcgtgtgaggtcttagctagagactcaaaccgggttcgacacccattctttatgtatagctgtacgtggttgggctttgagccctttgctgctgctgctgttgttttcaccaatgcaacgtgtagagagggactgtgggggagcagtgccttctaccagactgtacatgtaacatgttgcagaaatatatgaagaaaaaatgacgtttgaaggat

SEQ ID NO: 61907 - DNA, 493 bp, Zea mays
  Clone ID: LIB3075-004-Q1-K1-B9
aacaacattgcccggatcgagaagatggtgtggacgctggcaggctacggggagcggggcggggaggttggtgggttcgtgttccaccggttccccacgatcgagcggctcgcgctcgtgtcggagcaggaacttcgtcaggccgggtttgggtacagggcaaagtacattgttggcactgctaaagaattgcaggccaaacctagtggaggtcaaaaatggcttgcctcactgcgtgagaaggagctttcagatgtgattgaagctctttgcactctcccaggtgttggtccaaaggtcgctgcctgcattgctctgttctcccttgatcaaaatcatgctattcctgtcgacacacatgtttggaaggttgctacacagtatctattaccagagctagctggcaagagcttgaccccaaaacttagcgttgttgttgccgatgcttttgttactagatttggaagctatgctggttgggcacaaaacgttc

SEQ ID NO: 61908 - DNA, 396 bp, Zea mays
  unsure at all n locations
  Clone ID: LIB3075-004-Q1-K1-C1
gattattagagaaaaggttaatatagaccaaaataagggcaacgttgagagggtcttcttgagtagttgtattcgaactgacaagtctcatggttttcgagctttggttgtaatggaggatcattcactcttgttaattcaacaaggtgaggttgtttggagcagagacgatgggctggcttcaattgttgatgtaacaacatcagaattgcctgttgagaaggatggtgtatcagttgttggtgtggaacacaatctctttgagtggcttaagggacacatgctgaaactcanaggaactctaatgcttgctaatgttgatgaagttgctgcaatccaagcattgagactaaagagctctgagaaaaatangatgacaagagaccattatggatt

SEQ ID NO: 61909 - DNA, 462 bp, Zea mays
  unsure at all n locations
  Clone ID: LIB3075-004-Q1-K1-C10
ctaccccacacagaatcggcagccgcctatcaaacgcatgccaacgcgaaggtctcaggggaggagcaccaaccatggtgcacgtcaacttctaccgcaactatggtaagacgttcaaaaaaccaaggcgtccttatgagaaggagcgtcttgatgctgaactgaagctggtctggtgagtatgggctgaggtgcaagcgtgagctttgcagggtccagtatgcactgagcaggatccgtaatgctgcaaggcacttgctcacccttgaccagaagaaccctcgtcgtatccttcacggtgaggcacttcttctccggatgaaccgctatgcgctgcttgctgacggtcagaacaagcttgattatgttcttgccctcaccggttaaaactntctcgcaaggcggcttcaaacacttgtattcaatgctggcatggccaagtccattcaacatgctcgtgtc

SEQ ID NO: 61910 - DNA, 473 bp, Zea mays
  Clone ID: LIB3075-004-Q1-K1-C11
ggctgccgcaggtatatatagcatcctgaagaagataggccgggacaaagtaccaagcagtgggagtaaaatgccaaggactgtaattgccttggatggtgggctctatgagcattacaagaagttcagcagctgcgtcgaagcaactcttacagacttgctcggcgaagaggcctcttcctccgtggttgccaagctggccaacgatggctctggcattggagctgctctccttgcatcctcacactcccagtatggcgagagtgactagtcttgaaaactggtgtggatcgaacttcgagtgtagctctcatttttatctttttttcccttcaaaacatccctaatattccggctctcctcggagaatttttcggcttcctttcttggctattctgtggatgcacttaaggctctgcagcgggatatagctagtatagagccaatcagtttcgaggttatctaatggcata

SEQ ID NO: 61911 - DNA, 450 bp, Zea mays
  unsure at all n locations
  Clone ID: LIB3075-004-Q1-K1-A7
cgcggcgcaccgggctcggatgttcacccttggctggttcctgcaccccatcaccgaggggccgagtacccggagacgatgcagaagatcgtcatggggaggctgcccaacttcaccttcgagcagtctgccatggtcaaaggctcagcggactacgtcgccatcaaccactacaccacgtactacgccagcaacttcgtcaacgccacagagaccaactaccgcaacgattggaatgcaaagatttcgtatgagcgagatggtgtgcccattggcaaaagggcgtactcggactggctntacgtcgttccatgggggctctacaaggctctgatttggaccaaggagaagttcaacagccctgtgatgctcatcggagagaacggaattgaccagccttgaaatgagaccttgccgttcgctctgtacgacaagttcaggatagactac

SEQ ID NO: 61912 - DNA, 269 bp, Zea mays
  Clone ID: LIB3075-003-Q1-K1-H10
ggcacgtgcgatggtgcccgagcgcgcgcggtggtgaaccccagggcgtgcggtggctcctcgattcggagttgcggcggcggttcccaaattcataggcgtgatggcggcggctccctaatctggagggcgagctgcggcggggccctgaggcgggcgagcagtggtggcgccccatgaggcgcgactgtctccagcgacagttgccatgctaggcacatgtgggtctaacggcgacgacggtcttgcgagacacgtgttgcgagggt

SEQ ID NO: 61913 - DNA, 409 bp, Zea mays
  Clone ID: LIB3075-003-Q1-K1-H11
acccgcgcacaccgtccaccggcacgtccaccggctccatggcgctccacgccgtctcctccgcggcggtctcctccccgttgcgcgctctctcacgcagcctcccccagcgcccaggctgtggttgtttaccaaagcagtccgtcatgatttactccacaaaatttgcaagacctcaggctggaccggtggacttcgctggcaggcctctggttcttggacgctcggacaagagagcagttttgatgcatgccactattgaagaaatcgaagcggagaaatccctcatcgaagaccaagctaaagaaaagatggagaaggcaatcgaaacagtccaagctaacttcaacactgtgaggacaggacgtgcaaacccggccatgcttgaccggattgaggttgagtacta

SEQ ID NO: 61914 - DNA, 412 bp, Zea mays
  Clone ID: LIB3075-003-Q1-K1-H12
cccacgcgtccggagcagcatttcgagtaacacagttgagcacgacgatgggatccctcgctgataacatcatggtcgtgggcgccgtccttgcggcgcttgtcgtcggcgggtcgtgcgggcccccgaaggtgccgcccggccccaacatcaccaccaactacaacggcaagtggctcaccgccagggccacctggtacggtcagcccaacggtgccggcgctcctgacaacggcggtgcgtgcgggatcaagaacgtgaacctgccaccctacagcggcatgacggcgtgcggcaacgtccccatcttcaaagacggcaagggctgtggctcatgctacgaagtgagatgcaaggaaaaacctgagtgctcgggcaatcctgtcacggtgttcatcacagacatgaacta

SEQ ID NO: 61915 - DNA, 131 bp, Zea mays
  Clone ID: LIB3075-003-Q1-K1-H2
gggagccaacatataactccctcatttgtattctacacggtatgctatggacctggggggggttcttactaagttgaggtatattgcatgagatagcatgcaccggttaccatatatactatttatacttc

SEQ ID NO: 61916 - DNA, 362 bp, Zea mays
  Clone ID: LIB3075-003-Q1-K1-H3
caaaatttgagtttgagtttgaaagaaggaagctggccagagatgatgttcgagaattaattgagcagagagacattggaataccatcctcagatgttgcaggagtttcttggtggtggtgtcaaggcgaactttgtgtacccgagtggggtggatcgtttcaagaggcaattcgttcatctcgaagaaattgctgctaagggtgagaagactagcccacaattgcgacaacatacttccttaccaagagaaagagtaaatgacagcggcgacgaccttgagaaaccaagtgcagattactgcataagattgcatgtatgtgatcaactgtcaagctctcgtaactttctgaagagcgaaag

SEQ ID NO: 61917 - DNA, 384 bp, Zea mays
  Clone ID: LIB3075-003-Q1-K1-H4
ggcaaaatgcactgttgatggcaatctcatcacagcagcgacttataattctcatcccgaatggatgagcctatttgtcaaagcactcggaggttcagtggcaggctcagataagagaatactgttcctatgtggggactacatggaggattatgaggtcatggtcccattccaggctctccaagctcttggctgccatgtcgatgccgtttgccccgacaagggagctggggagacgtgcccgacagccattcatgatttcgaaggtgaccagacctacagcgagaagcctggccacgattttactctgacagcgtcgtttggaagtgtggatgcttcgagctacgacgcgcttgtggttcctggcggacgggcttcagagta

SEQ ID NO: 61918 - DNA, 260 bp, Zea mays
  Clone ID: LIB3075-003-Q1-K1-H5
agtatttgtgggcgggctcgacccagatgtcagtgaagaggaccttaggcaggccttctgcgagtacggagaaatttctaccgtaaagattccagttgggaaacagtgcggcttcgtgcagtttgctcagaggaagaacgcggaagacgcgttgcaagggttgaacggcagcactattggcaaacaggccgtgcgtctctcatggggtcgcaacccagcaaactagccgtttaagggcgacaatggcaacatgcaatgga

SEQ ID NO: 61919 - DNA, 361 bp, Zea mays
  Clone ID: LIB3075-003-Q1-K1-H6
tgggaacacaacatgtgccaaggaaatgacaaagctctctggcatctctgaaatcatccccgagatggagatctgcgattttgactttgaaccctgtggctactccatgaatgcgatccatggctctgcattctccacaatccatgtgacgcccgaggacggtttcagctatgccagttatgaggttatgggcttggatgccactgctctgtcttatggtgaccttgtcaagagggtccttcggtgctttggcccctcggagttttccgttgccgtgaccatcttcggcgggcgtggccatgccgggacatggggaaaggcacttggtgcagaggtctatgactgcaacaacatggtggag

SEQ ID NO: 61920 - DNA, 243 bp, Zea mays
  unsure at all n locations
  Clone ID: LIB3075-003-Q1-K1-H7
gcgccatggaacgggccttcctgccgctggctccgccgcgccaccgcttggtgcaaaacgttcggccggctgcaccacgtgtgcctgcaggacngctccatcaccgttcccgcctacgccgacccgcgcaagatgcatgcgcacctcatcagccccggacgccgcgctccatcttcgtctacttcaggggcctcttctacgacatgggcaacgaccccgagggcggctactacgccaggggcg

SEQ ID NO: 61921 - DNA, 435 bp, Zea mays
  unsure at all n locations
  Clone ID: LIB3075-003-Q1-K1-H9
accgggcgtcgagcgagcagtctcccaattccacccaataactaataacatctnctcaacgcgggttccttggaccactatatccaggagcgacgaagtgatccacccgccagccatggagatgaagaaggtcctctgcgccgccctcgtcgccgccgcctcggccaccgccgtgctggcctcggtcgcctccgaggcgccctccgaggcgcccgccggcgcggccggtggtgcggctggccctagcgcaagcggcgccgtcgtcgtcgtcgtgcccgacgtcggggcgctcgtcgactncttcctcggctactacctncactgagcgacgacgcgcggngcggcaacgttgggatgcatcgtgtttggttcattcgattaattaattggtttttttatttacgtggtttgcgattgggtaattggttggttggt

SEQ ID NO: 61922 - DNA, 444 bp, Zea mays
  Clone ID: LIB3075-004-Q1-K1-A1
attcacccaatccagatgcgcaaacatcgaatcgtctcgctcgtggctgccctactcgtgctgcttgccgtcgccgccgtttcctccacgcgcagcgcacaaaaggagtccgtggctgacaacgccgggatgttggcaggcggcatcaaggacgtgccggcgaacgagaacgacctccagctccaggagctcgcgcgcttcgccgtcaatgagcacaaccaaaaggccaatgctcttctggggttcgagaagcttgtgaaggccaagacacaagttgttgctggcacgatgtactatctcactattgaagtgaaggatggcgtagtcaagaagctttatgaagctaaggtctgggagaagccatgggagaacttcaagcagctgcaggaattcaagcctgttgaagagggtgctagcgcctaaggatctgtcgtctccctgtgc

SEQ ID NO: 61923 - DNA, 481 bp, Zea mays
  Clone ID: LIB3075-004-Q1-K1-A10
cggacgcgtggggctctttgaggatgctggtaatcagtggagtctgagtcgaccaatgcggagggtgataatgaccagtgagcagatgttcagtgaactcagagcgcacatattagcatcacagactgtggaccagcaacaacgcctttcacagtgcttcgataagctgatgacggatgtcaataggaacttgtaacctaagaatcgtgacagattcactcaaaacctgacagcatttagacgtgattttcgactgaagtaacagctccttggtaccagctatcagtttgaaggtgttcctgcatgatgtaaatactccagttaccttcttttttggaaccacctttctgtgggttgagaaaagaagagcttgtccttaggtttgccttggattggctgaagatggtcttggtgatgcatgtggtagtgaaagcagctgtaaatttcatagcatgtcattttaatcagaatggtgaaaggt

SEQ ID NO: 61924 - DNA, 438 bp, Zea mays
  Clone ID: LIB3075-004-Q1-K1-A11
caattttgaagagaatgatttccagattctacgagttctcatgacaatcattgacacagggaagggacaccaccgctcttgccgtggcctgctacgacctctcacagttcctccagtaccatccatctggccgaatcgtggtggcagacctcaaggccaaggaccgagtcatgaagctcatgaatcatgaaaacactgaagtgcagaaaaatgcgctgctctgtgtgcagaggctcttccttggcgcaaagtatgccagttttctgcgggcctgagagaaaccgagccttttttgtatttagatccagagaactcctggccatttttcaaaatggctgttaagaaaaccttgaaaattcttgtccattatatcctattgttattttatttctgagaccgatgtataataaataattagagccgtaccatgctcgatgt

SEQ ID NO: 61925 - DNA, 54 bp, Zea mays
  Clone ID: LIB3075-004-Q1-K1-A12
acatcctcactttttctacactacaatctcaaactcttctacataatcacaaca

SEQ ID NO: 61926 - DNA, 408 bp, Zea mays
  Clone ID: LIB3075-004-Q1-K1-A2
cagacgacgaggcgacgacaccgcccactctctgtcaacacgaggagagagtagactgcggcagcggagtgcagagagcggacgcaacgcaacaccgtccactctttgtcactgatgatcgaattgaggagcgcactgaagctaaccgccttcgccgccgatgagtcgcctcctctcgcggcagcaccttgccgtcgtccgtcgatctgcaccctttgcgtgcgtgtccaggtgatcccgcctctcgccccctttccccgcgatcaatcgcgcgtgcaaactgaggtgtcgttgcgtggtctgatgcgaattggggggatcgcactaatggtggaaatggaaccatgtgactgttcgccaggctacatgcgtgtgttcacacttttcaaactgacaggatatgttttt

SEQ ID NO: 61927 - DNA, 396 bp, Zea mays
  Clone ID: LIB3075-004-Q1-K1-A3
cggacgcgtgggcggacgcgtgggggaaacacaattagctggagacgagcattctcagtcacagaaaagttcccgtggccggattgaacatcctcacgtgtcacctcttcacgaggaacttatccccacttcaattcatacccctggatcaccctattcttgtgatgtcccgatggttgaagaggccatagacgccatctgcaagagccacggaacaccaccagatgagaagattgccatcaccaaagctattataaatgtatcgaatggatccaagcccccactctttgctggcatcatagcacttgtgatgagcatcgcaacgatggtccgtctgacccgcagcatgatgcctgggaaggttctcggtgctgccataggtggagctaccctctc

SEQ ID NO: 61928 - DNA, 314 bp, Zea mays
  Clone ID: LIB3075-004-Q1-K1-A4
ccagcgtgcacgaggtcctttgcgtgggggcagccagggaccaacacagatccagcgtggacgtggctggcacaaagacgacatgcagaaaatggagcatgcattgaatgccatgaggaacaatagatatcgtacattacttttgttcttgatgtccaaacctctactgttcctctttctccaacaacaagttctttcttttctggcgagcaaaagtgctgataacgtgttagagcgcagtgaaaacgagactcgagagaatagagaaaatgacagttgtcgatctttattgcagagattctgggttatataaa

SEQ ID NO: 61929 - DNA, 477 bp, Zea mays
  Clone ID: LIB3075-004-Q1-K1-A5
cttggtttcacgttttccttcccagtgaaccaaacatcaatatcatcaggaacactcatcaagtggacaaagggcttttccatcaatggcacggttggtgaagatgttgtttctgagttgagcagggccatggagaggcagggactagatatgaaagttacggcattggtcaatgatacagttggcacattggctggtgggagatatatggataacgatgtagttgcagccgtaatattgggcactggtacaaatgcagcatatgtggagcatgcaaatgcaattcctaaatggactgggttactgcctaaatctggaaacatggtaattaatacggaatggggaagctttaaatccggcaagcttcctctctcagaatacgacaaagccatggactttgaaagttgaaccctggagagcagatatacgaaaaaatgatttctggcatgtatctgggagagaatgttcgaagaattt

SEQ ID NO: 61930 - DNA, 77 bp, Zea mays
  Clone ID: LIB3075-004-Q1-K1-A6
agcatcgatctacccccatcttccaggatagccttccaccacaataatcataaacacctgtcatagtcaaatctctc

SEQ ID NO: 61931 - DNA, 268 bp, Zea mays
  Clone ID: LIB3075-003-Q1-K1-H1
tccaattctactagactttgaattcccttcgattcatccggcgcggtgggctatggacctgcagcaggaagctaaataaggttatatatattgcattaaaaaacatgcaccgcttaccatatatactactgagacttttgaattctagtataagtaatccttttggttggggttaggagggcaatctaatcatgtatgccgaattccaaatagtggaaaacaagctaaatgttaaatatacatgcctattttggagggcatttttttt

SEQ ID NO: 61932 - DNA, 321 bp, Zea mays
  Clone ID: LIB3075-003-Q1-K1-F12
gctgggtttaacattaaggcgctgttccgtaaaattgctgctgcccttcctggtatggagacgctctcatcagcgaagcaggaagacatggttgatgtgaacttgaggtctggcaatgcaaactcgtcccagtctcaggctcaggctgggggatgcagttgttagttgcagtctctgacacttgctgctcatgatctctgagaccctgagcatcagaacgcgttaccactgatgcttctctcgggaaggagagttgatcggcattgaacacgcacacgctatagttgttacccggtgaatggaccatttgcattggaacga

SEQ ID NO: 61933 - DNA, 295 bp, Zea mays
  Clone ID: LIB3075-003-Q1-K1-F2
cggacgcgtgggatcgcgagggccgccctttttttttttttttcgaaggaaactacatcggagtgattctgcaaacatgtgctaccagatttaacctaaatctgcaaacagtaaaatggaaagcaccactgttctgttcatattgtgacgaactggcagcctggcatgcttgacatcaaacaccactgcgactggcaccaaagaccttaaaccaagcacaacgccgttgaactttaacagcctatcaaagcaagctccaacatcaggagatgtttaagtatcctacccctgtccg

SEQ ID NO: 61934 - DNA, 427 bp, Zea mays
  Clone ID: LIB3075-003-Q1-K1-F3
cccacgcgtccgaagagttcagtccttacagacagagggaatagaagtaactgctgaaatgggtttggtcggtcagcaaaatatcatgttagacttggaaaataaagccttgaagcaacggcttgagagtctatctcaggagcatctcattaaacgttatcagcaggagatgtttgagagggaaattggccgccttagaacattgttccagcagcagcaacagcaacaacatgtgccgcagcagcaggctcctacccatagccgcagtaacagtagagacctggattcgcaatttgcaaacctgtctctgaaacacagtgatcccagttcatggcgcgacgctttctctggccttcgcatttaagaaccctttggttcagcttttggatccctgagctttgcagaacctggtgcccctttatgccac

SEQ ID NO: 61935 - DNA, 424 bp, Zea mays
  unsure at all n locations
  Clone ID: LIB3075-003-Q1-K1-F4
accggtcgagccgcgcgttcggcaacagcatccatcgcgtgcgtacattaatctaagcgatcttcatccagccttctgctctgcgcggtcgaaatggangcgacgagcaaggcgatggcttcaggcctcctcgttctgctgcttctcatcaacacaggctttgtcctgcccgtccattccgaggactgctgggccgacacccgcgtcatctgcaccaagacgcacaactgccgggacgacacttgcgcggagcgcggcatgccggacggccgctgccactgggagttccccaacctggtgcccttctgccagtgcctgcgccccaactgccactagtccgggcgcctcggattggctcacttcgccggcgattatggatggtgcccaactgcgactgcccaatctggttcatttcgtgtggtta

SEQ ID NO: 61936 - DNA, 365 bp, Zea mays
  Clone ID: LIB3075-003-Q1-K1-F5
agcagctgcacctggaggagcagctcctgcgacgcacatcagacaactggtgtattatcaacgagggcacggcccctgctaccatcgttatgggcgtgtctgggagagtctcggagcttgtcaatatacagctggtcctccgggacaaggtgccgattgtgaggaggttcagtggaggtggcaccgtcattggtgatcagggaacggtgtttgtgactttcatttgcaacaagaatgttgttgctgggctgcagccctttccacgggacatcatgtcatggagtggtcagctatatgggaaaagttttgacagatttggtgaatttcatctacgtgagaatggcatgaaaccacacagaattctt

SEQ ID NO: 61937 - DNA, 254 bp, Zea mays
  Clone ID: LIB3075-003-Q1-K1-F6
cttctcgatgtggaacacgagaagggctgcaaccccaactacctggccgtgctggtgaagtgggtggcggacgatggcgacatcgtgctgatggaaatccaggacaagttgtcggctgagtggaagcccatgaagctctcttggggcgccatctggaggatggacactgccaaggcgctcaagggccccttctctatccgcctcaccagcgagtccggcaagaaggtcatcgctaaagacatcatcccggcgaa

SEQ ID NO: 61938 - DNA, 232 bp, Zea mays
  Clone ID: LIB3075-003-Q1-K1-F7
ccaattgcctcttattacattattacaatagagtgcacgcatctagatgaaataataagacaggtggattgatcaaaatcagaagccgcttatggctattctcgtcaagttttcgagtgtgtggatgtccacgtagctctcttggactgggatctgaatgatagacacttccttggtggtggatgcgccattgtctatcagggtacctagttagtgcctctcgttggttatg

SEQ ID NO: 61939 - DNA, 285 bp, Zea mays
  Clone ID: LIB3075-003-Q1-K1-F9
cccacgcgtccgatcacgcgtacgcatgaatctatccttgcacccatcatcttcgtgactctaggacatcgcaccagacgaactaagcatgtcactcgccacagctgctggtctcttctacatcctcgatgtcgatgcgctaagcgcggccgaggcaccggcagagataccgaaggcacgcactcctgacaaggcaccggacgagtcactgaaggcaggcaatcctgcagctgctggcaaggcacccgagtctgctgccactagaactgcccccgctaaggcacc

SEQ ID NO: 61940 - DNA, 304 bp, Zea mays
  Clone ID: LIB3075-003-Q1-K1-G1
cgccgtcctctcctcgccggtacttcactgagggcgaagaaaaaagtggcagtatattctgccactgacccaagagccaagatcatggcgtcatcttcctgcgtccgcctccatcacctgccgtccacctttcgccggtcgtccgcccctggcgccccaaccaacctccagttccgcgcggcgagctgccggtggcggcggcgggttctcgttcccggcgcggcatctcctcccctacgcctctgcgccacgggttccccgcagccgcctcttggcagtgacagcaacgctccgttgtcccgcg

SEQ ID NO: 61941 - DNA, 323 bp, Zea mays
  Clone ID: LIB3075-003-Q1-K1-G10
cggacgcgtggggttgagggagaagaagcaggggaggggaagcgatgagcaacatgctgcggggtcgccgccgcctggacctcctgcaggtggtgctcttcgccgctgtgctcctcgtcgtcgtcgccgacgccggcgtgacgagccagtaccggcggaagctggaggcgacggtggagatgccactggacgccgacgtcttccgcgtcccgccggggtacaatgccccgcagcaggtgcacatcacgctgggtgaccaggagggcacggcgatgatcgtgtcgtgggtgacggccaatgagctgggcagcagcaccgtcatg

SEQ ID NO: 61942 - DNA, 325 bp, Zea mays
  unsure at all n locations
  Clone ID: LIB3075-003-Q1-K1-G11
ggacgacgtcgtcaacttcagcctcgacttcgagaagctgcagcgcgtcacgctcgacctcatgaccgaggcgtccggcaccatgtccgcaggcatcgccctgccaccctccaacgccggagcgccctcctacggcgcggcggcgccttccgggggctccgccgatgcccccgccggcgcctccgagggccctgcgagcgccagcggcccgtctggtgacgacgcgccggcgtccggtgctggtgccagcgcgtcggctgctgaagctcttccgggntnggcctatccggcccctctagcgcaccaacgccatcgtcgtcgtctg

SEQ ID NO: 61943 - DNA, 280 bp, Zea mays
  unsure at all n locations
  Clone ID: LIB3075-003-Q1-K1-G12
cacaggtgagcgcgacgatgggatccctcgctaataacatcatggtcgtgggcgccgtccttgcggcgctcgtcgccggcgggtcgtgcgggcccccgaaggtgccacccggccccaacatcaccaccaactacaacggcaagtggctcaccgctagggccacctggtacggtcagcccaacggtgccggcgctcctgacaacggcggtgcgtgcgggatcaagaacgtgaacctgccaccctacagcggcatgacggcgtgcggcaacgtncncatctt

SEQ ID NO: 61944 - DNA, 395 bp, Zea mays
  Clone ID: LIB3075-003-Q1-K1-G2
cccacgcgtccgattgcaagtgggtcgacgaggtcataccggacgctccatgggtgatcaaggaggggttcatcgacaagcacgacatcgactacgtcgctcacgacgcgctcccatacgctgacacgagtggagctgccaatgatgtctatgaatttgtgaaagccatcgggaagttcaaggagacgaagcgcaccgagggcatctcgacgtcggacatcatcatgaggatcttgaaggactacaaccagtacatcatgcggaacctcacccgcgggtacagccgcaaagatctcggcgtcagctacgtcaaggagaagcagctgagagtcaacatggtgatcagcaagctacgggagaaggtgaaggagcaccaggagaagatccacagcgcg

SEQ ID NO: 61945 - DNA, 341 bp, Zea mays
  Clone ID: LIB3075-003-Q1-K1-G3
cgtactgctaccccggctcgtcctcctctcttctccatcgccgttggttctctcacgccacacggtcgtccgatccctgtccaccgcgttgggagcgccgcagcccatggacgacaacgagagagagaaagagaatgagaatgagaaggagaagcactacgggactgacgtcgaggatgaagaagaggacgaggaaggtaacaagcgagtcgtggtgcttggcccccaggtccccctcaaggagcagctcgagctcgacaaggatgatgagagcctgaggaggtggaaggagcaactccttgggcaggtcgacacagagcagctgggagaaactgcggaac

SEQ ID NO: 61946 - DNA, 407 bp, Zea mays
  Clone ID: LIB3075-003-Q1-K1-G4
atttcaagttgggattaaaaaaatccttgtctgtcccatgacaaagcataggtctaatacccggctgtgatcgcggttgttctgatatgtgctactatgccactgtgtatggatggaccaggggtttgggggttttctcgacctgcatgagaagctcttaatataatgctcagggctatcttaccccccgcatgtccagttttttatatgtttcatgcggtctaaatttagtgttatgttagttctcttattttcaaggtggtactccccctgttccaaaataagagtcattctcgcttcttgagaagtaaagttaatataaaacataattagtaacactaggtaaatattcgaatgtattttcataataaagttatttggggatttaaatgtggataatattttct

SEQ ID NO: 61947 - DNA, 344 bp, Zea mays
  Clone ID: LIB3075-003-Q1-K1-G5
cacacacgtacaaaccgagagcacacaccgttccccgcccgcccgccgccgcgacacgcgcgcgatggccatgctggctcgctccgccgcgcacctcttcttcttccttctcctcgtctccaccgcgcccgccgtgcggaccatccccgacgaagcccgcggccccggaaacaacatccacgaggcgtgcagcaagacgctgttccccaaggtgtgcctgcacgcgctcaaggacaaccccgagtgccaggcgggggcggtcacgccgcgccggctggccgagctgctcgtgtacgtgtcgggcgatgtgggcatgaccgtggccgcgttcgcgcaccacgagc

SEQ ID NO: 61948 - DNA, 377 bp, Zea mays
  Clone ID: LIB3075-003-Q1-K1-G6
cgttcgctaattagttgcatcaacactgagcaggtgacatcatgcaagctgtggcatcaagtgggagagtcattcaaacctccaaagacatgcacaaccgtttcatggactttctataacttctatgagaagagagagcaagattgataaaaagacttgccaaaatcaaagaggagcagggacagattgatgaggctgttggtttgatgtaagaagttgtaagtttgcaccatactgaatttggaccagcgtaccggatttgtcaaggctacgctttgattgaatacgagaagtttgaagaagttcaggctgcaataaaagatctggatggagctgacctttataaacaaataatgagtgttgattgggcatttagc

SEQ ID NO: 61949 - DNA, 295 bp, Zea mays
  Clone ID: LIB3075-003-Q1-K1-F11
gctcatttgtgtgatgaacccaaaggtctaaaatctgggatgttcatgtctctggtgtttcttggttttccaattgcaaatgctctcattgcaaagatcaacgatgggagtcctttagttgatgagcttgttctgctgctgctttattgtgcatatacagtgggtctctacctgcacctcgctgtgtcggttgtgcatgaaatcaaagatgcccttggaatctattgcttcaggataactagaaaggaggcttgaactttgtagtgaagatatattattattacttcacaagtgc

SEQ ID NO: 61950 - DNA, 203 bp, Zea mays
  Clone ID: LIB3075-003-Q1-K1-G7
cggacgcgtgggcgcgtcgtcgtcgtccctcttgaaacaaaagaagctattttgacaccggacgcacacacacagaggagagaagataagaaaaccaggggcaaggcatccagcgccgctagcttaagcaaggcaaggcaagagaatccgtacgtttaggtgcaagtcgtaggtaagatggacgcggaccaacagggcgtggt

SEQ ID NO: 61951 - DNA, 403 bp, Zea mays
  Clone ID: LIB3075-003-Q1-K1-G9
tcgccaagctgaacaacagccagctcgcgaaaataatgaagagccgcagcatggcatcatcggccgggctcttgttgctagccctcgcgctagtgtcggacaccgccccacatgtagcggacgcaaagaagaagagagcggccgacagcgtctagacctctgaagctaatactaacaggtatactacagctcgatgtgcagctggtatatacgtcatgcgtgctaaaatgagcgttatgttattcatcttattctcaaggtggtactccacctgttacagaattagaatgattctcgcttcttgagaagtcaaagttaatataaaacataattagttacactaggtgaatattcgaatgtattttcataattaagttatttggagatataaatgttgataata

SEQ ID NO: 61952 - DNA, 226 bp, Zea mays
  Clone ID: LIB3075-035-Q1-K1-G6
gacatgatacatgcatgcatcccattgtatgtgctcaagaacataccatagcagttgtggttctggcagtgtcctggaatatatatttatgccgttcaccagactggttgaccatggctacagcctacaactttatagatcgattgtgcttcaatcagggatgttattttgttttgtatctgagacgttttaaaggtgcatgtggtcttatggtctgttgtaccct

SEQ ID NO: 61953 - DNA, 331 bp, Zea mays
  Clone ID: LIB3075-035-Q1-K1-G7
gcagtgatctactccaccaccaccaccaagctcaacaacagccagctcgcgaaaataatgaatagccgcagcatggcatcatcggccgtgctcttggtgctagccctcgagctagtggcggccaccgacccacaggtagcggaggcaaagaagaagagagcggcagagagcggcgaggcggcggatgcgaagaagatccatgacgacttctgctcgacgctgtgcgaggtcatgaaggggacggacctggtcgcgtgcaaggagtcctgtgctctgtgcaacaggccaacctggtgctgtacggcaggatccagtgcaagggcaagtgcac

SEQ ID NO: 61954 - DNA, 331 bp, Zea mays
  Clone ID: LIB3075-035-Q1-K1-G9
tcgcggacgcgtgggcgcagcaagtacaaggttcgttatgccggcaagatcggcatcctggtggacttggtgtggtacgagccggtgaccaagtccgtggaggactagtacgcggtgcaccgggctcggatgttcacccttggctggttcctgcaccccatcacctacggccactacccgtagacgatgcataagatcgtcatggggaggctgaccaacttcaccttcgagcagtctgccatggtcaaaggctcagcggactacgttggcatcaaccactacaccacgtactacgccagcaacttcgtcaacgccacagagaccaactacc

SEQ ID NO: 61955 - DNA, 279 bp, Zea mays
  Clone ID: LIB3075-035-Q1-K1-H1
gggtttttgattttagccgccgccgctgctcatcttacatccctcgagaagacgcctgctcctcgcggatcgatacgatggccgtcttgtgcgacctccacaccgtcgacggcctcaagtccctcgaggctcacctcgccggcaaaacctatgtgtctggtgactccattactaaggatgacattaaggtcttcgccgcggtgccgtcgaagcctggcgctgagttttctaatgccggccgctggtacgagaccggctctggtgctgtagcctcaagat

SEQ ID NO: 61956 - DNA, 346 bp, Zea mays
  Clone ID: LIB3075-035-Q1-K1-H11
tgtggaactacaaagcttccgctcgctattccgaggatccttgaacttgctgaagaggtcctgttgccactcgctgaaatgaaatactgccgtgcaacgttcatattccctgaagcacacccttccccacacaagaacttcgctgacgaggttgtcttcctgaatcacttcttcggtggcctcaagtccggtggcaatgctcatgtgattggtgactatgcgaagcccgggcagaagtggcacgtctactacgccgctgagcaccctgaggagcctgtcgttactctggagatgtgcatgactgggcttgacaagaagaaagcttctgtcttcttcaagaacactg

SEQ ID NO: 61957 - DNA, 316 bp, Zea mays
  Clone ID: LIB3075-035-Q1-K1-H12
gacgttcaacgacggtggggacacgccgctgcaggtgtgcgcccgccatctacgacgaggccatggttcttcaatagatccgtcgtcgtgggctactacaagaaccgcgtcaaggtagagtatcccgcttgttgctttatgctaccgctgcatgcagtctaggtgttcagtgaaatgtcaatgcaattttgctattgttttgcgattgattgctatgtgctagcgtctgttgtatggtggtgagttacgaggccattgagttccttctgtcgcggaagggtacagtcaaagttttgtgattgactgctatgtgcta

SEQ ID NO: 61958 - DNA, 305 bp, Zea mays
  Clone ID: LIB3075-035-Q1-K1-H3
gcttaattgcgccactggtcggtatcctcctcttgcattgcattgcaggtcgtagttgagcagcagggaccactgcacaggatgtcgtgggagacgtacgtcgatgagcacctcatgtgcgagatcgagggccaccacctgagctctggcggcatagtcggccacgacggcgccgtttgggcccagagcaccgcattcccacagttcaagccagaggagatgaccaacatcattaaggacttcgacgagcctgggtttctggccccgatcgggctcttccttgggcccaccaagtacatgggcat

SEQ ID NO: 61959 - DNA, 323 bp, Zea mays
  Clone ID: LIB3075-035-Q1-K1-H4
tgtggaactacaaagcttctgctcgctattccgaggatccttgaacttgctgaagagctcctgttgccactcgctgccattaaatactggcgtggaacgttcatattccctgaagcacagcctttcccacacaagaacttcgctgacgaggttgccttcctgaatcgcttcttcggtggcctcaagtgcggtggcaatgctcatgtgattggtgactctgcgaagccctggcagaagtggcacgtctactacgccgcttagcaccctgaggagcctgtctttactctggagatgtgcatgacttggcttgacaagaagaaagc

SEQ ID NO: 61960 - DNA, 180 bp, Zea mays
  Clone ID: LIB3075-035-Q1-K1-H5
tcggcggacgcttccgccgttcccctgcattccaggccagccacgacccccgtggcttctacgctgcccgccagcgccagctgagtgctacatcgcagtgtcagggctgatgccgtgcgcggacttactcacccacattgggctgtcaccggtaccactcacgagcgcctgctgtgacgg

SEQ ID NO: 61961 - DNA, 212 bp, Zea mays
  Clone ID: LIB3075-035-Q1-K1-H6
acgaccacgcgtccgggagctgttcaacatttttctgaaatttttgagaaaacaaatgctggtgctgcccttgctgctggcatttttcaccggaaagaggttcctatactagcagtgaaagagcatctggtcaatgctggtgtggaggtcagggtgttacatggagatccttcggtttattgaaatattcatgtttgatggcacaactgcta

SEQ ID NO: 61962 - DNA, 319 bp, Zea mays
  Clone ID: LIB3075-035-Q1-K1-H7
ggcgatgacttcttctttgagctcaaggagggcccggtcggcacctggacgcttgacacagaggccccactcaagtgcccggtgtgcatccgctttgccgttaagtctggcggctaccgcatcgccgatgatgttatccctgaaaatattaaggccgacaccacctacaagaccaccctcaacatctgatcatcctcttatgaggaataatattgtgaaagagctcatctgatccatgtgccagcgagctaatatttaatttttgagctatggttattctatggcaccacaccatccaagaaataaagtatgttacatg

SEQ ID NO: 61963 - DNA, 211 bp, Zea mays
  Clone ID: LIB3075-035-Q1-K1-H9
cgagcgcggaacccgacccatcaacgatcgcctgattggcgtggatcgatctgcccagatcgacgcggacatcacccctggggttctgggactccacaactctaatgcgtccgatgcacgtaccgtaggcgacaccgggcatgacgcacgcaggatgacacagttgaccaagatctgcgtggacagccttgacggaccaccagaaagacct

SEQ ID NO: 61964 - DNA, 368 bp, Zea mays
  Clone ID: LIB3075-040-Q1-K1-A10
gacatgcctgtctactgtggacagcttggacagaccgacgtgaataggctaacgctggacagtacaatggatccctctgtcaagaaccatgtcaaggagttcgagaagaacttatgctgttaagcacccatcttgctcaatcgccggaaatcaccatatcgaccagatcacaacaattcttgacgtgcaaggagtggggacgaaccaattcagttaaccttcaagggagctcattggcatgcttcagaagattgatggcgacaattatccaaagaccctgtgccgcatgtacatcattaatacaggccacggtttccggcttctattgggcacccttaagagcttttttgacccaaagaccactgcat

SEQ ID NO: 61965 - DNA, 289 bp, Zea mays
  Clone ID: LIB3075-040-Q1-K1-A11
atcgatcacgacaagatggcgtgcacagacaatgcgatgagagccttgttcctcctggtccggttttgcatcgtgcatggtgagaatgaataatcatagggcatcgttgcgaaagcgttcgggcctgggggtgtcttttacattaccaattttgggcgccttcggcaatggcatgacatgacagcacgaaagctgtgcatgatgcattggcatttgcgttcggcggctctgggtagcatacaattcttataccctatggcgactttcttgtcgtacaactcaactttac

SEQ ID NO: 61966 - DNA, 394 bp, Zea mays
  Clone ID: LIB3075-040-Q1-K1-A12
tcgagacaccatggcatacccgatgaaggccctgagggactgatgatggaagtggttggttcctggtgcaatggtgcagatactcattgataatcaaggaatggaggagggcaatgacgagggcccatgataggcggtcattgaataaccacttggttctcttggctcaatgtcgcgtctgtcgcatctattcatgtataatccataaatggaggatggcaatgacgaggacttatgagaggaggcggtcattgaagaaccagttggttctcttggcgcaatggcgcctctattcatgtatgatcaagaaatggaggacatcgaggaggatcaggcacacttgatgcagattgcaccagctgcagcgaagcctttgttttgtgttgctggggcg

SEQ ID NO: 61967 - DNA, 277 bp, Zea mays
  Clone ID: LIB3075-040-Q1-K1-A3
cagatctcagagggttggtgtcaggtggcgtcgccggccggccgtcgtggaacagggaaccgcgtgtggaggacgaggattccctctgtagcactgcactgcactgcactgcaagttgttgtacacaagtgcatgtgtatgtgtagtagtccggcctccgggcgggaggcgccgaccccatccgatggcgacgattgggcatgctatatggatgatcgattagcccacactgcacgtgaatgaaggagagctgtggccaacgattagcccaccacac

SEQ ID NO: 61968 - DNA, 420 bp, Zea mays
  Clone ID: LIB3075-040-Q1-K1-A4
tcggattttgggctctccgtgttctacaagcctggtgataaatttgctgaccgttgtgggagcccgtattatgttgcccctgaggtgcttcaaaaatgttatggcccagaagctgatgtatggagtgctggagtgattttgtacattttgctatgtggtgtacccccattctgggcagagagtgaagcagggatattcaggcagattttgcgaggaaaacttgatttggaatctgaaccatggccaagtatctctgatagtgctaaggatctagtccgtaagaagctaatccgggatcctaggaagagattgactgctcatgagggtctttgccatccatggtttggggttgatgctggtgcccctataaaccctttggttctggcgggttgttaagggtgaaaaacttttttgaatgaa

SEQ ID NO: 61969 - DNA, 151 bp, Zea mays
  Clone ID: LIB3075-040-Q1-K1-A9
cagatctcatagggttggtgtcaggtggcgtctccttccggccgtcgtggaacagggaaccgggtgtggagtgacttggattccctctgtagcactgcactgcactgcactgcaagttgttgtacacaagtgcatgtgtatgtgtagaact

SEQ ID NO: 61970 - DNA, 367 bp, Zea mays
  Clone ID: LIB3075-040-Q1-K1-B1
tgagcatctaaagagaccagagaactgggcactagttgaaaaggcaaaatacatctacattgctggatttttccttacagtgtcgcctgattctatccagctagtcgctgagcatgctgcagcaaataacaaggtgttcctgatgaacctctctgctcccttcatttgtgagttcttccgtgatgcccaagagaaggtcctcccgtatgctgactacatcttcggcaacgaaactgaggcaaagatctttgccaaagtcagaggatgggagactgagaatattgaggagattgctttgaagatctctcaacttcctttggcttcaggcaagcaaaagaggattgctgtgattactcaaagtgctgat

SEQ ID NO: 61971 - DNA, 269 bp, Zea mays
  Clone ID: LIB3075-035-Q1-K1-G4
gctgaccgccgcaatgggcgcctccgagagctgcgaggacgcgtggaagggcgaggaggaggatgtccccgtcgccgcgcacgacagggagtacgggcggatggcgcacatcgccttcggattcacacaccacgccgtcgtcgccgccggcggcgcatgaatcgatgaattattatatatatatatgcatgctatctactatgatcgagcgcttctcgaccttcttgcatcgatctgcatgcatattataatttatattatattgatgc

SEQ ID NO: 61972 - DNA, 374 bp, Zea mays
  Clone ID: LIB3075-040-Q1-K1-B2
tcgcccacgcgtccgctcacggatcgcactttcttcatgcgcagcgactgccgctagttgcggcccgtgagggcacaacgagcaccgtcggcttcgagcttggcgtgtgggcagaaaagcaacgccaccgctgacacttctatatgcgctgcttcttcaggaagccatgggtgatcgccgtgctttagtctctgcatctgatggcatgcgggcccgtcgagcgccgctacgagggtgagcaggcgtgccattgacactctgcgggcgagcctccactggcgggcgaactggctgccgccgctgcaccgatctggcgagtggaagggagtgctaacgggagcagggccacatatttgggttctttaaggaaactg

SEQ ID NO: 61973 - DNA, 426 bp, Zea mays
  Clone ID: LIB3075-035-Q1-K1-E2
ggaaaccagagctcctgactgttcctctctccctcctcacgggcgggctccgtctgttccgtccatgcaccgccccggtcgtctcccgggcagatccctctcctgcaaggtttctttgcgagtggccggagaagatgatgggcgggttcctctccagggttctcctgctggcttttggctatgcctatcctgcctatgaatgctacaagaccgttgaactgaacaaaccacagattgagcagctcatattttggggtcagtattggattttagttgccctgttgacagttttggagagatttggagaatttacaatatcatggctaccgttttactcagaagcaaaggttgttgtctttgtatatttggggtaccctaagacaaagggaactacgtatgtttatggaactttctttaagccatata

SEQ ID NO: 61974 - DNA, 90 bp, Zea mays
  Clone ID: LIB3075-035-Q1-K1-E3
ggccaatgatgattgcaaatctctttctagtgcatctcacatgtacattatatactactattccacacgggtacatgacacagtttcaca

SEQ ID NO: 61975 - DNA, 386 bp, Zea mays
  Clone ID: LIB3075-035-Q1-K1-E4
cgatcccaaccctgtgcccgccaagtacgtggccaagatgaaccagatccgcggctacgccggcaacggtggcctcaagctcggcgtcggcctcgagagccacttcagcacacccaacatcccgtacatgaggagctcgctggacacgctcgccaagctgaagctgcccatgtggctcaccgaggtggatgtcgtcaagagccccaaccaggtcaagtacctggagcaggtgctcagggaaggcttcgcccaccccaacgtcgacggcatcgtcatgtgggcagcgtggcatgccaggggctgctacgtcatgtgcctcacggacaacagctttaagaacctccccgtgggcgacctcgtcgacaagctcattgccgagtggaaga

SEQ ID NO: 61976 - DNA, 152 bp, Zea mays
  Clone ID: LIB3075-035-Q1-K1-E5
gggacatcagcaagctgaacatggccgtcgccatgtacatggctcaaggtcctagactgtggcctcctatcaccgaattcttgggtatggcaagctccatcagcccatgcacgaatgtgttctgagggcttccattgactaacgggacaccc

SEQ ID NO: 61977 - DNA, 184 bp, Zea mays
  Clone ID: LIB3075-035-Q1-K1-E7
attttatgggataataattaactagtttgtttacttctagatatatgtaatactacttaaataatccgtatttctttaatttcttagctgtatagctagaaacatgtttttagttgccaaccactttagtaatatatgtttcttctcctttattataaacctcaatacttgttgtgagcttctc

SEQ ID NO: 61978 - DNA, 227 bp, Zea mays
  Clone ID: LIB3075-035-Q1-K1-E8
ggagttggtgcctgctgatgcaatggcgatgactatggatcatgagccgccgcaggagtgcgcgaccccggtgagcgtggaggatgcgtgccgcggcacgttagagacgcacgccggcatggcctactaccactgcatggcgtcgctggtcaccgacccgcgcagcaaggacgccggcaacaagaacatgcacgcgctggcggtgctggccaccaggatggccattg

SEQ ID NO: 61979 - DNA, 435 bp, Zea mays
  Clone ID: LIB3075-035-Q1-K1-E9
agcgaaagcttgcattgtaacctgtggaggcctttgccctgggctcaatactgtcatcagagagttggtttgtggcttgtcccacatgtacaacgttagcaatgtcttcggaatacagaatgggtacaaggggttctattcgagcaattatcttcccatgacaccaaagagtgtgaatgatatccacaaacgaggtggtacagttcttggaacatcacgaggtggccatgataccaaaaagatcgttgacaacattcaagatcgtggaattaatcacgtattcattataggaggagatggaactcataagggtgcatatgagatttacaaggaaattcggaaacctggtctacaagtagctgttgctggtattcccaagactattgataatgatatagctgttatagacaagtcatttggttttgatactggtgt

SEQ ID NO: 61980 - DNA, 295 bp, Zea mays
  Clone ID: LIB3075-035-Q1-K1-F10
tcgggcatcttctccatcaccaccaaacttaacaacagccagctcgcgaaaataatgaagaggcgcagcatggcatcatcggccgggctcttggtgctagccctcgcgctagtggcggtcaccgacccacaggtagcggaggcaaagaagaagagagcggcggatagcggcgaggcggcggaggcgaagaagatccaagacgacttctgctcgacactgtgcgagggcaagaaggcgacggacctggtcctgtgcaaagagtcctgcgcgctcttccagcagatcaacctggtgc

SEQ ID NO: 61981 - DNA, 238 bp, Zea mays
  Clone ID: LIB3075-035-Q1-K1-F11
tacaagaactagagcatcccgtgcgagagaacgcgttttccgcgcctgtgggacacgtgggtcctgtgggataagagcgcgggcagtctatggctggttaggcagacgcctgactcgcagcccttcatattcacgtctcgcggcgctgtgcgagcagtcgtcccagacgttatctgatacctcgtgatgcatttcaccgtgtccagctacgagcagttcgaggcccaccttcgctcca

SEQ ID NO: 61982 - DNA, 348 bp, Zea mays
  Clone ID: LIB3075-035-Q1-K1-F12
cgatcacaataagatggcgtgtatagacaatgcaatgagagccttgttccttttagcgctcttctgtgtcgtgcatggtgagaaggcaaagtcaaaggacaacgatgcaaaagcgtccgggcccggtgggtccttcgacatcaccaagttgggcgcctacggcaatggcaagacggatagcacgaaggctgtgcaggaggcgtgggcatcagcgtgcggcggcaccgggaagcagacgatcctcatccccaagggcgacttcctcgtcggaccactcaacttcacaggcccatgcaagggcgacgtgaccatccacgtgaatggcaatctgctggcgaccacggacct

SEQ ID NO: 61983 - DNA, 325 bp, Zea mays
  Clone ID: LIB3075-035-Q1-K1-F2
cgaaacaccgcaaccctccctcgatctagccgccatggccgcgcgcgtccccggttccctcttggctgtcctcctgctcatcctcgcgaccgcgtcccccaccggcgccctccgcttcgacctgcgttcgggccacaccaagtgcatctccgacgacatcaaggtgggcgccatggccgtcgggaagtaccaagtcatggcccccgacggcgtcgcctcttcgtcgtcgtcacagcagcttccggactctcaccgcatctcgctgcgggtcacctcggccctacgcaacagtctgcactacgcggagaacctgcactcgggcaac

SEQ ID NO: 61984 - DNA, 278 bp, Zea mays
  Clone ID: LIB3075-035-Q1-K1-F3
cggacgcgtgggcggacgcgtgggcggacgcgtgggcggacgcgtgggctaccctcgtcgtcgtctgactcaccccgccttcacgcctccctcaccaaataaggtcccgcccttttccgacattcacaggggggacaggaaatcagcggccatggcctcgattccggcgacgaccttcgccgtcatcttatccgtcctcttctgtgccgcggctggcaccggcgtcgacaacgacctccccgactacgtcatccagggccgcgtctactgcgacacct

SEQ ID NO: 61985 - DNA, 301 bp, Zea mays
  Clone ID: LIB3075-035-Q1-K1-F5
cccacgcgtccgggaatatctacaacgagaaaggcaagggtctgctcgtctagagaattttgcttctgcactcgaactgattggacaaaagctccaaatggatacactgcaaagtcgacttgatgcagagttccttctagctcatatgtgttcagtcaagtttaatgaatggatcgtggtgctagctactttattgcggcgtgcagaggttatggtggatctctttaggcatgatttgcgattgtggaaagcatatagcatttactctacagtcacatgatgtattcacagaatatcttga

SEQ ID NO: 61986 - DNA, 444 bp, Zea mays
  Clone ID: LIB3075-035-Q1-K1-F6
gcgagggccgcccttttttttttttttttttgtcacaactttactatataataggagttctatacagaatatataaataattgcattataaggagacaacggtccagcaacccaaagttgactgggagacgacggcctagaccactcacgaactcatcacagcatccttcatgcgcctcatcctgtggtacctgctcttgacctgggacttgagattccaggtaccaacttgctctttggatgacacgtgaccttaccgcatagtttgaagttgctaaatcgcttgccatgcagtgcagatggaatgcgttcactctcaaatttcgggtagaaattgcccatgtgtgagaccatcgcgtgactcgtaatccatgcacggcggctatgaatatggaggcacacgttcgctggttttctctagagcgaccgaaacggcaacggggc

SEQ ID NO: 61987 - DNA, 436 bp, Zea mays
  Clone ID: LIB3075-035-Q1-K1-F7
ctctctctctctttcatttctatagccagcaggtatcaggcaggcaaccggccggtatattagtagatcttcgatcgttcatgcaagctaataagtcagtaagcagcagtaggtcgaaaatggcgatgaggtcgctagcgctactggacctcctcagcctgctggttgttggtgtggcgcatgcggtggagttggagatggagttggtgcctgctgatgcaattgcgatgactatggatcatgagccgtcgcaggagtgcgcgaccccggtgagcgtggaggatgcgtgccgcggcgcgtcggagacgcacgccggcgatggcctacgaccacttgcatggcgtctgtgggctgccgacccgtgcagtaaggatgccggcaacaagaacatgcacgcgctggccgtgctggccaccatgatggccattgaccacgc

SEQ ID NO: 61988 - DNA, 339 bp, Zea mays
  Clone ID: LIB3075-035-Q1-K1-F8
cagctacgccaccaaaatcatcatctgatccaccgtcgacaccagcagctacaccaccggcgactccatccccatcatcttaatcacgaaggatatttcaaaagcagtagtagtttagtcaaattagatatgcgttttaggattctagttgatatgcgtccattattttgttcacatcgaatgcagcagtgtgttagctatgtagttgcatacctatcataactaagtctattagaagtatttctaataatatttatgatctgtcatcaataaaatgtatgcaacaatacgactataaaaaaaaaaactaataaaatattaaatgagaaataataaaaa

SEQ ID NO: 61989 - DNA, 370 bp, Zea mays
  Clone ID: LIB3075-035-Q1-K1-G1
aatcaacatatgcaagttgcagactgagtatgcaagattaggcaatcgacctccacacatcagttttggtctagcattagttctgatcgtggtgctttccttgagggttttgaattgcttggttcaagaaaagcaaaaaatatatttctcctttctacttcaacatctagcgatgtatctgcatgtaagctcttcgttggtatcgaggctacatccagatacatcactagatgttgaattataaaggagaaatatatttttggtagtttcgtcaatcctaaagaagatggtaagaattgcaatgcaaatgcaggatccacagataaagaacgtgttcaattgcttcatttgaatttattaacttttgggc

SEQ ID NO: 61990 - DNA, 270 bp, Zea mays
  Clone ID: LIB3075-035-Q1-K1-G11
gctgaccgccgcaatgggcgcctccgagagctgcgaggacgcgtggaagggcgaggaggatgatgtccccgtcgccgcgcacgacagggagtacggtcggatggcgcacatcgccttcggattcacacaccacgccgccgtcgccgccgccgccgcatgaatcgattaattattatatatatatatgcatgctatctactatgatcgatcgcttctcgaccttcttgcatcgatctgcatgcatattataatttatattatattgatgcc

SEQ ID NO: 61991 - DNA, 351 bp, Zea mays
  Clone ID: LIB3075-035-Q1-K1-G12
cggacgcgtgggcggacgcgtgggggcgcacacggatggtgttccacaccagtgcccatgggacacaggcctagccaagcagcgctaccgtatatctacatgcgaccgtgggacagcgtcagccggaggccggagcagctcgatcgggtagttgccgcgcgaccgtcagagacctctgtttctttgggttgggttcggtgtttctctttctatttatgttttactaattagttgtccgtgtgttgcgacggtacataaacaccattgataaagcattagtagtaattaattttagatcacttcatgagatgcgctctgccgacatgaggaaaaactcattcattttttatt

SEQ ID NO: 61992 - DNA, 111 bp, Zea mays
  Clone ID: LIB3075-035-Q1-K1-G2
tcggagaggagaaccagcagcctccaataagagccagctcagtgaaacttataaaactctagtcgtcgccatccgagcgaacaagccaaccgactcccgttctcaaggcaa

SEQ ID NO: 61993 - DNA, 331 bp, Zea mays
  Clone ID: LIB3075-035-Q1-K1-E12
caaaccgacgatggcgtcgaataagacggtcctcatcgtcgcggcgatgcttctcatggcgctcgtgctggaggccgtcccggcggcgaccgccatggactgcaaggccgggtgtgacgaggtcacgggcccactccacatgagcatggaggactgcatgaagaggtgcaaggagatcgctgctaagcaggggcctagggacccttacaaggataacaaacttgacataccatgaactaattaatgctgctatatcatctgcctatccatgcatgcattgcattgcgtatgcacactgagcgtgcctgaccacagagtttcgtcaacacac

SEQ ID NO: 61994 - DNA, 241 bp, Zea mays
  Clone ID: LIB3075-035-Q1-K1-G3
atgggtttgtatctgttagccatataaggttgcacgttaagcatgcccctgacttgccggacgagcagcaagacttcgggacctagattggctaaggcactaagaatagaatagcttatctaccgatatgtaaagtcttatttccacctttcgaattcttttcctcggtagctaagcttatttagttgcctaatggtcgatgttatcttttttattgtgtgattcattccactttcatggt

SEQ ID NO: 61995 - DNA, 480 bp, Zea mays
  Clone ID: LIB3075-035-Q1-K1-C6
ctgacattcgacaacgcgggcatgtggagcgtccggtccaacgtctgggagcggtactacctcggggagcagttctacatcagcgtcatcgtgcctgcgcggtcgctgcgcgacgagtacaacatgcccgacaacgcccttcgctgcggcaaggtcgtggggctgccgatgacggcatcctacgcccgcgcgcgctaaagacgacgaatgcgccgttttcacctcgacgttctgaccatccagtctaactaatccattcctgagctgctcggcgaaatataatcatcaaatagaacaaagacgaatgaagcctagggaagggagaaggcacgttgggtgtgggtgagccaaatgagaacccacggatatatctattgacgtaatcttggagatgccctctcaattaactgtaatggggttaaaaaacaatccttgtaatgggagggatatatacttttatcttaacctttatttacacca

SEQ ID NO: 61996 - DNA, 350 bp, Zea mays
  Clone ID: LIB3075-035-Q1-K1-C7
gtacgtctagttcagaagggcgcgatgcacgtaccctgccgggcagaagatcgtgtcggacatcgagaacggctgcaaccccaactacctggccgtgctggtgaagtatgtggcggacgacggcgacatcgtgctgatggaaattcaggacaagttgtcggctgagtggaagcccatgaagctctcttggggcgccatctggaggatggacactgccaaggcgctcaagggccccttctccatccgcctaaccagcgagtccggcaagaaggtcatcgtcaaagacgtcatccacgcgaactggagacccgaagccgtctacactttcaacgttcaattctactagactt

SEQ ID NO: 61997 - DNA, 369 bp, Zea mays
  Clone ID: LIB3075-035-Q1-K1-C8
ccgttcgcgttgctctccagcataccgtcactgtcgcagacggcctcgcactcgcactcgccactggtcaaccagaactaccggcttctgaaccagatgcaggtgttccaccacctcggcggcagtcagcagccgtcgttccaccaggacggcagcgcggcggctttcggtgacatcgtctcctctcgcctgccgtcactgccaaccggcagaacgcatgccgagctacattcgaaccaatttgacacctacatcagcggcgggctggtggatcagtcgatgctgatcggtgacgaacacctgctgaggcctaacccgagtatggtcaacgtcttctgcatgcccgcgctttcctaccgtgagccggat

SEQ ID NO: 61998 - DNA, 361 bp, Zea mays
  Clone ID: LIB3075-035-Q1-K1-C9
tccacgcgtccgtccacgcgtccgaatgaatgaatggaagccattgcctctaattcagaaagcttggattggtctgactgctggagcagttggtgcttgtgttggtagtcctgctgacctggcactcattagaatgcaagccgattcgaccctgccagttgcacaacgacgcaactataagaatgctttccatgcactctaccgtatcagtgctgatgagggagtcctcgcgctttggaagggtgcaggtccaactgtggtgagagctatggcactcaatatgggtatgcttgcttcctatgaccagagtgtcgagctatttacggacaaatttggcgcaggagaaatttctactgttgtt

SEQ ID NO: 61999 - DNA, 164 bp, Zea mays
  Clone ID: LIB3075-035-Q1-K1-D1
gacctaatcgcatgtccatcctaatctcaccctattttagtaacaggtctaactaaggctctctattggtctcatggtgaacttgaaactgaactcgattccccttctgaatcaggacccggacatgctctaccatatcctgctggtgcatatcaactatatta

SEQ ID NO: 62000 - DNA, 275 bp, Zea mays
  Clone ID: LIB3075-035-Q1-K1-D10
cttctgctacccctcttaccaagtcctcttcgggttagggttacttagggtttcgaggaggggcgatggcagcggctgatgtggagtaccgttgcttcgtcggcgggcttgcctgggccaccagcaacgagtcgctggagaatgccttcgcctactacggcgagatccttgactccaaggtcatcaccgaccgttagactgggacgtctcgcggctttggcttcgttaccttctactccgagaacttcatgcttgacgctatcgagaacatgaac

SEQ ID NO: 62001 - DNA, 337 bp, Zea mays
  Clone ID: LIB3075-035-Q1-K1-D11
tcgcaccgttagggccacctggtacggtcagcccaacggtgccggcgctcctgacaacgggggtgcgtgcgggatcaagaacgtgaacctgccaccctacagcggcatgacggcgtgcggcaacgtccccatcttcaaggacggcaagggctgcagctcatgctacgaggtgagatgcaaggaaaaacctgaatgctcgggcaattcagtcacggtgtacatcactgacatgaactacgagcctatcgctccctaccacttcgacttgagcggtaaggccttcggctccctggtagagcccgggctcaacgacaagattcgccactgcggcatcatg

SEQ ID NO: 62002 - DNA, 272 bp, Zea mays
  unsure at all n locations
  Clone ID: LIB3075-035-Q1-K1-D2
ctgcctctcaattctcaatgaggatagtggttggagacctgctatcactgttaagcagattctagttggaatacaagacttgcttgatcagcccaatccagctgatcctgcccaaactgatggttatcacctattcatccaggatccaacagaatataagcgacgtgttcgtctgcaggccaagcaatatcctgctctggtctgaggatgttggcataccagagatccatgatccatnctacacatcatagaaagttcaagtttacactgga

SEQ ID NO: 62003 - DNA, 325 bp, Zea mays
  Clone ID: LIB3075-035-Q1-K1-D3
caacaactaagcctccgtgaccgccacatctattaggtgcagccatgggtgcctgtgcaacgaagcctaagacgcttgaggggaaagccccagctgaggccaccatcttcacacccaaggttgcacctgagaccactgccatccacattgaggttgcggcgaaacaggcagtagttgagaaggtggaggaggacaaggaggaggcactaacagtggcggcgaaacatgagccagcagccaccatcgagccttaacagattgctggtgaggtgaccacttcggaagtggctgtcgtcgttgtcgagcctgagaacaaagaggagga

SEQ ID NO: 62004 - DNA, 394 bp, Zea mays
  Clone ID: LIB3075-035-Q1-K1-D4
caccgctagggccacctggtacggtcagcccaacggtgccggcgctcctgacaacggcagtgcgtgcgggatcaagaacgtgaacctggcaccctacagcggcatgacggcgtgcggcaacgtccccatcttcaaggacggcaagggctgcggctcatgctacgaggtgagatgcaaggaaaaacctgagtgctcgggcaatccagtcacggtggacatcactgacatgaactacgagcctatcgcttcctaccacttcgacttgagcggcaaggccttcggctccctggcaaagcccgggctcaacgacaagattcgccactgcggcattatggacgtcgagttcaaaaaggtgcgatgcaagtaccccgtcgggcagaagatcgggttccac

SEQ ID NO: 62005 - DNA, 388 bp, Zea mays
  Clone ID: LIB3075-035-Q1-K1-D5
gttccctaaccttgacgcttctcccttctcggcgcctgcttcgttggttgccttcagcggacgccggcgattcggctctcctgttcggcgccctccccagattgccccacccaccgtcagcctcgtcagggtcctcccaggacaaaccatgctccggagacagatgcggcagagctggggcaggagcagagccatcacagaaattcttgtctccagattcttggtcaaaggaatgttggacacctgctagccaatgtgcagccgcgagagggcttagacagataatatggtcgacggcatggacttctaggagctctgcagcgacttcgaatgcataagcagcccctacgtggagtccattatgaggccatgtcgcgccggacatctt

SEQ ID NO: 62006 - DNA, 360 bp, Zea mays
  Clone ID: LIB3075-035-Q1-K1-D6
tcggcagcggcggcgatgacgacgagcctgaacaagaaccggaagaagcgcgggcacgtgtgggcggcgcacggtcgcatctgcgagcaccggaagcacccggtaggccgagggaacgccggcagcatgcaccaccaccgcatcctcttcgacaagtaccacccgggctacttcggcaaggtgggcatgcgctacttccacaggctccgcaacaagttacactggccgtcggtcaacgtggagaggctctggtcgatggttcccgccggcaaggccgcggaagcggtcggcgcggaccaggccccgctcggcgacttgacgcacatcggctacttcaaggtgcttcggcaggggatgctg

SEQ ID NO: 62007 - DNA, 341 bp, Zea mays
  Clone ID: LIB3075-035-Q1-K1-D7
cacacacatccgtgaaagaaacaagcacatagaaacaaatacatcgctagctcgccaccagacaatggcctcaaggtactctatcctgcttgccacaacgacactggctatgttgttcgcattcagttcgtgcaccaccccactcaccttccaggtcggcaagggctccaagcctggccacctggttctcacccctaacattgtcaccatctctgacgtgtagatcaaggagcatggcggcaaccatttctcctttacactcaaggagggcccagctggcacttggacgctcgacaccaaggccccgctcaagtaccccctctgcatccgctttgctacca

SEQ ID NO: 62008 - DNA, 472 bp, Zea mays
  Clone ID: LIB3075-035-Q1-K1-D8
ctctggttctggtttcctctttttatgctacaggtttggttagctaccatatcactcgctatctacaaggttagttttccgcatcgagaaatattatgtgatattgattgtcgagttcttttttctgtttcaaaaaatttagtacttgtattcatagtaacatttgatgcattaatgtatacattcttattttcatatataggtttttgatcatctcggcatgttaaagaagaagaaatgcatctagctgtaaagaaaaggaaggcaaatatcatcttatgcaattatttgtgtgctgtcggcggcgcgctatggctaccggcaaagaactacctgatccccatggacggagctggaacctaatgcctggcaaacacactgattaacacagtcatgttaatcattgggaacgtgcagcagcagggcacccgtgtcagactgtcagctttgacaccgtcaagggcgccatcgt

SEQ ID NO: 62009 - DNA, 452 bp, Zea mays
  Clone ID: LIB3075-035-Q1-K1-D9
ggcacgccgcagttccccgggaggaccgtcacgctcgagcaccagcccggagcgacttgctggggagttgcttacagaataaaggaggaagataaggagatagctttggagtatcttgaggtcagggagaagcaatatgatgagaaggtttaccttgacttgtatactgattcatcgcccaaagtaccagctgtcgaaaatgtgatggtatacttcgccaccagtaacaaggagaacaatcaaaactatcttggtcctgcacctctggaagaaatgaccaggcaaatttaccttgctcaaggcccatctggacctaacaaagagtatgtgttcaaactcgaggacgcgttacacaaattaggagttgtagaccaacatgttcaagaactggcaaatgctctgcgtgagtattctgacaccgagttatctaagtgaaagatcacatttacccc

SEQ ID NO: 62010 - DNA, 137 bp, Zea mays
  Clone ID: LIB3075-035-Q1-K1-E1
ggcctaaacgcattgcgtgtaccattgcaatcattgccggagtctacttcgtctgaaggctcaagagcttacattgcatcaacgcgagcgtgcaacacttccatggcaacgtcgaagacgcaacgtgtggcgcaaag

SEQ ID NO: 62011 - DNA, 298 bp, Zea mays
  Clone ID: LIB3075-035-Q1-K1-E10
gcgagtgtagcaagctgcacacacattgaaggggacaaccacatgcgcctaagatcccgtcctccgcgtccagatctttggcgaggcggtgaccgtcgagggatcgccatggcgttgagggctttccacgtgtcccatggcaccgcggcagcgcctctgccgcctttcgcgcggaggatgatggcccagttcgtggtggttgtcattgtcgacaacattaacattgtcaaactctgtaaagaaccctataccccttcacgagaggttcattgccaaattacccatgtactaccacctt

SEQ ID NO: 62012 - DNA, 347 bp, Zea mays
  Clone ID: LIB3075-035-Q1-K1-E11
cgatcccaaccctgtgcccgccaagtacgtggccaagatgaaccagatccgcggctacggcctcaacggtggcctcaagctgggcgtcggcctctagagccacttcagcacacccaacatcccgtacatgaggagctcgctggacacgctcgccaagctgaagctgaccatgtggctcaccgaggtggatgtcgtcaagagccccaaccaggtcaagtacctggagcaggtgctcatggaaggcttcagccaccctaacgtcgacagcatcgtcatagtggcagcgtggcatgccacgggctgctacgtcatgtgccttacggacaacatgcttcaagaacctcccc

SEQ ID NO: 62013 - DNA, 444 bp, Zea mays
  Clone ID: LIB3075-035-Q1-K1-C5
cagcaagagggtcaactggccaggctaccacgtcatcggacaggccgacgccacgccattcaccggcggcgccttcatcgacggcgcgtcatggctgcagagcaccggcacgcccaacgtcatgggattcaccaaagggtaatgatcgggggattgcagtatgcatgcgatgatgatacgcgcgcgtgtcttcatgcatgcaacatgcttttgggtttatccggaaactgctagcatttttgtgcgcatatatatagctggaagctcctgtgcacgcatgcacggtgaataggatgacctgtctatatgggtagtacgtggagctaacgcaagtgtgtgtacgtgtttggcacggctccggctacttttaaattgacttcggcttcaacatttttacaggaggaatttttaataaattatttggcaaaacgaataatataaaaa

SEQ ID NO: 62014 - DNA, 441 bp, Zea mays
  unsure at all n locations
  Clone ID: LIB3075-003-Q1-K1-D12
cgaggacccgcagacgagggcgatggtggagaacttcgcccggaacgagccactgtggcagcagaagttttcccaggcgatgcagaaggtcgggatgcttgacgtgctcatcggcgagggcaagggccaggtaaggaagcagtgccgcctggtgaacgggcaggagaaggaggagaagcagcagcagccgcaggaggagcaggaggagcagcagccaccggagctggaggaggaggagcagcagcagccgcatcagccacagcttccatggttcctgcagaggcagcgcccgcccgttcttcttccatggctccggccccatccacggtcgcgtcgaccgttccggaaacatccggtggccgacctggttaacggatttttccgtggttttcactgaaggcgagcactatgctcgggacgtagacctncaaaatatgcaat

SEQ ID NO: 62015 - DNA, 408 bp, Zea mays
  Clone ID: LIB3075-003-Q1-K1-D2
cggacgcgtgggcggacgcgtgggcggacgcgtggggtaaattgcaccgatcgagacacaggggacaaaggcaacagccatggcgggaacccgtgccctgtacctgctcgtcgcggctgtcgcggcgctcttagccacgcctgcggccgtggacgcggccacgctggcggagatctgcaggggaaccgcgttccccgacatctgcaccagcacggtggggagcgaggcgcagagcgccggggtgttggacgccatggcggtgttgcggatgcaggtggacgcgttcaacaagcgcaccgaggcggcgagggcgcacgtcaaggaggccgccgtgacggcgtcccccaaggcgcggacggtgctggacctgtgcaacaacctggaccttgacttggaggacaacctggg

SEQ ID NO: 62016 - DNA, 376 bp, Zea mays
  Clone ID: LIB3075-003-Q1-K1-D3
cttttgaacaacaacagtgggctgctaaagttgctgaatttctgaagaccggtgttgctgtggagcattgcaaggagggcactgagagctctattttctggtcttctattggtggaaagcagagttatacaaatagaaatgctgcacctgatgttgttattagagagcctcatttgtataccttctctctgaggaatgggaagctggaggttactgaaattttcaatttttcacaagatgatctgttgaccgaagacatgatgatacttgatacacactgtgaggtttttgtttggatgggtcagtgtgtggagacaaaagaaaaacagaaagcatttgacattggccagaaatacgtacgaaatgccgtggcctt

SEQ ID NO: 62017 - DNA, 269 bp, Zea mays
  Clone ID: LIB3075-003-Q1-K1-D4
ggatatttaaaatatttgatctttaatatcctacaacttaaatctaaaagtaagtagaatgggggcggcgggcacaagttgcaggtgaggacatcatttcgaaacttgaaaggtgcatgcatcatcttaacatgaagctccactcattttagattaattgttggtgacctgatgctccaacttgaatatgttgaaccaaacaatgtcagaatacatcaatccaaacattcccagtacatcaaggaattgctggtgccacctgcacttat

SEQ ID NO: 62018 - DNA, 101 bp, Zea mays
  Clone ID: LIB3075-003-Q1-K1-D5
aatatcacccacatactacatctatactttccttctacttatatctcaaactactttcaggagggtattttcctaagctacacttctctatcctaattctt

SEQ ID NO: 62019 - DNA, 369 bp, Zea mays
  Clone ID: LIB3075-003-Q1-K1-D6
tgcagcgccgccagacactccgtagtctgtaccccaagcaccggcgcggcggcggcgggtacggatggcagtcgggaagaacaagaggatctccaagggaaagaagggtggtaagaaaaagaccgtcgatcccttctctaagaaggactggtatgacatcaaggccccatcggtcttcagtgtgcgcaacattgggaagactctcgtgtccaggacacagggtaccaggattgcctctgatggtctgaagcacagagtctttgaggtttgtctagctgatcttcagggtgacgaggatcaggcttacaggaaaatcaggctccgtgcttaagatgtgcaaggcaggaatgtgctcacaaacttctgggg

SEQ ID NO: 62020 - DNA, 148 bp, Zea mays
  Clone ID: LIB3075-003-Q1-K1-D7
ggcatggtgcagtaaaatgaaatagagagaaattgcagcaattctttgttatcttagcggcacgttttcttcttccgagagcactatgtacaaggtgacattataaaagattaagatagtgaaggccttattttcgcgaggctaatgt

SEQ ID NO: 62021 - DNA, 425 bp, Zea mays
  Clone ID: LIB3075-003-Q1-K1-D9
cccacgcgtccgccctcgtcgtcgtctcactcaccccgccttcacgcctccctcaccaaataagggcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctactgcgacacctgccgcgccgggttcgtgaccaatgtcaccgagtacatcgcgggcgccaaggtgaggctggagtgcaagcacttcggcaccggcaagctcgagcgctccatcgacggtgtgaccgacgcgaacggcacgtacacgatcgagctcaaggacagccacgaggaggacatcttgcaggtggtcttggtgg

SEQ ID NO: 62022 - DNA, 358 bp, Zea mays
  Clone ID: LIB3075-003-Q1-K1-E1
gttgcgcaggcggtagtggagttggtgcctgctgatgataatatcgccgccgccgctgctggcgcggcggtggacgatggcgagccgcctcagcagtgcgcgaccccggtgagcgtggaggaggcgtgccgcggcgcgtccgagacgcacgccggcgtggcctacgaccactgcatggcgtcgctgggcgccgacccgcgcagcaaggaggccggcaacaagaacatgcacgggctggcggtgctggccaccaggatggccatcgaccacgccgtcagcaccgagtccaagatcgccgacctccttcgcgacgcgctggacaaccttaaggcgaagatctacggcaaggtcatggagc

SEQ ID NO: 62023 - DNA, 282 bp, Zea mays
  Clone ID: LIB3075-003-Q1-K1-E10
ctcttccttctacttggtgtgtctatggattccaccaaaattgcgcaggatattgcgcagtcttataataagatatattttctacaaagatcataagaacaaatgatatttaactatttatcaataatttagctatcaccatctgagagttttgtaaatatatgtactagtctatttgcataaattataagatatggatatgctagataacatatactaggctagcttatctatcaacgcactcatcatataattgacatatgctagtacatttcacatttt

SEQ ID NO: 62024 - DNA, 379 bp, Zea mays
  Clone ID: LIB3075-003-Q1-K1-E12
cggacatgagctgggaggagttccgtgcaacccggctcggcgcagcgcagaactgctccgccgggctcgccggcaaccaccagatgcgcgccgtcgccgccgtcgcgctgccggagacgaaagactggagggaggatgggatcgtgagcccagtgaaaaaccagggccactgtggatcatgctggaccttcagcactactggtgcgcttgaggctgcatatacccaggcaactggcaaggccatctctctttctgagcaacagcttgttgactgcggttttgcattcaacaatttcggatgtaaggggggccttccatcccaggcctttgaatacatcaaatacaatggtggtcttgacactgaggagtcctaccctta

SEQ ID NO: 62025 - DNA, 412 bp, Zea mays
  Clone ID: LIB3075-003-Q1-K1-E2
ggcctcacgggcacgacagatgaagtaagacaagttgcacgtgcttatcgagtttactatatggggacagaggaggagggttctgactaccttgttgatcactcaattgtcatgtacctgatggacccagagatgaagtttgtcaagttttatggcaagaactacgacacagattcccttgctgacggtatcgttaaagaaattaaagagcacaagtaaacagtagttggaatgccactttgcaacgtcagccttgtttctgaatttctcccgagagttttgttaaatcaagcaaaaaccaaatggcacacgagatcatgtggcaatagctgatgacatttgaatctcgcggcggcttttatttcagcagattcgggtgcacatgttgcgggtttgtgcacgtttttgtcac

SEQ ID NO: 62026 - DNA, 376 bp, Zea mays
  Clone ID: LIB3075-003-Q1-K1-E3
gcttgtacagcgcaagttggcatgactcctgaggaagtagtatcgaaaataatggcaaacccggatggagctgttgcattccagaatccaaaaatacagacagccatcatggactgctcgcagaaccctcttaacattgtaaaataccaaaatgacaaggaggtcatggatgttttcatgaagatatcacaaatcttcccccaaattaacggctagctgatcttcgtcgtgggatagcacttctgatttttgtcggcccgtcatctccagtctggagggctgctgcggtagcatctatcaagaaaagggtcgtgacgctccgatatacccctcccgtgtcaaggtttttgaagttcttatgtacatcatgtgatgt

SEQ ID NO: 62027 - DNA, 237 bp, Zea mays
  Clone ID: LIB3075-003-Q1-K1-E4
cggacgcgtgggcggacgcgtgggcggacgcgtgggccggcaaattggccggaccccagacggcaagcgagctagtttttgtagatctgctatggtgtgctttattccgttagtcgatatatgttgcattgtttctagtttcgaagtccatttatttacttctctatgatttctacacacggcctaataatcttgctaaggccctgattgaatggaaaatattttttgggagttttt

SEQ ID NO: 62028 - DNA, 312 bp, Zea mays
  Clone ID: LIB3075-003-Q1-K1-E5
tgcttacttcctttagtgaacatggaaataaggacaacagtgaagctacattcatcattgctggcgtgaagagtttgtcaaccttccgtgcttgcaaccatgatattatctttattagctgtgggcaagttggacaaagtaatggtgaaaataactggtctgggaaccatgtggaagattcttctcttcaaatgcttgaagggaaatgcttctggggttaaataccaactaatttacttgcttcatcttttgagagttgtgtcatttaaagttgggacatattgtggagttggcatctaaagttacaatgag

SEQ ID NO: 62029 - DNA, 179 bp, Zea mays
  Clone ID: LIB3075-003-Q1-K1-E6
acttcctctaatgaacatcgaaatatttacaacactgaatctacattcatcattggcgagctttaataattagtcagactaccttgcttgcaaccatgatattatatatattacctatgatcaaattatacaaattaactttaaatataactactatcataaccattttcaatattttt

SEQ ID NO: 62030 - DNA, 364 bp, Zea mays
  Clone ID: LIB3075-003-Q1-K1-E9
cgctccgtctttatttgtaatctgaagcttacaggaacatttgagtggatcatggactgattggtaggcctcttgaaagtccgggtggtgaggggcatcaaccttgcctaccgcgactcaagaggcagcgatccgtatgtcgtcctacgacttggcaagaagaaacttaagactagcgtgaagaagagatctgtgaaccccatctggcacgaggagctaactctgaccgtcacagatcccagcctagctctgaagctggaggtgttcgacatggacacgttcagcaaggacgacccgatgggtgacgctgagatcgacgtggcgccgcttgtggaggcggcgaacgcgagcccggaggcgagcc

SEQ ID NO: 62031 - DNA, 434 bp, Zea mays
  Clone ID: LIB3075-003-Q1-K1-D11
agacaggcaagacaggttggggtgtaagatccctcagttctatatcatcaggcagtttcatatgggagtataccggtgagctattggaagatgaagaagctgaaaagagagagaatgatgagtatctatttgatattggtcataactaccatgataaagaactttgggaggggctgaagtcagtggttggcctaggatctgctacttcgtcttctgagaccatggaaggcttcacaatagatgcatctgagtgtggcaatgtgggaagatttatcaaccatagttgttcaccaaacctctatgcccaaaatgttctctgggaccatgatgatatgaggatgccacatgttatgttttttgctgttgagaatatcccgccactacaggagctgacctaccactataactataagataggggaggtctacataaat

SEQ ID NO: 62032 - DNA, 401 bp, Zea mays
  Clone ID: LIB3075-003-Q1-K1-F1
gccatttgcccggttgcgcccgcccccggaccgcagaattcgagcaccaacgcctgggggccgtggtcacctggcgtggctcttccggcctgtggattatgtgggcggaaggatagggatggagcctggaggaggggagagacgcgtccggtgacgtcccctgtccaccgttttgagtaggagcgctgtcaacgtggcgaggattcaaggaggacagacagtccatggcaggttgatcacaatatcaactgtttgttttaggtaggagccctgacaacttgacatccgacaccgtgacattgaggtgtgctccggaggcttctctcggatagtttaaattttggaacttgattgctggtcgaggtgaaatatttatactccatggcctgattgcagtgctt

SEQ ID NO: 62033 - DNA, 400 bp, Zea mays
  Clone ID: LIB3075-003-Q1-K1-F10
aatttgatcggttttaaatgtttgatggaatcggttggactgtggaccgaggccggcgaatcgatcaagaacgccatctgctaggttagggtgtgttggacctgccatgggggacaggccggcgccgatcgagaaggtcgcggtgccggagaagatggccttgttcctgcacgccgtcgtcacgtcaccgggacaccagcagcagcacggcgcctcgtcgcacgaggcgcccgccgcgaacatcacgccgtggacaacagccaggaataagcagcagcacctgccggtgagccccggggcgtgcctctgctcgccgaccgttcacgagggctcgttccggtgcaggctccaccgcggcagcggcagcggctccggccttcacgagatgaagatgagcaag

SEQ ID NO: 62034 - DNA, 456 bp, Zea mays
  Clone ID: LIB3075-003-Q1-K1-B6
ctccaacaaggatttcgactcatatgtcctttctgagtcaagcttgtttatctatcctctgaggattgtcatcaagacctgtggcactaccaagctcctgctcaccattccaagaatccttgagcttgctgaagagctgtctatgccacttgctgctgtgaagtactcccgtgggacgttcatctttcctggcgcacagccagccccccacaggagcttctctgaggaagttgctgcacttaaccgctactttggcggcctgaaatctggtggtaatgcttatgtgattggagatccagcaagacctggacagaagtggcacgtcttctacgccactgagtacccagagcaaccaatggttaaccttgaaatgtgcatgactggtctggacaagaagaaagcttctgtctttttcaagactaatgctgatgggaacacaacatgtgccaaggaaat

SEQ ID NO: 62035 - DNA, 164 bp, Zea mays
  Clone ID: LIB3075-003-Q1-K1-B7
gttcattatctcgttcttatttatgacgaatgtcatgtatgttctggtgactgtcatgtatagtctgatgactgtcatgtatcttgttcatgtatgctcaaggttcattatcttgttcatgtattaagtatgttatgaataactcaatatttattattttgttc

SEQ ID NO: 62036 - DNA, 461 bp, Zea mays
  Clone ID: LIB3075-003-Q1-K1-B9
ggaggccaagagccgggtggacgagttcgcggcgaggaaccacgagggccggccgatggagtggatcctcggagcctgcagcaacgggtacgacaacgttgtgcagacgctcgaggaggcgcggaagatcgtcgccacgcggccggcggcgggcacccaggcccaggccgacgacatgaacacgaagctgtcggccgccgtcacgagcgccagcgactgcgacaacgccttcgccgacttcccggcgattaggtcccccttcttgcccatgcagcggaacgtctaccgcctcgtcgacaacgtcctcaacatcttcgtcgtcgtcaaccagccggagcacgcgcacaagcacgggcactagccgcgtgcgcgctggccggcctgccggttgtaagagccgcgatggtgttgtatcgatctcctttctgcacttgaatatatatatgtgaacaaggcttgag

SEQ ID NO: 62037 - DNA, 434 bp, Zea mays
  Clone ID: LIB3075-003-Q1-K1-C1
cacgagagagacgaatcttccgaatctctcggtggcgatggcgctctccgaccgctcccgcgagtcggtcctcccgagcttcctgtacgcctcctcggcgcgctctttcgctgccacaggagccgccgcgcgcctccctgtctcctccccagcgcctgccacggctggagcaggaggcggcgtgccgttctcgatccaggcgcccaaggagaagatcgagatgtactcgccggccttctatgccgcctgcactgccggaggaatcgccagctgcgggctcacccacatggccgtcacgcctctcgacctcgtcaagtgcaatatgcagattgacccagcgaaatacaagagtatctcatctggatttggtatcctgttaaaggagcaaggggccaggggtttcttcaggggatgggtgcctactttgcttggta

SEQ ID NO: 62038 - DNA, 385 bp, Zea mays
  Clone ID: LIB3075-003-Q1-K1-C10
cggacgcgtggggtcggcactcggcagcaaactgaatggcgcttcgcgctgtggagctccggagagtgcttctccggcgcatcggcggcggcgaggcggccctgcctcctctcgcgtggcgcggccggccagcgagcacatacgccccggcggacgacgagctcgcggggaagagcgcctacgaggtcctcggggttggggagaccagtttcagcgccgagatcaaggctttcttccatcgcctagccaaagagacccacccagacgtcgtcgcggctgctggttcccgacgggtgcttcagatcctcgtcgcctacgagatcctatcagattcacagagaagggctcactatgatagctacctgcgatcgcagaggcgagttgt

SEQ ID NO: 62039 - DNA, 425 bp, Zea mays
  unsure at all n locations
  Clone ID: LIB3075-003-Q1-K1-C11
cgccggcatcgacatggtgatgatcccctacgactacccggagttcgtcgccgacctggccaaggaggtgaagcatgggcagatcaagctggagcgcatcgacgacgccgtcagccggatcctccgggtcaagttcgccatgggcctcttcgaggacccgctcccggacccgcgcctcaccaaggagctcggcgcgcatgagcaccgggcgctggcgcgggaggccgtccgcaagtcgctcgtgctgctcaagaacagcaagaaggggcaggcgaagccgatgctgccgctgcccaagacggccaagaagatcctcgtcgccggcagccacgctcacgacctgtgcagccagtgcggcggctggaccatcaagtggcaggnggagaggggcaacaacctnaccggcgtggcaccacgatcctgga

SEQ ID NO: 62040 - DNA, 307 bp, Zea mays
  Clone ID: LIB3075-003-Q1-K1-C12
cggacgcgtgggcggacgcgtgggcggacgcgtgggtggtccaagtgatcttgccaagttacgggcagcgagcagagatcagatcatccatcggcaatgtcgaacatcgggcagtccttccaggccggcaaggctgaggcccagggcgagtaccaggcggagcacgcggcgcagtgcgtcaaggacaccgccgcagccgcggccgacagtgcgcagctgcagcagcaccggcccaccggcaccgttgagcaggtggcgcaaacgggccaaggcgtggcggcaggcgtcaaggacacggtggcgggcg

SEQ ID NO: 62041 - DNA, 384 bp, Zea mays
  Clone ID: LIB3075-003-Q1-K1-C2
acaagattggcccaaataaactgatccacgcacgcaggagacggagagctgaagcctgcaggcgagcggaagttcatcaccaaggaagaggagccagaacagtactggcagaccgcgggggagagggagggggagaaccccatgatgacacccctgccctacatcatcatcttcggcatgtccacccccttcgtcatcctcgccattggcgaaggctatggctggatcaaggtccctgtgcgatgaccgtaacgcgatcagccagcctggatcatagatgctgactcgtcagcctgcatcttattcagcgtgtgtcctgcgactttggaccttcatatatagagacaagagtttttgcgtgtgaacataattgcatgatcgcgt

SEQ ID NO: 62042 - DNA, 445 bp, Zea mays
  Clone ID: LIB3075-003-Q1-K1-C3
aggaaatcgattcccccagcatctgatctcttcggtgctagagaaatataggccgtcgccggggccggctcattcggtgaaaggtgcgcagttagggttgggagatctcttgcctcacgacacgagcagcagaatttgtcgagggccgctggttgctgcgagaggtccgggccttcgtgggatcttgaaaattgaatgttctaatggagtccaagggtggcaagaagaagtctagcagtagtcgttcctccctgatgtacgaagctccccttggctacagcatcgaggatatccgccctgcaggcggcatcaagaagttctccgctgcttactcgaactgcgcgaggaagccatcctggtatctctgttgtcatccccatcctagtagcgtagaaaccaactgcattttcattttgatctccctaatccctccggctagctgctt

SEQ ID NO: 62043 - DNA, 341 bp, Zea mays
  Clone ID: LIB3075-003-Q1-K1-C4
cgaagagctagcgcgcgatggccaacaaccttctccgtccgctcgcgctcctcctggccgtcgtcgggtgcgcgctgtgtccccgcgccgatgccaccgcgttcgaggtcggcggcgacgacgggtgggtcgtgccgccggccagcgacggcggcaggtacaaccagtgggcatccaagaaccgcttcctcgtcggcgacgtcgtccacttcaagtacagcgaggactcggtgctggtggtgacggaggccgactacgacagctgccgcgcgtcgcaccccgtcttcttctccaacaacggagacacggatgtgacgctggacccgccgggccccgtctac

SEQ ID NO: 62044 - DNA, 322 bp, Zea mays
  Clone ID: LIB3075-003-Q1-K1-C5
ggatcaggatgtccgacttcatccccgtctcatcgttcaccagaccgccgctccggtgcaccgtgtagaccagctcgtgcttgccgggcgcggcgtcgatgtagaccgtgcagttctcgtcgatctcctcctggatcagcatcttcgacagctgcgtcaccaccctcttctcgatccacctactgattggccgcgcgccgtacacctgttgctgaagccacacaagatagaaagttcgcatcatcaggtgtcaccgaccaattcagatggatctaatcatggatggtcacataccggatcgtatgagagagacatgatgatg

SEQ ID NO: 62045 - DNA, 371 bp, Zea mays
  Clone ID: LIB3075-003-Q1-K1-C6
cggacgcgtgggcgtgtatgatgccatgttgtatagggacttggcagattgactacactgcaggaactggtggtgaaaagatatgcataggtgaccaagaactacaagttgtttttgcacctggtcatacagatggtcatatggggcttctccatgtaaataccaatacattggttgttggagatcattgtgtagggcatggaagtgcaaccttggacagtagaaatggtggcaacatgaaggattactttgaaactacatacaaattcttggagttgtcaccacatgtattaattccaatgcatggaaggattaatctatggcccaagtatatgctttgtggatacctcatgaatcgaaaggctagagaa

SEQ ID NO: 62046 - DNA, 307 bp, Zea mays
  Clone ID: LIB3075-003-Q1-K1-C7
gacaaaagcatggcggcgggctacggcgaggaactcctgggcagggtgtcgggcctggtggcggcgtgcacagtgcgcgtgtcgcgcgcgacgcggcgcctcctccggcgccaccagaagaagaggccaacgaagcaccaccagacgacggccgacgtggtggcagcggcgctgtgcgcgcgtggggcggccatcgacaagggcagggcgtcctcggggtcggcgggcgaggtggccctctggagccggcggatcctgatgggggagcgctgccagccgctggacttcgcgggcgccatccactacg

SEQ ID NO: 62047 - DNA, 433 bp, Zea mays
  Clone ID: LIB3075-003-Q1-K1-C9
gttgctgatgataatggttatggttgggcaattgctaaggctcttgctgctgctggtgctgagagtcttgttggtacatgggtgcctgcgttgaacatatttgagacaagcttgagacgtggaaagtttgatgaatcacggaagctacctgatggatctcttatggagattgctaaagtatatccactggacgcagtttatgacacccctgaggatgttcctgaagatgttaaagcaaacaaaagatatgctggagcttcaaactggactgttaaggaagttgttgagactgtaaagaatgactttggtagcattgatatccttgtacactctctcgccaacggtcctgaggtaacaaagtcactgcttgagacatcaaggagaggataccttgctgcaatttcagcatctagttattcttatgtttctttac

SEQ ID NO: 62048 - DNA, 451 bp, Zea mays
  unsure at all n locations
  Clone ID: LIB3075-003-Q1-K1-D10
tcgggaaaagcgggagggagtggaaatgcatatactggagctgatgcaggtacaagtgtttcaggtggaggatccggtggcgccagtgcaggtaccagtgctaccgtgggtgctggtgtctccggaggtgccaaagttggtggtggcgtaggaggaaatgcaggaggaagtggcaacgtctatactggaaccggtgccgatgcaggcgtttctggtggaggatccggtggcgccgatgctggtattggagctaccataggtgctggtgtctccggaggcgtcaaatttggtggcggcgccggaggaagtgtatgaggaagtggcagtgctgctgcaggtgcttctggagggagtaaatcatcagggggtggctcagattttggatatggttcancgagcaaggagttatagaggatgatgaccactcaccaccgtaagatcgatatgatcc

SEQ ID NO: 62049 - DNA, 438 bp, Zea mays
  Clone ID: LIB3075-003-Q1-K1-B5
cggccgtcgagcgagcagtctcccaattccacccaataactaataacatctcctcgaacgccgggttccttggaccactatatccaggagcgacgaagtgatccacccgccagccatggagatgaagaaggtcctctgcgccgccctcgtcgccgccgcctcggccaccgccgtgctggcctcggtcgcctccgaggcgccctccgaggcgcccgccggcgcggccggtggtgcggctggccctagcgcaagcggcgccgccgccgtcgccgtgcccgccgtcggggcgctcgtcgcctccttactcgcctactacctgcactgagcgacgacgcgcggcgcggcaacggtgggatgcatcgggtttggttcatccgattaactaattgttatttttaattacgtggtttgcgattggtaaatggttggttggtcgtt

SEQ ID NO: 62050 - DNA, 228 bp, Zea mays
  Clone ID: LIB3075-002-Q1-K1-H12
acgcgtaccgtataaagtgcaatttcacgcagttaccatctgttggtatctcactaggagctgaaaaagaggcgaaaacctctgggctgactgaagaagtacctgaggataggatagctgtgcaggcttccgatgcggtctagctaaattgtaaccagaatagcaggactagcacgactacgccgaatgacaatgtgatccacgaccattctagtgacacatgatcat

SEQ ID NO: 62051 - DNA, 172 bp, Zea mays
  Clone ID: LIB3075-002-Q1-K1-H9
acgggctggatgaaagtgccttgcttaaaacactgcagagaggtgttgcttcctcgacaaggggggaagaaagctttagtaggattgcagcattaattggtgctggtcaagtaacaaaagatggagctcttggcactgcaaatgcacctattcacatggtcacagcagaaac

SEQ ID NO: 62052 - DNA, 266 bp, Zea mays
  Clone ID: LIB3075-003-Q1-K1-A1
cggacgcgtgggcggacgcgtgggcgactccatccccatcatcttaatcacgaaggatatttggaaagcagtagtagtttagtcaaattagatatgcgttttaggattctagttgatatgcgtccattattttgttcacatcgaatgcagcagtgtgttagctatgtagttgcatacctatcataactaagtctattagaagtatttctaataatatttaggatctgtcatcaataaaatgtatgcaacaatacgactattgtatt

SEQ ID NO: 62053 - DNA, 302 bp, Zea mays
  unsure at all n locations
  Clone ID: LIB3075-003-Q1-K1-A10
cccacgcgtccgggagaagcactacgggactgacgtcgaggataaagaaaaggctaggaaggtgacaagcgagtcgtggtgctttggcccccaggtccccctcaaggagcagctcgagctcgacaaggatgatgagagcctgangaggtggaaggagcaactccttgggcaggtcgacacagagcagctgggagaaactgcggaaccagaggtcaaggtgctggacctgaccatnctgtcacctggcagaccggacctgatccttccgatcccgttccaggctgacgagaagggctatgcgt

SEQ ID NO: 62054 - DNA, 486 bp, Zea mays
  Clone ID: LIB3075-003-Q1-K1-A11
ggcaaagatgtcgtggcaggcgtacgtggacgagcacctgatgtgcgagatcgagggccaccagctcgcggcggcggccatcgtcggccacgacggtgccgcctgggcgcagagcacggcgttccccgagttcaagaccgaggacatggccaacatcatgaaggacttcgacgagccagggcacctcgcgccgacaggcctgttcctcggacctaccaagtacatggtcatccaaggcgagcctggtgccgtcatccgtggcaagaagggatcaggaggcatcaccgtgaagaagacagggcaggcactcgtcgttggcatctacgacgagccgatgacgcctgggcagtgcaacatggtggtggaaaggctgggcgactacctgcttgaacagggcatgtaactactacgtaccagctggaatgcatgtcgacgacgatggtttcgagtttcgacttccaataatagtaacaacaaagcaaaggc

SEQ ID NO: 62055 - DNA, 409 bp, Zea mays
  Clone ID: LIB3075-003-Q1-K1-A2
cgaataacacaggtgagcgcgacgatgggatccctcgctaataacatcatggtcgtgggcgccgtccgtgcggcgctcgtcgccggcgggtcgtgcgggcccccgaaggtgccacccggccccaacatcaccaccaactacaacggcaagtggctcaccgctagggccacctggtacggtcagcccaacggtgccggcgctcctgacaacggcggtgcgtgcgggatcaagaacgtgaacctgccaccctacagcggcatgacggcgtgcggcaacgtccccatcttcaaggacggcaagggctgcggctcatgctacgaagtgagatgcaaggaaaaacctgagtgctcgggcaatccagtcaccgggtacataacttacctgaactaccaacctattggttcctaac

SEQ ID NO: 62056 - DNA, 299 bp, Zea mays
  Clone ID: LIB3075-003-Q1-K1-A3
accggtcctgaatgttcgacgtcgcagcgtccgggcatacgatccaatggtggcacgtagaagtggaaagaaacttccaatggaagacataagctttggccagtgtcctctgcagggtgttgaacattttgggctctttggaatttttgatggacatggtggggatggagctgccaaaactgtcagcaagattctttcagaaaatctgggatacatgttatctcattctgaaacaaaagaaccagtgcagtcatgttctgatgcttctgatgagcttagaaattcttctactttgacag

SEQ ID NO: 62057 - DNA, 290 bp, Zea mays
  Clone ID: LIB3075-003-Q1-K1-A4
atcgagatgagtcacacagactacacaaatatattcggacgtgctagatggcctgatgctccacagcgggtcctggaaacacccttctatgatgagtggaagaataatttcccagaccaggaaacagaggaagatcaacccatcataggccactctatcatccatggtgtgcacaaggatattcgtcggtttgccggtactgttccaaacgcgacggcaacaggagatatcgacatcatggccatgtattcgggtcacggtgttgggctaatcacggagatcataccagc

SEQ ID NO: 62058 - DNA, 254 bp, Zea mays
  Clone ID: LIB3075-003-Q1-K1-A6
cggtcccggagctggtccttcgtggagcggcccggcgcgctgctggtgatcgccttcctggcggcgcagctggtggcgacgtgcatcgccgtgtacgccaactgggagttctgcaagatgcaaggcatcggctggggctggggtggcgccatctgggcgttcagcgtcgtcacctacttcccgctggacgtgctcaagttcgccatccgctacgcgctctccggcaaggcctggaacaacatcaacaacaagac

SEQ ID NO: 62059 - DNA, 320 bp, Zea mays
  Clone ID: LIB3075-003-Q1-K1-A7
cgaataacacagttgagcgcgacgatgggatccctcgctaataacatcatggtcgtgggtggggtccttgcagcgctcgtcgccggcgggtcatgcgggcccccgaaggtgccgcccggtcccaacatcaccaccaactacaacggcaagtggctcaccgccagggccacctggtacggtcagcccaacggtgccggcgctcctgacaacggcggtgcgtgcgggatcaagaacgtgaacctgccaccctacagcggcatgacggcgtgtggcaacgtccccattttcaaggacggcaagggttgcggctcatgctatga

SEQ ID NO: 62060 - DNA, 220 bp, Zea mays
  Clone ID: LIB3075-003-Q1-K1-A9
atatgggtgtgcccgcagcatcatcgttgctgaaagggttgtgctaaatttcatgcagctgatgagtggcatttctaccctaacagatgctatgtctgatgctgtccgtccagcatgcatattggaaacaaggataactgcttcaggtttacgtctgattgacatgtggtcagtactgattgttggctgaaagaaccacatgcttggtacattacgatat

SEQ ID NO: 62061 - DNA, 283 bp, Zea mays
  Clone ID: LIB3075-003-Q1-K1-B1
ccccggcgaagttgttaaacctgaccaattcaaggcaataaacgacgaggggatgccgatttaccagaggcccttcatgaaggggaagctctacattcatttcacggtggagttccccgactcgctggcaccagagcagtgcaaggctctcgagtcggtacttccgccaaagccttcgtccaagctgacagacatggagatcgatgaatgcgaggagacaaccatgcttaatgtgaccaccatcgaggaaaaaatccccaggagccaggctatggctgttaag

SEQ ID NO: 62062 - DNA, 347 bp, Zea mays
  unsure at all n locations
  Clone ID: LIB3075-003-Q1-K1-B10
gtcagaggatagtgggatcgagttgtttgactgcacgagcacatcctccggcgaccaccggccggcctatccgtcctctagcgaccgaccaacgcgccgagcgaagatgtcgtggcagacgtacgtggacgagcacctgatgtgcgagatcgagggccaccacctcacgtcggcggccatcgtcggccacgacggcgccacctgggctgagagcaccgcgttccccgagttcaagcccgaggagatggctgccatcatgaaggatttcgacgagccggngcacctcggcccgaccgggctgatcctgggaggcaccaagtacatggtcatncaaggcgaacctggag

SEQ ID NO: 62063 - DNA, 474 bp, Zea mays
  Clone ID: LIB3075-003-Q1-K1-B11
gcgcttgtgaaccgcaggcctcgggcgccgctccgtccagacaccagtccactcccacggacgggcccgtggcgtgaaagcgctggcgcctgccagtcgggcaagccaaggccgccactcgtagggccctcttctctgcgcttgctctgctggagcgcgccgccgaatagcacaatgccagcggcagcctctcatccgagccccacagggccacttgtcgctcgcccgcccgcgtcgtcgtctccgccggccggccggccggcctcccaaaccctagcgaggcgagcgagagagaaactagacgccatgttcgggtacaggaaggcggacccggacctcgaggccggcgggtcctcgctgctgtacccggggatgacggagagccccgaactgcggtgggcgttcgtccgcaagatctacgtcatcctcacggtccagctcgccatgacggcagccgtctcggccttcgtcgtc

SEQ ID NO: 62064 - DNA, 231 bp, Zea mays
  unsure at all n locations
  Clone ID: LIB3075-003-Q1-K1-B12
gcgcgtgacgctggacctcatcaccgaggcatccggatccatgtccgcaggcatcgccctgccagcctgcaacgccggagcgccctcctacggngcggcggcgccgttcggaggcgccgcggacgcacccgtcggcaccttcgagggccctgccagcgccagcgggccatcggctggtgacgccccggcgtatggcgccagcgccagcgccagcggcccgactgctgatgc

SEQ ID NO: 62065 - DNA, 184 bp, Zea mays
  Clone ID: LIB3075-003-Q1-K1-B2
cccacgcgtacgcggacgcgtggactttggaaggacatctgttgactttgtgatgccaatatggtagggattagttacctagggaggaattctaccttgacattgagcctaagtggggccatttgatggacctgcacctggctgctgaatctgtgctagaaggtcctgctctagttttatacat

SEQ ID NO: 62066 - DNA, 399 bp, Zea mays
  Clone ID: LIB3075-003-Q1-K1-B3
atagaaacgatgaatcaggtggcggaaggtctggagagccatggaacagaagggactttgatggtggcggaggaagaggcagaggtcgttttgggcgaggtgaccgtaaccagggcaacaacttcgggtcaggagatggtggcagctggggctctggcaggggaaatggtggccgcggtggttacaggaactggaacgataacaatgagcgatccttcggtgaaggtggtggctggtcccagtcccagtcttccgattggaatgccaacaaaggaaatggcgaaggaaatcaagctttctcgaaaagcaagcccagctgggaagcacaaaacacctctggtagagatggtcaggcatgaaaaggtgatgcatacaactcctggaataagaacagatcat

SEQ ID NO: 62067 - DNA, 343 bp, Zea mays
  Clone ID: LIB3075-003-Q1-K1-B4
ctgcgtgctcaagaacaccaccaacggcgtgcgcatcaagtcgtacgtggacgccgagtccgggctgacggcctcccatctcaccttcgagaacatcaggatggaggaggtggccaaccccatcgtcatcgaccagtacttctgcccgcagaaggtatgccctggcaagcggagcaactcctcgcatgtctccgtcaaggacgtcacgttccgcaacatcaccggcacgtcgtccacgcccgaggccatcagcctgctctgctcggagacgcagccatgcagcggcgtctccctcatcgatgtcaacgtggagtacgccggcaagaacaacaaaaccatggcc

SEQ ID NO: 62068 - DNA, 284 bp, Zea mays
  Clone ID: LIB3075-002-Q1-K1-H11
acgcagaaatgcctggtttctatgcatagggtgaatattatctaagtcgttttgctgtcgatggtgaggataaacataaactgtctcacgcacaacacattgctaccgatgacacccacatacgtctgtcttcaaggtctcatcatacttaacaccaactctctcatttgaatattccatatcaacaacggacacattatcaaactactacctccacccattatacccatacccattactgctctccacccttttattgttccacccttcctactagccatact

SEQ ID NO: 62069 - DNA, 444 bp, Zea mays
  Clone ID: LIB3075-035-Q1-K1-A7
cggtgaagagaggtgactggtataggaccaaggatttggtgattaagggggcagactggatagttaatgaaatgaagaaatcaggtcttcggggtcgtggaggtgcaggttttccctctggtctgaaatggtcctttatgcccaaggtttctgatggacgcccttcttatcttgttgttaatgctgatgagagtgagcctggaacttgcaaagatagagaaatcatgcgccaagacccccacaagcttctggaaggatgccttattgctggagttggaatgagggcatcagctgcttacatctacattcgaggtgaatacgtgaatgagcgtctcaacctcgagagagctcggcaggaagcatatgcacctggacttttcggtaagaatgcttgtggatctggttatgattttgatgtgcatattcattttggtgctggtgcgt

SEQ ID NO: 62070 - DNA, 471 bp, Zea mays
  Clone ID: LIB3075-035-Q1-K1-A8
catgtcgttgtcccgcccgtcgctgcgcgaggtatggctgtccctgcccctccggtgaggctgggcgtgacaatccacggacaggcccagcgtctcgtccactctgacccttcgggcttcatctgccgcaccggagccaccacaccttcgcccaccacacgggagacgctccatcgctgctatggtgggccctaccatcgagaggacccaggcacggttgcaggcttgcagcgggcagacaacacgggccaccgcatggccgtcatcgtcgtacccaccacccgatggctgcgcacggtctccagatctgaatagggaggcgacccaacggctgcgcacgatctccagatctaaacaggaagcggcatgggcggcgttggctggcactggtgccctgcttcgacccaatgggcttcgtctaccgtatgggagccgcatgggaaccgatccacctttaccatttgcatggga

SEQ ID NO: 62071 - DNA, 370 bp, Zea mays
  Clone ID: LIB3075-035-Q1-K1-A9
agcgccgcgtctccgaggaggaggcgcacgcatgcgaggacaggtacaacaagtccaagctcgtgcgctccatcatgcgccacgtcggcgagacgctcgaggtcgacctcgagccgctctaccagcggattggctggccgctctaccgcaagtacggtcacgccttcgaggccttcaagctcatcgttgcggaccctgacgctatcctcgacgtactcacctatgaggaaaaggaggtcggcccagatggccaggaggtggctaaggtggtgcctgctgtcacccctgaggttaaggattcactggtgaagaacataaggaggaggatgacaccgcaggcactcaagatccgggctgatatagagatgaa

SEQ ID NO: 62072 - DNA, 304 bp, Zea mays
  Clone ID: LIB3075-035-Q1-K1-B1
cgcttaagaagacggccaacggcgtccgcatcaaggcgtatgaggacgccgcctccgtgctcaccggctccaagatccactatgagaatatcaagatggaggactcgggctaccccatcatcatcgacatgaagtactgccccaacaagttatgcaccgccaatggtgcctacaaggtcaccgtcaaggacgtcaccttcaagaacatcaccggcaccttctccaccccggaggccgtcaacctgctctgctctgccaagatcccatgcaccggcgtcaccatggacgacgtcaacatcaagta

SEQ ID NO: 62073 - DNA, 210 bp, Zea mays
  Clone ID: LIB3075-035-Q1-K1-B10
tctgttgcatggacatgatcatcaaggacgtcaacctgtcggtgcccgatgacagcctcgacgctgatggcatacacatggtcggatcatacgggatcaccatgaccaacaccgtcatcggcagctcgcgactactgcatccccatcggcccgaaaacctccatggtgaacatcaccgtcttgacctgcggccctggcacacagcatcac

SEQ ID NO: 62074 - DNA, 292 bp, Zea mays
  Clone ID: LIB3075-035-Q1-K1-B11
acatagagtcaccaagcgatgaactcggctaagtttctatcaaccaaccctacatagctagacacggtacccatggctcgcgctagcgtcgcctttgtcattgccgatctcctgttcgtcgccatggtacaatcacccatggccgaggcatagtccgtcgatgcttctgtggctgactcgccagccgatggacctagcggtccaacatgctgcacctgttccacagggtgtcgaaatgcctatcatgcaatgaagatgacgattattacttcaccaattgatgtctcacacg

SEQ ID NO: 62075 - DNA, 194 bp, Zea mays
  Clone ID: LIB3075-035-Q1-K1-B2
gtgaactgcgcgcgtactactcaacagcggatatacagctaatctgtgctctacccagcatttcacatgacgtcctgcactactgagggggagctatacctaaagtgcagacgaaatgacgtatctgctgaagagatttccgcttacacccgactcgtctacaccttgcaccagggatgggagtccgacgagac

SEQ ID NO: 62076 - DNA, 407 bp, Zea mays
  unsure at all n locations
  Clone ID: LIB3075-035-Q1-K1-B3
cccacgcgtccgtttcagttcttttcggaatgcgttcagagggtggcaataagagctcacgtgatggtggaccaactcaaagggcatcagccttggcagctctttcatccgcattgaatccatcgtcgcaaggaaaacagtcagatgagaggcccacaaaacccagcagcacacaggcgcagtctcattcaggccaagggtctcagagagccgctgctgttgcagcactttccaatgttttgactgcagagggatcgcacagcccccgccacagtaggtcgtccccaacagcagatgctgagaagactgaattagctcctgcttctnctcaccagttggaaacagggcctgcagaagatgtccggacagaacctgatgtctcacatgaacaaactgcttacgaaaac

SEQ ID NO: 62077 - DNA, 355 bp, Zea mays
  Clone ID: LIB3075-035-Q1-K1-B4
gcacagagacaccaagcgttgaactcgcctaagcagctatcaaccaaccctagaaagctagacaccggacccatggctcgcgctagcgtcgtctttgtcattgccgctctcctcttcgtcgccatggtcgtagcaccgatggccgaggcaaagtccgtcgatgcccctgtggctgacgcgccagccgatggacctagcgggccagctgctgcacctggcccccagggtgtctaatgcctgtcatgcaattaggatgacgatgatgactccaccaattgaggccacactacgttgcacgggttaaattttgaacaagacatggatgaaaaatgagagcaatgtctttaaaaccatg

SEQ ID NO: 62078 - DNA, 458 bp, Zea mays
  Clone ID: LIB3075-035-Q1-K1-B6
gtgacgcgacgcccttcgctcatctcatctacctccgcctcactgtcgctttctctgacctcctcctcctcggatccgtcctcttactggcgagggacgcgcagcggaaacagcggccgttcctcgctctcgcgctcgtcctatggtcgccggcgctgttagctgtcgaccacgtccactttcagtacaatggattcctcatcgggctgctgctgctttcgctgcacttcctcgagcaggggtgggatcttatcgggggagtcgtgttcgcatgcttgctgtgctcgaagcacctgttcctcgtggcagcgccggtgtactttatgtatttgttcaggcattattgctgtggccggtgtgtcgtgaaggggctgggaaggctcgtgctgatgggttctggagtggctggtgttttggcggcacatttgtgcccttcgggtattatggtcagatgcaac

SEQ ID NO: 62079 - DNA, 96 bp, Zea mays
  Clone ID: LIB3075-035-Q1-K1-B7
tcggtgacgcgacgcccttcgctcatctcatctaccttcgcctcactatcgcattctctggggtactactgctaggatccgtagggttactggcga

SEQ ID NO: 62080 - DNA, 446 bp, Zea mays
  Clone ID: LIB3075-035-Q1-K1-B9
gtgctcttcgtagtgaagattgtgaaagaggaaacctgggaagcagtaattgctgactcgttgctttatgcgaagggtttattgctggcagttactttggttattgattgttggctggcctttgcctactttctgggatttcttgttatatatgctgtagctcaacagccaccttatgatggcctaggccattcaaatcatttgaccccattgcaacttgaaagtctgctaactgaagagccaacatcacgattttggctggtagaattccgaacttcattttcagcaaaatgtgtacaagcaagcagcattctgcctgaactttctatcacgtactccaacaagaacatctcttttggaacaattgaccttgggcatttcccaaatgctgcagcaaagtttgggatattcatgtgggatcatcttctcacttacatattggttga

SEQ ID NO: 62081 - DNA, 264 bp, Zea mays
  Clone ID: LIB3075-035-Q1-K1-C11
gttctagatcgcgagcgcgccctttttatttcattttctctctgtttttgatttctggtctattcgggttattttttacgtgctcttggcaaaaaccctcttttaaaaaaggtgcctcacgattgagcactgaacatcaacccctagtccacctgtctatgcacacccttacactaatcaacttctcatatacattaaaccttattgctaaatctctaaaagatctcctgtaaaccaaaaggaaatttctccttcatacacacc

SEQ ID NO: 62082 - DNA, 380 bp, Zea mays
  Clone ID: LIB3075-035-Q1-K1-C12
cgacgttcggcgaggaggctgatccggtctgttggatcggaggcgcggcgatgggggcgctgtcgcggccggaggaggtgctggcgctggtaaagctgcgggtggcggcggggcagatcaagcgccagatcccgcccgaggagcactgggccttcgcctactccatgctccagaaggtgtcccgtagcttcgctctcgtcatccagcagctcggacccgaactccgcaatgccgtgtgcatcttctacctcgtgctccgtgccctcgacaccgttgaagacgacactagcatcccgaccgaggtgaaggtgcccatccttcaggaattctaccggcacatctacaaccgcgactggcattattcgtgtggaacaaatcac

SEQ ID NO: 62083 - DNA, 465 bp, Zea mays
  Clone ID: LIB3075-035-Q1-K1-C2
tcggggcaccatggtgagatgtgagagaatctgaccgccgcagccacttcacgcatcggtcatcattcaggcttgtatggggatcgtacatggtcaccagggagcgtaggtcgtgtgcatggtctgcggtgcggggattttgtggcgtgcttggccaaatcgctcaacggagcaatggcgccgtcgtgggccacactactccgagggcggtatgcgttgcaacaccattgtagtgagggcacgagaatctgaagatcatcctggtacctggaatctgaagtctaaggtcaagaacaggttccactggattaggcgcatgaatgatgatgtgatgaagtcgtgagtggtctatgtcgtcggctttcagtcaactattgttgctggatcgatgtcttcgtatgatgtattttttatttattttgttcagaactcctattatattgtataagggtgggcatttgtttc

SEQ ID NO: 62084 - DNA, 142 bp, Zea mays
  Clone ID: LIB3075-035-Q1-K1-C4
gttctagatcgcgagcgcgcccttctttttttactttacatcacttttattatgtttattttttatgggttttctttattttttcttttggtaaactgtgttttaaaaaaggggaccttgacttgacccctgatcattaacc

SEQ ID NO: 62085 - DNA, 180 bp, Zea mays
  Clone ID: LIB3075-035-Q1-K1-A6
gcgtcgggagaaccagcatcttaataagagccagtctatatactaataaaactctcgccgagggcatccgagcgaacaagccaagcgaccccgtgctcaatgcaatatcgtcgtcgacgtaccaccaccaccttatgatcgagatggagatgaagaggatcctcttcgccgttctcgtcg

SEQ ID NO: 62086 - DNA, 339 bp, Zea mays
  unsure at all n locations
  Clone ID: LIB3075-034-Q1-K1-G7
tcgcccaggtggatacatacatagataatagaaaggcgacgattaccgcacatcttgaggggggcgtggattcgggggagattgggcttggagaggagcacccacttgccctctacgcatagctgccggatctccgcctcggacaggtgcacctggcgcccgcctcggccgtcctccacgaggcggcgcaccatctcgttcaccgtcgcgccctccatcggtcccatatgtgcccgcgtcatcatcatcttcccgccccgcntccttnctgcccagaaacagccgcggcgtgtggcgcatgacgagagatatagagagagagagagagggagagaggag

SEQ ID NO: 62087 - DNA, 403 bp, Zea mays
  unsure at all n locations
  Clone ID: LIB3075-034-Q1-K1-G8
gcgcacgcgttcgcccacgcgtncgcagatttgttgtgcgatttaccaacaaggacatcacagcacacatcagctgtgctattataggggggggtatgggtcttgcttctgcttactcncatgagttgccacgatatgagcttgaaattggtcctaccaactatgcagctgcctactgcactggccttctctttgctcgccgtgtgctcaagacccattgtttagataaggaatatgacggcaatgttgaggccactgtgtnttttttttctnatnnctcatcttatcataagaagactttccgtgctctcttggatgttggccttattatgactacaacttggaaccagaggtttgatgccctcaatggagcatttggatggaggcctggatcttcctcaca

SEQ ID NO: 62088 - DNA, 419 bp, Zea mays
  Clone ID: LIB3075-034-Q1-K1-H1
gaccgcaggaagctgtactccaactttggtttattgtatccatatggccacgaagaattggccgtttgtgaagatgttgaccaggttcgtggtgcaatggagaagtacccaccataccagtctatattttccaggatttcatatggagaaagtcagatgttggataaggcattttatgaggaggaagtcaagaggctatgcttgtcctttgagcagcagttccactacgctgttttcttcgcttacatcaggctccgcgagcatgacatcaggaacctgatgtggatctctgaatgtgtcgctcagaaccagaagtcccgggtccatgacagtgtcgtcttcatattctgagaacccccgccactatatatgtatgtacaaaatgcctgctttgatgatggcacaatcgctcgacaatt

SEQ ID NO: 62089 - DNA, 242 bp, Zea mays
  Clone ID: LIB3075-034-Q1-K1-H10
gtgattatgggcttgtggttgatgagattgggaatgggatcagtgaaactgggatgaggggaaagctggtaaagaggaacatgtagtcttctggcgacttggatatctatggtgggcatagaatcaatgtggaaccaatagggacgctaggtgaagacaggtcatcataaataagatcaaggggtgacagtgatattgacaaccgacaagctcttcaagcataatagatggatgttgtgtca

SEQ ID NO: 62090 - DNA, 78 bp, Zea mays
  Clone ID: LIB3075-034-Q1-K1-H2
gatgaaccaacagtctacaataaaagccagtcacatgcaaataaaaccgatagacctcatccctgaggcaagcctacc

SEQ ID NO: 62091 - DNA, 328 bp, Zea mays
  unsure at all n locations
  Clone ID: LIB3075-034-Q1-K1-H3
agcagcagtaggtcgaaaatggcgatgaggtcgctagcgctactggtcctcctcagcctgctggttgttggtgtggcgcaggcggtggacttggaaatggagttggtgcctgctgatgcaattgcgatgactatggatcatgagccgccgcatgagtgcgcgacccctgttagcgtggaggaggcgtgccgcggcgcgtctgagactcacgccggcgtggcctacgaccactgcatggcgtcgctgggcgcctaccttttcantnnntgtgccggctacaagaacatgcacgccctggcggtgctggccaccatggttggcattgacc

SEQ ID NO: 62092 - DNA, 371 bp, Zea mays
  unsure at all n locations
  Clone ID: LIB3075-034-Q1-K1-H4
gtcgtcgtcgtcgtcgtggtggtgcttgcggcagctccggagtccaggcagcaccctagtcngggggcgcgggggaggagatatggatcggtcgtatctccccgtggcggcggcagccgtcgccctggtcctcgtgtgctgctccggcctctgccgcggcgagcggctcggggcgagggagtgcgaggacctggggttcaccggcctcgctctctgctccgactgcaacgcgctctccgaggtcgtcaaggacccagagttgttttntnnntttcataaatgttgcaccgaggattcagatgattctatcagcaagctcacattttctggtgcaattattgaggtgtgcatgaggaaactggtattttatc

SEQ ID NO: 62093 - DNA, 235 bp, Zea mays
  Clone ID: LIB3075-034-Q1-K1-H5
tcgcgtgaccaatgtcaccgagtacatcgcgggcgccaaggtgaggctggagtgcaagcgctgtggcaccggcaagctggagcgctccatcgactgggtgaccgacgcgaacggcacgtacacgatcgagctcaaggacagccacgaggaggacatctgcgaggtggtctaggtggatagccctgacaaggactgttactaggttcatgcggacagggaccgcgccggcgttctg

SEQ ID NO: 62094 - DNA, 303 bp, Zea mays
  Clone ID: LIB3075-034-Q1-K1-H6
tgacaagatcaaatacctcgccggctacaatggcctccatgtcctccatcctcctcgccatggtgatgctggctgcgctattcgttgttcgtttgtgcaccacccccctcaccttccacgtctgcaagggatccaagcctggccacctgatccttacccccaaagttgccaccatatacgacgtggacatcaaagagcacggtggcgatgactgctcctttacgctcaaggagggcccgactggcacctgtgctttctttaccattttcccgctcaagtaccccctttgcatccgctttgctg

SEQ ID NO: 62095 - DNA, 444 bp, Zea mays
  unsure at all n locations
  Clone ID: LIB3075-034-Q1-K1-H7
tcggtgtgatcatccgttgatccatcttgctaataaccctgcgtgcccttcgttctcgggtggatcccgacgacgctcgcgttcggctccggcaaaccacatcaagtcgcgatggagatgaagaaggtcgcctgcgccgtcctcgccgccgccgcctccgccaccgtggtcctcgccgccnagggcccggcgcccgcgcccaccagcgcctcctcggctgcgttctccggccgtcggcgccgtgctgagctccnccggagtcnncagcnagggctactacctgcagtaaaattaaaggaggatcggagggagaggctgctggctgccattgcctgtattcggttggatcccgcttatatatatatatatatatttaagtactttaatttgggtctgaacatgtccattgatccattcattttatttgctttggcatttcttccc

SEQ ID NO: 62096 - DNA, 444 bp, Zea mays
  unsure at all n locations
  Clone ID: LIB3075-034-Q1-K1-H8
gccacagctcgtcgcgttcgtcaacggtcgacccatcgcctatggaaggaatgcgcgaggcggatgctgacggcggaaagggcgggggcctccctccgtcggagccgccgcacctgcagggccagccgccgcaggagtacgggtacggcacgttccagggccctcgacatcctcccgtcgggttcccgcagcctgccccgcctcccgggctctgcggcggcggcgggggcggcggctatcacaaccagaagcaaccattttcnccnnnngagacttactacgcccaggggtaccaggccgtaccaggctatggtcctgttgctgaaggaagacctgtgagaatgaggcgtcttccatgttgtggcctcggcttangctggtgtctgttcataactgggtttttcttggctggcatttcatggttcattggagctttcggtctta

SEQ ID NO: 62097 - DNA, 180 bp, Zea mays
  Clone ID: LIB3075-034-Q1-K1-H9
gtttggtgaaggttatgtgagcacttgtggaatcgagactacaaaggaatttgtgggcatgctcgatcttaaaccgggccagaaagtacgtgatgtcggatgtggaattgtaggcggcgactgttacatggctgcaaactatgatgggcaagtgcttggtattgatcttttggtgaacat

SEQ ID NO: 62098 - DNA, 366 bp, Zea mays
  Clone ID: LIB3075-035-Q1-K1-A1
ggaaaatatgtctgaattccatgtggtgtttttttgttgcctctttttgtgcctttttctgttctcgtaactgtgttgcacacttatgaggatatgatgaccctttccccagatgatcgacagtgaacatattgagcgccatattttctcttttgagaaaaccaagccagaattctgatcctccatttatgcataaaaagtatttctgaattttatgtagtacttattttgtattcctccttttgtgttttttgttcttgtaactatgttgcacactttggaggatatgatgaccctttccccagatgatcaacaatgaaaatactgagcgctataatttctcatctgagaaaaccaagccagaat

SEQ ID NO: 62099 - DNA, 386 bp, Zea mays
  Clone ID: LIB3075-035-Q1-K1-A10
cggacgcgtgggcggacgcgtgggcggacgcgtgggttgcgaaaaaagaacaacaaaggaggaaacgaaaacgagcgggggagctcgcggaccccaaaaccctaaccccgcggacccacctggcggcggcggcggcggcgatggcggacggcggaggagaaggaggacctcctgcggcgtcggcggcgctcaaggaccaggggaatgagcagttcaaggcggggagctacctcaaggctgccgcgctctacacgcaagccatcaagctcgaccccgacaacgccaccctctacagcaaccgagctgcagcattcctgcagttggttaagcttagcaaagcgcttgctgatgcagagacaacagtcaggctgaagccacaatgggag

SEQ ID NO: 62100 - DNA, 441 bp, Zea mays
  Clone ID: LIB3075-035-Q1-K1-A12
cgcgagtgctcgagacccgcgccgagggaggctgcctcttcatcgtgccaaggttcttcgttgtctgcaagatcgccgacgaaaccggcatggagtggttctccatcatcaccacccccaacccaatctttagccacttggcgggccggacatcggtgtggaaggcaatatctccggcggtcttgcagtcgtcgttcaacaccacgccggagatggagaagctgttccgtagcaagaggcttgactcggagatcttctttgcgccttcaaactgattcattcgccggtggaaaatggtccatccatctcgagtaaacttggtgtcctgggtgtgttctttagcagcttcagtttaaaataatcagggtatgtcttcatcatcaggtttttagatcggttcatggtaatataaacttgagatggtgcacatgtttcttaatt

SEQ ID NO: 62101 - DNA, 364 bp, Zea mays
  Clone ID: LIB3075-035-Q1-K1-A2
ctcgattaaagagaaggagcacattagtgtactgctccggaacgcactttaggccaccacaagtgaggtgggaaaggttgcagaggatggtctgggagaagctggcattgagattggacttaacgagcgaaaggagcacatgctagggagtgtggagaatgacgaggtttataccctggcaggggctcttgagaataccatgaaggagtcttaggtcaaaattattgagctccaacatcttgtcgaatcactaatggcggagtctggtttacttagaacaaggctagaatggcaagagaaggagattggtcagctgagaaagcaaatataaaatcttgaagagaatgagaaggtggcaaatgga

SEQ ID NO: 62102 - DNA, 309 bp, Zea mays
  Clone ID: LIB3075-035-Q1-K1-A3
cgtggacttcgtgaacaacggggaggtgtccgggatcacgctgtttaactccaagttcttccacatgagcatgtaccagtgcaagaacatgctgatcaaggacgtgaccgtgacggcgcccggggacagccccaacacggatggcatccacatgggcgactcatccgggatcaccatcaccaacaccgtcattggcgtcggcgacgactgcatctgcatcggccctgggacctccaaggtgaacatcactggcgtgacctgcggccccggccacggcatcagcatcggcagcctagggcgggacaagga

SEQ ID NO: 62103 - DNA, 442 bp, Zea mays
  Clone ID: LIB3075-035-Q1-K1-A4
gagagacgcacatctatctgtcaagcgacgccgcggcctcgatcagagtcggaggcgaacacccccatggcggcggctggcggcggcgcaggagggaaggtatccttcaagatcatcctcacctccgaccccaagctccctttcaaagtgttcagcgtgcccgaggcggcgccctttaccgcggtgctcaagtacgccgcggaggagttcaaggtcccgccccagaccatgcgccatcataaccaacgatgggatttggcatcaacccccagcaaaagtgcatgcaacggtgtttctgaaacatggttcggagctgcgtctcatccctcgcgatagggttggagctgtagtcatgtcttacggttagaggatatatacacgtcaatgcattattgagcaaaacttgagagaaattaagcctttatgttggccctgcttggct

SEQ ID NO: 62104 - DNA, 441 bp, Zea mays
  unsure at all n locations
  Clone ID: LIB3075-034-Q1-K1-G6
tcgcgtgacggcgcccggggacagccccaacacggatgggatccacatgggcgactcattcgggatcacgatcaccaacaccggcattggcgtcngctacgactgcatctccatcggccccgggacctccaaggtgaacatcaccggcgtgacctgcggccctggccacggcatcagcatcggcagcctagggcggtacaaggactagaaggacgtcacggacatcaacgtcaaggattgcactcttaagaagactggtttcnncgtnctgatcaaggcgtacgaggacgccgcctccgtgctcaccgtctccaacatccactacgagaatatcaagatggaggactcagccaaccccatcttcatcgacatgaagtactgccccaacaagttgtgtactgccaacggcgcctccaaggtcaccgtcaaagatgtcacctt

SEQ ID NO: 62105 - DNA, 424 bp, Zea mays
  unsure at all n locations
  Clone ID: LIB3075-034-Q1-K1-D6
tcggccggagtacctcaaggacaacgagtacatccgcgggcactaccgcnccnagtggcccggccgcgacgcgctcctcagcgccttcgcctggcacaacgagactctcaacgtgtggacgcatctcggcgggttcctgtttttcctggcgctcgcggtcgccggagggtggacggaggccgccgacgaaaccgctcccgggatcatgaggttcgtggtgacaccaccagctaacgcttcgtggggtaagcgccagcattcnnttcttgcaagccacgacggcagggcgtcgcagtccggcgtgccccggtggccgcggacggtgttcctggtgggcgccatgtcntgcctggccatcagcgcgacggcccacctgctggcgtgccactcgcggcgcgccagcgtggggttcttgcagctcgac

SEQ ID NO: 62106 - DNA, 436 bp, Zea mays
  unsure at all n locations
  Clone ID: LIB3075-034-Q1-K1-D7
gcttcagcgacgaagggtacgggcctgtaccgtcacggtggaaaggcgtgtgccaagggggagagggctggggcagcaacaactgcagccgcaagatcatcggcgcgcgcttctacagcgcgggcgtggccgaggaagatcttgagatcgactacctgtcgcctcggggcgccagcggccacggcacacacacggcgtccaccgcggcagggtccgtcgtggaggcggtcagcttctacggccttgccncgggcaccccactcnntggcgcgcccagggcccgcatcgcggtgtacaaggccttatggggccgtggggctggcacgggcaataccgccactttgctcgcggccatcgacgacgccatccacgacggggtagacgtcctgtcactctccctcgtcggcgttgagaacacgttcggcaccctgcacgc

SEQ ID NO: 62107 - DNA, 257 bp, Zea mays
  Clone ID: LIB3075-034-Q1-K1-D9
ccggcgaactccacgggctccggagtgtgccgttcgtcgtcggagttcaccggagccgggtactagctgtccgtagtcgagccccgctctccgtcgatccgtgcccgtcacacgcacgaacccgaggttgttgatgacccaaatttattttatgtattttataaagcgtttttattcgattcatgtgttgtatattttgttgttgtaatatgaacacatgtgattccgatttatggatatgtgtgcgcttattaaaa

SEQ ID NO: 62108 - DNA, 349 bp, Zea mays
  Clone ID: LIB3075-034-Q1-K1-E11
gcaagctgcctcctcctcgtcgtccggtcgtgagaagggatggcgggccgtggcaaggctatcggcgctggcgccgcgaagaatgcaacgtcgaggagctccaaggccggactccagttgcccgtctgcaggattgccaggttcctcaaggcgggcaagtacgctgagcgcgtcggcgccggcgcccctctgtaccttgcctgcgtcctcgagtacctcgcggctgatgttcttgaacttgccgggaacgccgtgagggacaacaacgagacctcgattgtgccgtgccacattcagcttgctttgcgcaacgacgaggagctgaccaaactgttggggtgggccacca

SEQ ID NO: 62109 - DNA, 444 bp, Zea mays
  Clone ID: LIB3075-034-Q1-K1-E12
cgaaaaccctcgcggcgaggagcgctctccgtcccacacacgcgcgccgcagcctccgcagtccgcacctgcctccacgacttgtcgtgctcgtgcgctactctcctcgagcgcggcgcggagcacggggacatcaaatggcggcagcggcggagatcggtggtttcgcggcggcgagagtggcggtggcgacgctcaggccggctgcgcacccagccccggcggcggcggtggcaccgcagcctaggagggcggtggcggcgcagtcgctgcagacgaccgccaccgaggcgctgacggcggatctcgccggcacgaccaacggcgctgtgcatgctcggatgaatagtaaggctacaagtgaaatcacttcacaggcagttactgcaaattctaggagaaagacatagatagtctggaccatagggccccttaaccaacact

SEQ ID NO: 62110 - DNA, 454 bp, Zea mays
  Clone ID: LIB3075-034-Q1-K1-E2
aggctccccaaagatagcatagcagcagcactcacaatagcaaaaaccaccatccgtcgtgggcaaccgtagcaagaacatcaccaccgcccagcaataatggcgcagagcatgaggattgtggcgctggccctggtggccctgctggtggtggcggcggcggcgcccgtggccaccgcgtacggctgctacgacgactgctacgagcgctgcgccaacggcaagaaagaccccgcctgcaccaagatgtgcaaccaggcgtgcggcttcacggatcatggcgccggtgccgccggcgccgcgccggcttgatcgcccagcgcattcatcgcttcagctcgatataatcgctgctccgtcagcaacccacatatgattcgatcaattttcctcctctaatttctcgaccccgtcgaatttttttcctttctattcttctactatactactacta

SEQ ID NO: 62111 - DNA, 433 bp, Zea mays
  unsure at all n locations
  Clone ID: LIB3075-034-Q1-K1-E6
gcaacctcgtcgtgccgccgggcatcatcaccaggccgcggctgccgctgccgccgtgggcgtcgccgcccgcgccgaggatgacgcatatggcggtcgcgccgagccctccgccgacgttaacttcgccgcggcaatctccgtcgacgttgttaccggcctcagtgggcgataccgcggaggctccggacactgctgaagcgccggtgccgtcgcatggccatgtggcgcaagtggcgagttggtggactgctgcngcccccnngatggcaatggcatgcatactgatcgggtacttgtaggtcactgcatttgcaaattgcaactggttcggtcgggtgggaattggatcgtcccttgcattttataagagtagttcattttgcgcgccatatatataggtaactcttatggctcattttcttttgtcgat

SEQ ID NO: 62112 - DNA, 421 bp, Zea mays
  Clone ID: LIB3075-034-Q1-K1-E7
agcgccggcgcctccatttcgttttcctcactctctcctccagctcagggtccggcggggaagggaaggcaagatgtacaccgcgaggaataagatccagaaggagaagggtcttgagccctccgagttcgaggactccgttgcccaggctttctttgatctggagaacgggaaccaggagctcaagagcgacctcaaggacctgtacatcaacaatgctatccagatggatgttaccgggagtaggaaggctggtgtcattcacgtcccataccgcctgcgcaaggccttcaggaagatccatgtcagactcgtcagggagctggagaagaaattcagcggcaaggatgtggtaattgttgctacacggaggattgtgaggccacccaagaagggttcagctgttctgcgccctcgcacc

SEQ ID NO: 62113 - DNA, 378 bp, Zea mays
  unsure at all n locations
  Clone ID: LIB3075-034-Q1-K1-E8
tcgcggacgcgtggggccattccaggcggtcccaacatatagcggccccatcagcccggccggggcgtggcctcgggggcgcggactcagtcataccttgccccccggtggctcacggcgtcggtcggcccatcagcacgcggcaaccgacggctcggtcaccaaccccatcctcggccaggggcgcacgacccccatccccagctccccggcggctaggctcgaggcctggatctttgcggcgcgcggggnagggcttnncngtttctgttgacgcggccccacgcatggcgcccaggctcacggacccctccgactgcggcggctggcaaccccggcgcgggttccaccctgcatggcggttcacatcccgacacc

SEQ ID NO: 62114 - DNA, 448 bp, Zea mays
  Clone ID: LIB3075-034-Q1-K1-E9
gtcctctcataccgtcgactgcggagacgtttcagttggccctgaaactcttcagctgcgggccaaaagacaggtcgatgacctgttaggagacaacccgatgaagatgtcgtacatgatcgggtacggcgaccggtacccgcagcggatccaccaccgggcctcgtcgttgccctcgatcagggaccatcctcagccgatggcgtgcaaggatggcacgccgtacttcaactcatccggtgcgaatcctaacccgctggtcggctcggtggtcggcgggccgggggaggacgacgcttacgaggatgaccgtgcggatttcaagaagtctgagcccactacctacatcaacgctcccttggttggggtccctgcgtacttcgttggcaaccctaatcctggtcataacaccagacattgagcggtgcagcctctggatctttcttgg

SEQ ID NO: 62115 - DNA, 149 bp, Zea mays
  Clone ID: LIB3075-034-Q1-K1-F11
ggacgatggatgggacagagacaaaagatgattgctgtgagcatcatcgtggtcattagggcacgagcctacgttgacgatgatggcgatatcatttttagtaggcggtgcctggtgtgctactacgaagggcggcggacgctagaaca

SEQ ID NO: 62116 - DNA, 410 bp, Zea mays
  Clone ID: LIB3075-034-Q1-K1-F12
gatcgacccgtcatcctcggttcctcatccaaccgggcatccggattccggtgagcggaggaaggcgccatgaaagctgcggatgacgccactcgctgccctcagatcccccggcgttgccaccactgtgccgggccactctccaaggacatggaaacgagcagctgtacatgacctccgttggttcgagatagctgctccatgattggatcggctcttgggggtatagcaggagcgtgttatggttgcaaccattttatgcctgttgttcgacgtcacataaagggcccaatggggatgcatttttttgttggtgcaccagcatttattgtgttctcttctgcatgtgctggattagcaggtggtacaataccagccaccgtacagttggtttcatcatcctgtcatgc

SEQ ID NO: 62117 - DNA, 441 bp, Zea mays
  unsure at all n locations
  Clone ID: LIB3075-034-Q1-K1-F2
cggacgcgtgggcggacgcgtgggaaaaatgtgacatttgtttctgtaccatgaaaaaaggaggaaaaaaaaaaaaaaaagggaaaaaaaaaaaaaaaaaaaaaaaaaaccccacccgtccaaaaaatcgcaggttgttgaagcgaatgtacctgaacatgttttttgtgacgaacaacaaaaaattttaaacgaacaggattcactgtcaaatatgaacaaccatattggaatagttgagcatttaaagcaaaataccgaatccaagggtnttatggtactgcgtttcttatatagttcttcattccatgagggtctcacatttacttttttttttaaaaccaggatgaaagacctgcatctgataagcaacctgaacctgtttttaggcagcataaacatttgaactttcctccgttcactacccaaattcacttgaaa

SEQ ID NO: 62118 - DNA, 421 bp, Zea mays
  unsure at all n locations
  Clone ID: LIB3075-034-Q1-K1-G3
caagggactataagagggttctagaaagcatgaaggtggaaaaggctgttgctaancatgcaaaggagcctaagatggcagatggaatttctgtgacaactaagaaagtacaacctgatcagtcagcaagccgaccaacacatgttgccaatgccaaaaagtacaggggctttattacatatgagcgagagagtatttcatacagagatccaaaagagcgtgttagagattggaaggaagttgcaatcgaatctacacctggnccactattaaatacacaatctgctcgttgcatggactgtggcactcctttctgtcatcaggaaagctcacgtgctggttgtcctcttggaaataagatcccaaaattcaatgaattagttcaccaaaacagatggcgcgaagcattggatcgactact

SEQ ID NO: 62119 - DNA, 391 bp, Zea mays
  unsure at all n locations
  Clone ID: LIB3075-034-Q1-K1-G4
tctcgttacngcgcccggggacagcctcaacacggatgtgatccacatgggcnacttattcgggatcactatcaccaacaccggcattggcgtcntctactactgcatcttcatcggccccgggaccttcaatgtgaacatcaccggcgtgacctgcggtcctgtgcactgtatcatcatcttctgtctanggcggtacaaggacgagaaggacgtcacggacatcaacgtcaaggattgcactcttaatganacggtgtgcnncgnncggggcaatgcgtactatgacgccggctccgtgctcaccgtcttcaacatccactacgagaatatcaagatggaggactcagccaaccccatcttcatcgacatgaagtactgccccaacaag

SEQ ID NO: 62120 - DNA, 431 bp, Zea mays
  unsure at all n locations
  Clone ID: LIB3075-034-Q1-K1-G5
tcggcaggaggcctctcccccccagcccagccaccccgtagcgactactgatggctgaagaggatgagcgcgtccaggttcataaagtgcgtcacggtctgtgacggcgccgtcggcaagacctgcatgctcatttcctacacctgcaacaccttccccaccgactatgttccgactgtgtttgacaacttcagtgctaacgttgtggttgatggtaacactgtcaacctcggcctctgggacactgcatgtcaagatggattncatcnnactgagaccactgagctatcgtggagctgatgtttttcttctggctttctcactgatcagtaaagccagctatgagaatgtttcgaagaagtggatacctgaactgaagcattatgcacctggtgtgccaataattctcgtagggacaaagcttgatcttt

SEQ ID NO: 62121 - DNA, 429 bp, Zea mays
  Clone ID: LIB3075-034-Q1-K1-D11
aatctgaaaacaaagcttttccgctgccgaccgagcactccgttccatggcgtcgccttgctcgtgggactagcaagcctggcctcgctggagaccatcaagaagcaagtggcaatcatgtatttgtggccgaaggcgctagaagtacctataatggacccctcaaaagcattaaaaaagcctgttggaattctacttgtgaaggtcgtaagagcccaaaatttgcgaaagaaggatctgctgggtaaatcagacccatatgtgaaacttaaaatgtcagatgataaacttccatccaagaagactacttgtaagcgcagcaatctcaatccagagtgggatgaagaatttaagtttggtgggactgagccagaaagccagtctctttgaattaaaggcttcgactgggaacaggtttggaaacatgaa

SEQ ID NO: 62122 - DNA, 403 bp, Zea mays
  unsure at all n locations
  Clone ID: LIB3075-005-Q1-K1-H4
ggccgtcgagcgagcagtctcccaattccacccaataactaataacatctcctcgaacgccaggttccttggaccactatatccaggagcgacgaagtgatccacccgccagccatggagatgaagaaggtcctctgcgccgccctcgtcgccgccgcctcggccaccgccgtgctggcctcggtcgcctccgaggcgccctccgaggcgcccgccggcgcggccggtggtgcggctggccctagcgcaagcggcgccgtcgtcgtcgtcgtgcccgccgtcggggcgctcgtcgcctccttcctcgcctactacctncactgagcgacgacgcgcggggcggcaacgttgggatgcatcgtgtttggttcatccgattaattaattggtttttttatttacg

SEQ ID NO: 62123 - DNA, 397 bp, Zea mays
  Clone ID: LIB3075-005-Q1-K1-H5
ggaggccgcaccaaatctatctggggatcggagcgcgggcgacaagatgccacgcggcggcaagcccgcggcttcgtcgaagccgaacccgttcgactcggactcggactcggagtccagcaataagccggcgaacaagtccggggcgtcgtcgtaccaggcccccgccgacgccaagaagcggtacaaggacgggttccgggactcgggcgggctggagaaccagtcggtgcaggagctggagcactacgcggcgtacaaggccgaggagacgacggacgcgctcgccggctgcctgcgcatcgccgaggacatcaggcaggacgccagcgacacgctgatcacgctgcacaagcagggggagcagatcagccggacgcacgagaaggccgtcgag

SEQ ID NO: 62124 - DNA, 448 bp, Zea mays
  Clone ID: LIB3075-005-Q1-K1-H6
cccacgcgtccgcccacgcgtccgcccacgcgtccgcggacgcgtggggccgtggaggtcaccggtgggcctgagattcccttccaccccggtagggaggacaagcctcagcccccacctgagggccgccttcctgatgccactaagggttctgaccacctgaggcaagtttttggcaagcagatgggcttgagcgatcaggacattgttgccctctctggtggccacaccttgggaaggtgccacaaagagcggtctggtttcgagggggcctggactacaaaccctttggtctttgacaactcttacttcaaggaacttctgagtggtgataaggagggccttcttcagctcccaagtgacaaagccctgctgagtgaccctgttttccgccctcttgtcgagaaatatgctgcggatgagaaggctttctttgatgactacaaag

SEQ ID NO: 62125 - DNA, 466 bp, Zea mays
  Clone ID: LIB3075-005-Q1-K1-H7
aacaagttcagttgctatagcaacacgtggggaatgtgctttcacggaaaaagcaaatattgctcaggccagtggttcgaccggtttactagttatcaatgataatgaagagctttacaagatggtttgcggtgagaatgacacctccattaatgtgacaatacctgttgtcatgataccacagtcagcaggaaagaagctgaagaacttcttgcatcatggagcaagtgtggaagtgcagctatattcaccaaatcgaccaactgtggacctttcagcatgcttcttatggataatggctgtaggcaccatagtctgtgcttcactctggactgaatttgttacatgtgaacaggttgatgagcgttataatcagctgaccagaaaggatggacctgacacgggaataaactacagagaagattaagaggtcttcgagatcagcgcgaaaggtgcttttattttt

SEQ ID NO: 62126 - DNA, 474 bp, Zea mays
  Clone ID: LIB3075-005-Q1-K1-H8
gcccaaatggcacaattaggaacattataaatggcactgtgttcagagagcctattatatgcaaaaacgttccaagacttgttccaggatggactaagcccatctgcattggaaggcatgccttcggtgatcaataccgagctaccgatgcagttctgaaggggcctgggaagctgaagctagtttttgagggaaaagaagaacagattgatctggaggtattcaacttcactggtgctggaggagttgccttgtctatgtacaacaccgacgagtcaatccgagcttttgctgaggcttctatgacaactgcttatgagaagaaatggccactctaccttagcaccaaaaacacaatcctgaaaaaatatgatggcaggtttaaggacattttccaggaggtctatgaagctgactggaagtccaaatttgaggctgctggaatatggtatgagcatcgtcttattgatgaca

SEQ ID NO: 62127 - DNA, 453 bp, Zea mays
  Clone ID: LIB3075-005-Q1-K1-H9
ggaacagagaggatgcctccaccatcgattgaagacttcgtcgtcgattctacctctgcacggggacatggaacgccaccgggagtacctgtgcatgggcgaagatgttccaggcaagaagatcctcggtggcatgtcaattgctcaccggagttgggcgggtatgataggtctgcaccgttgcgtggccgacccttgcaccgttgtcgtcatctgggtactacaggataaggcatatgaaggatgtcgcgatgagttcatgagaagtctagaccgccgtctcccagtcaactatggttgctggatcgttgtctatgcatgatgtaattatttagttattttgtacagaactcctattatgtagtaaagacattcgtttctattccatgagtcatcatatgtgtgagacttgatcctagcacacatttgattcgcgcccgggtttgtccctta

SEQ ID NO: 62128 - DNA, 210 bp, Zea mays
  Clone ID: LIB3075-006-Q1-K1-A1
cccacgcgtccgcgctccccgtccttcggtaggtgcattgcttcggtggtccaccatggcgcggcgagcggtggccacgatgacgactaataagccccttctcctcctcgccctggcgtccgcgctccttggtgcggcgccggccgccgcgaacgcgcccggcggggcgttcagcaactgcgtggcgatcaaccagcacagctactcgct

SEQ ID NO: 62129 - DNA, 323 bp, Zea mays
  Clone ID: LIB3075-006-Q1-K1-A10
ccaaccttgactggtacaaaggcccaaccctgcttgaggctcttgaccagatcaccgagcccaagaggccttcagacaagcccctgcgtctgcccctccaggatgtgtacaagattggtggtattggaactgtaccggttggtcgtgtggagactggtgtcatcaagcctggtatggttgtcacctttggtccaactggcctgactaccgaggtgaagtctgttgagatgcaccacgaggcgcttcaagaagctcttccgggtgacaatgttggcttcaacgtgaagaacgttgctgtcaaggatctcaagcgtgggtttgtg

SEQ ID NO: 62130 - DNA, 430 bp, Zea mays
  Clone ID: LIB3075-006-Q1-K1-A12
ccagcaccgacctcggagctgatacctgcttcgtctgcatgagtgatatcgtggcggcacacacgcatcttggtcactcctatccatggttcgaattaccgaccgaaaagtctggttcctcggccaatttctcgttcccggtcagctaggggaagcatttctcggcccggtatcacattttaaaaatatgaaagtcaattttttttgttcaaaacgaaatttccgaacagtgaatcgaaaaagtgaagcctgttccttactatgttcaaggatttttgctctctccatcccacaattttcgagcagtatgtcagcttagaattaagattatttggtgctgcatcattgatgcagattaatataatgaggcccagaacatggcacatgttacttttgacaaactaaaaatgaatcatcactgattcttaaa

SEQ ID NO: 62131 - DNA, 345 bp, Zea mays
  Clone ID: LIB3075-006-Q1-K1-A3
gtggagcaagctgttggaatgccatcagttgtccaaatattcaaggtccatagtgaagccttgtttggggataatgagagtagtgtcttgagagatttgtcctccatgcgacgattagttgttgccaccggaggtggtgctgttatccgaccaattaactggagatatatgaagaggggcctatctgtttggttagatgtgcccttggatgctcttgctaggcgtattgctaaagtgggaactgcctctcgtcctcttctggaccaaccatctggtgatccgtacgcaatggccttttttaagctcagcatgcttgcacagcaaaggggtgatgcttatgcaaat

SEQ ID NO: 62132 - DNA, 409 bp, Zea mays
  unsure at all n locations
  Clone ID: LIB3075-006-Q1-K1-A4
cggacgcgtgggcggacgcgtgggcggacgcgtgggagaaggcgtagtagtttcgtcggattggtatgatgtgcaggaaccttcttagcaccgtgaattgattctttttagttaggttagaagcaggaacgatccatcatctgctgttgtaatttgtagctgttgccaggaggtagatgtagcaaggcagagctgtaagaacccattattattgatcttgtagcagtctgaggttttggaaattgtatcatatactacctccgttcttgaatatttgtcgcctattgtttcaaaaaacgacacataaaaaaattaaaaaagaatggagagtatttttatgctgctgctatgcacggctcaaaaaaaaaannnnnancnannagnanaataaatttttttaacatcatat

SEQ ID NO: 62133 - DNA, 267 bp, Zea mays
  unsure at all n locations
  Clone ID: LIB3075-006-Q1-K1-A5
ccaaggctccccaaagatagcatagcagcagctctcacaatagcaaaaaccaccatccgtcgtcgccaaccgtagcaagaacatcaccaccgcccagcaataatggcgcagagcatgaggattgtggcgctggccctggtggccctgctggtggtggcngctgcggcgcccgtggccaccgcgtacggctgctacgacgactgctacgagcgctgcgccaacggcaagaaagaccccgnctgcaccaagatgtgcaaccaggcgtgc

SEQ ID NO: 62134 - DNA, 431 bp, Zea mays
  Clone ID: LIB3075-006-Q1-K1-A6
acagactgaaaatatgaaacaaattcaggatgctttgtcagctcctctcggagcttctgctgatttcgatgaggatgaactggaagccgaacttgaagaactggagggagcagagttggaatctcagcttctggagcctgttgcagctcctccggtgcatccagtgcatgccccagccaacaagcaaccagcgcgccctgctccacagaaagctacagctgaagatgatgagcttgctgcactgcaagctgaaatggcattgtgatcaggtttccaattaagaggtggaatgtgtatatgaatggcgttatgctaccaagatgaaagttgagtcaggatttattatatttgccatgtgtataatcttgggggatatttggcaagcaggaaaaaagctgctccaagccagtgtttggttcaatgattttggg

SEQ ID NO: 62135 - DNA, 139 bp, Zea mays
  Clone ID: LIB3075-006-Q1-K1-A7
gggacgcgtgggaaaaaaataaaaaattaaattttattaaaagaaaataaaaaaaaaaaggatggagaataaataaaattaaagtattaaaaaaattataaatccataaataaaattacatagagtaacttaaaataaa

SEQ ID NO: 62136 - DNA, 302 bp, Zea mays
  Clone ID: LIB3075-006-Q1-K1-A8
tcgggcctgcagaagatgttcggacagagcctgatgtctcacaggaacaaactgctaacgaggacggaggccagaccacctttagctacgaccgcttggtatcaaagtctactgaccctgtcagtgggatagaccacaagcgcagagagacatatttggtggacaatgagttcgagaccgtgtttggcatgaccaaagaggagttctacgagcagccaaggtggaagcaagagttgcagaagaagaaagctgatcttttctgaactcacacacacggctagctacgaataaaagccctcccg

SEQ ID NO: 62137 - DNA, 426 bp, Zea mays
  Clone ID: LIB3075-006-Q1-K1-A9
cccacgcgtccgagcagagaagagcgcgtgcaaccaccacattcatataattaataagcaaggggtagagaagaggcaacatgggcacaaagatgaagaaggggatcctgaagccgttccgctatatctcaaccatcatggatggtaaggaggctgaaatgcaaattgggttcccgacggatgtaaaacacgtggcacacatcggttgggatggtcctggctccaccaacaacaataacaacaacagcaacaacaatagtggcggagcacctagctggatgaaggattaccactcggcaccgcttgactcgtcctcttttaggagtgagagtgggggcacggctgctgcaaatccctgggcttctcaagagatagtcatggatggagcaagcgtcggagaaacctccttcagggacacgaaaagcg

SEQ ID NO: 62138 - DNA, 413 bp, Zea mays
  Clone ID: LIB3075-005-Q1-K1-H12
gtgaacttgtcataccaatgacaatctccttctgttggaagagtcctggctttccagttaccggtttggtttggggtatacgtctgaaaggactccgcgattttgcctggtctgttgattcacttgtcagttgctggtctgtgtccgtattttaattggaagggctttgcaacttcgtcattcttcatgctctgtgtgggttttcgaaatattctttttagaagggggaggcatggtgcaataaaatgaaatagagagaaattgcagcaattctttgttatcttagcaacaccttttcttcttccgagagcactatgtacaaggtgacattataaaagattaagatagtgaaggccttattttcgcgaggctaatgtacattcatcttgcaagtgttgcaactcttttgaagt

SEQ ID NO: 62139 - DNA, 348 bp, Zea mays
  Clone ID: LIB3075-005-Q1-K1-G1
tctacctgtactcgctgtccgtcctggagcaccagatcgtggggaccctcgttccagtgcttaaggacgtggtgatgaatatctcgcgcgtgcagaagctgacccccgccgtgcagtgctcgcttttcaaggccttcgtcgatgtcggcgacaggtactgacacctatcgctcggcgtcaagtgctccaatgaggtcatcaccgacattcgaggcgccatcatgctgcccaagctgtcgagagtgcccagtacggatgcgctactggggaaacttgatcggacatccggacactgtgctctgcaaggtcactcggcaaatgctggtccaacatcgtgcgcattgtgcc

SEQ ID NO: 62140 - DNA, 411 bp, Zea mays
  Clone ID: LIB3075-005-Q1-K1-G10
agcaaacctgcagtcatctcctccaccaccaccaccaagctcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgctctctcccagcagtccaacctggtgctgtacggcaggatccagtgcaagggcaagtgcaccgagcagaagggcatcacggcgccggccatgaaggtctgccaggaggagtgcgacaaggcgtacgtggtg

SEQ ID NO: 62141 - DNA, 414 bp, Zea mays
  Clone ID: LIB3075-005-Q1-K1-G11
cggacgcgtgggcccgccccaaccagccatgggttcccgcgcggatcgcggctcttagacgcggaggaggagagagacagggggaggggaaggccgaggcctaggaggcgtggtgcagcgcgcgagcgcgttcgttcggcatggaacagaacgacggctcgttcctcgccgtgcgacgcctctccggcggcgccatccaccaccatcgccaccactcttcgccggctgaggtcgtgggcgtgtccacggcgtggatcgggaaggggcttacgtcgtgcgtgtgcgcgcatgggacggagagcgacgggcgcctctccttcgatttgagtcccattcaggaagagtgcttgcataggttgcagaaccggatagaggtgcagtatgatggttcaaatctagagcatcaaaaagcac

SEQ ID NO: 62142 - DNA, 448 bp, Zea mays
  Clone ID: LIB3075-005-Q1-K1-G12
gaaccacagccaccgcgatggcgcagatcatcgatggcaaggccatcgccgccgacgtccgccgcgaggtcgccgccgatgtggccgcgctctcgtcagcccacggactcgtgccggggctggccgtggtcatcgtggggagcaggaaggactcgcagacgtacgtgaacatgaagcgcatggcgtgcgccgaggtcggcatctgctccatcgacgtctacctcccggaggacatctccgagaccgcgctcgtcgccgaggttcatcgcctcaacgctgaccccgcagtgcacgggatccttgtccagcttccacttcctaagcatatcaacgaagagaagatactgagcgagatttccatcgagaaagatgtggatggcttccatcctctcaacattggcaagcttgcaatgaaaggcagagagccactgttcgtaccatgtacgcc

SEQ ID NO: 62143 - DNA, 466 bp, Zea mays
  Clone ID: LIB3075-005-Q1-K1-G2
gcaagacgaatgactcggctggtgatggaaccacaactgcctctgttctcgctagggagatcatcaaattgggcatgttgagcattacttcaggggcaaatccagtgtccgttaagaagggcattgataagactgttcagaaattggtggaggaacttgagaagaaatcaaggccggtcaagggtagtggggatattaaagctgttgctgccatatcagctggaaatgatgaatttgttgggactatgatcgccgaagctattgacaaggttggccctgatggtgtcctctcaattgagtcgtcatcgtcgtttgagaccacagttgaagttgaagaagggatggagcttgacagaggatatatctcccctcagtttgtcactaaccttgaaaaatctattgttgagttcgaaaatgctcggattcttgtcactgatcagaagatatcatcgattaaagaaattat

SEQ ID NO: 62144 - DNA, 373 bp, Zea mays
  Clone ID: LIB3075-005-Q1-K1-G3
gctacccgcacgttgtatcgcgatgctatgcttttaatgttggcaactccttggcccggtgctggggcgggtctgactgggcaccggcgccttcagtgacgtggacccgggcggcggtgctgtcgggatgagggcgtaccacgagcgggtgatggaccactacaacaacccgtggaacgtcagttccttcgacaaggaggaccccaacgtcggtactgggctggtcggcgcgccgttctgtggcgacgtcatgaagttgcacattcgcgtcaactaggactcccgtaaaatcgtcgacgcctgctttaagacctttggctgctgcttcgtcatagcgtcctcgtgcgttgcttctgaatgggtgaagggaaaa

SEQ ID NO: 62145 - DNA, 403 bp, Zea mays
  Clone ID: LIB3075-005-Q1-K1-G4
gggggcgccggcggcggggaggagctctcggtggaggagcgcaacctgctgtccgtcgcctacaagaacgtcatcggcgcccgcagggcctcgtggcggatcatctcctccatcgagcagaaggaggaaggccgcgggaacgaggcgcacgccgcatacatccgcgcctaccgctccaagatcgaggccgagctctgccgcatctgcgacggcatcctcgcgctcctcgactcccacctagtcccatccgacggcggtgccgagtgcaaggtcttctacctgaagatgaagggtgactaccacaggtgccttgctgcgttcaagtcaggtgcagagaggaaggatgctgcggagagcaccatgaatgcctacaaagctgctcaggatattgctcttgctgatc

SEQ ID NO: 62146 - DNA, 370 bp, Zea mays
  Clone ID: LIB3075-005-Q1-K1-G5
ggctggcttctcctccccctcttaccaagtcctcttcgggttagggttacttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggcggtggccgtggcggcggtggctacggcggccgtcg

SEQ ID NO: 62147 - DNA, 460 bp, Zea mays
  Clone ID: LIB3075-005-Q1-K1-G6
accacgcgtgcgacaaagatagcatagcagcagcactcacactagcaaaaaccaccatgcgtcgtcgccaaccgtagcatgaacatcaccaccgaccatcaataatggcgcagagcatgaggatagtggcgctggccctggtggccctgctggaggaggcagctgcggagctcgtggacaccgcgtacgggtgctacgacgactgctacgagcgctgcaccaacggcaagaaagaccccgcctgcaccaagatgtgcaaccagacgtgcgggttcacagatcagggcgcatgtgccggcgacgccgcgccagctagatcgcccagcgcattcatcgcttcagctcgatataatcgctgctgcgacagcaacccacatatgattcgatcaatgttactcctataatcactcgaccgccgtcgatcattctactttatatacttgtactatactactactat

SEQ ID NO: 62148 - DNA, 414 bp, Zea mays
  Clone ID: LIB3075-005-Q1-K1-G7
ccaggttcgtgggcgatgctgcgcgcgggaggtaggcagctccttgccccggggctccggcggctcggtctgggcaccggcgccgccggtgaggtgggcccggccgccgcggcggcggggatgagggcgtaccacgagcgggtggtggaccactacaacaacccgcggaacgtcggttccttcgacaaggaggaccccaacgtcggtactgggctggtcggcgcgccggcctgcggcgacgtcatgaagttgcagatccgcgtcgacgaggactccggtaaaatcgtcgacgcctgcttcaagacctttggctgcggctccgccatagcgtcctcgtccgtcgctactgaatgggtgaagggaaaaccaatggatgaagtcttgacaatcaagaatactgagattgcaaagcac

SEQ ID NO: 62149 - DNA, 463 bp, Zea mays
  Clone ID: LIB3075-005-Q1-K1-G8
cccacgcgtccgaccgcgagtatgccgcaccctcccgctctcgctactaggccacgccgtccacccccttgacctccgcctcgcacaccaagtgaagcacgcgccaccacattcatccgttcgcgtgatggattcggaggcacatcgcacgcatggagatctggggcaatccactgtcagtttgatgctccggcatgtgcttcctccaataagatttgaaggtcagatgctagtggatcagcccgatggcaatcgaattgcccttgcttgagttgtgatgagcatttggaaatgctgctcttgcaaggacgttgaccatgaacacaaggaaaatatgttttttttctttgcttattaatctgcagattctagggcgccatgtttatttctttgcttctatctttgtttagtcagctaggaattacaatcgggccaggaaaacaattagacaagtcccacggtc

SEQ ID NO: 62150 - DNA, 452 bp, Zea mays
  Clone ID: LIB3075-005-Q1-K1-G9
cccacgcgtccgggtgggttggcttctcctccccctccggttcgggttcgggttcgtgaggttgtccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaagcggcggctacggcggtggcgggcgccgtgatggcggcggcggc

SEQ ID NO: 62151 - DNA, 396 bp, Zea mays
  Clone ID: LIB3075-005-Q1-K1-H1
ctctctctctctttcatttctatagccagcaggtagcaggcaggcaaccggccggtatattagtagatcttcgatcgttcatccaagctaataagtcagtaagcagcagtaggtcgaaaatggcgatgaggtcgctagcgctactggtcctcctcagcctgctggttgttggtgtggcgcaagcggtggagttggagatggagttggtgcctgctgatgcaattgcgatgactatggatcatgagccgccgcaagagtgcgcgaccccggtgagcgtggaagaagcgtgccgcggcgcgtcggagacgcacgccggcgtggcctacgaccactgcatggcgtcgcttggcgccgacccgcgcaacaaggaggccggcaacaagaacatgcacgcgc

SEQ ID NO: 62152 - DNA, 449 bp, Zea mays
  Clone ID: LIB3075-005-Q1-K1-H10
gcacttcaaaaccagccaattgttaatgctgtcattgatggcgatgacatcatatacagagactacgtagacgtcagtgttgctgttggcacttccaagggccttgtggtgcctgttatccgagatgctgataccatgaactttgctgacattgagaaagggataaacaaccttgcaaagaaggcaaatgagggggcgctctcgattgatgacatggcaggaggaacattcactatctccaatggtggtgtctatggaagcctcctcagcacacctatcatcaaccccccacagtcgtcaattctggggatgcattccattgtgcaacgccctgtggttgtgaatggtgacattctcgcaaggccaatgatgttccttgcgctgacatatgaccacaggctgatcgatggcagagaggctgtattcttccttcgtcgcatcaaggatgt

SEQ ID NO: 62153 - DNA, 428 bp, Zea mays
  Clone ID: LIB3075-005-Q1-K1-H11
aatgtcaaatttaaatactttattacattaacgattcattagcacattctcacgtagttttgcacgcagacaattattaagcaaaagcgatattctaaacttgagcatatgcctccacaggacttctcctgaccgaccggggacaccaagaaggtacctgtggtcatctttagtaaactcgacacgacaattgcgtaattagacaatttagtaatccgctgcggtaggtactttgctcgtcccttcttgcacaaacgaaagagacagtgagaaaaaaaaatgacttgggtgacaactgacaagatgatgaggggagcacgcgcacagcgaaacggcgcggcctggcacagtggcagtggcaccccgaaggcccgaacacctactccgatgatccatctactgcttggcctgaccggcgccgcggagct

SEQ ID NO: 62154 - DNA, 416 bp, Zea mays
  Clone ID: LIB3075-005-Q1-K1-F9
gaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggcatcacggcgccggccatgaaggtctgccaggaggagtgcgacaaggcgtacgtggtgaaggcggccgaggtcaccaaggcctgcagcgtcacctgcgccaaggagaagaacccgcgcctcagcgagaact

SEQ ID NO: 62155 - DNA, 434 bp, Zea mays
  Clone ID: LIB3075-005-Q1-K1-E4
gccgcatgagtgtccagtctgctcgcaatactttgtgcttaaggtcattggtgatggtggtgatccagatggtcatgacgatgaagatgatggacatcactaaggatgccttgtggttctgaaaataagaacttggtgaggcagatgaatccaatacacttcttttttctagaaccagactgctccacggcatccttgtttatgaaaagacagttggccatcaagcaggtggtagttttcacctaggtattttgtccaaacaaaagctgtttgagatttgacccatgcgtttctttaagagcatcgtcgaataaaagatgactgcagtcagattgctttcttttgatacctcatattggcccatcgggtgtgatggacatgtaatattcagttatggaacagccccatttctatgcttagcgtgctgggaattt

SEQ ID NO: 62156 - DNA, 200 bp, Zea mays
  Clone ID: LIB3075-005-Q1-K1-E5
aaaaaaaaaaaaaaaaaaaaaaaaaataaaaaaataaaaaaaaaacaaaaaccaagaaaggggatggcaacaaagcaacgcaagcatgcaaagacaattactctactatagcgaaaggtaaatacaatttgctggcctttatatgacatagtctttccatgacaaaagccgcgatcaaacaaaatttaattgacttgcat

SEQ ID NO: 62157 - DNA, 421 bp, Zea mays
  Clone ID: LIB3075-005-Q1-K1-E6
gtgatttattcatactgaagcgcataatggtggagaggggaaatgcagcttacttgagtggattgcgggagaaatactttggggaattattttcaaatgcttccaggactcttgaaggtttgtcgaggatagaatcatcgactatctcagtggacatgctatatgatcctgatatccatctagaaaagaacttgtcagctactgaagaaccacttaagcatgtggctaggtttatagaatcttttgaatcagaatcaagggaaatttggctggtgtatcacaatgaaggccactcattatcaaaattgatatatacagctgaagaaacgaagttagtcactggcaacaataatgagagggtcagacatatccaagttttgcacccatcgaagtggtggcattggctaaggacaacaaaagc

SEQ ID NO: 62158 - DNA, 401 bp, Zea mays
  Clone ID: LIB3075-005-Q1-K1-E7
gttgccgctcgctcgccgtgccgcaatggctacggccgtcgcctcccatacgttgctctcctccgccttcgctccgcgccactaccaccgccgcctgacccggaccgcgtccgtggggccgtgccgggccgccccggtgggactggccgtgcggtgcgagaagagcgacaagcagaagaggcagccgctcgccgcgctcgtgccccgcgagcagcgcttcatgttcgagggagacgagctctgcggccccgacatatggaatacaacctggtatcctaaggctgcagatcatgtaactaccgagaagacatggtatgttgttgatgcaacagacaagatcctaggcaggctagcatccaccattgcagtacatatcaagggaaagaatgaacccacttaca

SEQ ID NO: 62159 - DNA, 395 bp, Zea mays
  Clone ID: LIB3075-005-Q1-K1-E8
gttctagatcgcgagcggctgccctttttttttttttttttttttttagactaaacatatattgattagttaatctatgaatgtggcttgtatttgtgtctatatttattatcattcattcgaacgattgacagaaaaagaaaaagagtgctaaaaagaacgagtattcactgacatttcgtggcattgttctccgtcaaggaggtgctactctacgctaccaaaaggccaaagagagagctcacagaaatttcctgtccttttctgcaagcacaaaatttccgaaatctctgccgactaataataattctaattacgcgaccgatgatcgatcaaatcactagaccaaattctgcgttccatcgaggacgagtattgggctgcgaacagagtac

SEQ ID NO: 62160 - DNA, 426 bp, Zea mays
  Clone ID: LIB3075-005-Q1-K1-E9
atctccatgtccaactgcgaggacggcctcatcgacgtcgtgcagagctccacggggatcaccatctccaactgccacttcaccaaccacaacgacgtcatgctcttcggcgccagcgactcctggccgcaggaccagatcatgcagatcaccgtcgccttcaaccacttcggcaggggcctggtgcagcggatgccaaggtgccgctggggcttcttccacgttgtcaacaacgactacacgcactggctcatgtacgccattggcggcggcgacgcgccaaccatcatcagccagggcaaccgctacatagcaccaccaaacatcgccgccaaagtgatcaccaagcactacgcggaagaaggcgtgtggaagaactgggtgtggcacacggaggacgacctgttcatgaacggcgccatcttc

SEQ ID NO: 62161 - DNA, 389 bp, Zea mays
  Clone ID: LIB3075-005-Q1-K1-F1
cgacggcaccatcatgaccatctccaaggaccgcgtgaagccgtcgccgacgcccgactcgtggaagctcaaggagatcttcgccacgggcatcgtgctagggacctacatggcgctcgccacggcgctcttcttctacctggcgcacgacaccgacttcttcaccaacgccttcggcgtgcggtccatcaaggagaacgacaaggagctgatggcggcgctgtacctgcaagtgagcatcatcagccaggcgctcatcttcgtgacccggtcccggagctggtccttcgtggagcggcccggcgcgctgctggtgatcgccttcctggcggcgcagctggtggcgacgtgcatcgccgggtacgccaactgggagttctgcaagatgc

SEQ ID NO: 62162 - DNA, 465 bp, Zea mays
  Clone ID: LIB3075-005-Q1-K1-F10
atcacgacaagatggcatgcacaaacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggcgacttccttgtcggacaactcaacttcacaggcccttgcaagggcgacgtgaccatccaggtggatggcaatctgctggcgaccacggacctaagccagtacaaggaccatggtaattggatcgagattctacgcgtggataacctggtcatcaccggcaagggaaaccttgacgggcagggcccatccgtgtggagcaagaactcctgca

SEQ ID NO: 62163 - DNA, 366 bp, Zea mays
  Clone ID: LIB3075-005-Q1-K1-F11
cgaaatgatgcgagtaaggacaatgagatggttcaagcaacatctaggttagattgggattctatggttctccgtgatgtttgggaggaggaatggggacatgatgtttgagatgcagatgtattctcaacttggacttgctgaagaggacaatgctgaggaaagtagaagagaggaagcctttagaggtgttacaagggattttgaacaatctgagcatgttatgtttttggaagagagccttatagaccaagctttaaataaaaaaacacaaaaaaaaaaaaaataacaaaaaaaaaaataaaaaaatatactaaaaaaaaaagaacataaatacatacaaaaacgatgataaaatcaataaag

SEQ ID NO: 62164 - DNA, 172 bp, Zea mays
  Clone ID: LIB3075-005-Q1-K1-F12
gtcttcttcccccccggagaaaagtgcttccgagaataaatttttttccatcggaatgtctgaaactatgttgggtgtatcctagtggttggttgagcattaatggctcatattttgtcaggtctatgtgtcgccgtgaaacttttaatcaaatcagttcactcttttgcct

SEQ ID NO: 62165 - DNA, 306 bp, Zea mays
  Clone ID: LIB3075-005-Q1-K1-F2
aaaaaaaaaaataaaaaaaaaaaaaaaaaaaatttaaaattataaaaaaaaaaaataaaaaaaaggagaattgaaaaaacaaaaaaaaaaaaaattaaattaacatgatattatatttttttttaggaaatctgataattattttacatgatggtttttttatatgacctataacttttaaataaccttggttgatcctctttttttgcctgatagtgatttttctttttgacgtcgatgtgataaacatggggatttttgcaatttacattcttatgaagcttctatgctattttgaatatttta

SEQ ID NO: 62166 - DNA, 463 bp, Zea mays
  Clone ID: LIB3075-005-Q1-K1-F4
gaaaggggaagccgccactgacgctcgcggtacacccctagccgagcctcgctgttgggtgctggacttccctggggccttcctgggcgattgcgcgacgttgtcgggggtggatcgaccactgtggcggcatcaattgctcatcggagaaggaaggccgccgcagattgcgtctctccgtggaccgccctcacttcgacgtcatggctgcagtgaggacacgtgtcatctgaagagcaagatggtacctggaatctcaagtcccaggtcaagaacaggtaccacaggatgaggcgcttggaggatgttgtgacgagttcgtgagaggtctaggccgtcgtctcacagtcaactttgggttgctggaccgttgtctccttataatgtaattatttattttggatagaattcctggtatgtagtaaatatgtgatattcgatcctgtgccatgattcatcatat

SEQ ID NO: 62167 - DNA, 397 bp, Zea mays
  Clone ID: LIB3075-005-Q1-K1-F5
gtccgatactgttactgatgatgagttgaaggagatgtttggaaaatatggaaccataacaagtgctgttgttatgcgggatagtgatggaaattctaggtgttttggatttgtcaattttgaaaatgcagatgctgctgctcaggctgttcaagagttgaatggcaagatattcaatgataaggaactgtatgttggaagagcacaaaagaagtctgaaagagagatggagttgaaggagaaatttgaaaagaatattcaagaggtagctgagaagttccaaaacactaacttgtatctgaagaacttagatgataacattgatgatgaaaagttgcgtgaaatctttgctgagtatggcaatattacttcttgcaaggttatgcgggattcttat

SEQ ID NO: 62168 - DNA, 463 bp, Zea mays
  Clone ID: LIB3075-005-Q1-K1-F6
aacatgaggcaccatgccttattcaggcggtttataagtgctcttactagaggtggacctggagggttcccaagaccaatagaagtgcatgcccatgatcctcttcgctatgtaggcgaaatgctgggttggctacatcaggccctggcatctgaaagagagcttatagttgtcttgcttgatcctgatgcaatgactgacagtggtccaacttttcgacgtcagtctggtagagatggtgattcttccaaaggagaacctgatgtaacttctgtgcttgatagaatatttgaaggagcatgtcggccatttaaagttcgagttgagcaagttttgcagtcacagccaagcctgatagtttctttcaaacttagcaataccttggaattctattggtacacgatatcagaactgctgggtgaagacactgcgctgtgcaatacaatatggtcacttagagatg

SEQ ID NO: 62169 - DNA, 435 bp, Zea mays
  unsure at all n locations
  Clone ID: LIB3075-005-Q1-K1-E12
cttggagatgctctaaggcaccgactcgccggtgacagagagagagaccgacgcgccggcagatcccaagctcaccctagagggggaagagggcgaccgaaggcggcgatgggtttcatcatggacttcgcggagaatctgatcctccgtctgatggaggacccggacaagcgcgaccaggttcggcgggagcatgtctacaagatgaaggagcggtgcgagcgcactaaggcggcgtggagcctccctctgcgcccctacggcttctggaccttcgaccgcttcaactcgcagctctcctgggatccccagatcagccaggccgccggccgtcgggacccctacgacgacctcatcgcacgccactctggctcgccgncgtcttcctgaacacccgttccgatctttgcccagaagtctacttgngcatcaata

SEQ ID NO: 62170 - DNA, 382 bp, Zea mays
  Clone ID: LIB3075-005-Q1-K1-F7
atcgtcactcactgcatcgttcgttcatccatcaactactggaaattagagagccggatctcttggtcggagaacctgcgaggaaggactaaggagtcgaagatgactgcggcggtgctgtccgtgcgcacgacgacgacgtcgctgctagcagcagtcatcctgtgcctctgcatcgtctccctctccccccgcggcgccgctgccgcgcgggtctcccccggcgccagcccgatcgcggccacctgcatgacgggcccgtacccggagctgtgcgtgggggagctgggacagcggctgctggacgtgcagacgtcgatcgcgtccgcggcgcccgaccagcgcgcggccaggatcgcgggcgccccggtgcaggtggacg

SEQ ID NO: 62171 - DNA, 166 bp, Zea mays
  Clone ID: LIB3075-042-Q1-K1-F7
gcgcagacagcatgggcggacgcgttgcctatgtacctgctaaagactctcaaggaggaaacagtgctcgttgatgtgttgatctgatcatgacacccacccaacagtaatcgtctgggctcttattgaagatgacatgaatgaacttcatcgacaaattcatatt

SEQ ID NO: 62172 - DNA, 318 bp, Zea mays
  Clone ID: LIB3075-042-Q1-K1-F9
acctcgcatgcgcattttacaaggcactgggctattctgttggaaaatctctcgtgcaagaggataaacttcgatctcgcatgcttaccttattcgcaagagcgaacgcatccgggggtcctcctactgcttgccactgatattcttaagcggacaggttgcaacttatgctgacagcatgattgtccctgcgactgctatgcccgatgactatacgagtctagatgttaagcctgatgcctccaacacgttcaccttcaccttggactaccccatgactgacacttagatcgacctgacgccagtgtttgaggctga

SEQ ID NO: 62173 - DNA, 388 bp, Zea mays
  Clone ID: LIB3075-042-Q1-K1-G1
gcggcaatacggagcaaacagatagttaagcgtgctaccttttacttgggaaaatctgagaaaggagtatattgtgcgttgttgtattgggcccaggatgacagcgacccccagtttcgagtctggtctcttatggaggaagagatgaatggacgtgatggacaaattcatatgaagtggttgataaagactagcatcagccttaaacccctgctggcacaacttcatcattgtggtcacgacttgactccagatgaatggaggatcatctataaccgccatgaccgtgaccttgttagttcgtctgcacaagatgatattgatgatgaatgggactttgaaaatgctcatgagattgtgcttgaagcacctaacactgtttatgact

SEQ ID NO: 62174 - DNA, 308 bp, Zea mays
  Clone ID: LIB3075-042-Q1-K1-G10
ctcggtgccaattgcagctgaggttctgaagcagaagggtgcctactatcccaagaagctgttcgggtctacgacattggatgtggcatgggctaagagattgacaggcacaaacgaagagctggatcatttgtatagggacgtggaggagctgaacttcattgtgaagggagctaaccagctgtgcgcgcaagctcgtcgcctaatatgccgtctagctcgaacgtgggagcttgcgcattcctgggtctggtttgctccacgatttactcttgtcggctgattgcttgctgtatcatgcatgtatt

SEQ ID NO: 62175 - DNA, 274 bp, Zea mays
  Clone ID: LIB3075-042-Q1-K1-G11
cttttccgacatataattcttgaaaacaacgtcattaaacctgtaacaaacagcagagatgcacaggaggtgaaactagagcaaggaatggagatgctgaagatctttaagaaccatgatgatgatgcatcgatccttgacgactttgagttttacgaggagcgtgagaaagcactgtaggaaaataaggcacgcttgcatcagcaacatctacccagttctattgttgttgagcccaagaaacccttgactgcacccagtgacctcgtgggcc

SEQ ID NO: 62176 - DNA, 256 bp, Zea mays
  Clone ID: LIB3075-042-Q1-K1-G12
tcggactcctctctagattggatcgaattccttcgtttctctcctcaccgaggacggcggatagagacgaggaggaaaggcccggcgcgacggagaaggcgtcaacgtcaatttggttgtgctggttcagttttgtcagagctctttttcattcttgcatgcaaattttcgcagctgaatatctgatatgggtgaaaccatgtgaaggataacagtcagtggccttcttgtcaccatatgaggctctattcttgtc

SEQ ID NO: 62177 - DNA, 156 bp, Zea mays
  Clone ID: LIB3075-042-Q1-K1-G2
cggacgcgtgggcacgattagcaattagagttagactctgcttttgctttttcggcgtggatgaaatagttagcgggaacggcaaataagcacttttttttgtagaaaatacacaaagctttttttttgtgggtgtggttaaaaaagatggataaa

SEQ ID NO: 62178 - DNA, 334 bp, Zea mays
  unsure at all n locations
  Clone ID: LIB3075-042-Q1-K1-G3
cctcctcctacgccgcgctcaacgggatcctctactgcaagatccatttctcgcagctggtcaaggagaagggcagctacaaccacctcatcgagacggcgcagaccaagaagaacgaggccgcggaggccgcagaggagccatcggtggacgcangcgccgcggctgaggcggaagcgcccgcggaatcggcgtagaacgaagagtagccgcgtgtgtatctcctaattatacgaactctgcattcagtaagtagttttcacaaatctatatatgttgttgttatgctgcagcttgggtttggtcagtctgggattgtaacacgtgtatgttg

SEQ ID NO: 62179 - DNA, 315 bp, Zea mays
  unsure at all n locations
  Clone ID: LIB3075-042-Q1-K1-G4
atcccctacgactacccggagttcgtcgccgacctggccaagcaggtgaagcaggggcagatcaagctggagcgcatcgacgacgccgtcagccggatccttcgggtcaagttcgccatgggcctcttcgaggacccgctcccggacccgcgcctcaccaaggagctcggcgcgcaggagcaccgggcgctggcgcgggaggccatccgcaagtcgctcgtgctgctcaagaacagcaagaaggggcaggcgaagccgatgctggcgctgcccaagacggccaagaagatcctcgtcgncggcagacacgcccac

SEQ ID NO: 62180 - DNA, 267 bp, Zea mays
  Clone ID: LIB3075-042-Q1-K1-G5
gcgcgagcgcaacccaaccaccatcaagaactacggcatctggctgcggtaccagagcaggacggggtaccacaacatgtacaaggagtaccgcgacacgaccctgaacggcgccgtggagcagatgtacaacgagatggcctcgcgccaccgcgtgaggtccccctgcatccagatcatcaagacggcgacggtccacttcaagctgtgcaagatggacaacacgaagcacttccacaactcggcgatcaagttcccgctcgtgta

SEQ ID NO: 62181 - DNA, 145 bp, Zea mays
  Clone ID: LIB3075-042-Q1-K1-G6
accatgagcaattacagttacactcttcttttgctttttaggagcgggttaaattgggggcggtaggggaaaataagctctttatttttttgaataaacacaaaacttggcttttgtatgtatagtttaaaaagattgactaata

SEQ ID NO: 62182 - DNA, 243 bp, Zea mays
  Clone ID: LIB3075-042-Q1-K1-G7
actcgaaaatgctaacaacaagcctcttgctccttaacaacctaaacactgtggggcgcgacggaacgatcgggggccccaagttcttcaacatgccgctgatgctaatgaagaacatccggatgacgcgggctcaagatcagcgcgcactccaacagacccaacacggatggcatccacatcgagcgcagcagcgggatatccatcatggacacgcacatcagcacgggcaacgactgcatc

SEQ ID NO: 62183 - DNA, 198 bp, Zea mays
  Clone ID: LIB3075-042-Q1-K1-G8
cccacgcagtctatatgcttcgacgagaggtgggtcatctcgcaccacactcctgatcttgcgctcgtccatgctcgagcgtgcctagagattatggtgacccaaacagataccccgatgacctatcatgagcaataattgcctcttcgcaagggtgaatcccctctacaaacacacaagtctgtggcgaacatgacg

SEQ ID NO: 62184 - DNA, 362 bp, Zea mays
  Clone ID: LIB3075-042-Q1-K1-G9
atcaccgtgatgctctccaagttcttccacatcaacatcgacaactcagagagcatcaccgtgaaggacgtgaacatcaccgcgcccgccgacgttgagaacacggacggcgtccacgtcggaggctcctccaagatcagcatcctcaactcgaccatcggcaccggcgacgactgcgtctcgattgggcccgggtgcaacggcgtcttggtggacagcatcacctgcgggcccgggcagggcatcagcgtcggctgcctaggccgctacaaggactagaaggacgtgagcgacatctcggtgctgaactgcgtgctcaagaacaccatcaactgcgtgcgcatgaagtcgtacgtggacgc

SEQ ID NO: 62185 - DNA, 431 bp, Zea mays
  unsure at all n locations
  Clone ID: LIB3075-042-Q1-K1-H1
cgcaaggactgcaaagtgctgccaacaagcgtgttgttcgtgaacaaccagaacacggtggtgcgcgacgtcacgtccgtgaaccccaagttcttccacatggcgctgctgtcggtgaagaacatccggatgagcgggctcaagatcagcgcgccctccaacagccccaacacggatggcatccacatcgagcgcagcagcgggatatccatcatggacacgcacatcagcacgggcgacgactgcatctccatcggccagggcaacgacaacgtggacgtggcccgcgtgcagtgcggcccaagccacggcatgagcgtcngcagcttgggtcgctactccggcgagggagacgtcacacgggtgcacgtgcgcgacatgaccttcacgggcaccatgaacggcgttcgcatcaagacatgggagaactc

SEQ ID NO: 62186 - DNA, 376 bp, Zea mays
  Clone ID: LIB3075-042-Q1-K1-H10
aaaaaagcagcgcttgccgcacagtttgcagctgaggcaacactacgaagggttcatgcggcacagaaggatgatgacatgcctcctattgaggccatccttgcaccactggaagctgagctgaaactggcccgtcaagagattgcaaaattacaagatgacaacagggcattggatcgtcttacaaagtctaaggaagcagctctgcttgaagcggaaaggacggttcagatggcactggcaaaagcttccttggtggatgatctgcaaaacaaaaaccaagagttgatgaaacagattgagatatgccaggaagagaacaaaatcttggatagaatgcaccggcaaaaagttgctgaagttgaaaagctcacgc

SEQ ID NO: 62187 - DNA, 350 bp, Zea mays
  Clone ID: LIB3075-042-Q1-K1-H3
caccgttcccctgcatcccaggccagccacggcccccgcggttgccaccttgcccgccggcgccaaccgagtgctacacgtggctgtcgggaatgatgccgtgcgcggacttcctcacccacaacgaggtgccaccgatgccacccacggtcgcctgttgtgatggtctcaggtcactcgtcaccaacgcgtccatctgtctatgccatatcgtcaacggtaacatcaacaagctcctaccggcgcccatgatacccgtgcgcatggtggcgctcccccgcttttgtgttgtccgctttccacgagccatacttcgccggtgtatcagaaggcatttgccaccgatgaac

SEQ ID NO: 62188 - DNA, 264 bp, Zea mays
  Clone ID: LIB3075-042-Q1-K1-F5
aaaaaaaccagcagctagcgatggctggagcccgggcactgctcatcgtcctcgcggctgccgtcgcggtcctggccgcgcggccggcgtctgcaggcgggggagccgcggcggtggcggacatctgcatgaagactccgtcccccgacctgtgcaccaggacggcggggaagcacgccaacaagtacaaggtggtggacgccgtgacggtgctagagatgcacgtggacgcgttcaagaagcgcgtgaaagcggggcggaagc

SEQ ID NO: 62189 - DNA, 334 bp, Zea mays
  Clone ID: LIB3075-042-Q1-K1-H4
gccggcgccgccgcgacaggaggaaggagcagcagcggcaggggaggcccggcgatctcttctgttgcgtgcggcgagggagtaaaaggagccgcgacaggatgcactcctttgggcaccgcgccaacgcggtggcaacgttcgcggtcaccatactggccgcgatttgcttcgccgcctccttctccgacaacttcaacaccccgacacccactgcctgcgttaagatcttgaatctaaactggttccagaaggaagccaacggcaacgacgaggttagcatgacgctgaacatttcggccgacctttcgtctcttttcacgtggaacacaaa

SEQ ID NO: 62190 - DNA, 165 bp, Zea mays
  unsure at all n locations
  Clone ID: LIB3075-042-Q1-K1-H5
caggactgaaagtgctgcaaaagcttgttgtcgttaacaaccagaacacagtggtgcacnacgtcacgttctttgaccccaagttcttccacatggcgctgctgtcggtgaagaacattcgtatgagcggtctcaatatcagcgcgccctccaacagccccaaca

SEQ ID NO: 62191 - DNA, 235 bp, Zea mays
  Clone ID: LIB3075-042-Q1-K1-H7
catcctttgggtactagaaaatgctgagcttgctgctgttgcactatcggctgcatcggcaactgctgctggagttggcatgggtgctgctggcgctgatggcgtggcagctttgggaacaactggcccagctgatgcagctggcttaactgcagctgcaattggggcttctgttgctggtggattaactgcataaaagggtgtggcgcaagatgggctaactgctgcagatcat

SEQ ID NO: 62192 - DNA, 56 bp, Zea mays
  Clone ID: LIB3075-042-Q1-K1-H9
tcgtagttttgtctaataacaagggattgaagttttgttcataatgacaacttatt

SEQ ID NO: 62193 - DNA, 92 bp, Zea mays
  Clone ID: LIB3075-043-Q1-K1-A1
cggacgcgtgggtgttactaaccatataagctatccgttgttccttgttttttgttcgagacaaaggctgttgctgggaaatgttaccaatc

SEQ ID NO: 62194 - DNA, 393 bp, Zea mays
  Clone ID: LIB3075-043-Q1-K1-A10
aggacattgcattcgccgtggcgcgcttcttctccgtgggcggaaccttggcaaactattacatgtaccatggtggaacaaacttcggaaggacatctgctgcctttgtgatgccaaaatactacgacgaggcacctctcgatgaattcggcctgtacaaggagcccaagtggggccatctgagggacctgcaccaggcgctgaagctgtgcaagaaggccctgctgtgggggacgccgtcgacggacaagctgggcaagcagttggaggcgagggtgttcgagatgccggagcagaaggtgtgcgtggcgttcctcttcaaccacatcaccaaggacgacgcgacgatgacgttccggtgccggtcctacttcgtgccgcgccacttcatca

SEQ ID NO: 62195 - DNA, 291 bp, Zea mays
  Clone ID: LIB3075-042-Q1-K1-D7
gaaaacaagccgacggttttactatcggcaggtgcggccaaatgtgctcgctgcagcacctacaacataaatgggggttcatatgagctgaatgtctcgggttctcggggacctaggcggatgaaatgagttatgcactccatacctacctcacgccttgaggctgtgggcactgttaccagccagctggacagaatccttgctagatctactgaagagacattttgcagcatttgcttctccaaagcatctgttgtggaccgcgctatgtgtttgaccagctcaagattc

SEQ ID NO: 62196 - DNA, 419 bp, Zea mays
  Clone ID: LIB3075-042-Q1-K1-D8
gccacgcgtccgcgatcacgacaagatggcatgcacaaacaatgcgatgagagccttggtcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaatgctgtgcatgaggcatgggcatcggcgtgcggcggcactgggaagcagacaatcctcatacccaagggcgacttccttgtcggacaactcaacttcacaggcccttgcaagggcgacgtgaccatccacgtggatggcaatctgctggcgaccacggacctaagccagtacaaggaccatggtaattggatcgagattctacgcgtggataacctggtca

SEQ ID NO: 62197 - DNA, 421 bp, Zea mays
  Clone ID: LIB3075-042-Q1-K1-D9
gaaaggtcgaagcgtcgtctctctcggcacggagcctagtgcccggcctcgtgagatccgggattcagaagcgaggatggcgacgaccgcgactaggcggtggtggaggcggcacgaaggcggcgacgatgacccagacgacctcgtccccatggacacccaagagcaagaagagctggtccggtctctggaggctaagcaggcgcagcaaggccgccgttggaagcgcgtcttcgcggggttcctcctaggttacgcggtcttccttgtctactacagtttccatcatgcttggtctccctgggagctgcggtaccatgcttacttcatggaagatttgcctgcaccaatggtcataattgcaggattactacaaaattcatgcccatcaaagaagtggatgtggtattcttgctatgtt

SEQ ID NO: 62198 - DNA, 298 bp, Zea mays
  Clone ID: LIB3075-042-Q1-K1-E1
cgagaaccccgagaagagcatcgacaccattcacatcgacgggtacgccttcttcgccgtcggcatgggccccggcaaatggacgccagcgtcccggagcacgtacaacctcctggacacggtgagccggcacacgatccaggtgtaccctacgtcgtggacggcggtgatgatgacgttcgacaacgcgggcatgtggagcatccggtccaacatctgggagaggcagtacctcggcgagcagctgtacgtgagcgtcatctcgccggagcggtcgctcagggacgagtacaacatg

SEQ ID NO: 62199 - DNA, 428 bp, Zea mays
  Clone ID: LIB3075-042-Q1-K1-E10
gggtacggctcgtcggctggcgcccccgcctacggcgctccgtctcctgatgccccagcttatggcgccagcgtaccagcaccgacctcggagcagagtactgcttcgactgcatgagtgatatcgcggcggcacacacgcatcttggtcactcctatccatggttcgaattaccgaccgaaaagtctggttcctcggccaatttctcgttcccggtcagctaggggaagcatttctcggcccggtatcacattgtaaaaatatgaaagtcaattttttttgttcaaaacgaaatttcggaacagtgaagcgaaaaagtgaagcctgttccttactatgttcaaggatttttgctctctccatcccacaattttcgagcagtatgtcagcttagaattaggattatttggtgctgcatcattgatgca

SEQ ID NO: 62200 - DNA, 402 bp, Zea mays
  Clone ID: LIB3075-042-Q1-K1-E11
ggaggtgagaatccagggtcaacacgctatcttcatcatcacttctgggcaacagagattatgttgctgggcagatctttgatttagctgataaactagagcaagctgaaggccagctggcacacagtcgatttggtggtatgattatgccttcacaacgaaagaaagagcaagaagagtctccactggctaaggtaacacgagatagctccaaaatcacagctgagcaggttcacggcctcatgtcacaggtcataaaagacatccttttcaactctgttcacccgtcaagcaagggcaggccaaagtgcttcaccagattcatcaaggcctgagcctatggttgaagcctgagttccagcgaaaggggacattggatatttgcgttatgctatctgattc

SEQ ID NO: 62201 - DNA, 413 bp, Zea mays
  Clone ID: LIB3075-042-Q1-K1-E12
cggacgcgtggggttgcggctcatgctatgaggtgagatgcaaggaaaaacctgagtgctcgggcaatccagtcacggtgtacatcactgacatgaactacgagcctatcgctccctaccacttcgacttgagcggcaaggccttcggctccctggcaaagcccgggctcaacgacaagcttcgccactgcggcatcatggacgtcgagttcagaagggtgcggtgcaagtaccccgccgggcagaagattgtgttccacatcgagaagggctgcaaccccaactacctggccgtgcttgtgaagtttgtggcggacgacggtgacatcgtgctgatggaaatccaggacaagttgtcggctgagtggaagcccatgaagctctcttggggcgccatctggaggatggacact

SEQ ID NO: 62202 - DNA, 237 bp, Zea mays
  Clone ID: LIB3075-042-Q1-K1-E2
gttacagtgattaacttggatcctgaccagcctcttgaggttcttgcaagagctggtgttggtgcccgcgctgcacgtggggctcatcccattgaagacattgctaataagggattgaagattgatggtgggagcgctcagaagattgctggacgtggacatgaagggactacatgtctagggccatagaaagtatgctattattatgcacttttgcttggcctatttggttctgta

SEQ ID NO: 62203 - DNA, 383 bp, Zea mays
  Clone ID: LIB3075-042-Q1-K1-E3
gaggaagatgaggaagggctcgggggcggcggaggctgggggaggagggaccgcgggcccgaccccgactacgacccggcccttgacatggaacgcatcgagtcctcgaccgtaaggctattggacgaacagaaaagaatggttggtgtagtatctgtcagcgaggcagttcagattgcagacgataatgatcttatactggcaatattatcaatggatggggaccccccagtacttcgactctttgaggagagagattacaaaaaacataggtgtgaacaacagaagaagaaaaagattcagcaggaaaagatctgtcgcgaaacgcatgggctttggaagagctgaataaggggataccaacatttgacaattcatgatta

SEQ ID NO: 62204 - DNA, 276 bp, Zea mays
  Clone ID: LIB3075-042-Q1-K1-E4
cccacgcgtccgcgacgggagggggagggacactgggattgtgagggataggcggggatcaggaggaagggactcatgcggtagggatgaccaggatgatggggagagggagatccaggagctctgggataccattgctggtggtgagtcagaggatgaccaagaaggtgttagaaccgtagatgatgataatttcattgatgacactggagttgatccagctgatcgttatggcagcgataatgttctacattcacctggacgttatgcacatgc

SEQ ID NO: 62205 - DNA, 143 bp, Zea mays
  Clone ID: LIB3075-042-Q1-K1-E5
ctcgtcggcgtgcgtccgtcccctggccgtctggagaggtgggtggggagtctaccggacgcgggtagccggggcggtagggccaccttgccgatacaaggtgttgggtactatgagcctgcacacaatccagtgtaccctag

SEQ ID NO: 62206 - DNA, 269 bp, Zea mays
  Clone ID: LIB3075-042-Q1-K1-E6
tcggccacgcgtacgcgatcactacaagatggtatgcacaaacaatgcgatgggagcctcggggtgctggggggttctgcatggggcatggtgagaaggaagagtcaaagggcatcgatgcgaaagcgttcgggcctggtgggtgcttcgacatcaccaagatgggcgcctccggcaatggcaagacagacagcacgaaagctgtgcaggatgcatggtcattctgtgtgcggctgcactgggtagcaaacaaatcttatacctaaggg

SEQ ID NO: 62207 - DNA, 224 bp, Zea mays
  Clone ID: LIB3075-042-Q1-K1-E7
gtgaggagggtttctttccgtgcgccgaggtcttggcccgacggtcgtttacttgcaggtgattacctacgggcttcttcgggggattttgagggttgtccgcaccagttgatctgctattctcttgcattcggggtcggttcttgcgaaacctaacttgaccgcaggcatggagcactgctatgtgggacagccgatctccaaggccgatgctatgccctaaa

SEQ ID NO: 62208 - DNA, 429 bp, Zea mays
  Clone ID: LIB3075-042-Q1-K1-E8
gcgacgatgatgccacagctgcggaacctcttcgcgctggtcctagcgggcacggccatggacgactattcgggtgttgggtaggaccatgaaccccagaggctatcgtagcaacagaacttctctctttgatggcattgaggagggtggaatccaagcaacatgctattcttgtcatgagatagatgagcaagaaaatgatggagctattgatggactgcaggatcgtgtcagcattctcaagcgggtgtcaggcgatatccatgaagaggtggagactcataacagaatgctggaccgaatggtgaacgatatggatactttaaggggttttttgtctgggaccggggacaaatttaagattggttttgggaccaaatcaagccggagggtgggaacccttcgtgaattatttattgaccttttttt

SEQ ID NO: 62209 - DNA, 158 bp, Zea mays
  Clone ID: LIB3075-042-Q1-K1-E9
ctcgatcgcgttccctgtaacgccaccactaccgtcaccgccatggctcgcccggatcgtcaacatgtcatccgccctgcgtgtcggcatcacattcctatccttcgtatgcgtctcttttgggctcgccaaagtgtactactgtgagaaaaatctgg

SEQ ID NO: 62210 - DNA, 362 bp, Zea mays
  Clone ID: LIB3075-042-Q1-K1-F1
gcgaggaccaggagaggagctacaagccgccgccgctcgagatggagttggagaagaagtgatgagcagggaggtcaaaagatgggtgccaaacctgtacgtgaacagctgcgactacatctgctgcttctacgctgaccgtagcggcgtcgctaccgtcaccgaggagaagcgttccggagtgcattccaagctgtacgtgatcgccaaaggaccgagcaagttcctggaggctcacgggctgcagcagtggtggtccgatgattctgagctccacttggccgtgcacgacagcaaactcatgtataggcaccttaagtccctctatgtgcaacagtagtagagaaggcattagtactttg

SEQ ID NO: 62211 - DNA, 160 bp, Zea mays
  Clone ID: LIB3075-042-Q1-K1-D6
ggcaatggaactagatgaacaaccttttgatgcaaacataccagattagggaaaataaagtgctcgtccgggtaaatcaagggatgttcaaagtgcttaaatagcacttggttacatgaaacagaagggtatggtacctggtgttattctttacaatgaa

SEQ ID NO: 62212 - DNA, 143 bp, Zea mays
  Clone ID: LIB3075-042-Q1-K1-F11
cccacgcgtccgcccacgcgtccgcctcttctccggctagggtgttcacgcctgccgcggcgaagcttctgccctccccggcgtcgggctctggtcgtcgtcaatcgtgaagattgctgatgtcttttgtgttctatattata

SEQ ID NO: 62213 - DNA, 295 bp, Zea mays
  Clone ID: LIB3075-042-Q1-K1-F12
gcgtcccagcgactacgccggcgacctcgtcacccccaggaagggcacgctacggcacgccgggacccggtcccgggcgctgcggatcaccttcgctcgcgacatggtgatcgagctatgccatgagctcatcgtgagcagagacaagaccattgaccggcgcggagcgcaggtgcacatcgcgggcgcgcaaattacgctgcagaacgtgcgcatcgtgatcactgcacaacctggaccttcactacgtctgggtgcacggaggatgcaccatccgggactgacagcaccactg

SEQ ID NO: 62214 - DNA, 343 bp, Zea mays
  Clone ID: LIB3075-042-Q1-K1-F2
gatggctccctcgggtgtgcgagtggtggcgatcccaggggcgagaggcggtggcgccccgaggtgggcgatcgacgacgatgctcccgaggtgggtgggaaagcggcggcggcactccccttagaccgagtgatggcgtcgctcccgaggcagacgggcaagtggtgagaacgctcccgaagcgggcgagcggtggcagcgcaccctaagcgtggaggcgacggcggttgcgtgaggtgaggtaagcttcggcagcagatgtggcggccacaagagacgcgggtggctccaggagtcgcgcgaggcatggtcaattttgccatggcggcctcaagaggcatg

SEQ ID NO: 62215 - DNA, 258 bp, Zea mays
  Clone ID: LIB3075-042-Q1-K1-F4
gttctagatcgcgagcggcgcccttttttttttttttttttgataacgcggattaccatttctcaaagatcagatcaaaacatggatcaagatccaacacgtccatgtacaaaaactagccactacacatcacgcgaggtggctcccgattattcgacttgctgcacgggtccaattcagttcatcaccatacacgcatgcatcgtggcgcacgccactcacgagcgcggcgcccatgcgcccacaacttattacgac

SEQ ID NO: 62216 - DNA, 346 bp, Zea mays
  Clone ID: LIB3075-042-Q1-K1-B5
cccttcggccaaggagcgtacgcgacagccaccgcaaggggagggacaaaccccacgggcttattattcaaaagaacatggggctcttctttttccgcggggacccgaaagggcttaaacttaagaataacggacggatctgggaagaacagcaaacaccaaacggcgcatgtactccaaatctgtgcagctgattaagcaatcttcaaacaaaccaaaacacacaccttgcctgtcctttctttctaattaatcgtggggggggggctcaaaaggaattatttatttattactaattattaagaagatgtaggatgctcgtgtaaatgaaactgtgtatattata

SEQ ID NO: 62217 - DNA, 126 bp, Zea mays
  Clone ID: LIB3075-042-Q1-K1-B6
gcggccacgcgtccgcatacatgcgtgcataaaacatgaaatacgacgtgatggacaacatccggggtggtgaggtattgacggagcatgcctatgtaagatgaaggtggaccccaatagaaggtt

SEQ ID NO: 62218 - DNA, 333 bp, Zea mays
  Clone ID: LIB3075-042-Q1-K1-B7
tgcagtcatctcctccatcaccaccaaactcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaagatccaatgcgagggcaagtgcaccga

SEQ ID NO: 62219 - DNA, 317 bp, Zea mays
  Clone ID: LIB3075-042-Q1-K1-B8
tgatgacactgatactgaacttgatttggatagcccgacagagggcttggcattaattgcagaagccattgaggacatacaacaaggaaaacttgtgattgttgttgatgatgaatcaagggaaaatgaaggagatctgataatggctgccttcttggttaccccagaggctatggcttttatagtaaggcatgggacaggaattgtttgtgtcagcatgaaagaagatgatctggaaagactgagccttcctttgatggttaccacaaaagaaaatgaggagaagctatgcactgctttcactgttacagtggatg

SEQ ID NO: 62220 - DNA, 428 bp, Zea mays
  Clone ID: LIB3075-042-Q1-K1-B9
agaagaaggatttaaacaatcaaagaaaaggaggcctggtgtttctcctggtgacaggtctggtggtcttgctaaacgagggaaagaaggaaagaacaggagggcaaaggattccatgtttgggcacggtggtcgtaaagggctgaagaagcaaaacaccgctgagaccactaatgatttcagaagctttaaccaggggggtgggtctcaaaacaagaagagaaagaggttttgaacttttgatggatatagtaagaatttgggtgagtctcaaaaccagatgaggaagaagttttgaacctttgctgttattactatccccggtgtggcattattttgttatggtgtgtgccagaatgaaaaattagcttgtattagtctagagaagcatttcaaacacaagggcttatgtcttgctttatctgata

SEQ ID NO: 62221 - DNA, 224 bp, Zea mays
  Clone ID: LIB3075-042-Q1-K1-C1
gcgatccggcccatgtgccagcgagctaatatttaattttttttctttggatatattgaggcaccacacgagccaagaaaaaagttatgctacatgtcccgtctcacgccttgttgcgttaggttgatatgcatgattacatagattaaactacacttttatttaaaaaaaaaaaaaaaaaagaaagaagaagaaggcgaaaaaaatacaagacgacatttgct

SEQ ID NO: 62222 - DNA, 203 bp, Zea mays
  Clone ID: LIB3075-042-Q1-K1-C11
cggacgcgtggtcggacgcgtgggcgatcacattgtctctcactgcatcgttcgttcatggatcaactactggaaattagagagcctcatctcttggtcggtgaacctgcgaggaaagactaaggagtcgaacatgacatgctgtggtgctgctcgagcgcacgactacgactatcgcttctagcagctgtgatcttgtgcct

SEQ ID NO: 62223 - DNA, 434 bp, Zea mays
  Clone ID: LIB3075-042-Q1-K1-C12
tcggaagtggacaagcttgcagagaagacagaaacactggcagtcgcagaacccgctgaacttaacttcactggaatgaagaagaaaaagaagaagccggtggatcttgattcaactcttgatgagcttggagatggggaggacactcaagatgatcaagctgtagaggaacaaggggaaggcattgtgctgggaagtgtccctacatacccttgggagggaactgatcgggattataaatatgaagagctgctggacagggcgttcaacattctacgtgagaacaacccagatcttgctggggataggcgtatgaccgttatgaggccaccacaagttcttagggagggaacttagtagacagcgtttgataactttatggatttgtgtaaaacgatgcatatgctacctgaacatgtgattgatgtttttac

SEQ ID NO: 62224 - DNA, 158 bp, Zea mays
  Clone ID: LIB3075-042-Q1-K1-C2
cggacgcgtgggcggacgcgtgggtggaaatattactttatatggtcaatttcagaagcctcaattatcatatctggtctaggctttactggttgggcgaaatcttttcccccaaaagccaaatggaatcgggcaaaaaaggtggatggattaggggt

SEQ ID NO: 62225 - DNA, 94 bp, Zea mays
  Clone ID: LIB3075-042-Q1-K1-C3
cggacgcgtgggcaacacgtgcggcattgccgagaggggttgcgagagcgacgcttttggaggacgaagacgacgactagggggcgcgccgcga

SEQ ID NO: 62226 - DNA, 328 bp, Zea mays
  Clone ID: LIB3075-042-Q1-K1-C4
cagacgcgtacggaagccaggacatggaaataaaaccgtgatacctgcctactgatgcaagaaaaacaccgagataccacggtgctgaacggagtgatagacgtgctcgaataccaccttgttcaatgcaccgccaggggcaagtaccaggtcttataccttaaaatgaatgatgactaccacatggaccttgctgagttcaaaactagtgcaaagaggaaagatactttttacagcaccatgaatgcctacacaaatggtcacgacattggtcttggaaaaatgggtgtaaccacaccccatcaagcttggccttggtttcaactta

SEQ ID NO: 62227 - DNA, 291 bp, Zea mays
  Clone ID: LIB3075-042-Q1-K1-C5
gcgacaggcgacgcggtctttgtccctggttcacagggcgcggggcccctgcacagcgaccaaccccatcgggcattgctggcggtgccgacgagactgggcccccgaccgtaagcgcctgtgcaggcgcaccatgggcttcggtcacatgacacaccggcgggctggccggcaagttctacgtggtgattgaccccagcgacgacgccgccgacctcgtcacccccaggaagggcacgctccggcacgccgtgacccgggcccgggcgctgtggattaccttttcgcgcg

SEQ ID NO: 62228 - DNA, 216 bp, Zea mays
  Clone ID: LIB3075-042-Q1-K1-C7
gactgattgttgttcctttttctccctttctaaaatctaggttggataggagctccgaacgggagccatagacggagagttgatgccaccgcgcaatggatgggtggatgctcacgacctccgcgtgcaacaacaggggtaagaactcgtccccttcctctccggcggcgaggttacgatcttcctctgccgaccttgaactttaaaaatgagaac

SEQ ID NO: 62229 - DNA, 304 bp, Zea mays
  Clone ID: LIB3075-042-Q1-K1-C8
gccgcgggaacgaggcgcacgccgcctccatgcgcgcctaccgctccaagatcgagaccgagctcgcccggatctgcgacggcatgctcaccctgctcgactcccacctcgtcccatccgccggcggcgccgagtccaaggtcttctacctcaagatgaatggtgactaccacacgtaccttgctgagttcaagtctggtgcaaagaggaaggatgctgcggaaagcaccatgaatgcctacaaagctggtaaggacattgctcttgcaaatctgcttccaaccaacccaataaggctgggcct

SEQ ID NO: 62230 - DNA, 387 bp, Zea mays
  Clone ID: LIB3075-042-Q1-K1-C9
gtggctgccggtggagagagcgtcccatggggctggtcggcgccgtgttccaagtcgtcttcgatctgtcccccggagtttaccagtaccggtttttggttgatggcgtctggaggtgtgatgagacaaaaccctttgtacgtgatgaatatggactgatcagcaatgaagtgcttgtggaaaacaatgtacaacctgttgtgcagtcagagccttctatcagaagaactaatatggataagggttccatcttgaaaacaatgcccccggagccatcatgttagaacccaagcatgcaaatagcagttatccgtcatgtgggctctggaatattattacacaataccatatatgacggtgtttcacttttagcaagttaacaggttt

SEQ ID NO: 62231 - DNA, 276 bp, Zea mays
  Clone ID: LIB3075-042-Q1-K1-D10
ctcgcgctcgcagcggcggcgggcggcggctgcttctccgtctcctccttccccgcaaacttgtctcgtattcctagcgcaggcggggaacactcccggcctccgcccgagcggagcggagcgtttcgtccgcgccgctgactccgaggagttcattttgccgcgctgtctccctgaatcctacacgtccttctcgcgtttggctcgactggcgcgttgattccttcttctttcgttgttgatgtgcagatctcccattctctttttacaagaact

SEQ ID NO: 62232 - DNA, 412 bp, Zea mays
  Clone ID: LIB3075-042-Q1-K1-D11
ggcgagcaggatggaggacctggaggccattgtgatgctggctgcgctattcgttgttgggttgtgcaccacccccctcacgttccaggtcggcaagggatccaagcctggccacctgatcctcacccccaatgttgccaccatatccgacgtggagatcaaagagcacggtggcgatgacttctcctttacgctcaaggagggcccgactggcacctggacgctcgacaccaaggccccgctcaagtaccccctttgcatccgctttgctgtcaagtccggcggctaccgcatcgccgacgacgtcatccctgccgatttcaaggccgacaccacctattagaccacactcagcatctaatcaatctctggtgatgaattagatttcaaaagagctcatctagcgcacatg

SEQ ID NO: 62233 - DNA, 199 bp, Zea mays
  Clone ID: LIB3075-042-Q1-K1-B4
ggcagtgctgccaaggcacctgagtctgacaagagaactgctgcccccgctgaagcacccgaagccgcatgcacccccgtcggcgccgctggcccatcgacgttgtctatgaagtctggtccagataccgggccagtcaccgacttttcaccccctttttccaccgtcgaagagctgaggcctttccctccatcattca

SEQ ID NO: 62234 - DNA, 409 bp, Zea mays
  Clone ID: LIB3075-042-Q1-K1-D12
ctttatctcctctcgatcgatcgcttcctccatcgaggcggtaaagcgccgcccagatcgccggaagcaagcggcgacctcaccagctccgagcagcagcagggaggctcgtggaaccattagtcgttttctggcagcggcatggaggggctgagctggagaacggtgtgttgtttatcggtgctctgtgccgtgctgttcttgcgcccggccgagggcatccgcttcgtgatcgatagggaagagtgcttctcgcataacgtggaatacgagggggatactgtccatgtatccttcgtcgtcatcaaggctgacaccccgtggcattacagcgaggagggcgtcgatctttgggttaaggatcctaatgggcgctaagtccgtgattcccgagataagactagtgaca

SEQ ID NO: 62235 - DNA, 283 bp, Zea mays
  Clone ID: LIB3075-042-Q1-K1-D2
agcgtacaagtccattgagtgttgaatggcctccagggaagtagttggtggcaagaaataagcaataaccgaccagtctcgtggctttgtttcaagagccgctttgcggtatatataacttgatcaagggataattaatgtgattcttctgcaagtactgattataatatgctaacctgaatatattgtctaactcggacattttggggatattgaataaacaatgggagtgtttttttctttcttgcaaaaaaaaaaaaaaaaaagggcggcggtttaaaag

SEQ ID NO: 62236 - DNA, 103 bp, Zea mays
  Clone ID: LIB3075-042-Q1-K1-D3
cccacgcgtccgcccacgcgtgcgcccacgcgtacgcccacgcgtccgcccacgcgtccgaccacgcgttcgcccacgcgtccggactagttataaatcggga

SEQ ID NO: 62237 - DNA, 229 bp, Zea mays
  Clone ID: LIB3075-042-Q1-K1-D4
aaaaaacataaaaaaaaacatacgaaaacacaaaaagatggcttgcacaaacaaagcaaatgagaaccttggggctcctggtggtcttctgcatcgtgcatcgcgagaacgaagagtcaaacggcatcgatgcgaaagcgtacgggcctgctgggtacttctacatcacctcgttgggcaccttcggcactggcaagacacacagtacgaacgctgaacatgaggtatg

SEQ ID NO: 62238 - DNA, 324 bp, Zea mays
  Clone ID: LIB3075-042-Q1-K1-D5
cgcactgcagagagaggaagtattgaaacagacggttccagatgagaaaaacaaacatgtagaagcaattggagcagttgagatggcaaaaaatgcatttacacacgagacctattccaagcaccaggctgagaatgctaaggctgtggatgcccttttatcaacaggcaaaagttgcaggcggtactcgaaacatgaaatagagctcgccactgattacttttctgatgcaaagaagattggtgagggtggctatgggaatgtatacaggtgtacccttgaccacaccgaagtagctggtaaagttgttgaacaaagattcga

SEQ ID NO: 62239 - DNA, 200 bp, Zea mays
  Clone ID: LIB3075-005-Q1-K1-C5
acgcgtagggaccttagcactcatgcaagccgactttcgatttaccaccgtgccaacccgagagagggatggtgatgatcaagaggatcctcatcgccgcgctcctcgtagacggcgtcttggccaccgcattgctggccttcaccgaggccttcgccgtcggatccccatgcggcttcgagtcgtctgcgttcggctaa

SEQ ID NO: 62240 - DNA, 358 bp, Zea mays
  Clone ID: LIB3075-005-Q1-K1-C6
tgtgaaccatcaagtctgcctcaatattttccaatcaaagagatggatgccaaaccaagggacgaggaagctatacgattaaaggctgctggtggtagagctaatggacatggaacaaggaagacaaggacacggtaccggcctagggctgttccagctccagaggcaaacgccgaactgcaagcaaatattgataaaagaaggttaataactcatgcaaatgcgaagagcaagagcgaaaagttcccttcgccgtatcaggattgcgcacttggatttaccttgggctgcttcaaccacattgaatcatcatttgaactcctaaacccttcttactttaacactttatttacttacg

SEQ ID NO: 62241 - DNA, 427 bp, Zea mays
  Clone ID: LIB3075-005-Q1-K1-C8
gttgctgctgattggagtatatgtcgatgatctggtaattactgggtcaaacaagagaatagttgatgctttcaagaaggagatgatgagaagcttcagtatgagtgacttaggactattgagttactatctgggtattcaggtggaacagaagtgtggagtgactacattatgccagagctcatatactctgaaaatactcgagcaggcaggcatgaaaggctgcaatgcttgcagtgtaccgatggagaacagactaaaattgagcaagaaagatgagtcaccgcctgttgacaagacaaaatacagaagcattattggaagcctgaggtatctagtgaacacaaggccggatatagcctttgctgttgggattgttagcagattcatggaagatccaagagcaaaacactgggcagcagtcaag

SEQ ID NO: 62242 - DNA, 389 bp, Zea mays
  unsure at all n locations
  Clone ID: LIB3075-005-Q1-K1-D1
aaacctttcccccttctcccaattcccgccgccgctccatcccgtaacgcgacaccatgagggagtgcatttcgatccacatcggccaggccggtatccaggtcggaaacgcgtgctgggagctgtactgccttgagcatggcattcaggctgacggtcagatgcccggtgacaagaccattgggggaggtgatgatgctttcaacaccttcttcagtgagactggtgctgggaagcacgtgccccgtgctgtttttgttgaccttgaacccactgtcatcgatgaggtgagaactggcacctaccgncagctcttccaccctgagcagctcatcagtgggaaggaagatgcagccaacaactttgcccgtggtcactacaccattggc

SEQ ID NO: 62243 - DNA, 453 bp, Zea mays
  Clone ID: LIB3075-005-Q1-K1-D10
gcttcggtggtccaccatggcgcagcgagcggtggccacgatgacgactaataagccccttctcctcctcgccctggcgtccgcgctccttggtgcggcgccggccgccgcgaacgcgcccggcggggcgttcagcaactgggtggcgatgaaccagcagagctacgcgctgtacgcgcagaagtccgtcggggacgggggcaaggagcccctggacaagaagctgtcggaggcggagaagaagaaggtcacgtacgtggtggaccccagcggcaagggcgactacaccaacatcaccgcggcgctggaggatatcccggtgagcaacaccaagcgcgtgatcctggacctcaagcccggcgctcagttccgcgagaagctgttcctgaacatcagcaagccgttcatcacgttccggtcggaccccaagaagcccgtcgtcgtggtctggaa

SEQ ID NO: 62244 - DNA, 453 bp, Zea mays
  Clone ID: LIB3075-005-Q1-K1-D11
ctcgctcactcccgagtccctatcgcaaccgttctccacattccccagagttagcccgatcagatcgtttttccctcgaggtgagagtaagatgagggagatcctgcatatccagggagggcagtgcgggaaccagatcggctccaagttctgggaggtggtgtgcgatgagcacggcatctacccgactgggcggtacatggggacgtcggacgtgcagctggagcgcgtcaacgtctactacaacgaggcttcgtgtggtaggttcgtgccgcgcgcggtgctcatggaccttgagcccggcaccatggactccgttcgcacgagcccctactgtcagatcttccgcccagacaacttcgtcttctgccagtccggcgccggcaacaactgggccaaggggcactacaccgagggggcggagctcatcgactccgtccttgacgtcgtccg

SEQ ID NO: 62245 - DNA, 344 bp, Zea mays
  Clone ID: LIB3075-005-Q1-K1-D12
tctcttactcgtggtcgtactcgtgtcatcagcgacttccgccctttttttttttttttttttttgtgtttttttttttttatttattatttattataaattattaaaacataattaatatttttaaatatttcttataaatttattttataataacaaaaaaataaaaacgatattcgctataaaaaaaaaaaaaaacgtaatcacggtctacaatatacaaaaatacgtactcaaacatgaaaaataatattatatatataggttaacctacatccaactcactgttcatctttataaaaactcctcaatataaaaaaacttaaaataacacaacttaattt

SEQ ID NO: 62246 - DNA, 296 bp, Zea mays
  Clone ID: LIB3075-005-Q1-K1-D2
cttgaaatgaatgaaccatgcatgcatgcatgtatgcatgcgccggggtgacgtggcgttcagctcaggcgctgagcgagtctatacgtacgtcgtcaccggctggccacgcatgcgataaccatctgatatggacggaactatatattgtattcctattaatctggcattttctaagctaattgttttttttccaaatataccgtcgatggaactccaaatgtaatgtcacgcaaatgtgtgtttttcatcgattgaatggataataataaaaaggcatgctggcagttactact

SEQ ID NO: 62247 - DNA, 378 bp, Zea mays
  Clone ID: LIB3075-005-Q1-K1-D3
gctaagcaggtctgacaggatgtcgtggcagacatacgtcgatgagcacctgatgtgcgagatcgagggccaccacctgacctccgctgccatagtcggccacgacggcgccgtttgggcccagagcaccgcattcccacagttcaagacagaggagatgaccaacatcatgaaggacttcgacgagcccgggttccttgccccgaccggcctcttcctcggccccaccaagtacatggtcatccaaggcgagcccggcgctgtcatccgcgggaagaaaggatctggaggcataactgtgaagaagacagggcaagcgatggtggtcggcatctacgacgagcccatgacccccggccagtgcaacatggtggtcga

SEQ ID NO: 62248 - DNA, 379 bp, Zea mays
  Clone ID: LIB3075-005-Q1-K1-D5
ataaaacccaccacacctaccgtcgtccgtagaggaaggaaggactcgagatggacaccgtcagcgtccccgtggtggccgttgcgaatgggatcggggaggtggagcgcaaggtgcagaagagctactgggaggagcactccaagtgcctcactgtcgagtccatgatgctcgactcccgtgccgccgacctcgacaaggaagagcgacccgagatcctgtctttgcttccctcttacaaagggaaatcagttctagaacttggtgctggaataggacgctttactggagatctggcaaaagaagctgggcacgttctggctctagacttcattgaaagtgtgattaagaagaaccaaagcataaatgggcatcacaa

SEQ ID NO: 62249 - DNA, 452 bp, Zea mays
  Clone ID: LIB3075-005-Q1-K1-D6
cccacgcgtccgcggacgcgtgggcgacaagatggcgtgcacaaacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggtgacttccttgtcggacaactcaacttcacaggcccttgcaagggcgacgtgaccatccaggtggatggcaatctgctggcgaccacggacctaagccagtacaaggaccatggtaattggatcgagattctacgtgtggataacctggtcatcaccggcaagggaaaccttgacgggc

SEQ ID NO: 62250 - DNA, 70 bp, Zea mays
  Clone ID: LIB3075-005-Q1-K1-D7
gcacgtactcggtctcgtgaattcccgggtacgactccacgtcgtcacgtgtcatgtcgttgactgtggc

SEQ ID NO: 62251 - DNA, 445 bp, Zea mays
  Clone ID: LIB3075-005-Q1-K1-D8
taccactcgtccgtttacaggcccgttacatattctcatctgtctcatcttatgaaaggagatgggccacaaggaactacatgacccagagcctttggggcccttcaatgtctgttagcggtggcatcaatgtcccagtgatgcagaccccgctctgtgctaatgctcctgctgagaaaggatgcaagaacttcatgattgattacatgatgggcggcgtttcagctgctgtttcaaagactgctgctgctcccatcgagcgtgtgaagctgcttattcagaaccaagatgagatgattaagtctggtaggctatcagagccgtacaagggtattgttgactgcttcaaacgtaccattaaagatgaagggttctcttccttgtggatgcgtaacactgctaatggtattcggtactttcctacttaggctttgaactttgcatt

SEQ ID NO: 62252 - DNA, 180 bp, Zea mays
  Clone ID: LIB3075-005-Q1-K1-D9
ctgttacctagagcttgtaatgatagaaagcagttgtagtacgttttaaccataaaagagtacactaagttgatccgatggattatctattagaaatcatttgtgcattatgtattattttcaaatatttcttagatatttcctttcttattagatggatttaaaaatgagatttgttat

SEQ ID NO: 62253 - DNA, 388 bp, Zea mays
  Clone ID: LIB3075-005-Q1-K1-E1
gtgaagtctgggtcagtaaaaaagaccaagaagatccgcacgtccgtgacatttcaccgccccaagaccctgaagaaggctagggaccccaagtacccaagaatcagcactaccggaaggaacaagcttgatcagtaccaaattctcaagtatcccctcaccacagaatcggcgatgaagaagattgaagataacaacactctggtcttcattgtcgacctcaaggcagacaagaagaagatcaaggctgctgtcaagaagatgtatgacattcaggccaagaaggtcaacaccctgatcagacctgatggaaagaagaaggcttacgtgaagcttacgcctgactatgatgctcttgatgtggccaacaaaatcggcatcatctaaa

SEQ ID NO: 62254 - DNA, 442 bp, Zea mays
  Clone ID: LIB3075-005-Q1-K1-E10
agcatagagacaccaagcgtcaaacttgtcatgcagctagcaaccaacccaagaaagacaccatacccatggctcgcgctagcgtcgccttcgtcgttgctgctctcctcttcgtcgccatggttgtggcaccgatggccgatgcaaagtacgctgatgccccctccgtcgatgcccccgcccccgctgctgacgcacctgccgatggacctatcggaccggcaggtgcacctggtccacacggcgtcgagggactactcgacaatgaggacgacgacgatgactccaccaactaaggccaagcacgtcggtccgattgcattcggaacaagatatgaaagaaaagtgagagcaacgttgtttaaaaccaaaaatacataataatgtgtggccatccacgatatgttcttgctctgcctctttttctatccgttcgatttcg

SEQ ID NO: 62255 - DNA, 456 bp, Zea mays
  Clone ID: LIB3075-005-Q1-K1-E11
ggactcagccaaccccatcttcatcgacatgaagtactgccccaacaagttgtgtactgccaacggcgcctccaaggtcaccgtcaaggatgtcaccttcaagaacatcaccggcacctcctccaccccggaggccgttagcctgctctgcactgccaaggtcccatgcaccggcgtcaccatggatgacgtcaacgtcgagtatagcggcaccaacaacaagaccatggctatatgcacgaacgccaagggcagcaccaagggttgcctcaaggagcttgcatgcttctagaccctccatcgactgacccatctctctagttataatttttctctcgtccttgcattgcccattagatgctatccattggtaacgcacaacagtaaaacgacagacatccgacagctatattatgttcgacggtgtaacaccctgaatttgagggtataaaattt

SEQ ID NO: 62256 - DNA, 379 bp, Zea mays
  Clone ID: LIB3075-005-Q1-K1-C3
cttgtatttcccttgaagcatccgctccaccttccggtgctagttactcaaaatgcaaggatgatgcagtgaaagcccttaaagttgatgaagcatgcacccacatgaagtgttcttttggtggcatttggaatggtggtggtggtgctggacagaagaatctctttgtagcatcctttttctttgatagggctgctgaggctggatttgttaacgccaatgcgcctgtcgctaaggttaaaccatcggacttcagacaagctgcggagcgcgcttgctcgttgagcgtgaaaaacgccgaggccacctttcctggtgtacagaaggatagcattccatatatctgcatggacctcgtttatcagtacacattactcgt

SEQ ID NO: 62257 - DNA, 247 bp, Zea mays
  Clone ID: LIB3075-005-Q1-K1-B1
gtccataatcatccaagcaaaagcgtctcacagagaggaaagagagagggaggaaaatgctgctgccatggctccttgccccaccggcgttcggtgtacacggtatgggcatacgcaatcactggtgcgggagaaattcatcaccggtggagtgcttcgatgggctagcatgcgccgcgccatggccgagattgtttgccgcacggactcgtcgtcggtcgtgaagtcacgagtcatctgaaaagca

SEQ ID NO: 62258 - DNA, 453 bp, Zea mays
  Clone ID: LIB3075-005-Q1-K1-B10
cgtcgtcgtctcactcaccccgccttcacgccttcctcaccaaataaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctactgcgacacctgccgcgccgggttcgtgaccaatgtcaccgagtacatcgcgggcgccaaggtgaggctggagtgcaagcacttcggcaccggcaagctcgagcgctccatcgacggggtgaccgacgcgaacggcacgtacacgatcgagctcaaggacagccacgaggaggacatctgcgaggtggtcttggtggagagcccgcgcaaggactgcgaccaggtgcaggcggacagggac

SEQ ID NO: 62259 - DNA, 452 bp, Zea mays
  Clone ID: LIB3075-005-Q1-K1-B11
tgccgccgccgtttctgcatctcccatcttcgcaacgccggcgctccatcttgcgctccctccctcactcgctctcggtacgcaggcggcggcggcggcggcggtggcggctctcagattcgggctctcagcgacggcgtcagcagcttccactcccgcctctcgccagttgcctcgcgccctcgcctccggtcctccgcacaccgccggttacccttctaaaacacctcatccccaaatgaagcacatattcaagattgctgcaatactggtagcaatctctgctatctggattgctctccttgaaacctccactgttcctcgaagttatacttggctgcttcccatctacttggtagtggctcttggatgctatggcctttttatggttggatttggacttatgttcttcccaactggtcctcgagaagctgtactactgcaacaggata

SEQ ID NO: 62260 - DNA, 413 bp, Zea mays
  Clone ID: LIB3075-005-Q1-K1-B12
ctcgagcacactgatgtggctatcctgctggacaacgaggccatctatgacatctgccgccgttcccttgacattgagcgcccaacctacaccaacctcaacaggcttgtgtcccaggtcatctcatccctgactgcctccctgaggttcgatggtgctcttaacgtggatgtgaatgagttccagaccaacttggtgccctacccgaggatccacttcatgctttcctcctatgctccagtcatctctgctgagaaggcctaccacgagcagctgtctgtggccgagatcaccaacagcgccttcgagccatcctccatgatggccaagtgcgatccccgccatggtaagtacatggcctgctgcctcatgtaccgtggtgatgtggtccccaaggatgtgaatgctgctgt

SEQ ID NO: 62261 - DNA, 449 bp, Zea mays
  Clone ID: LIB3075-005-Q1-K1-B2
ggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctacggcggcggtcgcggcggcggcggctatggtggcgggcgccgtgacggcggttatggcggcggtggcggctacggcggtcggcgcgagggtggtggcggcggctacggaggccgtggcggctacggcggtcggcgcgaaggtggtggtggcggctacggcggccgccgccgcggctggaaggactgatgtgtgggcccattctggcttcagccgagttatcttatctatctat

SEQ ID NO: 62262 - DNA, 422 bp, Zea mays
  Clone ID: LIB3075-005-Q1-K1-B3
cggacgcgtgggcgcgccgtcgtcgccgccgccgtgacggaaggaagaggaggagcaaggagcacgacgcgatgggccactccaacgtgtggaactcgcaccctaagaactacggccctggctcccgcgtctgccgggtctgcgcgaaccctcacggtctgatcaggaagtacgggctcatgtgctgcaggcagtgcttccgcagcaacgccaaggacattggtttcatcaagtaccgttgaagaggccactgtgctgctgtggagaacttcctacatcaaagaaatgggtccttcattagaaggcctaatttatgcgctttagctttttgttcagaacttgagactcatgtgttaaactcgacttgttaaagttttgatggctactttgtgcttgttggaccagctataatcagaagattg

SEQ ID NO: 62263 - DNA, 376 bp, Zea mays
  Clone ID: LIB3075-005-Q1-K1-B4
gaaaccccaagcgccgaagggtcacggcatctgagccagcgtgaggctgcactgaacaagttccggctaaagaggaaggataggtgctttgagaagaaggttcgataccagagccggaaattactcgcagagcagcgtccacgggtcaagggccagtttgttcgtcaagatcatagcatccaaggaagctagggtccagttactgagctggaactctattctattatctaaaaaagtcactgcaagtgactccactgcggtctgcgggtatcctgatgtcagattttgtcgaatagttggaagcagtcacactgagttacagtttgctctgtatatttgctgaagtttgtaatatatgtatgtataggctaacgct

SEQ ID NO: 62264 - DNA, 180 bp, Zea mays
  Clone ID: LIB3075-005-Q1-K1-B5
gttgtggcattgttacacatcacagtacagtttggtcaaattttttttccacagaggaagtagggattgatttaatcattgatttaatcccacacgcgtgtatctacgtatacagtttgtataacatgaaccacctctgtttgcgattggtctaaaaataaatataatacttatatattg

SEQ ID NO: 62265 - DNA, 393 bp, Zea mays
  Clone ID: LIB3075-005-Q1-K1-B6
cctactacagttctgggcgcctccacctccaccaagcttcctgctgaactccagttgccagagggcagcgacgtagccaccaatgcagagctcaagacgccaggaccagaagctacggcttcaactctcaagacatctgctaatccagaaccacgcgtggatggcgatgacatcactgatgctctctacggtgaccatggtcatcgcaggctccctattttcagggagatctgtccagattgagtgtcagcatcagcattctcaacgtcgctgatggatgcatttcggcctagctgtatattctgttttatctatcttgtacccagggtcttggtagcaattactctgaagggtcatttctagtttcctaagagcttgttcggttgctaaggg

SEQ ID NO: 62266 - DNA, 368 bp, Zea mays
  Clone ID: LIB3075-005-Q1-K1-B7
cccacgcgtccgctagtactcagccgccgcaatcagggacaggtagctcgagcgcgcgctccacctgctccgacgcgatgcgggccaagtggaagaagaagaggatgcggaggctcaagaggaagcgccggaaaatgaggcagagatctaagtaggcgcatcttgtgacgaggatggcgagcttctcctgcatcatggctgaggctcgttgggatgatggtctccctttgcagacgtcctttgctgtagacgtaggcgatgtaaaccgtcctttttgattcattctagcatgttctgagactgggtttatattgtaatttgaggataattatatgatgctctaagttaaatcagattcctggcaaaaa

SEQ ID NO: 62267 - DNA, 453 bp, Zea mays
  Clone ID: LIB3075-005-Q1-K1-B9
cttttctactttgtccttgaggattttatattctactgggggcacagggcactgcatacgaaatggctatacaaacatgttcacagcgtccaccacgagtacgccacaccctttggtttaacttccgaatatgcccacccagctgaaattttgttcctgggattcgccacagttgttggtcctgctcttactggccctcatctgttcaccctgtggctgtggatggtgttgagggtattggagactgttgaagctcacagcggctatcacttcccatggagcccatcaaatttcctgccactgtacggtggctcggacttccatgactaccatcaccgagtgctgtacacaaagtcagggaactatgcctcgacatttgtttacatggactggttgttccggacggacaatggttatcgcaaggcaaagagaccattgaggagcaagaagtga

SEQ ID NO: 62268 - DNA, 353 bp, Zea mays
  Clone ID: LIB3075-005-Q1-K1-C1
catcagccaggcgctcatcttcgtgacccggtcccggagctggtccttcgtggagcggcccggcgcgctgctggtgatcgccttcctggcggcgcagctggtggcgacgtgcatcgccgtgtacgccaactgggagttctgcaagatgcagggcatcggctggggctggggtggcgccatctgggcgttcagcgtcgtcacctacttcccgctggacgtgctcaagttcgccatccgctacgcgctctccggcaaggcctggaacaacatcaacaacaagacggccttcaccaaccgcaccgactacggcaagggcgagcgagaggcgcagtgggccacggcacagaggacgc

SEQ ID NO: 62269 - DNA, 420 bp, Zea mays
  Clone ID: LIB3075-005-Q1-K1-C11
atccgctccatcaaccggagcgtgctgcagtacgcgccctgctccgtcgccatcctcgtggaccacggcctcgcgtccgggtcggcgtgcgccaccgccgccaacagcctgctccagcgggcggcgctctacttcctgggtggcgccgacgaccgcgaggcgctggcgtacgcggcgcggatgccggagaccgggaccatgtcgctgacggtggtgcggttcaagctccggaactgggtcgggatgggcgggcgcgacgaggcgagggacgaggagctgctgcaggagttctggagcaggcacagggacaacgagcgggtggtgtacgtggagaagacggtggaggacgcggagggcacggcgtccgtggtgcgcgccatgagcgagaagttcgacctgctcatcgtgggtcggcgcggc

SEQ ID NO: 62270 - DNA, 407 bp, Zea mays
  Clone ID: LIB3075-005-Q1-K1-C12
gctgatgcagtttggtctcgctttatacagctaaccaaacaaaggctgtcttttagtcaacgcatgtgttgagactggatagatgtgcgcacgataccaatcagaaggataatgtatacaatgggttgtttcaggacagtggcgcttacctggagcaccgtctggccggcgtcgacagggtgcagatcaagggcctcaacgcgggcacgctggacctgacgaataacggctggggccacatcgtcggcctcgtcggcgagcagaagcagatctacaccgataagggcatgggcagcgtcacatggaagccagccgtgaacgacaggccgctcacctggtacaagaggcacttcgacatgccgtcgggagaggacccgatcgtgctggatatgagcacaaatgggcaa

SEQ ID NO: 62271 - DNA, 397 bp, Zea mays
  Clone ID: LIB3075-005-Q1-K1-C2
cgagtaacacagttgagcacgacgatgggatccctcgctaataacatcatggtcgtgggcgccgtccttgcggcgcttgtcgtcggcgggtcgtgcgggcccccgaaggtgccgcccggccccaacatcaccaccaactacaacggcaagtggctcaccgccagggccacctggtacggtcagcccaacggtgccggcgctcctgacaacggcggtgcgtgcgggatcaagaacgtgaacctgccaccctacagcggcatgacggcgtgcggcaacgtccccatcttcaaggacggcaagggctgtggctcatgctacgaggtgagatgcaaggaaaaacctgagtgctcgggcaatcctgtcacggtgttcatcacagacatgaactacgagccta

SEQ ID NO: 62272 - DNA, 452 bp, Zea mays
  Clone ID: LIB3075-005-Q1-K1-A9
tggaaatgaaattgatgaatctgcagaacgcattaccgataaacaaattatcgagtggaagctgacattgcatcaaattgggcttgacgttttacgcactgatcgtaccatggtattttatgagaacaaagaaaatctttccaaattatgggatattctagccgtgtatgcatggattgacaaagatgttggttactgccaaggaatgagtgatttatgctcaccaatgatagttctactaaaggatgaagcagatgccttttggtgctttgagaaattgatgcgtagattgcgaggaaatttcaaatgcacagatcaatctgtgggagtatccaaccaacttcaacatcttgcatctattattcaggttcttgacccaaagctacatgaccacctagaaactcttggcggaggtgactacctttttgcgttccgaatgttcatggtgctat

SEQ ID NO: 62273 - DNA, 204 bp, Zea mays
  Clone ID: LIB3075-004-Q1-K1-H3
taaacaaatacattcttgtccgttacaattcctaagcactctatcctcttccacacacctgctatgttttccatcgttctcaccacccactcaccttcagctcaattctccacctattccctgttctaccctaacattccaccattttactgatatcaattacattctgaactattctcctttacctaagaggcccactgcact

SEQ ID NO: 62274 - DNA, 412 bp, Zea mays
  Clone ID: LIB3075-004-Q1-K1-H4
cttggttatcaaccaagagtctaaactcctttgtcatgtgttatcgtttcaatcctgaactgtgcattgttgtgggtcttgaagatctggttacaagcctacaacttaactgatatatatcacatgatgatgataatatgtatattcatggtgacacctttgctctttgaacatgttgtagtctattgtgtagttgcaaaagaatatgtgaattaccagtcagtggagattgagagggattccccggctagaagctcaagcggattaggaagtggctcatcttcatccagtggtacagtacagtggagcaaatgagtatctatcaccattaatgctgagttatcgatcaagtagctcgttaattcgttaaaattcttgcagaatctgacttttgatgtacaggttatttttt

SEQ ID NO: 62275 - DNA, 462 bp, Zea mays
  Clone ID: LIB3075-004-Q1-K1-H5
acacaacacacacatccgtgaaagaaacaagcacatagaaacaaatacatcgctagggcgccgccaacaatggcctcaaggtactctatcctgcttgccacaacgacactggctatgttgttcgcattcggttcgtgcaccaccccactcaccttccaggtcggcaagggctccaagcctggccacctggttctcacccctaacattgccaccatctctgacgtggagatcaaggagcatggcggcgacgatttctcctttacactcaaggagggcccagctggcacttggacgctcgacaccaaggccccgctcaagtaccccctctgcatccgctttgctaccaagtctggcggctaccgtatcgccgatgatgtcatccccgccgatttcagggccgcaccacctacaagaccactctcagcatctgatgagcctgtgatgagtgatgacgaataatat

SEQ ID NO: 62276 - DNA, 342 bp, Zea mays
  unsure at all n locations
  Clone ID: LIB3075-004-Q1-K1-H7
gcagccgccaccgcgaatgccatcttgctcttggctctcttcttcgccggcgctcaggcgagtgtcccatgcatactccccgtatgcaagacggtgggtggcgggagccggttcttcgacgtgcagttctgcctggcggcactcggctccgatggccggagcgtcgaccactgcctcgactaccaggtctactccgccattgccgctgacctcctcgcggccaacctcaccgctacggcggccaagatcaacggcctgctccggaagagcggcggctccgncgacgaggccacgacgcgctgtctccggtcctgtcaagcgttggacggcgacatggaacgg

SEQ ID NO: 62277 - DNA, 198 bp, Zea mays
  Clone ID: LIB3075-004-Q1-K1-H8
tatctgaaccggaccgaatttagaatcagtacaatcctgcactagacctggttatcacccttgaaggatctgtttcaatccatacaactaactgatatatatcacatgatgatgataatatgtatattcatggtgacacctttgctctttgaacatgttgtaatctattgtgtaattgcaaaagaatatgttaattac

SEQ ID NO: 62278 - DNA, 502 bp, Zea mays
  Clone ID: LIB3075-004-Q1-K1-H9
cccacgcgtccgcccacgcgtccgctcagctcaaagaaatccggcaagggtaagaagccgggcggggtcggcaaccgattctggaagagcattggccttggcttcaagactcccagggaagcaattgaagggacctacattgacaagaaatgcccattcactggaactgtttctatcagaggcagaattattgctgggacatgccacagtgctaagatgaacagaactatcattgttcgcatgaactacctgcactttgtaaagaaataccagaggtatgagaagaggcactccaacattcctgctcacatctccccatgcttccgtgtgaaggaaggtgaccatgtcatcattggccagtgcaggcccctgtcaaaaactgtgaggttcaatgtcgttaaagtcattccagctggatccgcagctgctggaaagaaggccttcacagcagcctgagtttatagactatgttccatgagtagtctatagaatgatgtctttt

SEQ ID NO: 62279 - DNA, 433 bp, Zea mays
  unsure at all n locations
  Clone ID: LIB3075-005-Q1-K1-A1
gccgtgcaaatccatttcttgccttgccggcacagctctgcatagctcctcccaagctttaggattaggatttggatttggatttggatttggatcgggtgtgtttcctgcgtaaccatgagcgagatcatgaagctaaagcgtgggatcagcaccaaaccaggagaccacctcgtccaaaatggccaacaacatccatgtcacgaatgggaggagcaacagcgctactggccctcgccgcgggcgccgncggcgagcccgacggagtcgcccaggaccccaggcgggagccagaagaaggcggttctgggcaaggtgaagagcaaggccaagaaatggatgcacatgctgcatcacaggaagaaacccgngccaccggaggagatgatgtggacccccagggccgggcctggacccacggcgggacaagaca

SEQ ID NO: 62280 - DNA, 437 bp, Zea mays
  Clone ID: LIB3075-005-Q1-K1-A10
cggacgcgtgggttcgaataacacaggtgagcgcgacgatgggatccctcgctaataacatcatggtcgtgggcgccgtccttgcggcgctcgtcgccggcgggtcgtgcgggcccccgaaggtgccacccggccccaacatcaccaccaactacaacggcaagtggctcaccgctagggccacctggtacggtcagcccaacggtgccggcgctcctgacaacggcggtgcgtgcggcatcaagaacgtgaacctgccaccctacagcggcatgacggcgtgcggcaacgtccccatcttcaaggacggcaagggctgcggctcatgctacgaggtgagatgcaaggaaaaacctgagtgctcgggcaatccagtcacggtgtacatcactgacatgaactacgagcctatcgctccctaccacttcgacttgagc

SEQ ID NO: 62281 - DNA, 451 bp, Zea mays
  Clone ID: LIB3075-005-Q1-K1-A11
aaacgatacggttaatagatatagcgaagaagggcagcaccaccagtagcagcagccatgcccgctcgcgctcgatggcgactcctcgcgctgccgctcgcgctcttactcgttgccgggtcggcgcatggcctcgtgaagccggaggcagccgcggcgcccaagccccccgtccccaaggccatatcggacctgagggacgcgatcgtgaaggggctgggattccaggccgaggggctcaaggtgtccgggttcgacgtgcgagacgcgctcgtggggcacgcggtggcgtacgagttcgacatcgaggtcggcaggaaggtcctaccggtgcgcctgctggaggacgtcagccggtgggacttcgtcgacctccccatcttccgttcccaggccgacgctgacgatacggcgctcgccgagatccggcgggccgggagggggagcatcg

SEQ ID NO: 62282 - DNA, 437 bp, Zea mays
  Clone ID: LIB3075-005-Q1-K1-A12
cataaaggaagtgatgtcataccttcccatcatattatttggcatctacatgagctggatttacctgcgttacttccaaaggagattagaagtaggccttaaaggggacccaagtgatgaattctcgttttcaagcttcttccctggatttttaaggcctattttggatcctattgcttctgtattccacaaacttttctgtgggcgacctgcaagacctgaatgcacaggccagacattggatgggtcacagttccctggttcaggctccactgaggcaaacaggaggagagaaaggggccagaaggcactggagcagagactggcagagaagctggctgcggtcaggaaggcggagggcacgcctccgccgaagcagcatcaggaggaggacgcggagaatgatgcttctgataaagtctgagcgtgctttcagc

SEQ ID NO: 62283 - DNA, 393 bp, Zea mays
  Clone ID: LIB3075-005-Q1-K1-A2
gttgtgtgtactctgtccttcactaccatctgtcccctggaaagttataacaatagcttgattttcctgataaatattcttccccttgtatgattaaagaatagatagttctttttacttgcatacaggttatcagacatagcgaatagggaaacatgcaagaagatacatgtgtccataggacctactgtttagaacattggtcacattgacatgaagataagctgccttttcatgatctgcagcttcaacatagctaaaacaacaaatttttaatctttaaaatgccttttaaaggaaaaatggttcaagcaccattacatagtccttaatttgactgtatatattacttttgaacaggttaattagggtttaataaagataacaaaaagg

SEQ ID NO: 62284 - DNA, 232 bp, Zea mays
  Clone ID: LIB3075-005-Q1-K1-A3
gcgctcggcctcgccttccgtttccaaccaggcacctcgccacctcctcgtgggatcgcgcgcaggagcggatcgccgccgcaggagagcgttccgagtccgaatacgtacgggatggtggaggcgccggccggtctgagcgcggcggcgcatgtgagcgcgctgccgctgcaggtggatctcctgcagctgccgccggaggtgcccgcgccaggggaatcccgcctgcgcg

SEQ ID NO: 62285 - DNA, 426 bp, Zea mays
  Clone ID: LIB3075-005-Q1-K1-A4
catgaactccgcatacagcgagaagaagcccagcagcaagggcgcaagcgcaactgatcccgcacacgggtgatgttccacatccatgcctataggccactcacctcaccacgcagcgttaccggccgtactactatatctacatacgaccgtgggacaacgtcgaccggagctcgatcggcgcagttgccgcatgggcgtggctgtcaaagttcctttgtttctttcttgatttgtgcttgcgttgggttcggtgttccactttctttttatgtgattattaatcttgttttcagatgcatgtacgcatgtatgtgccggcaccatttggtcttgtgttaagtttattcttggattccaatctctaatgtaaggtcctttggtttgtgtgtgcatggtggactcataccaacttttggctttaca

SEQ ID NO: 62286 - DNA, 420 bp, Zea mays
  Clone ID: LIB3075-005-Q1-K1-A6
accaaaccgacgatggcgtcgaataagacggtcctcatcgtcgcggcgatgcttctcatcacgctcgtgctggaggccgcccctccggcgaccgccatggactgcaaggccgggtgtgacgaggtcacgggcccactccacatgagcatggaggactgcatgaagaggtgcaaggagatcgctgctaagcaggggcctagggacccttacaaggataacaaacttgacatcccatgaactaattaatgctcctatatcatctgcctatccatgcatgcattgcattgcgtatgcacactgtgcgtgcctgcccacaaagttcgacaacacaccgatctcgacggatttgtaatcgtgtccactcgatcgagagatcgatcgatgcttggtattatatttgtattccacattatatattag

SEQ ID NO: 62287 - DNA, 252 bp, Zea mays
  Clone ID: LIB3075-005-Q1-K1-A7
ccaagatccaggacaaggagggcattcccccagaccagcagcggctcatctttgctggaaagcagcttgaggacgggcgcacgctggccgactacaacatccagaaggagagcaccctccacttggtgctgcgcctcaggggaggcatgcagatcttcgtgaagaccctgactggcaagactatcaccctcgaggtggagtcttcagacaccatcgacaacgtcaaggccaagatccaggacaaggagggca

SEQ ID NO: 62288 - DNA, 464 bp, Zea mays
  Clone ID: LIB3075-005-Q1-K1-A8
gaaataattgggaataaatagttcgtgaatccctgaagcgtgcatatatatattcctgccaagataaaggtaatggagtcgtcacgcaggttccagccggccgtcatcctgcttctcctgctcattgtgtccaccgatatggcacaggcaagggaatgcgagaagtacagtgagcgatttgttggggcatgcatgatcgcagacaactgcgccaatgtgtgccgcggtgagggcttcttggccggcaggtgcagcaccttccgccgccgctgcatctgcactaggcagtgctaaacaagatcgctcgatcgctcgccatgcatcgacaacctattcttaataacgttcattatctcgttcttatttatgacgaatgtcatgtatgttctggtgactgtcatgtatattctgatgactgtcatgtatcttggtcatgtatgctcaaggttcattatcttggtcat

SEQ ID NO: 62289 - DNA, 450 bp, Zea mays
  unsure at all n locations
  Clone ID: LIB3075-004-Q1-K1-H2
caagcagtagctaatgaacggggctctctcgcctggatatagtagattcattacacattgntgggtatgatccatatgaagcctgagtgatcaggatcttgttatttcatttgtgttcgggagaggggttggtccacagccatacggaaacgaaaggttgatgtacagggagcagagaggactaaagtcggtagaagtgagcttgatctaggacagtgctctccaattcgttccattgaacacaagtagcagtacaaatagaactcatcctaagatccttggaggcttcacttgtatatactcagctgggtggataggtggtgggtgtatggtgtgattttggcatccaattggaatggcaaaggtaatagtgttattgtactaagaattctttcccttttttttctttctcggggcctatattctcatgttgcaaatatttttgagttg

SEQ ID NO: 62290 - DNA, 174 bp, Zea mays
  Clone ID: LIB3075-041-Q1-K1-H2
cccacgcgttcgcgaatggatccaagcccccactctttgctggcatcatagcacttgtgatgagcatcgcaacgatggtccgtctgacccgcgagcatgatgcctgggaaggttcttggtgctgccataggtggagctaccctttcagatagttaattttatgttcaagagctc

SEQ ID NO: 62291 - DNA, 151 bp, Zea mays
  unsure at all n locations
  Clone ID: LIB3075-041-Q1-K1-H3
cgcgnccgnccgcnaccccacccagaccagagcgccacgagacgccgcgcgaaccgacccaggccgacgcggacaaccccccgcggcgccgggggacaaagcgnacagcgaccgcgccaccacccgcgaggaccccgagaaggagagcgag

SEQ ID NO: 62292 - DNA, 232 bp, Zea mays
  Clone ID: LIB3075-041-Q1-K1-H4
cactaaccaggtcattgcgccaacttgaactgtggaaggagaagagctctggcacgtatgagaagaaggtgtatgtgctccccaagcaccttgatgagaaggttgctgctcttcacttgggcaagcttggtgccaagctgaccaagctcaccaagtctcatgccgactacatcagcgtgccgatcgagggttcctacaagcctgtccactaccggtactaggcacacggctt

SEQ ID NO: 62293 - DNA, 343 bp, Zea mays
  Clone ID: LIB3075-041-Q1-K1-H5
gacagacagcacgaaagctgtgcaggaggcatgggcatcggcgtgcggcggcactgggaagcagacaatcctcatacccaagggtgacttccttgtcggacaactcaacttcacaggcccttgcaagggcgacgtgaccatccaggtggatggcaatctgctggcgaccacggacctaagccagtacaaggaccatggtaattggatcgagattctacgtgtggataacctggtcatcaccggcaagggaaaccttgacgggcagggcccagccgtgtggagcaagaactcctgcaccaagaagtacgactgcaagatccttcccaactcgctggtgatggac

SEQ ID NO: 62294 - DNA, 382 bp, Zea mays
  unsure at all n locations
  Clone ID: LIB3075-041-Q1-K1-H6
gngacggatgacatcctaaaaccctaaccacgcgacgctcgccgactcgccgtcacagccgcacctcaaccggagtcgaagcgccattgatgaactccgagcctgccgtcgccgcagctagcgatgcacaagcttcttccacgccgccgctncttncttgacgcagncggcgncgcgggccccctgctgctcttctttccacgcatgcccacgctgcgcctgtctggtaggccgttcgtagccatgcgtnctggcggaaaccctagccgtatccgtgcgccgccgtggctgcactgtgacgctgggtggaggcggngactctgttccgccgaggctgcgaggcgcgggggcgatacagaggagatggagaaggatggcgggg

SEQ ID NO: 62295 - DNA, 55 bp, Zea mays
  Clone ID: LIB3075-041-Q1-K1-H7
gacgattcacaagaacatcttaactttttttttaataacaactaacccaacatta

SEQ ID NO: 62296 - DNA, 444 bp, Zea mays
  Clone ID: LIB3075-041-Q1-K1-H8
cggcgcagggccgcgcggacgcgcgcgaggccacggggttcgtgctccagaagtgcgaattccaggccgaggccgcgctccgggacgccaagcgcccggccatccgcaactacctgggccggccctggcgcgagtgctcgcgcaccgtcgtcatggagtcggagctcccggacttcatcgacaaggccgggtacctgccctggaacggcgacttcgggctcaagacgctgtggtacgccgagttcggcaacaccgggcccggcgccagcacggcggggcgcgtcagctggccgggcttcaagaaggtgatcagcaaggcggacgcgaccaagttcacggtcgagaactttctgcacgctcagccctggatcgatcccacaggcacgccgggtcaagtacgacctgttcacatgagcgcccggggatcggaccggaggatgcatc

SEQ ID NO: 62297 - DNA, 394 bp, Zea mays
  Clone ID: LIB3075-041-Q1-K1-H9
aggccctcaagggggtcaccatcatggagggcgacgccgaggacctcccgttccccaccgactccttcgaccgatacatctccgccggcagcatcgagtactggccagacccacagcgggggatcaaggaagcctacagggtcctgagatttggtgggctagcttgcgtgatcggcccggtctacccgaccttctggctgtcccgcttcttcgccgacatgtggatgctctttcccaaggaggaagagtacatcgagtggttcaagaaggctgggtttagggatgtcaagctgaagaggattggaccgaagtggtaccgcggtgtccgaaggcatggccttatcatgggctgctccgtcacaggcgttaagagagagcgcggggactttccctt

SEQ ID NO: 62298 - DNA, 323 bp, Zea mays
  Clone ID: LIB3075-042-Q1-K1-A1
agcttgccaaatatgtttcatgacaatgtaaatgtggagtctgctcttggtccagcacttaaatcagctttcatggttatgagtcaaattggggggaagttgcttgtcttccagagtactttgccatctcttggtattggtcgtttgaggctacgaggagacgatgtccgtgcatatggaacggataaggagcatactctgagggtaccagaagattccttctacaaacagatggctgctgaattcacaaaatatcagattgcagtggacatattttctttcaacgataaagtactcaaatataagcatctttaacgatcttt

SEQ ID NO: 62299 - DNA, 149 bp, Zea mays
  Clone ID: LIB3075-042-Q1-K1-A11
tcggacgacactcagcatctaatcagcatctgaagatgaactatatttcaaaagagctcatctggcgcacgtgttagcaagacaatttttttctttggttattttatggcaccaaaccacccaagaaataagttatgctacatgtccat

SEQ ID NO: 62300 - DNA, 342 bp, Zea mays
  Clone ID: LIB3075-042-Q1-K1-A12
atcggccgtagagcgagcagtatcccaagtccacccagtctctaatcacattactctcgaacgacaggttccttgcaccactatatccaggaccgacgaagtgatccagccgacagtcatggagacgaagaaggtgctatgggcactgctagtaccagccgtctcggtcacagtcgcgctgagctggctcgcctacgaggcaccatccgaggcgctcatcgtctcggccggcggtgcggctggctcctagcgatagcggagcgggctgcaacgtcgtgctatccaccagagcacttacaacttcatcactaactgctacgtggatatgacgaaggctctcta

SEQ ID NO: 62301 - DNA, 329 bp, Zea mays
  Clone ID: LIB3075-042-Q1-K1-A2
gagaagagctctggcaagtatgagaagaaggtgtatgtgctccccaagcaccttgatgagaaggttgctgctctccacttgggcaagcttggtgccaagctgaccaagctcaccaagtctcaggccgactacatcagcgtgccgatcgagggtccctacaagcctgcccactaccggtactaggcacacggcttgcaactcactcgggccgttgtgtgctatgaagttcgctacactggcctgtcagatatcttttgcatgcatatgcattatcatatacgcaggcgcgtagcacgttttcttatggttatcgcttgaactgagggggg

SEQ ID NO: 62302 - DNA, 358 bp, Zea mays
  Clone ID: LIB3075-042-Q1-K1-A3
aaggggtgcggaccaactacctggaactgttggacaattacgtaaacggcaacggggcctttatggccgtgaccataagggaaaagggttccacacaatccaaccccactatgacttcttggggcgccatttggaggaaggacagcaacaaaccgtttaagggacccttcaccgtccgcctcactaccgagggaggcaccaatgcccggctacgacgatgtcatccctgccaactggaaagccaacaccgtctacaccgacaaataaataactttattgctgacaatactttaagccgacctatgctaactatactagattgggttggatcccaaaccatgcattacacatgcatgca

SEQ ID NO: 62303 - DNA, 308 bp, Zea mays
  Clone ID: LIB3075-042-Q1-K1-A4
cggacgcgtgggggcgtgcacaaacaatgcgatgagagccttgttcctcctggtcctctgctgcatcgtgcatggtgagaaggaagagtcaaagggcatcgatgcgaaagcgtccgggcctggtgggtccttcgacatcaccaagttgggcgcctccggcaatggcaagacagacagcacgaatgctgtgcaggaggcatgggcatcggcatgcggcggcactgggaagcagacaatcctcatacccaagggtgacttccttgtcggacaactcaacttcacaggcccttgcaagggcgacgtgacca

SEQ ID NO: 62304 - DNA, 186 bp, Zea mays
  Clone ID: LIB3075-042-Q1-K1-A6
ttcacgcgtccacccacgcgttcgggcactcgtcaaaaaacatgcttgcataactcctccagtacgatcctatggagattatcacaggtggagttgtcatacacgaagcctatctatctaataatcccctgatccaaaagtgacctttatgacatgcatatggacgggcatatatatttatataaa

SEQ ID NO: 62305 - DNA, 386 bp, Zea mays
  Clone ID: LIB3075-042-Q1-K1-A7
gacagaaagtagcataaacgctaccatgcttgaggaagggcttgcccggctcgaaagaagcaagagatgggacactagggagaggaagacggctctccagaacctggaacagttccaggacaaggcaaagaaggaaaggctgcggatttggcagtacggagatgttgaatcggacgaggacgagcaggccccgcctgcaaggaagcctggaggtcgtcggtagagactgggcagcgtaaggctgcagtctggcatgctatgaaagttttggacaaccacaaatgttggactctgccgggagttatagatgaagacttactgaggggtaccggatttatattcggctagaagaagggaacttaacgaggcgaaatcacttttgatat

SEQ ID NO: 62306 - DNA, 199 bp, Zea mays
  Clone ID: LIB3075-042-Q1-K1-A8
cccacgcgtccgcatgcatgcatgcataacacctcgagtaggagttgaagtacatcatcattgatggtatatatatagaggaagcatgtctatctaataagtccctcatccaaaattgatctttatgtcatgtatatgtacgtgcatatatatatatataaaaatacgtctccttttattaaaacaaaaaacccaagaa

SEQ ID NO: 62307 - DNA, 418 bp, Zea mays
  Clone ID: LIB3075-042-Q1-K1-A9
cagtcagaaaatagtgggatcgagttgtttcactgcacgagcacatcctccggcgaccaccggcctccctctccgtcctctagcgaccgaccaacgcgccgagcgaagatgtcgtggcagacgtacgtggacgagcacctgatgtgcgagatcgagggccaccacctcacgtcggcggccatcgtcggccacgacggcgccacctgggctcagagcaccgcgttccccgagttcaagcccgaggagatggctgccatcatgaaggatttcgacgagccggtgcacctcgccccgaccggcctgatcctgggaggcaccaagtacatggtcatccaaggcgaacctggagctgtcatccgtggcaagaagggatccgggggcatcactgtgaagaaaacagggcagtcactcatcattg

SEQ ID NO: 62308 - DNA, 134 bp, Zea mays
  Clone ID: LIB3075-041-Q1-K1-H12
gcgtcgaggcttgtaacaactgggatgatatggagaagatctggcaccacaccttctataacgaactccgtgttgcgcctgaagagcaccctgtgctgctgacccaagccccactcaacccaaaggcttacaag

SEQ ID NO: 62309 - DNA, 306 bp, Zea mays
  unsure at all n locations
  Clone ID: LIB3075-042-Q1-K1-B1
gagcggacgcgtgggtcatgatacaaattcttagtggaattatgaccttggtaaaactgtgcgtgtttcaatacacagagtgctgagcctgtcttattatacaaaggggaccggaaggagctaaagctcaagatcaccggacgggtctggaaagagcagcagacaccagacggggcatgtacttcaaatctgggcagctaattaagcaatcttcaaacaaacaaaaacacacaccttgcctgtactttctttctaattaaacgnggtgggggtgctcaaagggatttatttatttattactaatta

SEQ ID NO: 62310 - DNA, 321 bp, Zea mays
  Clone ID: LIB3075-042-Q1-K1-B10
cggacgcgtgggtgcccatggccctctcgagtctcgctccgtggcctggtggccctgattgcaccggccctccctcccgctcgcccgagcggggcagcggcggcggccccggcaccccgcgcgcggggtcggacggggagaggggcgggggtcgtggcgctggcggcggcgctgccgtcggacgcgcagtggctggagcggctgccggagaagaagaagcctctggacacgcacagcctgccgtgcatcgaggcgtggctgcgcagcctcgggttcacgcagtccctcgaggaccccgtcgtctgggtcgtcgagaagccg

SEQ ID NO: 62311 - DNA, 258 bp, Zea mays
  Clone ID: LIB3075-042-Q1-K1-B2
cggacgcgtgggggcgctgtcgtggacgtgccggttcgctgctgaaccggggttgggttggaccctgttcgttttcgtctgatctagcactagaagtagcggtgatggggtgtgtgtggttgtgtacatgttcctggaggccgttgtgatctgcgtgtgctattatcacttattcttttggtccatatacggacccacatactggattgttcgtatgtataaccacggtggagaggcgcctgttatattaataaacac

SEQ ID NO: 62312 - DNA, 280 bp, Zea mays
  Clone ID: LIB3075-042-Q1-K1-B3
gaaaatagtgggatcgagttgtttcactgcacgagcacatcctccggcgaccaccggcctgcctctccgtcctctagcgaccgaccaacgcgccgagcgaagatgtcgtggcagacgtacgtggacgagcacctgatgtgcgagatcgagggccaccacctcacgtcggcgggcatcgtcggccacgacggcgccacctgggctcagagcaccgcgttccccgagttcaagcccgaggagatggctgtcatcatgaaggatttcgacgagccggggcacc

SEQ ID NO: 62313 - DNA, 343 bp, Zea mays
  Clone ID: LIB3075-041-Q1-K1-F12
cccccagcgatctggacaaggccactgaaaatattaagatggacgaagatgagcagaatgcatcgagtctgacagaagatggaagcacattattacctctaccagtaccagtaccactaagcaatgatattgtaattatcccaaagatagtgagaaattttgatcaagaagagaaacagatccaggatttgaaaagtaacatgtccactgttaagtctttcatggagcagttaaaactgctgtactctgaagaccttaaaaagcttggtgatcatttgcgtattatttctcatgcggcttctgggtaccgcaaggttgttgaggaaaaccgcaagccttacaa

SEQ ID NO: 62314 - DNA, 338 bp, Zea mays
  Clone ID: LIB3075-041-Q1-K1-F3
caaaccctagcacacgcaccatggcggcgcagcagaagatccggtggggggagctggaggaggacgatggcggggacctcgatttcctcctgccgccccgcgtcgtggtcggacccgacgagaacggcctcaagaaggtcatcgagtaccgcttcgacgacgacggcaacaaggtccgggtcacgaccaccatccgcgttctgaaactcgctcgggcgcgcctttcccgcagcgccattgagcgccgccagtggcctaagtttggggacgtcctctatggaggactctggttttcatgttttactatgggtttttacttgatgagtattcttttttgt

SEQ ID NO: 62315 - DNA, 179 bp, Zea mays
  Clone ID: LIB3075-041-Q1-K1-F4
gcaagcagcagcagcagttacgacgacgacgacgacgacatccaactcccagaaagcccattcacgtcgtcagccgtgccgatgctgatgtaatgggccgggaaagggaaaccaacgtccacttaattagcttcttttgttacacaggacaggacaggacacaaaaacaccctcttttt

SEQ ID NO: 62316 - DNA, 245 bp, Zea mays
  Clone ID: LIB3075-041-Q1-K1-F5
cggacgcgtggggatcacactcgcagagagaaggaaaaatatccccaaaccctaagtcccgatctggagggcgaaccctcgcggctgctgcgacatgaccggcaagggagccccagggggccggatcgtgatggagctgtacaccaacgaggagcccaagaccgaggagaactttcggcgctgtgcactgacgagaagggcgtgggcaaattccagaaggcgattcactacaagggctacacctt

SEQ ID NO: 62317 - DNA, 320 bp, Zea mays
  Clone ID: LIB3075-041-Q1-K1-F7
cgagattctacgcgtggataacctggtcatcaccggcaagggaaaccttgacgggcagggcccagccgtgtggagcaagaactcctgcaccaagaagtacgactgcaagatccttcccaactcgctggtgatggacttcgtgaacaacggggaggtgtccggggtcacgctgctcaactccaagttcttccacatgaacatgtaccggtgcaaggacatgctgatcaaggacgtgaccgtgacggcgcccggggacagccccaacacggatggcatccacatgggcgactcatccgggatcaccatcaccaacaccgtca

SEQ ID NO: 62318 - DNA, 335 bp, Zea mays
  Clone ID: LIB3075-041-Q1-K1-F8
ctcggcttcttctctctcgtccatcaacccagggggaaggagcgggagggagcgagccatggtagtcagcacgttcaatggacccgggattgggatcgggttcggtgtcggctgcgggttcggcgtcgggtgggggttcggaggaatgcctcttaacatgttcggcttgggtatcggtgggggttgtggatttggtcttggactaggatggggctttggaaatgcttttggttgtcagtatcgatcttcaagagttcagttccaaggcattgaatttcagaagaaggcggaaggagatgatgccccaaaagttgtttcaccggagcttgctcaaa

SEQ ID NO: 62319 - DNA, 311 bp, Zea mays
  Clone ID: LIB3075-041-Q1-K1-F9
cccacgcgtccgcccacgcgtccgcccacgcgttcgcggacgcgtggggcgaaggcataagccatcagtttccaccgcacgtccggaccccctctccggcgtgccgacggtatccatggcggcggtggtgcgcggcgtcttgaggggcatcaaggagaagggactcaccaacttcatccgcgacgtccgcaacgaaggatacttcaaaggccttctggacgggaacctttggcaaacgaaaatccacaatattggcgcacacttggtaggagtggccaagtttgggaccaaattttttgggaacctccttg

SEQ ID NO: 62320 - DNA, 346 bp, Zea mays
  unsure at all n locations
  Clone ID: LIB3075-041-Q1-K1-G10
cggacgcgtgggttcttccagtgaagagggatactttgtatcttgaacgagaacctttggtagatcataacattcatcggtggggcgtatcactttatgggcgggatccagccttgtcaacactacgaccacctggaatacatggtgctggcccgctacttacacagataacccaaaccatgcaaatcccacttacctatgctgaagacattataggagttaaaggagcaaatattgcgtacatacgagctaatagtggagctgttgttacaattcangagagtttgggtagtccagatgatattactgttgaaataaaggggacatcttcacaggtacaagctgc

SEQ ID NO: 62321 - DNA, 305 bp, Zea mays
  Clone ID: LIB3075-041-Q1-K1-G11
aacagccgagcgatctcctctccctctccctctccgatccattctccagcgcagcgaagtaaacatgtctgaccgggcaaagatgtcgtggcaggcgtacgtggacgagcacctgatgtgcgagatcgagggccaccacctcgcggcggcggccatcgtcggccacgacggtgccgcctgggcgcagagcacggcgttccccgagttcaagaccgaggacatggccaacatcatgaaggacttcgacgagccagggcacctcgcgccgacaggcctgttcctcggacctaccaagtacatggtca

SEQ ID NO: 62322 - DNA, 341 bp, Zea mays
  Clone ID: LIB3075-041-Q1-K1-G12
aagaaaaacctgcactgcgggagttagaatcatctgctgggaagcataacaataatctttttgatggccacccaagtacattgaaaagagtaaaatcagatggcactattcttcatgaaaggaaagcttctatatctggctctggtcggtgccataatgaaccgataagtgcatcgcagcctgatgtacaaaatgggtttcaattcccaacttcagaatccgattcacttcatgaaaatgaaatttcatcacctttgggaagtggagtaccacacctaacgtatactcccacaagctctgacgtgcttcatgtgccaagagctaaagttaatattgcatga

SEQ ID NO: 62323 - DNA, 362 bp, Zea mays
  unsure at all n locations
  Clone ID: LIB3075-041-Q1-K1-G2
atcacatcgtcactcactgcatcgttcgttcatccatcaactactggaaattagagagccggatctcttggtcggagaacctgcgaggaaggactaaggagtcgaagatgactgcggcggtgctgtccgtgcgcacgacgacgacgtcgctgctagcagcagtcatcctgtgcctctgcatcgtctccctctccccccgcggcgccgctgccgcgcgggtctcccccggcgccagcccgatcgtggccacctgcatgacgggcccgtacccggagctgtgcgtgggggagctgggacagcggctgctggacgtgcagacgtcgatcgcgtncgcggcgcccgaccagcgcgcggccaggatc

SEQ ID NO: 62324 - DNA, 143 bp, Zea mays
  unsure at all n locations
  Clone ID: LIB3075-041-Q1-K1-G3
caaacagcagtgaattgttcttcttctcaatgtatgcaacganctgcaactgacactgcccgagtctcccggtttgaagaccctgcggggggggccttttgattcgaagatgaccgcggcggtgctgcccggcgccgatacga

SEQ ID NO: 62325 - DNA, 303 bp, Zea mays
  Clone ID: LIB3075-041-Q1-K1-G4
cgggatcaatgggttcggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaaggtgaaggactccaagacccttctctttggtgagaaggaggttgctgtgtttggctgcaggaaccctgaggagatcccatggggttccgttggcgctgaatatgttggtgagtctactggtgttttcactgacca

SEQ ID NO: 62326 - DNA, 342 bp, Zea mays
  unsure at all n locations
  Clone ID: LIB3075-041-Q1-K1-G5
caaaggagggggcacacacacacacacacaccgttttcgtccgcccgccgcgacgcgccatggctatggctcgctccgtcgcgcacctcttctttcccatcctccttatcttcaccgcgcccgccgtgcgggccattaccgacgccgccggcgggcccggatacctccaggaggcgtgcaacaagacgctgttccccaaggtgtgcatgcacgcgctcaaggacaacccanagtgccaggcggagacggcggtcaccctcgcgccgctggccgagctgctcgtgtacgtgtcggccgaggtgggcatgaccgtggccgcgttcgcgcaccacgagctcaacg

SEQ ID NO: 62327 - DNA, 307 bp, Zea mays
  unsure at all n locations
  Clone ID: LIB3075-041-Q1-K1-G6
ctgcatacaggcgcatagtaggtgctcttcggtacctggtgaacacaagaccggacatagcatttgctgtgggatttgtctcacgttttatggagaagcctactaccgagcatctgcttgctgtgaagcgagtgctgcggtacgtancatgtacttcggactatggctgctactatcagagaaggaagaaaccagcaggcttgaccgggtacagtgacagagaccatgcgggtgatgttgatactcgcaagagcacgacaagagtggtcttcttccttgtgggcagtctcattactttgcaatcaca

SEQ ID NO: 62328 - DNA, 191 bp, Zea mays
  Clone ID: LIB3075-041-Q1-K1-G7
ggccgccggcgctgtgggcggcgccctggccatctcggagctgatgccggcgcagtataagcacacgctcgcgggcccctcactcaaggtggatccccacaccggtgccctagccgaaggggtgctcaccttcgtcatcaccctgaccgtgctctgggtcatcgtcaagggcccccgcaacgtcatcctca

SEQ ID NO: 62329 - DNA, 345 bp, Zea mays
  Clone ID: LIB3075-041-Q1-K1-G8
gcctcatgcgcgactcccccacgcacatcggcttccgcaccagggccgacggcgacggcatctccctcttctccgccaccaacgtctggatcgaccacatctccatgtccaactgcgaggacggcctcatcgacgtcgtgcagagctccacggggatcaccatctccaactgccacttcaccaaccacaacgacgtcatgctcttcggcgccagcgactcctggccgcaggaccagatcatgcagatcaccgtcgccttcaaccacttcggcaggggcctggtgcagcggatgccaaggtgccgctggggcttctttcacgttgtcaacaacgactacacgcact

SEQ ID NO: 62330 - DNA, 273 bp, Zea mays
  Clone ID: LIB3075-041-Q1-K1-G9
gcgtagtggtcgataataaaacccagcggaacaaagaaaacgtgtaccagaaactgtttgcaaacaccggtgcctttttttgtgttgaaccaccattagttgagccgtgagggaatggtgaacaagctttccacttgctcatttccgagcgcttctctttgattgtatccatggtttggactcatgactgtacgtcttggcagttggcttggcacccaggaatctaatcactggagttgctgctgttatcgagactttgcagcgttgcattct

SEQ ID NO: 62331 - DNA, 400 bp, Zea mays
  Clone ID: LIB3075-041-Q1-K1-H1
cgcgtctgtccgctacccctccccgaccagatcgccacgagacgccgcgcgatccgacccaggccgacgccgacgacccctctcgccgccggcggccatggcgtacggcgaccgcgtcaccaccttcgaggactccgagaaggagagcgagtacggctatgtccgcaaggtctctggacctgtggttgtggctgatggaatgggtggtgctgccatgtatgaacttgttcgtgtcggacatgataacctcattggggaaattatccgtcttgagggcgattcagctacaatccaagtttatgaggaaaccgctggactgatggttaatgaccctgtattgagaacaagaaagcctctttcagttgaatggggacctggaattcttggaacatttttgacg

SEQ ID NO: 62332 - DNA, 442 bp, Zea mays
  unsure at all n locations
  Clone ID: LIB3075-041-Q1-K1-F11
gaccgggcaaagatgtcgtggcaggcgtacgtggacgagcacctgatgtgcgagatcgagggccaccacctcgcggcggcggccatcgtcggccacgacggtgccgcctgggcgcagagcacggcgttccccgagttcaagaccgaggacatggccaacatcatgaaggacttcgacgagccagggcacctcgcgccgacaggcctgttcctcggacctaccaagtacatggtcatccaaggcgagcctggtgccgtcatccgtggcaagaagggatcaggaggcatcaccgtgaagaagacagggcaggcactcgtcgttggcatctacgacgagccgatgacgcctgggcagtgcaacatggtggtggaaaggctgggcgactaccttgcttgacagggcatgntactactacgtaccagcttgaatgcatgtcgacgac

SEQ ID NO: 62333 - DNA, 404 bp, Zea mays
  Clone ID: LIB3075-041-Q1-K1-H10
cggacgcgtgggggcgaagaaaatgcaggcccccctgctgctgctgcacgtccgtcaaatagattggtagggagcccagagggtgatgggaatggcgaaggagcagcacttcgtgcttgttcatggcgaaaggcatggggcctggtgctggttcaagctccgctggctcctcgagggcgctggccaccgtgtcacgtgcgttgacctggccggaggcggcgtcgatcctaccgaccccaacaccatccggtccttcaagcagtacgacaagcctgtcatagacctcatcttcaacttgccagacggagagaaggtgattctgatcggacatggcgcttggaggctgaatgtgaaccatgcaatgcatggatttgttgacaggatctgtcaagcattttttcgtg

SEQ ID NO: 62334 - DNA, 225 bp, Zea mays
  Clone ID: LIB3075-041-Q1-K1-D2
cggacgcgtgggtcttggcctacgcgtagacagacttcaggaatatgtcgatcttctgcttctgcatcagcgtcgttatcatgcaggctggtggaatgccacagcgggacaggagcatggggatgagcaggcgcaagatgactgcaagtggcgccggatcccgacattcggcgactggaacctgcgggacgacatgcccgttacctaatacttgcaagcagggac

SEQ ID NO: 62335 - DNA, 439 bp, Zea mays
  unsure at all n locations
  Clone ID: LIB3075-041-Q1-K1-D3
caatgttctttgaccaccgagcaaaccccagcctccgttactctccttcctcttggctcgcttcggctcccgtcgtccccttccttgagatctctaggatacgagcgcattcgcatcgcttcgcctccgccgcggcctggggagatggcgggtttgggaaaggcgatgtacgcggtgggattctggatccgggagaccggtcaggccctcgatcgcctcggctgccgcctgcagggcaagtacttcttccacgagcagatttcaaggcatcgcaccatcatgaatatctttgacaaatcccttattggtgatgttcaagtcgggcaaggagcttccatttggtatgggtgcgtcttaagaggggacgcanacaacatacaaattggatctgggaccaatatacaagacaattctcttgtgcatgtggctaaatctaatc

SEQ ID NO: 62336 - DNA, 256 bp, Zea mays
  Clone ID: LIB3075-041-Q1-K1-D4
gattatacgtgtggattagcgggggagtaccgggtcgggaaacctccacgggcatggcccacgcgggtggagcaagagctcctgtagcactaattacgactgccacattcttcctaacttgctgttgatggacttcgcgaacacaggtgaggtgtgcggggggacactcctcaactgcaaggatgccacatgaacacataccggagcgcggacatgcttgtcaaggacgtgaccgctaccgcgcccggggacagcc

SEQ ID NO: 62337 - DNA, 391 bp, Zea mays
  unsure at all n locations
  Clone ID: LIB3075-041-Q1-K1-D5
cacagccggacgatccgagcagagaaggggaggtacctgctacgactagctagattccacgcgcgatggcgcccaccaggatccgcgtgggcttgctgagcttggcgctcgtggggctgctcatttgccaccttgccaccaccgccttcgtcggcaagaacagaatccgcatcctcgacagcgtcgacgactcggccggggacaacaacagctccgacgcctcgggcggggacaacagcaccgactccgagtcggaaggccgcgtcgtctattccgacatgaagctggctgatgagacgggatctgcgccggctccggcaccggcgccggngccgacgaccagttgaagcgaggaaggtggccaaaactgatggcccggctactatctttt

SEQ ID NO: 62338 - DNA, 257 bp, Zea mays
  Clone ID: LIB3075-041-Q1-K1-D8
cttcgatttgcttcgggcggaccgtgtgctgatcgcgcgcgcctgggaaatggaagtcgaagcgagggccaccgatccggtacggtggcgcctcgcatcaagagatgcgagatggggcgtcaagtcgaaaccagttctaatgataggatcagtgtatctctgaagatacggtatgggttaccctaccgtatttgtaaagtaatgatgccggccgaacgacctttcctaacgcgtttgggcagaaattcgttgctgtc

SEQ ID NO: 62339 - DNA, 401 bp, Zea mays
  Clone ID: LIB3075-041-Q1-K1-D9
ctaatccaagacaaaacatggctgtgaatgtgagaaccatgtggtcgtcgatgcgggcacatgttgcgatggctgtggcgttggtgttcttggtgagcggcgcatggtgcggtcctcccaaagtccccccaggcaagaacatcacggccacctatggcaaggactggttggacgctaaagcgacatggtatggcaagccgacgggtgccggtcccgacgacaacggtggcggctgcgggtacaaggacgtgaacaagccccccttcaatagcatgggcgcatgcggcaacatccccatcttcaaggatggtctgggttgtgggtcctgcttcgagatcaagtgcgataagcctgtggagtgcttccgcaagcccgtggtggtgcacattacggacatgaac

SEQ ID NO: 62340 - DNA, 205 bp, Zea mays
  Clone ID: LIB3075-041-Q1-K1-E10
acaatgtgtttggttgttggatgctgagagattggttctcagctcagatgcaagctgcgcctagcctgtgtaggtttgtgctggtacattgagagctcttatttatttgctttgattgcaattaaccaggatgaccatagccctttgttttggttttgcttgttttttataaagtttgcattgaaacaaccacttctgtttgggt

SEQ ID NO: 62341 - DNA, 433 bp, Zea mays
  Clone ID: LIB3075-041-Q1-K1-E11
ccgggaggatgctgcagcgagctacagatatggtctcgagtgtctattcagattttatagttatggtttggagaaaaaattccaacccaatgtatatgaagatttcgagaagcttactttcgaattctaccgtaatggtgatctttatggactcgaaaaatactgggcatttcaccattaccgaaatccagatagcggtcctgtagataaacttccagagctggagaggcttctgagggaggagttccagaccctagaggacttcaaggcaaaggagaaagcccgagcgacgacggagaaaggaactggcatcagtagcagcagtgtggtggtggccgcaagtcatagcaaggctgagactaagcaggtctgagtcccgcatgaaaattttcggtggtcgcccccagcaaaagaggaagtagcgttttctttt

SEQ ID NO: 62342 - DNA, 324 bp, Zea mays
  Clone ID: LIB3075-041-Q1-K1-E12
atcgtcactcactgcatcgttcgttcatccatcaactactggaaattagagagccggatctcttggtcggagaacctgcgaggaaggactaatgagtcgaagatgactgcggcggtgctgtccgtgcgcacgacgacgacgtcgctgctagcagcagtcatcctgtgcctctgcatcgtctccctatccccccgcggcgccgttgccgtgcgggtctcccccggcgccagcccgatcgtggccacctgcatgacgggcccgtacccggagctgtgcgtgggggagctgggacagcggctgctggacgtgcagacgtccatcgcg

SEQ ID NO: 62343 - DNA, 413 bp, Zea mays
  Clone ID: LIB3075-041-Q1-K1-E3
cggacgcgtggggccggccatctgctaccaccagtgcgtcgtcagcaagtgcctctgcttcccaccctttagcaaagagaaaacgatgtgcatgaagagctgctgcaacaagtgcttccaccacggcccgccagcgcctggtcctggcccgaagccgaggccgccaatgcctggtcctccgaagccgcctgccccgaagccgaagccgaggccgccagcgccaaagccaccgacgcccaaggcgccgccaccgccaaagaaagccgtgtccctgccccccgggcagcgacgaggccaaggccgacagcaaaaactgattcatacgatgggatggatcggccagtcatcatcagaagcactcatattagtatatacacatcgtaagtacgcgtgtacgtgtaacgtacgtactc

SEQ ID NO: 62344 - DNA, 354 bp, Zea mays
  Clone ID: LIB3075-041-Q1-K1-E4
caaaataatcgccaccgctctccgcaccgaaccgaagcagcggcgatgtcggcggagaagccggctcccgtgcgcgtgctctactgcggcgtctgcggcctcccggccgagtactgcgagttcggccccgacttcgagcgctgcaagccctggctgcgcgcgcacgcgcccggcgtctaccccgacgaccttgtcgccgtctcctactaacccggcggcggcgacaaggacgtccacaaggtcggggatcgccttcagggcgtcgggatctccgacagctccaccggcgccgcaggggatgcttccgcgtctaagccccaagaggcgaaacgcctgcctggtggttagctcaag

SEQ ID NO: 62345 - DNA, 187 bp, Zea mays
  Clone ID: LIB3075-041-Q1-K1-E5
tttatatcttcacctttttacatgttggtttgtctgtcttccttgctatctgcaccaattatgtatatatcaaacaacaaactaaaagatgggttaaagtaaaatttgatgcaatgccacttgcatagtaaagtaatcacttacctggttaaatctttcaagggggtaacaagggtcaaatatgttt

SEQ ID NO: 62346 - DNA, 373 bp, Zea mays
  unsure at all n locations
  Clone ID: LIB3075-041-Q1-K1-E6
caagcacgtcgcgaggtcggcccgcaccatcccgccgcagcagacgcaggcgctcacgttctgcgacaccatgtacatgaacacgcaggacaccatcggcgcggcgcagcgggccatcacgttcaaggacaccggcaccgccaagatcatgctgcagctcgccgtccaggacttcgactcgtgcgaccgccccttcacccaggccggcgtccccaaccccatggggaagtttgacaaggagctcaaccagatggccaacaactgcatggctcttgcanacatgatatgaaccacgcatgcaacctcaggcgtgaggtgccatcgcatgcagggaatgcttgcattcatttttcatttaattaagaattcattg

SEQ ID NO: 62347 - DNA, 452 bp, Zea mays
  unsure at all n locations
  Clone ID: LIB3075-041-Q1-K1-E7
gtcaaggccaagatccaggacaaggagggcattccaccggaccagcagcgtttgatcttcgctggcaagcagctggaggatggccgcacccttgcggattacaacatccagaaggagagcaccctccacctggtgctccgtctcaggggtggcatgcagatctttgtgaagacactcactggcaagacaatcacccttgaggtggagtcttcggataccattgacaatgtcaaggccaagatccaagacaaggagggcatcccaccggaccagcagcgcctcatcttcgccggcaagcagctggaggatggccgcaccctggcggactacaacatccagaaggagagcaccctncacctggtgctccgcctaggggtggcatgcagatttttgtgaagacattgactggcaagaccatcaccttggaggtggagagctctgacaccattgac

SEQ ID NO: 62348 - DNA, 454 bp, Zea mays
  unsure at all n locations
  Clone ID: LIB3075-041-Q1-K1-E8
tgatgacattgacagttatgaacttgacttgtcaaaaggtagtcacacaggtggagtgtcaaggatgagttattcggatcttgagagtgcttctgattcagaaggttttagtgaaattgataatagtagagagtccagatatggtaatagtaaagagtccagatatgataatggtagagagtccagaaatgataataatagagagtccaaatatgcagccaaggttgaggatgaatttgaggatcatcattccctgagatcgactcatcttgctgattcctggcaaaaaaccagaggtcggagtggttcgaatgactacagaagggcatcttttggatcagagagtgatgatgagatcaattcttatccggacgaggacattgacaaaggtcctagaaataatggaagccgtagtcagggaagtaccaacagagcttttgtangcacaatgcac

SEQ ID NO: 62349 - DNA, 267 bp, Zea mays
  Clone ID: LIB3075-041-Q1-K1-E9
ctctgccccaccaaagaaagaagaagattcaacggcaccaccggcagaagccctacctccaccttcattcaacgacatcatccttccacctatcatggccaacaaatacgcatctccgcctcctcctctattccaaggatattaagctctatggagagatggtcgaccaagaatgaattgaacaacaatatataaggtcgcatgcgcaaccaaacagctacatgtacattgcaggcgtgtgtgaaattgtttatttattttttgcat

SEQ ID NO: 62350 - DNA, 286 bp, Zea mays
  Clone ID: LIB3075-041-Q1-K1-F1
aaagcatcgatcacgacaagatggcgtgcacaaacaatgcgatgagagccttgttcctcctggtcctcgtctgcatcgtgcatggtgagaaggaagagtcaaagggcatcgatgctaaagcgtccgggcctggtgggtacttcgacatcaccaagtagggcgcctgcggcactctcatgacatacaacttctttgctatgaacatgtcccggtccacgggcatgctgttcaatgacgtgacctttactgttctttgcgacagtcccatcacggttggtttcacatg

SEQ ID NO: 62351 - DNA, 289 bp, Zea mays
  unsure at all n locations
  Clone ID: LIB3075-041-Q1-K1-F10
cgcgaaaataatgaagagccgcagcatggcattatcggccgcgctcttggtgctagccctcgcgctagtggcggccaccgggcccgaggtagcggaggcaaagaagaagagagcggcggatagcggcgaggcggcggaggcgaanaagatccaggacgacttctgctcgacgctgtgcgagggcaagaaggggacggacctggtcgtgtgcaaggagtcctgcgctctctcccagcagtccaacctggtgctgttcggcaggatccagtgcaagggcaagtgcaccgag

SEQ ID NO: 62352 - DNA, 399 bp, Zea mays
  Clone ID: LIB3075-041-Q1-K1-D12
gccttaattatcctttagaactttggctggacatgcaactttagatagccataaccgcaagctgccttgtcctattctcagaaaaataaataaacaaaaccgttgatttatttatatttttccaactatataagctatttatgtcctgatgaagtttattactgacatttgactgaaccatcagctacttgtagcattcatctccagtcttgttacacatggatttattgccatctcttgcctgttgagttgcgcacttgggttgaagcctaccagctggatttttgctctgccgcacctgtgatgctactgctggggggcaatggatatagcaataacaccagctactgctggggggcaatggatgtagcaataacaccagcccatgcttgacacctt

SEQ ID NO: 62353 - DNA, 438 bp, Zea mays
  unsure at all n locations
  Clone ID: LIB3075-004-Q1-K1-F4
gctccttctgcctgaccttgtacgacgacgacgatactttgtgcttgcgcaggacgaccgagagctgggccctctaggagtgcagcctggtccagatggcgccctcgtcctatgctcctgggcaccgggaccaccttgtggaagcgcgcccaccggccgccgacagcccggcgctccacggtgaccttcaccctgggcgcgccctgcggctggcgcccggcagtggacttcaacttattgcgaccggcgctgtacactaccttcagaaacataaccgctgcatgcagccgcgcacgcgacgcgctatatggtgcgacgtgcggtctggccgaatgcgcactactgtcttacctgacacgtgcactacgagggtgancagctgctccgtgattgtngactcacactgtggtaccacagcatgtatgcaataggctgcaa

SEQ ID NO: 62354 - DNA, 447 bp, Zea mays
  unsure at all n locations
  Clone ID: LIB3075-004-Q1-K1-F5
aaatgatgtccgagagtgaagagcatggctcgctcctagacaagatcaacgacaaggtgcaacgagaagatccatgagtataagcactcgtcgtcgtcctcctcctcttcggactcagacgatgacaagaagcccaagaagtctaagaagaagaagctttttggaagaaaacatccattgcatcatgtcctcggaggaggcaaagccgccgaccttgtgctgtggaggaacaaacaggcatctgggagcatcttggtaggggtgaccgtgatctggttactgttcgagggcatcggctaccacctccttaccttcctttgccacgcactaattgtgtttctcaccatctggttcatctggtccaatgctgcgtcatttgtcaacaggtcacctncaaagttcccagaggtcattctatctgaagtccagtgcatgaaggtagctcat

SEQ ID NO: 62355 - DNA, 430 bp, Zea mays
  Clone ID: LIB3075-004-Q1-K1-F6
cttcaacaacatcgtgtccggcctcaagtacaccaacactgtctggaagactggcgtgaaaggggagacccagaagatgatgctgggaacgttcagcccccagctagagccctatatctacgagggcgaagaagagacgacacctgctggcatttttgctagaggctcctattccgctaaactaaagtttgttgatgacgatggcaagtgcttcttggagatgagctactactttgagattaggaaggagtggccaggaggccaatgatgtggccggaccagcagggcagagctgactcgtcggagtacgctgttgttagagctcatagcaaaaagccaagcagaaaatatgtgctatcgcttcaagaatgtttcactactttcttcgtcattatcgattgtgttttgatttgtttcgagctgtcattaa

SEQ ID NO: 62356 - DNA, 427 bp, Zea mays
  unsure at all n locations
  Clone ID: LIB3075-004-Q1-K1-F8
cccacgcgtccgggcctctcctcccggcttcctcacacggcactccagccgctagccctcacgcaaccagacaaccagtacaccaccgccaccaagcccgggccgaataactctgccgggcaaccgccgcccttcgccggcaaagaacgcccaccagatccaccccggcctgctatggagtccgcggtgaacccgaaggcgtacccgctggctgatgcgcagctgacgatgggtatcctcgatatcatccagcaggccgccaactacaagcagctcaagaagggagcgaacgaagcgacgaaaaccctgaatagggggatatcggagttcgttgtgatggcggcggacacggagcctctcgagatcctgctccacctncccttgttagccgaggataagaacgttccatatgtatttgttccatcga

SEQ ID NO: 62357 - DNA, 478 bp, Zea mays
  unsure at all n locations
  Clone ID: LIB3075-004-Q1-K1-F9
gtgacgtcggtgaaccccaagttcttccacatggcgctgctgtcggtgaagaacgtccggatgagcgggctgaggatccgcgcaccgcccaacagccccaacacggacggcatccacatcgagcgcagcagcggggtgtccatcgtggacacgcacatcggcacgggcgacgactgcatctccgtcggccagggaaacgacaacgtggaggtctcccgcgtgcagtgcggcccgggccacggcatgagcgtcggcagcctgggccgatactccggcgagggcgacgtcacgcgggtgcacgtccgcgacatgaccttcacgggcaccaccaacggcgtccgcatcaagacctgggagaactcgccgtccaggagcaacgccgngcacatggtcttcgagaacatggtcatgaaggacgtccagaaccctatcatcatcgaccagaagtactgcccctactacaactgcgagcacaagt

SEQ ID NO: 62358 - DNA, 96 bp, Zea mays
  Clone ID: LIB3075-004-Q1-K1-G1
acacccacgcgtccgcgtttcctcatatgatggaattacttaattattttgtatagaactcctgtgatatagtatatatgtgacattcgatccaac

SEQ ID NO: 62359 - DNA, 263 bp, Zea mays
  Clone ID: LIB3075-004-Q1-K1-G10
gcgacgctttgaaaactcctgtctcacttgatatgctcgggcgcatctttaatggttcgggagaacctattgacaatggccccccgatattgcccgaagcctactcggatatctctggaagctctattaaccccagtgagagaacctatccagaggagatgatccaaactgggatatccaccattgatgtcatgaattccattgctcgtggacaaaagattccactgttttctgctgctcggctccctcacaatgaaattgct

SEQ ID NO: 62360 - DNA, 439 bp, Zea mays
  unsure at all n locations
  Clone ID: LIB3075-004-Q1-K1-G11
ggatccccatggatccatgagagaaaggttgaggagatcaggcgacgtacgctcgtggcggtctgcttctgaacgctgtcaggtgaaccgacccgtgctcccatgggcgcgccgcgcgcaatggcccgacgacggcgccccctaccgtcgccgctgctcgtctggctggccggcctgttctctgcggtggcgcccggtgtctccaagaccgacaagtctcacgctgctgcgctcaatgtgatgttcaatagcgtgaacaagccatcgcaattgtccggttggaaatccagcggcggtgatccctgcgatgacgatgacgagtggaaagggatagagtgcagcggctcatctgtcacataaattaactngtcagggcttgaactacagggctcgctaagacatcagctatcaagcttgaaatcagtgaccaaatttgatc

SEQ ID NO: 62361 - DNA, 412 bp, Zea mays
  Clone ID: LIB3075-004-Q1-K1-G2
tactcactcagcagacgcgcaattgaagcaagagcttgctgctgtcttcaagaaaatcggcggcaagctaacatgtactattggcttctacgaactgtatcggataactcagctctacccaaaggttgatatatttgctcagcttcagaatgctagtgaagcatttagaacctatatcagggatgggctagctcaggtggagaagaatgcagcagctggaagaacgccttctagtcttccactgtccacgccacccccaatagcagcaataccttctccaaaattggcaccgtccccagttcacacaaaatcaattggtagcaaaacagattataacgaagataatgccagtggtgagacacaacctttcataggtcaaggtgacgcccctgaccaacaaactgatagatac

SEQ ID NO: 62362 - DNA, 414 bp, Zea mays
  unsure at all n locations
  Clone ID: LIB3075-004-Q1-K1-G3
gccttaccctcgaagccgaaggcctcgtgccttctcttcctccctggcatggaggaagtagcggtttcgcctatgatcgttgccgccgtagtgctggacaacaatggcgctgacgcggtctcctgcactgccatccctagcgtaacaataagcctagaggagaaagaaaatatcaatggggatgttcccacgatcacctcggccgcaagcaacgaggaggaggcgttgttcagtgtcggagaatccaccaaggacgatggccatcgcttgacgatggaatgctccactcccgtctcctccagtagcccttccactcgcaagaagcgcggggcgttcagcctctttagggcgatgttcctgtccttcggncggagcgacgacagcatgaagaagacagacgacgacaccacgagc

SEQ ID NO: 62363 - DNA, 376 bp, Zea mays
  Clone ID: LIB3075-004-Q1-K1-G4
caaaccctcttcatccccctcccgtgctcgacccagatcgagggctcgatccgtcggccatggcgctggagtgggtggtgctgggctacgcggcgggcgcggaggcgatcatgctgctgctgctgacgctgccggggctcgacggcctgcgccggggcatgatctccgtggtgcggagcgcgctgaagcccatgatgtcagtggtgcccttctgcctcttcctgctcatggacatctactggaagtacgagacgcgcctcacctgcgacgacgagcacgcctgcactcccttcgagcaccttcgtcaccagaagttcatcatgaagtcgcagcggaacgcgctcctcatagtcgtcgggcttgttctatactggat

SEQ ID NO: 62364 - DNA, 183 bp, Zea mays
  Clone ID: LIB3075-004-Q1-K1-G5
acgcccacgcttccggattggtctaaaaataaatataatacttataaaaaaaaaaataaagaaaagttttaaaaaaaaaaaaagccaaccacatctaaaaaaatccatacttacttacactttcatacaacttcatatctcttctatattttcacctatattcaatttactatctcttctttt

SEQ ID NO: 62365 - DNA, 430 bp, Zea mays
  unsure at all n locations
  Clone ID: LIB3075-004-Q1-K1-G7
gtcgggttcgcggccgggctcaccggaaccgcgatctccaacgggctgatcgcgatgcggaagcgcatggacccggcgttcgagacgcccaacaagccgccgcccacgctgctcaacgcggccacctgggcgctccacatgggtgtcagcagcaacctgcggtaccagacgctgaatgggatcgagtacctgctcggcaaggtcgcaccggcgccggtgttcaaggtgtccgttgttgctctccgctgcatgaacaacgtgctgggtgggatgtccttcgtgctgcttgccaggctgaccggngcgcagaaatcagacaagccagcgacggtcgcggaagagaaggagaggttgatagctgtgggcaatgccgcagcagatgccatcaacgaggcgaggcatggaaagggtagtaggtggtagaggagag

SEQ ID NO: 62366 - DNA, 486 bp, Zea mays
  unsure at all n locations
  Clone ID: LIB3075-004-Q1-K1-G9
ggagctgcaggactgcctgccttcggtgactcggccgcctccacccccgccgctgccgcggccgcatcgtcgtcgtcgtctaggaagtctggtccagctgccgcgccgaccaccgccgcctctacaccgtcttcttccacggacgaggagttgagcccttcgccgtcggcatccaccgccgaggtggcgtcccctgccgctgatgggcctgctgagggaccggcggctgctgatgcctccggtgctgctacccttggaagcggagctgccatcgctggtgtcgccgctgctgtcgctaccatgatcttctactgagttcaccagctgggaccgtgtcgtcgagggtgggcacgtagttggctgtgcggtaattgctcgtctggtcgggagggaccaataacgcatgtgttgctttgctttgctcactttcgttgctcttgtaactttatggngtcaaccgttatataactgaaacgatttgattaa

SEQ ID NO: 62367 - DNA, 177 bp, Zea mays
  Clone ID: LIB3075-004-Q1-K1-H1
accgcccgaattcccggtcggccgcgcgtacgcaatagtgttccttattgtgtgtcacaactctagattatgcacaaaccggttaattggtgcagtcttcattttcaagatgatggagtggtggtatcaatctggctgaaaaagaatgtcaactccgactgtatatccaccaccccc

SEQ ID NO: 62368 - DNA, 290 bp, Zea mays
  Clone ID: LIB3075-004-Q1-K1-H11
aatttcctaagcactactggctttttgtagtccatttacatgaactacatccacgggaccgttttataatcccaacgggccatcctacaattcttacacatcatgcatagctctacaaggattatgtccgcctctgaagtcttaactagcgactcattccgcattctacacccaatctttatgtataaacttcttaacctcagctctaagccctttacttctccttctcttgacctcaccaactcaacctgtacattgcgactccgttccagcatttccatataccctac

SEQ ID NO: 62369 - DNA, 365 bp, Zea mays
  Clone ID: LIB3075-004-Q1-K1-F3
gggatgttttaaacagtcaagaattcatatattagagtgcatatatatatatataattctgggagacgttaataatcgagacggcacgcatgttccatcctgccatcattctgcttctcctgctcattgcgaccacccatgtaagctcaagcagcaaaagaattctagaaggacacctagctattacttggggcatgcatgacgtcagacaactgcgcctacgctttccacgatcaaaccttcatctgcgaccatttcagcacctttcaccgtcagttcatctgcactaaaccgcgctaaattaacctactttcggcatctctatcgtggacttttattctatttaatgacttacttgatttttt

SEQ ID NO: 62370 - DNA, 372 bp, Zea mays
  unsure at all n locations
  Clone ID: LIB3075-004-Q1-K1-E1
gcgatcgtcggagcagagagagacttcctcgcctccatcccatcccgccgccgccgtctctagggtcgctaataagcagccgcatccagggatggagatgaagaagatcgcctgcgccgtcctcatcgccgcctcggccaccgtggcgctggccgcggaggcgccggctccgtctcccaccagcggctcctccgcggtcgcacccgccatcgtcggggccgccgtggcctccttcttcgcgtactacattcactgagccgccggacgaggagccggagccggagggaagagaccaaggtggngggagagacttggctgcgctgcgctgctctgctgctcccgcgcattcccgatgcgtgggcgtgctctgat

SEQ ID NO: 62371 - DNA, 414 bp, Zea mays
  Clone ID: LIB3075-004-Q1-K1-E10
ggctaacgtacaatctggtgagctggacttagagctagaatgggttccgatcctctatagtagggttactacgctggtgctgctggctaacaaactatcctgaagatgcatcaaaattttcaagctgtccacttcgatgatcttggacatttatgctggatggcttgaatttgttaaaaaaattgtcattgataaatatcctggtgtaactgtcagctataatcacagcctttcattttgcctcactttggttgacatgccttgtaattactcgccgtctcttgactgatgttgtattgtcccatcgaaaggacacgtgtatcataagacatgggcaattatagctaaaagacagctcagcgttcagacctactcagcatgatgctctgagtgcatatacgctacaagcctaca

SEQ ID NO: 62372 - DNA, 366 bp, Zea mays
  Clone ID: LIB3075-004-Q1-K1-E11
ctaattccgggtcgagcacgcgtcgcgccgcgcgcgcaacagcacatcgctcttcatctacctggcgagtgagcgtccagaccgggaggctttaaccgtggaccttcacatgtcagtgaacgatatctcctgaacgactacctgcttactggcaacacgcacattcctgcgactccgcggcctctccaaagcggtccaggccatgcccatctcacgcctaccaactcgctcatatgcacgcgcacacgcagaagtatggcgtcgatatgacacaccctgaatcatcactgctactgacccatccatcagtggtctgacccatttcacagggccacgtgagatccaccgtatggtcactgtgtgtag

SEQ ID NO: 62373 - DNA, 579 bp, Zea mays
  unsure at all n locations
  Clone ID: LIB3075-004-Q1-K1-E2
aattctctcgggtcgagcccacgccgtctcggctcgtccgtgggaacaaaccgtcgagggagaccgcgtctatcttcgtggacacccanntcgttcggtgccaacgcggtccaatctcctcgagggacaccggtntnnatcaggcnnagcagggcgaatggggcggcattctggcagcngtctcgcacaaaacgaccccacataccaccagcttgtatcgctcgctncgggcccggcccggcttggacaacccnntcgcagtgggggcctgctcgnngtttcttcggaggggcttcatctgctncatttatgatnngttttctttcgcccccgttggtattctattanngtttcaccaatatagaagaaaataggtacctgggtgaactttttaaaagggttgaggggttgttcgnntcttccctttttcttaaacctcttaaaaacccgacaatannaagtattgtatggataccaccaccannataatattatagaccangnntaaagtagtatttagttctaaatatataatgtgtaaagttttgggtattagaatatatatcttttccttttata

SEQ ID NO: 62374 - DNA, 371 bp, Zea mays
  Clone ID: LIB3075-004-Q1-K1-E3
cggacgcgtggggtcggcactcggcagcaaactgaatggcgcttcgcgctgtggagctccgtggattccttctccggcgcatcggcggcggcgaggcggccctgcctcctctcgcgtggcgcggccggccagcgagcacatccgccccggcggacgacgagctcgcggggaagagcgcctacgaggtcctcggggttggggagaccagttccagcgccgagatcaaggcttacttccatcgtctagccaaagagacccacccagacgtcgccgcggctgctggttcccgacagttccttcagatcctagccgactaccagagcctatcagattcacacagaagggctcactatgatagctacctgctatcg

SEQ ID NO: 62375 - DNA, 436 bp, Zea mays
  Clone ID: LIB3075-004-Q1-K1-E4
gcctagttgatgaatacaaggcctgcgagtcgcctgactacatcaaatggggaatggaggaggctggagaggcaaatgttgtggcggcacttgactctaagttggtagtgtaaatataaagtgttgtgcagcaatccacgcaactgaggaagtgctgtctacaatctacattcaagtcatgttggtcatccagaccaaacatgctactgtcacatctagtagtcatcagtttgacgccgcctgcttctatagatccaatcggagtgcagccaaagtgggttttgacgttattttgacctcaaatttgcctttagtctgtgctatgtatatttcgaaacccacttcctctggcctgttttcatttctttagggctagtttggaaactccattttttcaacggatttttattttctcaagttgaaatagttcattttt

SEQ ID NO: 62376 - DNA, 425 bp, Zea mays
  unsure at all n locations
  Clone ID: LIB3075-004-Q1-K1-E5
caaaggtaaaggttatgagggcgtggtcactcgttggggtgtcacccgccttccccgggaaacgccacaggggtctccgcaaggttgcttgtatcggtgcatggcatcctgctagggtctcctatacagttgcccgtgctggtcagaacgggtaccaccaccgcaccgagatgaacaagaaagtttacaagatcggcaaggctggacaagagacccacgatgcctccacagagtttgacaggaccgagaaggacatcactcccatgggtggcttcccccactatggtatcgtgaagggtgactacctgatgatcaagggatgctgtgtgggtccaaagaagagggtggtgacccttcgncagtcccttctgaagcagacttnccggctggccgctgangagatcaagctcaggttcatcgacaca

SEQ ID NO: 62377 - DNA, 399 bp, Zea mays
  Clone ID: LIB3075-004-Q1-K1-E6
gttagttgagggagaagaagcaggggaggggaagcgatgagcaacatgctgcgggcgcgccgccgcctggacctcctgcaggtggtgctcttcgccgctgtgctcctcgtcgtcgtcgccgatgccggcgtgacgagccagtaccggcggaagctggaggcgacggtggagatgccactggacgccgacgtcttccgcgtcccgccggggtacaatgccccgcagcaggtgcacatcacgctgggtgaccaggagggcacggcgatgatcgtgtcgtgggtgacggccaatgagctgggcagcagcaccgtcatgtacagcgaggcgtcgccggacccggagaagatggagctccgggcggagggcacccacacgcgctacgactacttcaactacacc

SEQ ID NO: 62378 - DNA, 395 bp, Zea mays
  Clone ID: LIB3075-004-Q1-K1-E7
cggacgcgtgggcgtgcgaaggcgaccctccctccttcgctccttccgcgccgcctggcggccgtcgccgccatggtgaagtactcgcaggagccgggcaaccctaccaagtcggctaaggccatgggcagggatctgagggtccacttcaagaacacaagggagacagcctttgcgcttcgcaagttgtctttgaccaaggctaagcgataccttgaggatgttattgctcacaagcaggcaattcccttccggagatactgtgggggtgttggtcgcaccgcgcaagctaagtcgcgccactccaatgggcagggccgctggcccgttaaatcagccaggttcatcctggatttgctgaagaatgctgagagtaacgctgatgtgaaaggctt

SEQ ID NO: 62379 - DNA, 440 bp, Zea mays
  Clone ID: LIB3075-004-Q1-K1-E8
gatctacatactatggatgagtatcagtctgttatcatgcagttaagggatgaaaagtcatgactaaaggaaagattatcaaagatggaagaatcgatgtcgcaagagctagtggttgagtgtgacaagaacaagtctttgacagagagggtggaggatctgcatagacaacttgagtctgcaaccaaggaacatgaggcgctgatcgacatcttctcagaagaaaggaaccgacgagaccaagaagaggagagcctgaggaagaagctgaaggacgcatcttccaccatacatgatttgctggagcaactgaatgctgccaggaaaggccgcaaagtttgaggaaataaactagtaacgttgctccttgcgggcatcatcttatattagagtttgaaggttagcttcatctacatagtgctccaagtcgtttgtagcat

SEQ ID NO: 62380 - DNA, 440 bp, Zea mays
  Clone ID: LIB3075-004-Q1-K1-E9
ctctccgtctctatttgtaatctgatagctgacatgatcatatcaatgtatcatgcactgctgtgtcgggttgctaagactgcggtgctggcgttcttgctgagctgcgcatggtgcggtcctaccaaagtacccccaagcaagaacatcactgccacctatggcaaggactggctggacgctaaaccgacatggtatggcaagccgacaggtgccggtccctactacaacggttgtggctgctgctacaaggacgttaacaagccccccttcaatagcatggtctcatgccgtaacatccccatcttcaaggatggtctgcgatgtgggtcctgcttctagatcaagtgcgataagcctgttcagtgctccggcaagcccgtgttggtgcacatcacggacatgaactatgaacctatcgcggcgtaccacttcgattt

SEQ ID NO: 62381 - DNA, 357 bp, Zea mays
  Clone ID: LIB3075-004-Q1-K1-F1
cgcagatgctgctggagcacggcgaccgcatcctgtcgggcgccacgtccgtgttcggcgctgcgcccgtggaggtctccgtgaaggtggccggcatccactggcactacggcagccggtcccacgcccccgagctcaccgcgggctactacaacacgcggcgccacgacgggtacctcaccatcgcgcgcctcctggcgcgccacggcgccgtgctcaacttcacctgcgtggagatgcgggaccacgagcagccgcaggaggcgcggtgcatgccggaggcgctggtccggcaggtgggcgccgcggcgcgcgccgtcggggtgggcctcgcgggcgagaacgcgctgccgcggt

SEQ ID NO: 62382 - DNA, 492 bp, Zea mays
  Clone ID: LIB3075-004-Q1-K1-F10
ggaatcttgacgggtctgtctacagtgtgcttattcatgggcattgtagggcaggaaagagtgggaatgctctcagcgtccataggcaaatgctgcagcgtggttttgctccaaattcaacaagcacgatttccttgattaggggtctatttgaaaatgggatggttgtagaagcagatcaggtgattcatcagttgttgaactgttgttcccttgctgatgcagaagcatcaaatgctcttattgacctcaacttatatgaaggtaatgtggactcagtcttagacgttctgcatggcatggcaaaggatggactgcttccaagtccaagatgagggtgattttcaacattcaagaaccaccctctctgtggaatactggagacctgattgtcatgtttggtacatattgtctcatgagtcataacacgagcatctgaatcagtgttatgtggtaagaacggtctgccctaaatcatgatgtgctccatat

SEQ ID NO: 62383 - DNA, 423 bp, Zea mays
  Clone ID: LIB3075-004-Q1-K1-F11
ctaattccccgtcgagcactcgttccgggatggcagccccttgctaaatgttttcaacccaacatttgactatgtgccacctaaggtggtgttcctattcatgactggcaccttaaggcacagtccgtcttatatgtatcggcttattgctgagtattactcatctgatgatctggtactgagactgaaggcaacatcttgaaagaagacgaaagcactgcaaagtctccttggtggtctgatgtgcagtcatggaattgttggtgggtccagtcactgtcaaacagcatgagatcgatggaagcattctcgcgtttgggcgtaaactgtctagggaatgggatgtgacgtcatggaattgttgtcgtactacaagagaggttcatatacatgaatatatgattgactggctgtgtaaaaggt

SEQ ID NO: 62384 - DNA, 186 bp, Zea mays
  Clone ID: LIB3075-004-Q1-K1-F12
tcttcctgtcacaccttctcttccctctactcctttctattcaactcaccctaccattcctattaggttgcttttaaaacacatcataccactcatataactaatctaacatacaattccatacccaatatcactcccactatcactctcaaacccatactttccaaatattctatcacaaatata

SEQ ID NO: 62385 - DNA, 404 bp, Zea mays
  Clone ID: LIB3075-004-Q1-K1-D9
agaaaaaacgacgtcagtgcgtcaggtgttcggcgccgtatttgcttgtgacttgataagtacgttttctttctggggggagtcctagtcctgagtgactttaagttccaacaaaatctcggtagaatcattatgcattgctcttctgacaataacatccccaacctagacaaaaagatgatgaaacctaacgcccgattgcatactaatgcataattatggtacttatgtcacgaggtggaactcacaatataatctagcacagagaagccaccaagataactcaacttgtacgctaatgtcataaaaatgcgaaaaataaccatttatccatcagtgtcaccatgctcgatttgctcacaccatattacatctaaccactgcgcaactacacagtgtaaagc

SEQ ID NO: 62386 - DNA, 417 bp, Zea mays
  unsure at all n locations
  Clone ID: LIB3075-004-Q1-K1-C2
ggcgggacgagggtatggtctcctccatcgcctccctccctgcacggagcattccagacacggtccgaagccacgaagaggccaacacgaggagggtatgatcttctccattgcctccctccctgtgtggtatgaactatcctcttccatcgcccagataagaagttcttctgcattaagattacttccttgccttcttcgtgcacacacacggccgcatggcgtgccagtgggatgcagtcagcgaacggcgcgcgggcgtgaggcagtcgtgtgctgtgcgcgagaatgggaggggttgcaggaagccgggacgggagccatacgctggggcgcttgagccggattgctccagcttggacgcctnctctggatagctgatggactcgctttcctaactcaagagttgccatgtgt

SEQ ID NO: 62387 - DNA, 343 bp, Zea mays
  Clone ID: LIB3075-004-Q1-K1-C3
attggactgtttgcgatgccaattgtacagatcaagacgcgtattggactaagtttgccgaggtcatgggtatagattcatgaggcgtgttgacgccgctggctgtgctggaccacatccatgcacacaaccatgcgagtagtctggtgaccgacctcattgcaccctcccattcacttctctgcagcagcgacgttcatgcatggtgatcaacgaagaggtttcttctttcctgattttcctcttacacaaaactatttgttcaatggattttcctatacgatctgtgtaccttctttatgctttcaagtcgtaagaattattgtgtcaacatttttaggct

SEQ ID NO: 62388 - DNA, 455 bp, Zea mays
  Clone ID: LIB3075-004-Q1-K1-C4
gagtcgccctgtatttttggtccaatcgtgaaacaaagatggtcctatacatgcgcaaagcagcttattgagaggcttgtatttgctgaaggtgcagaaaatggccttgatttcacaatcgtgagacctttcaattggattggaccaaggatggacttcattcctggtgttgatggtcctagtgaaggtctgcctcgggttttggcttgcttcagtaacaatctgctccggagagagcccttgaagcttgttgatgggggtcagtctcagagaacctttgtctacatcaaggatgccatcgaagctgtagtgctgatgattgaaaatcctgctcgagccaacggccacatcttcaatgttgggaatccgaacaatgaagttaccgttagggagttggcccaaatgatgacagaagtctacacatatgtcttaagaaaagcaaccgttgattaacc

SEQ ID NO: 62389 - DNA, 381 bp, Zea mays
  unsure at all n locations
  Clone ID: LIB3075-004-Q1-K1-C5
gcgcaggacatgcagaactgcgacgagcagttcaggcagatcggcgagaagaacccgatggggcagttcgacgcgtcgctcgtcgagatgtccgagaactgccgctcgctctccaacatgatctgatcgatctccttctccacggacgacaacagagagccgggcgttttgggccctcgcatcgtttgtcgccgctgctaacgttcgcatgcccatgcccgcgagcgcgctctcgcgcgacaataactgatgagttaagtttgttttgctttgaccatctcacatcgttatttcctgtagagatgcgttaatttggtctcggaaacggngaggcgaattgaggtggaatatttataattcaagatacacagttttggttct

SEQ ID NO: 62390 - DNA, 357 bp, Zea mays
  Clone ID: LIB3075-004-Q1-K1-C6
agactattaaggcgctcaatatgtgttacccaagtggcaaaacttctctaacaaatggtgagggccttaatagtctataggccacacaagtgatacaattattaccaactttgggtggataactgaagtagggaaaacttttcttgtcattttaacatctcaaagagtttttctgcaacattcttgtcaacacatttccagtaatcaaagtactggccggtacagtgtttgtgcccagtctcgtcattctcaatcctcttaacacatttctgatattcataccactgcgacacacacttagcctttgaacgttcctctaagaacgcctttggatcagttaccttcttatccgtcatg

SEQ ID NO: 62391 - DNA, 308 bp, Zea mays
  Clone ID: LIB3075-004-Q1-K1-C8
cgcctcatcgtcgttcagctcccttcaccgttaactgcaatgatctcaaccgccacgtgctcgttatactcgagcagagcctcaccaacttcaccaagatcctccacatcgacgccagcttcatcaacataatcaaaccgctttcatcgtcacttacagcgcgaactgtcacaccatgatcacctacatatgctcagccagcttcttctaactaacatagctgcatctataataaattgaagcctctaataattagccatcgttctctatagttcctttctttcttcgttttagtatatgcacctttt

SEQ ID NO: 62392 - DNA, 489 bp, Zea mays
  unsure at all n locations
  Clone ID: LIB3075-004-Q1-K1-C9
cggacgcgtgggggagagagagggagacagggaaagctctcttcctcctcctcctctcgggtggcgtctcttgtccctgtcgtcctcgcccggtttccccggtttttgagaggggaaagaggaggcggaggagagggatggggagggacgagaggttcccggtgtgggaggccgcgctcggcgccggagtcgccgacgccttcgccgctggactcgtcggtgtctacctttccatgccggactccgactacagcttcctcaagttgccacgtaatctcgaggaactccaaatcctcactggccatcttgagaactatactagtgactacaccctacaggtgttggtaggttattgcgctgtgtacatcttcatgcagaccttcatgatcccagggacaatattcatgtcactgcttgctggtgctctatttgggcaactgcgtggccttgcactggtggtctttgctgccactgcangtgcttcttcgt

SEQ ID NO: 62393 - DNA, 324 bp, Zea mays
  Clone ID: LIB3075-004-Q1-K1-D1
gcggcaagcataaagtgaaggaaaacacagccattattccgggaagtgatccatcagcgtaggctgtcattctatcacctcgtgtttttagcctgtctgtctctctcttattttgtcgtgcaccatgtataaaataaaactaaactaggttaaccttgatttgcgaataacgttttctgtttctatggcctagtcgcaaacgaagtggcacaaacattccatggctaatcttgatgcatgagcatcggctgcttttgtttgccacctggcagagtggcagtgcatcctgatgcacagacagtataacagacgtgtcatttgtcg

SEQ ID NO: 62394 - DNA, 469 bp, Zea mays
  Clone ID: LIB3075-004-Q1-K1-D10
ggcgagtccgattctagatcaagcgagtcctcccgtttcatcgcctcggaaaaaggcgggaaggctgcaacagaagaagcagcagcgacagcgattccttcctcgtacctttcgttgcgctcgcgcactcggatcgacccctctagggttttgcatcggcctcccgccagctcctatccctcccctctccctccgccgcgcgcccgcgcggggagccaccaaaccctaggacggcaaatccggtgcgatcacccacggtggaggcctcgtcggcggccgagaggagccgctcagggctcgggtcagggttccggtacctcgccggcgccgcctctggctggtgggaccggtggatggtcatgggagccagcggctccaagcttgagaaggccctcggagaccagttcccggaaggcgagcgctacttcggcctcgagaacttcggcaacacctgctactgcaacagtgt

SEQ ID NO: 62395 - DNA, 374 bp, Zea mays
  Clone ID: LIB3075-004-Q1-K1-D11
ctcaatcgctatacttggagctgagatggatgtgaggtcctcacctgagttagtcaagcgattggttcaagccctttgggtgaactcacggctaggtcactttgtcaagatcttccctgctgtggcacatggatggagcgtgatatacagcctatatgatgcagctgccgtgatgagcgctgaggatgcctttgccgacatgctcgactgggtcgaacccgaacctatagtgaactctgcaccttgtaataataatgcgtattccattgtcctgcaatcggatctagctgctgcagggctgccatccagagttgaacacatcatctagacatcattatgtagctcgtacccagattaagaccctatattataca

SEQ ID NO: 62396 - DNA, 419 bp, Zea mays
  Clone ID: LIB3075-004-Q1-K1-D12
gcacaatcctcgcacctatctgacacatttctcattatcacctcctatattactcgaagtgcttcaaaaccgtgctgtgcactcaaattttgctatcacaaacactacaatgaaacaccactcatccatagaacacactattgctcctgaccaggctccagctgcttcatacacctaccctcctcctgcgccagcatccatgacatggccccatctaactcctgaacatacacaagatgttcatataaaaacacttattacaaatcccacctacatattgtaccactactgtctaccatatatccttactcaacaacgcaacatcatctaaatctactaccacccacgattaccaccagatatccacggatcatgccttaataattccctacgactatattctatcaatcgttacctct

SEQ ID NO: 62397 - DNA, 388 bp, Zea mays
  Clone ID: LIB3075-004-Q1-K1-D3
cgcaggcgctcacgttctgcgacaccatgtacatgaacacgcaggacaccatcggcgcggcgcggcgggccatcacgttcaaggacaccggcaccgccaagatcatgctgcagctcgccgtccaggacttcgactcgtgcgaccgccccttcacccaggccggcgtccccaaccccatggggaagtttgacaaggagctcaaccagatggccaacaactgcatggctcttgcaaacatgatatgaaccacgcatgcaaccccagcgtgaggtgccatcgcatgcatggaatgcttgcattcatttttcatttaattaagaattcattgaaattatgagttatatatatggagtaactctatgtatttggtcctgacctgcactattta

SEQ ID NO: 62398 - DNA, 273 bp, Zea mays
  Clone ID: LIB3075-004-Q1-K1-D4
atcacgacaagatggcatgcacaaacaatgcgatgagagccttgttcctcctggtcctcttgggcatggtgcatggtgagaaggaagagtcaaagggcatcgatgcgaaagcgttcggtcctggtaggtccttcgacatcaccaagctgtgcgcctccggcaatggcaatgacagacagcactaatgctgtgcaagatgcttgggcattggcatgcggacgtactgcgaaacagacaatgctcatacccaagggcgaattacttgtcggacaa

SEQ ID NO: 62399 - DNA, 228 bp, Zea mays
  Clone ID: LIB3075-004-Q1-K1-D5
cccacgcgtccggtattctgcctcatgcgtgtaatgtttcgtcgtctactcatgtagttttattgcgatgtcaaaaaaaaaaaaaaaaaaaaaaaaaaaaaaaaaaaaaaaaaaaaaaaaaaaaaaaaactaacactataaaagatccaaccttacttacgaataaatgcaacttgataacattttctatagtgcaaactaaattgaacaaacattccattgtttaac

SEQ ID NO: 62400 - DNA, 575 bp, Zea mays
  unsure at all n locations
  Clone ID: LIB3075-004-Q1-K1-D6
gcacgtactcggtctcgtgaattcccgtggtcgactccacgtccgtccgtgatccgatcaattggcaagagggagccaagataccatccactcgtagcatcccacacgcaggtacggaagagagggcgactaacaatgngtcgaggctgtngccttggtagcgnngcggtggnnntctgtgccttcctnggttagcgatcaggtgccgtcagggggcccatttcagcgctcgaggggaatgggtgtcantnnttgatcaatttganntcagctgcaagggtaccctgggcannactgcgacaagggaactctgggccccgagggccttcccgcctcaggggaaactccgccatacgactacactccgcggtctgcaactccgatcactcggcttgtctgtcggctgatcaaatatctctctggtnncgatgtgcgcgccaatgtcannatgtcgcaacgcgccgtgcatggtaccaaaggcctcaaagcgtgtggtgctcgcgtgttgtgtattatattacacancatgcattnatacattgggtcgtcgatcgttactggatgcatggcaactg

SEQ ID NO: 62401 - DNA, 239 bp, Zea mays
  Clone ID: LIB3075-004-Q1-K1-D7
ttctgcgacaccatgtattttaacacgcatgacaccatctgctcttctggaccggtcataacgttcgagggcgcctgcacctccaagatcatgctgcaactcttcgtccaagacttttactcgtgccaccgtccctttacccaagcctcgcgttcccaaccccattgggaaattttaccaggagctcaacccgattgtccacaactccatggctctttccaacattttattaaccactc

SEQ ID NO: 62402 - DNA, 305 bp, Zea mays
  Clone ID: LIB3075-004-Q1-K1-C12
cctaattcccggtcgagcactcgtccgctcctcctcaactatcactgctacctcaatgtattccacttcagcctcagctcgctcatgaaggagtttaatcagtagggcggggctgcacactacctgcctcaccctctcatacttatcaccggatatcatcatcaagaaaggctactactgcaccctggcctacatctgattcttcagtctcatcctattcgtactcctcgcctgctacctctcgttccacgactcctacctagtgcatatgtacctcatgatcaccatagcctacctcaagtacc

SEQ ID NO: 62403 - DNA, 372 bp, Zea mays
  Clone ID: LIB3075-041-Q1-K1-B5
actggctaactcggactgcaaactgaaaatatgtgactttggtcttgcccgtgcatcatttaatgatgccccttcagctatattttggacagattatgtggcaacgaggtggtaccgggcacctgaactatgtggttcttttttctccaaatacactcctgcaattgatatttggagcattgggtgcatatttgctgaacttctcactggaaggccactattttctgggaagaatgttgtacaccaattagatattataacagatcttcttggaactccatcatctgagaccttatctcggatccgaaatgagaaggccaggagatacttaagctgcatgcggaaaaaatatcccgtgccctttactcataa

SEQ ID NO: 62404 - DNA, 266 bp, Zea mays
  Clone ID: LIB3075-041-Q1-K1-B6
gccgccaggagggagagggaccgggagatgctcctcccggcggtgggcggggagcatgtctccggcgatgaggacgacgtcgcatccgaccacccccgtcatcggtgggccgaagccgacaacgacaaccgcgcgcgagctccaccttcaccaccatcccaccggcatcgaggcattctcacgagtgataaggagctgggcgtggaagaagttcatgactggatggtgcgcaactctcgtacatatgaatactgcggcatcctgct

SEQ ID NO: 62405 - DNA, 448 bp, Zea mays
  Clone ID: LIB3075-041-Q1-K1-B8
gagcatggaaagaaaaagcctccctaaaacttttgggggcgaaactggtccttactgatgctgcaaaagggataaaaggggcctaagataaggctacagagattttaaacaagacaccaaattcttacatgcttcaacagttcgataaccctgccaaccctaaggtacattatgagactactggtccagagatctgggaggattcaaaggggaaggtggatatattcattggtggaattggaacaggggggacaatatctggtgccggccgttttctcaaggagaaaaatcctggaattaaggttattggtattgagccttctgaaagtaacatactctccggtggaaaacctggtccacataagatccagggaatcggtgcaggatttgttccaaggaacttggatagcgatattcttgatgaagtaattgagatatcaagtgatga

SEQ ID NO: 62406 - DNA, 366 bp, Zea mays
  Clone ID: LIB3075-041-Q1-K1-B9
agaggttgaagcagttgataggacaggaacgttcataggttctttgtgggagtccaagaccaacatgggctctgtgcttctggaagctggacttgccaagctgagttcatttggcttggataggacctcagatgcttatatcctaacaagagctgaacagtctgcgaagcaacagaagattaagatatgggagaactatgtcgagggtgaaaatgcttccaatggatccacacctgaatctaaacaaaagcaaattctcaaggttgttgtcacggaagttcttggtggtgggaagttttatgttcagacaatgggtgaccagagggtggcttcaattcaacagcagcttgcatttttgaaacttaa

SEQ ID NO: 62407 - DNA, 391 bp, Zea mays
  unsure at all n locations
  Clone ID: LIB3075-041-Q1-K1-C1
gcgagcagtctcccaattccacccaataactaataacatctcctcgaacgccaggttccttggaccactatatccaggagcgacgaagtgatccacccgccagccatggagatgaagaaggtcctctgcgccgccctcgtcgccgccgcctcggccaccgccgtgctggcctcggtcgcctccgaggcgccctccgaggcgcccgccggcgcggacggtggtgcggctggccctagcgcaagcggcgccgacgccgacgccgtgcccgccgccggggcgctcgtcgcctcctttctcgcctactacctncactgagcgacgacgcgcggngcggcaacgttgggatgcatcgagtttgggtcatacgattaattaattgctttttttattt

SEQ ID NO: 62408 - DNA, 114 bp, Zea mays
  Clone ID: LIB3075-041-Q1-K1-C10
gggcaagaagaaacagagacggactcgatccatcgtatcggcgcaggacacacaacgcgggcggcgacacggtcaagaaggggggggggaacaaactcgagaccaacatcgcca

SEQ ID NO: 62409 - DNA, 297 bp, Zea mays
  unsure at all n locations
  Clone ID: LIB3075-041-Q1-K1-C11
ctgaggccaaatggtggaagaaacttgttcgagatgatcaaagggcacctcactttgtgaaagttgattgggacaaatgggttgacgaagatgatgatggtgctgatgtcaacttggatgggatggacttctcgaattttggcggtatgggtggtatgggtggcatgggtgatatggctggcttgggtggtcttggtggcatgggtggaatgggcggtatgggtggtatgggaatggatgattntgaggatgatagtgatgaagaggaagtgtcgaaacctcaagctgccggacatg

SEQ ID NO: 62410 - DNA, 299 bp, Zea mays
  Clone ID: LIB3075-041-Q1-K1-C12
ggcaagactatcaccctcgaggaggagtcttcagacaccatcgaccacctcaaggccaagatccaggacaaggagggcatgggaccggaccatcagcgtttgatcttcgctggcaagcagctggaggatggccgcacccttgcggattacaacattcagaaggagagcacccttcacctggtgctccgtcttatgggtggcatgcacatctttgtgaagacactcactggcaagacaatcacccttgaggtggagtcttcggataccattgacaatgtcaaggccaacatccaggacaa

SEQ ID NO: 62411 - DNA, 449 bp, Zea mays
  unsure at all n locations
  Clone ID: LIB3075-041-Q1-K1-C2
aaatggggcaaaaaggcaatgttctttgaccaccgagcaaaccccagcctccgttactctccttcctcttggctcgcttcggctcccgtcgtccccttccttgagatctctaggatacgagcgcattcgcatcgcttcgcctccgccgcggcctggggagatggcgggtttgggaaaggcgatgtacgcggtgggattctggatccgggagaccggtcaggccctcgatcgcctcggctgccgcctgcagggcaagtacttcttccacgagcagatttcaaggcatcgcaccatcatgaatatctttgacaaatccccacatgttcatagggatgcatttgttgctccaagtgcatcccttattggtgatgttcaagtcgggcaaggagcttccatttggtatgggtgcgtcttaagaggggacgcaaacaacatacanattggatctg

SEQ ID NO: 62412 - DNA, 458 bp, Zea mays
  Clone ID: LIB3075-041-Q1-K1-C3
ctgtcgccgctgccgtacccggtgatcctggtgctgctgatggtgacgctgctgctgggcgcctcgtggttcttcacgtacgacgacttcatcgaggaggcgtcgcagcagctgagctgggcgctgctgggcgtgcccatcgcgctcgtcctcctcatccgctggatctcctccgtcgactccttcgagggctacctgggcttctacccgagggagagccgctggaagggccgctacgagcggggccccgccgagggcagctcgccctggggcgtcgccttgctcgtcctcctcctcctcgtgctcgccagcttccactccaccatccacgacatgtgggggccgtgaacggccggatgtgggtcctgctcctgttcgattccacgcgcgcacgtatgcgattgtactgctggttgctgcttgatcgatcgatggatcgatgattccatgtacatatt

SEQ ID NO: 62413 - DNA, 194 bp, Zea mays
  Clone ID: LIB3075-041-Q1-K1-C4
gttatcctcctcgatcttaattacaggtcatagctaagcaggtctgacaggatgtcgtggcagacatacgtcgatgagcacctgatgtgcgagatcgagggccaccacctgacctccgctgccatagtcggccacgacggcgccgtttgggcccaaagcaccgcatttccacaagtcaagacagaaggaagatg

SEQ ID NO: 62414 - DNA, 388 bp, Zea mays
  Clone ID: LIB3075-041-Q1-K1-C5
atctgaacgagtgcccgcacctgtgcgcgctgtcctacgattacctcaagaagaccgagggctacgagcagaacctgctcgccttcttgcagaacaagatgaacccggacgccctgctcgtgcagctcatcgaggagatggacaagtgcatcctcggctacttcttcttccactggaaatatgcgacccacataatcacgcaggttctgacgcacgagcagcctagaagaaagctcagaagaatggttatggaggccactaggaagatgaggtttgagagggtgacgagagagctgaaagttaccaggctgttcaccacgctggtggaggagctcaaggccatcggtgtgcactgtcagcacgaccacaaacgggcgggcacggacgt

SEQ ID NO: 62415 - DNA, 171 bp, Zea mays
  unsure at all n locations
  Clone ID: LIB3075-041-Q1-K1-C6
aacaccctgaatttgagggtataaaatttcttctccaaataccaaccaaattcaggggttacctcttggctctctctctcttttccttttgattaaaagtaagtgaattaggcgagggtttaattatttattttgtcaaaacttatgtgagtcatgaaatgttgcctccna

SEQ ID NO: 62416 - DNA, 266 bp, Zea mays
  Clone ID: LIB3075-041-Q1-K1-C7
cggacgcgtgggctgacacgtgggcgttaacaatacaagtgcacacaaataaatacctggctcgctagattgccaagagcgggggcctttaagttattcattctgctcgccatggtggcgctggctacgctattctcggacggctcatgcaccacccctgtcaccttacaagccggcaaggtctacaagcctggccacttggtccccacccccaacgttgccaccatctatgacatgtagatcaacgagcacggttgtgactactt

SEQ ID NO: 62417 - DNA, 387 bp, Zea mays
  Clone ID: LIB3075-041-Q1-K1-C8
gaatcagcagagccaaaatttgctgttctgttgcagaggagaggctgggacgcatcatactgcaaaaggggtggactgcagtgtacaacagttggggaagagccagtaaatctgttctacatgttcaaagatttgtcagctgtgaatgtgaaggcgacttcgctgaacctcttacacgatgacccagaaatgctaggttaccttgagcagaccggtgatgttgctcaggagggagacgttcttatctcaccaatggagattctggcatacaagttggacctacaaccaccatcatcgcaggaagagtagttttagtttgtgaaaacagtacatgcatattgaacagtcctacatgacagtgaagatggatctttccgaaatacttga

SEQ ID NO: 62418 - DNA, 339 bp, Zea mays
  Clone ID: LIB3075-041-Q1-K1-C9
gggcaggaagaaatcgagcctcactcgatccatcgcctcgccgcagcacacacgaggccggcggcgccatggccatgaagctggacatgtccgcgctcgagaccaacttcgccaacctgaccgccttcggcggcgacgacacgtacttcttcgccgaggcccccgacgtgccgtccatggtgctccccatctgcgacgactttgacggcttccaggcggccaccaaggatatggtgaagaataagaaggggacgaccacgcttgccttcatcttcgacaagggcgtcatcgtcgccgctgattccagggccagcatgggcgggtatatatcctcacaaa

SEQ ID NO: 62419 - DNA, 437 bp, Zea mays
  Clone ID: LIB3075-041-Q1-K1-D1
ataggcagcaatcatgactggtgtgaagccttctcgacctatcctcgaacatatgatcttctccacgcatgggcagtcttctccgacctcgataaaagaggctgcagtgctgaagacctgctcctcgaaatggaccgtatcctcaggcctaccgggtttgccatcgtgagggacaagggcactgtcatcgaattcatcaagaagtacctccacgcgctccactgggaagcagtagcggctgcagatgccgagcccagctcggaatcagaggagaacgagatgatcttggtgatccggaagaagttgtggctaccagaagcaggctcgcacacgtgattcccttcccggcgtctgcagctcagaagcgaggcgccagctgcaccagccatgatttatttctagccttaatgcacacatggagatagatttattattta

SEQ ID NO: 62420 - DNA, 222 bp, Zea mays
  Clone ID: LIB3075-041-Q1-K1-D10
cagacgcatggtacgtcgggcttacccctttatctccagccgggtaacacttgccgcgctgggctcttccaccggcgggaggatgtcgttcaacaagatcgtcgacatcgggagccttgccctcgtgatctacagggactactatggccgcctcgacgtgatcggcgatgtggtggtccagtacaaggtacttcgcgtacgcattgatctgggcaagggcct

SEQ ID NO: 62421 - DNA, 322 bp, Zea mays
  Clone ID: LIB3075-041-Q1-K1-D11
agccagccagccagccagccagccgcttgggcgccatctctctagagcttcgtaccctcgaagagagatccggcgcggcccaataaacacccggctcactacagactcgcagatggccggcctcaggatgaagttcgtcgccgtcgccgccatggccgccgcgctcgtggcgttcgccgcagcgcgaggctccgcccggtcccggtcgacgcgggcgtctaagatcaactactacctgctcacgatactcttatggactaatcatactgcgcgttcacgcggatggaacctgcgtccactatcgctgagaatcccttgcagt

SEQ ID NO: 62422 - DNA, 364 bp, Zea mays
  Clone ID: LIB3075-041-Q1-K1-B4
ccgaaccctagccccgggcccacccttagcgccaaccccgccgcgctcaacgccgtcaagctatacctgcacatcggcggctcctccccctgcgccaagtggatcgtcttcgacagcctcgccgccgcctccttcgtacgcaccggcgacgacgaggacgacgacgcgcccgccggcgggccgtggtgcctcgtcgtgggctcgaagatccaggccagggtcgggcccgagctgcagctcaagaccttccccgcgcagcgccgggtggatttcgttgccgacggcgtatgggcgcttaagttccgccacgctgacggcttcggtgacttctgcgcgaagtaccacagctgtatgtttgagaaca

SEQ ID NO: 62423 - DNA, 387 bp, Zea mays
  Clone ID: LIB3075-040-Q1-K1-F10
gaacgccgggccgtttcacttgtcttcttcctccgatccctcccggcggccggccgggctcgggcgttttccccttttgtttcccatggaggacgccaagatggggaacggctccaccatccgcgcggtgctcgccatcctccagtggtggggattcaacgtcaccggcatcatcatcaacaagtggatctttcagaaactggagttcaagttccccctgacggtgtcgtgcgtccacttcatatgctcctccatcggagcctacatcgcgatcaaagtcctgagaaccataccgctgatcgaggtggccttggaggaccgggggggggagatattccccatgtcgttggtgttctgcgtgaacatcgggctggggaaacggtagcc

SEQ ID NO: 62424 - DNA, 170 bp, Zea mays
  Clone ID: LIB3075-040-Q1-K1-F3
gcatcatggaacatcatccatccgagctaagtaattaggtcgaaaatgacccgtgccagcagggggagcagcagccggtgtgtgacgctggtactgtacggtctccgcctgctgcttctggttggggttgcgcaagcggaattggagttggtgcctgctgatgaataata

SEQ ID NO: 62425 - DNA, 260 bp, Zea mays
  Clone ID: LIB3075-040-Q1-K1-F9
gcgtccggcgtactctgactggctttacttcgttccatgggggctctacaaggctctgatttggtccagggtgaatttcatcagccatgtgatgctcatcggagagaacggatttgaccagcctggaaatgagaccttgccagtcgctctgtacgacaagttcatgatagactacttcgagaagtacctgtacgagctccagtgcgccatacgcgacggtgcaaacgtcttctgctacttcgcgtggccgctgctggaca

SEQ ID NO: 62426 - DNA, 87 bp, Zea mays
  Clone ID: LIB3075-040-Q1-K1-G10
acgggtgccgagagcagagcgagataaaaaaaaagggaaggcgacggaaacgacaagggcgacgggggggcagggacaaggacagga

SEQ ID NO: 62427 - DNA, 325 bp, Zea mays
  Clone ID: LIB3075-041-Q1-K1-A1
cggacgcgtgggcggacgcgtgggcggacgcgtggggacgggcacaagatgcccgaggcgcgcgacgaggacaggcagggcctgggcctcaactgcctagaggcgccgcttgacgtcgacatcaagaacggagggcgcgtcgtggtcctcaacacccagaacctgccgctcgtcaaggaggtcgggctcggtgctgaccttgtcaggatcgacgcccactccatgtgctcgcccggcttctcctgcgactccgcctaccaggtcacctacatcgtgcgcggcagtggccgcgtccaggttgttgggatcgacggcacgcgagtgc

SEQ ID NO: 62428 - DNA, 398 bp, Zea mays
  Clone ID: LIB3075-041-Q1-K1-A10
cggacgcgtgggctttcccgcggtgaggcccgaccggagtccacacacacacacacacggtgtcgatggcggccgtaataaggagccgccgcgtgtccgttgtcttctacgtcgtcctcgccgcagctgcagccgcggcgcaggcatccaataacgtcacctccgacgaggattactgggcggagcgcgccgaggtggctcggtcgcgcaacctcgccgcctacgtcagcgaccccgtggccgccacgaaccgcttcaacgcggacgtgctgagggccacgacgcggcgggcgctggcgaggtacgatggcccgtgcatggcgaccaaccccatcgaccggtgctggcgctgccgcgccgactgggcgacggaccggaagcggctggcgcaatgcgcg

SEQ ID NO: 62429 - DNA, 463 bp, Zea mays
  Clone ID: LIB3075-041-Q1-K1-A11
gtcgtcggcgccggataacgagtagagatggaggagacggcggcggtagcggggacggctgagaaggcgtcgtcgtacaggtactgggtgcgggaggccaccggcgacgccgcgccgctccccgtcccgcgcaagctcgacaccgctgccaacgggaacgggaacccgccgcccgtcggctccgtctggaatcaggctggaacatgggaggaaaagaacctcaactcatgggccaatagtagaataaaggatttgatgggctctttaggttcattggccttccctacagggaaggcatctattgacgaagtgtccaagtgctcaagcgacgcatttcaggtcattgtccgcaacaagaagagagtaggatataactatgaactaagcttgagatttagcggtgaatggttaatcaaagaagtaaacatgatgttcaaagggcatttagacatttccgaggttt

SEQ ID NO: 62430 - DNA, 365 bp, Zea mays
  Clone ID: LIB3075-041-Q1-K1-A12
caaccaggtcgaccatacggtcctttttacctgtaacgggatgcagtacaggaagaactggtggatggacgggatgccaggggcgcagtgtccgatcctgcctaacaccaacttcacgtacaagtggcagcccaaggaccagatcggcagcttcttctacttcccgtccatcggcatgcagcgggcggcgggcggctacggggccatcagcgtgggcagccgacttctcataccggtcccgttcgaccagcccccgccggagaacgaccacgtggtgctcatcggagactggtacaccaaggaccacgaggtgctagcccgccagatcgacgccggcaagggcgtgggccgccccgcgggcgtgc

SEQ ID NO: 62431 - DNA, 71 bp, Zea mays
  Clone ID: LIB3075-041-Q1-K1-A2
ggcccccccctttttaaaaaaaactgtcgacccccttcttttttaaaaaaaaaaaaaaaaaaaaacttttt

SEQ ID NO: 62432 - DNA, 429 bp, Zea mays
  Clone ID: LIB3075-041-Q1-K1-A5
cccacgcgttcggtcgctgctcacggacgccgaccgcctcatggaggcgcggcgcacggtctcccacgaggtgcacggcggcggcgggggcttcggcagcccgacgtcgtcgtcctccccgtcctcggcgtcgtcctccgcctcctccaggacctcgcgcacctggtccttcggcggcggctcccactactccgacagccctaccatgtgcctcacctgcgcccccgacgccgactaccgccacgacaaaaaatgcgacgcctacacggccgacgacgactgttgggccgcctcgtcgaattacaagagcggcagcaggtgggcagccacagtggacgaaggcgacggcgaggaccagcagcagcaccaggggctcatggacgacgcctgggacgcccactcggtgaaggacagcaccagcggcacatg

SEQ ID NO: 62433 - DNA, 333 bp, Zea mays
  Clone ID: LIB3075-041-Q1-K1-A6
aaaaaaaaaaaaaaaaaaaaaaaaaaaaaaaaaattaattaaaaaaaaaaaaaaaacccaaaaaaagaaaggaaaaaaaaaaaaaaaggggggggaaaaaaaaaaaaaaaaaaaaaaaaaaaaaaaaaaaaaaaaaaaaaaaaaaaaaaaaaaaagggggggccgttttaagggatcaaattttacttccccgggcttgcaacgaaatattttttttttggggcccccaaaataaaattaacgggccggcgtttaaaaacggggggatgggaaaaacctgggggttcccaaattaaatccctttgaaaaaaatccccttttggcaggtggggg

SEQ ID NO: 62434 - DNA, 164 bp, Zea mays
  Clone ID: LIB3075-041-Q1-K1-A8
caacttgggtaggtatcgtgtcttcggtcattaaagtgaagtattctgtatcgccgccagtaatttttgtggcttttgatgttggaacgccgattttcaaatcaaagctgacgaccacttcttgatcaaaaaaaaaaaaaaaaaaaaactagttctagatcgga

SEQ ID NO: 62435 - DNA, 115 bp, Zea mays
  Clone ID: LIB3075-041-Q1-K1-A9
cgaactcgttggcgagatcgttctcgttttttttagcaccaccattcccaacgtccaggggcttctttatgactacttggggggcaattattcttacaaggtcttgaaccctgat

SEQ ID NO: 62436 - DNA, 366 bp, Zea mays
  unsure at all n locations
  Clone ID: LIB3075-041-Q1-K1-B1
gagacgacgacctcgatcgcgttccctgtaacgccaccaccaccgtcaccgccatcgctcgcccggatcgtcaacatggcagccggcctccgtgtcctcatcgccgtcctcgccgtcgtctcggtctctctccggcgcgccacggcgactacggcccccaccgtcgtcgacgaggcgtgcaagcagtacaccaagtacccggagctgtgcgtcaagtccctgtcgtccgcggcgccggaggcgaatgcgaatgcggagcggggcgggctggcggggctggccgggctggcgctggcgcangcggcgcantgcggtgccgagacggtggcgttcgtcaagggcctggagaaaatgccggggggcatg

SEQ ID NO: 62437 - DNA, 462 bp, Zea mays
  unsure at all n locations
  Clone ID: LIB3075-041-Q1-K1-B10
cccacgcgtccgcaaatcaaaccatagcatcaatcatgtctggtcgttcgtggacaataatggcgcctctcctggcgtcgatgctgctcgtcgggctcgccgtgggctccgaggaggaggaggacggcggcggcaaaaagaagccccacgtcaaccacggcaagtttaaggcggagccgtggacggacgggcacgcgacgtactacggcgggcgcgacgggttaactgacaccacggacggcggcgcgtgcggctacaagggcgagctggggaaagactacggcaccctgacggcggccgtgggcccgtcgctgtacaccaacggcaccgggtgcggcgcgtgctatgagctcaagggccccaagggcaccgtggtggtgacggccaccaacgaggccccgccgcccgtgaagcggcagaagggcgagcanctcgacctcaccataccgggcgtcctcaaga

SEQ ID NO: 62438 - DNA, 469 bp, Zea mays
  unsure at all n locations
  Clone ID: LIB3075-041-Q1-K1-B11
ggactgcaaagtgctgccaacaagcgtgttgttcgtgaacaaccagaacacggtggtgcgcgacgtcacgtccgtgaaccccaaggtctttcacatggcgctgctgtctgtgaagaacatccggatgagcgggctcaagatcagcgcgccctccaacagcctcaacacggatggcatccacatcgagcgcagcagcgggatatccatcatggacacgcacatcagcacgggcgacgactgcatctgcatcggacagggcaacgacaacgtggacgtggcccgcgtgcagtgcggcccatgccacggcatgagcgtcggcagcttgggtcgctactccggcgagggagacgtcacacgggtgcacgtncgcgacatgaccttcacgggcaccatgaacggcgttcgcatcaagacatgggagaactccccttcctagagcaacgccgcgcacatggtcttcgagaacatg

SEQ ID NO: 62439 - DNA, 426 bp, Zea mays
  unsure at all n locations
  Clone ID: LIB3075-041-Q1-K1-B12
caacgctatggccgtcgggagggagagggaccgggagatgctcctcccggtggtgggcggggagcatgtctccggcgatgaggacgactcggatccgaccacccccgtcatcgctgggccgctgtcgccaacgacgtccgcgcgcgtgctccacctncaccaccatcccaccggcatcgaggcattctcacgagtgataaggagctgggcgtggaagaagttcatgtctggatggtgcgcaactctcgtacatatgaatactgcgtcatcctgcttccgatcgccatcaccttttacacgacatggtggttcatccgcttcgtcgacggcttcttctcgcccatctacgtccatatcgggatacacctcttcggcctcgggtttgtcacctccatcaccttcatccttctcgtcggcggtgtcatg

SEQ ID NO: 62440 - DNA, 381 bp, Zea mays
  Clone ID: LIB3075-041-Q1-K1-B2
gcgactgctagctactcgatcggatcctgaccacgcccgcctaccaggccaccaccaccaccacccacaaatccccaatggcgaggcgcatcgccgtggcggcagcgttcctggcgctggccgtggtggctaccgccgcgctggcgcaggctcccggccccgcggcgacgccgagcgggccgccgaacgtgacggcgatcctggagaagggcgggcagtacaccatgttcatgcggctgatgaaggagacgcagcaggacacgcagctgaacagccagctgaacagctcgtacgccagcagcggcggcgggtacacggtgttcgcgcccaccgacaacgccttcaacaacctcaagcccggcacgctcaactcgctgacgc

SEQ ID NO: 62441 - DNA, 322 bp, Zea mays
  Clone ID: LIB3075-041-Q1-K1-B3
agatcgcgagcgccgcccttttttttttttttttttttagcatccatgattttttttcatacaagagttgtccacgtaaaacatgtctcgtgttcgatctatatttacattatttgacaacatctgtcatatgttatcccactaatatcttattggagatatatttggaagatgctggaggtgctcaaaacacttccgagaaacaacttattctggcggaatttgtcctaatgatacatatttgccattagttcaattctttggccatgctgctcggttggtatggccgaggacaacatctaaatattatgttatgacagtt

SEQ ID NO: 62442 - DNA, 347 bp, Zea mays
  Clone ID: LIB3075-040-Q1-K1-F1
caccgtcgccgcaagaccggagccctaattccaagcggtaaacgatgaggccgcacgcggtgggtatgggtggcggtggcgtggggaggcggaaggcgggggccgccgccgccgcggctagtcgggagtggatggtggtgccggcgtcgggcccggcgcgggtggaggaagcagggaagcacgcggtgatggcgcgtacggggcttcccgcgcgcgatctcagggtgctcgacccgttactctcgtacccgtccacgatcctgggccgcgagcgctccatcgtcgttaacttggagcgcgttatagctctgatcacagccgcggaggtgctgtttcctaacaccaag

SEQ ID NO: 62443 - DNA, 145 bp, Zea mays
  Clone ID: LIB3075-040-Q1-K1-B6
gagatagataaatatccccaaaccctagctcccgatctcgatggcgaacccttgcgttttggggacatgaccgtctgcgtctccccgtctggcctgatctttaaggagctgtactccaacgttgtgcccaataccgctgttaact

SEQ ID NO: 62444 - DNA, 450 bp, Zea mays
  Clone ID: LIB3075-040-Q1-K1-B7
cggacgcgtgggaataattgggaataaatagttcgtgaatccctgaagcgtgcatatatatattcctgccaagataaaggtaatggagtcgtcacgcaggttccagccggccgtcatcctgcttctcctgctcattgtgtccaccgatatggcacaggcaagggaatgcgagaagtacagtgagcgatttgttggggcatgcatgatcgcagacaactgcgccaatgtgtgccgcggtgagggcttcttggccggcaggtgcagcaccttccgccgccgctgcatctgcactaggcagtgctaaacaagatcgctcgatcgctcgccatgcatcgacaacctattcttaataacgttcattatctcgttcttatttatgaccaatgtcatgtatgttctggtgactgtcatgtatattctgatgactggcatgtatcttgttcatgtatg

SEQ ID NO: 62445 - DNA, 178 bp, Zea mays
  Clone ID: LIB3075-040-Q1-K1-B9
gattccgagaagagcagtattacttcaaattcatgtgctggagatgattatagagacatagggtggggagacgagtcgggcagctgtaactgcgaggataaaaccgtctcagaagcattagagtctggtgcaaatgaaagacccttggagaaaaccatggttcctaatgaaagaaagc

SEQ ID NO: 62446 - DNA, 94 bp, Zea mays
  Clone ID: LIB3075-040-Q1-K1-C9
tccacgcatgcgtgaagatgttatataccacacattctggttggctgagggatggtcacttcgggggtcaccaggttgcatgcggtgaaagcac

SEQ ID NO: 62447 - DNA, 334 bp, Zea mays
  Clone ID: LIB3075-040-Q1-K1-D10
gaagcaccaggattcccaaggtccagcagctcctgcgggactacttctactgctaggggccgaacaagggtgtcaaccctgatgaggctgttgcctttggtgccgctgtgcagggaagcatcttgagcggcgagggtggtgacgagaccaaagatatcctcctccttgatggggctcccctcaccctgggtatcgagaccgtcggtggagtcatgaccaagttgatcccgaagaacactgtcattccgaccaataattctcaggtgttcaccacctaccagtaccaacataccactggctccatccaggtcttttgaggtgagctcagtatgac

SEQ ID NO: 62448 - DNA, 128 bp, Zea mays
  Clone ID: LIB3075-040-Q1-K1-D11
taccactcgttctcccactctttccatctatcacaacatgatgtcgtgctcaaacaaggcgaggagagccttgttccttctgttccctttatgcatcatgcttggtgttaaagaagagtcaatgggca

SEQ ID NO: 62449 - DNA, 431 bp, Zea mays
  Clone ID: LIB3075-040-Q1-K1-D12
ggataattggagatgtaactgaggtctttgatcgcagcacatggaagcttggaaagatcttaaagatgctaaagaacaactactttgttatcaggcttgctgattgcatccagctcaaagagttccacatatctagtttgagaatcccacgtggtctggaagctcctcaaagcaagccctttcatgcagcagataaggccaccggacgcggtaatcgtcgacctgctgatggcgccttgcccggcgcaagggctgcggatcaaatgggtcaccgagcctacgagctggggagcagcggcaagaagcggaaagcaaccgcagacgcccctcaccatctgggcagagcagcagcagcagcacattcccggaatgtcgccgcagcctccaacccgaacggcggcagctacccgcacagctcttcacaggccata

SEQ ID NO: 62450 - DNA, 352 bp, Zea mays
  Clone ID: LIB3075-040-Q1-K1-D2
gccccgggctccccctacgcctcctcgccggaatccgcccccaagcgtgccccacgctcccgtccgcagcagcagcagtctccctccgaggaaggagatgacaaggagaaaccaacacatttgagatttctagtgtctaatacggcagcagggtgcatcattggcaagggtggatcaaccattaatgattttcagtcccagtctggggctcgtattcagttatcacgtagcaatgagtttttccctggtacaaatgacagaatcatcatggtttctggactgtttgatgaagtaatgaaggccatggagctgattcttgagaaactgttggctgagggtgaagaattcaacg

SEQ ID NO: 62451 - DNA, 430 bp, Zea mays
  unsure at all n locations
  Clone ID: LIB3075-040-Q1-K1-D5
cacaatacgaaacgaattaatccccaatcaacacagcaagtcagcaacaagcaaagcagcgacccgagagatggacgcgaggatgttcgggctggagaccccccgggtggcggcgctgcatcacctgctggacgtgcccgacggcgacaaggcgggcggcggcgccacgcgcacctacgtccgcgacgcgcgcgccatggcggccaccccggccgacgtcaaggagctcgcgggagcgtacgcgttcgtggtggacatgccggngctgagcacgggcgacatcatggtgcaggtggaggacgagcgggtgctggtgatcagcggcgagcggcgccgggaggagcgcgaggacgccaagtacctgcgcatggagcggcggatgggcaagttcatgcgcaagttcgtgctgccggacaacgccgacgtggac

SEQ ID NO: 62452 - DNA, 348 bp, Zea mays
  Clone ID: LIB3075-040-Q1-K1-D7
agcagtacatcgaccctagcttcaagtggacaaatttcaccctcgaggagcaggcgaaggtcatcgttgctccgcgaagcaacaacgagatggacgcaaccaagctgaagaacgagttccccgagctgctgtcgatcaaggactcgttgatcaagtacgtctttgagcccaacagaaaggtgcccacagactgaagtccgaagggctggcacagctgataccgtacaacacagcaaccattacaagtgttagactatgtgtgtgggccagcactacttttgggttgtctgcctattaaggttagagtcctgtgagtctatatattgtacctcatctcttatacagtac

SEQ ID NO: 62453 - DNA, 230 bp, Zea mays
  Clone ID: LIB3075-040-Q1-K1-D8
gaagatttgagcaaaatgtacttcagtgacttcaagatgattgacatcaatggatatgcatgctttgtgacgagaactggctacaccggcgaagatggttttgagatctctgttccggcagagaatgcagtggatcttgcagaggccatcctatagagatcggaaggcaaggtgcggctgaccggcttgggcgcccgtgacagtcttcgactggaggcaggcctgtgcct

SEQ ID NO: 62454 - DNA, 341 bp, Zea mays
  unsure at all n locations
  Clone ID: LIB3075-040-Q1-K1-D9
ctgactcttgggcgatcacccgccatgcacattgcagtcgaatgttctttcaaaggtgtttggtgggactgcaaagagcctggccacatggctaacagctgcccaaatgaagggatatgccagaactgtggcaagtccggtcacattgcaagagactgcaccggtccaccattgccggcaggagaagtgatgctttgcaggaactgctacaaaccagggcattttcgtgaggaatgcacctatgagaaggcctgcaatatttgcgggttgancggccaccttgcccgtaactgcaccaatgatcctgttggcaaccagggcaatagtggtggccattttgc

SEQ ID NO: 62455 - DNA, 94 bp, Zea mays
  Clone ID: LIB3075-040-Q1-K1-E1
acggcgaagaaatcgcacgggcctgacattattgtatgcccactacaaggactgcccgggcgcaggggttaacatcattggcatgaacggggaa

SEQ ID NO: 62456 - DNA, 439 bp, Zea mays
  Clone ID: LIB3075-040-Q1-K1-E11
atcgccgccgtggtcccggcgctccgccgcaacctgcggcgcaaccgagtccacctcgcgcgcgcgccccgcctcgcccagctccactggaactgccccgcgcatctcgcgacgctagccaccccgcgccgcttcgatctcgtcgtcgccgcagacgtggtctacgtgcaggagtccgtgccgcacctcatcgcggccatggatgcgctcgccgacgccgagcgcggcgtggtgctgctcggctaccagatccggtcgcccgaggcgcaccaggtgttctgggagaccgttccggctgtcttcccggtgatcgagaaagtggcacgggagcacctcgaccctgagtacgcctacgaggaatccgatgtattcatactccgaagaagcccgcgtcagtgaggtcaggtggtgaacttttgccagcagtttactccccgat

SEQ ID NO: 62457 - DNA, 221 bp, Zea mays
  Clone ID: LIB3075-040-Q1-K1-E12
cgagatcaccaggctccaggagaagtacggaatcgggtccaagacgcccggcccgggctccagcgactgagcggccagggtattgcctctgcagcctcttgtatgatgaagagcaatcaaaaggaacaaattggttgcgctgtgctgtgttacatccagcgtcgctaattactctgttgttattcaggctccataacaattgaatagatatgtgcttgtct

SEQ ID NO: 62458 - DNA, 413 bp, Zea mays
  Clone ID: LIB3075-040-Q1-K1-E2
cgacgatggcgtcgaataagacggtcctcatcgtcgcggcgatgcttctcatcacgctcgtgctggaggccgcccctccggcgaccgccatggactgcaaggccgggtgtgacgaggtcacgggcccactccacatgagcatggaggactgcatgaagaggtgcaaggagatcgctgctaagcaggggcctagggacccttacaaggataacaaacttgacatcccatgaactaattaatgctcctatatcatctgcctatccatgcatgcattgcattgcgtatgcacactgtgcgtgcctgcccacaaagttcgacaacacaccgatctcgacggatttgtaatcgtgtccactcgatcgagagatcgatcgatgcttgttattatattcggattccacattatatataag

SEQ ID NO: 62459 - DNA, 423 bp, Zea mays
  Clone ID: LIB3075-040-Q1-K1-B3
caataccgatttccggaggagggtcctcatcggtctagtggcgccggagaggcttccagacataccccctgatgagatggctagcgacgcaaggaagcaagagaacatgcagatcaaggagaaggctctgttcgactgcgagcgtggagcggttccaaaggcgacgacggaccagttcaagtgtgccatatgtgggcagcggaagacgacctactaccagctgcatactcggagtgctgatgaaccgatgacgactgtcgttacatgcgttgaactgcaacattcactggaagttctgcttgagtgcatcccttggtgaagtgtttacctagttgtgctgaacacactatcctggtgtgatgtgtgtgcttctgtatgtgttactggaagttcgacagggcaggctttatctaactaaccttt

SEQ ID NO: 62460 - DNA, 346 bp, Zea mays
  Clone ID: LIB3075-040-Q1-K1-E5
cccactcctccgaagcaactgaaaacaggctatcgatctcctctgcctctccctcttcgatcgattgggcagcgcagcgaagtaaacatgtctgaccgggcaaagatgtcgtggcaggcgtacgtggacgagcacctgatgtgcgagatcgagggccaccacctcgcggcggcggacatccgcggccacgacggtgccgactgggcgcagagcacggcgttccccgagttcaagaccgatgacatggccaacatcatgaaggacttagacgagccctggcaccttgcgccgacaggcctgtttctctgacctaccaaggacatggtcatccaaggcgagcctggtg

SEQ ID NO: 62461 - DNA, 218 bp, Zea mays
  Clone ID: LIB3075-040-Q1-K1-E9
gcgcccacgcgttcggtaagatgtgatcccaatcagaaccccactttggtgtgaacataatggtgcgcaggatacatcacaacgatgcatgttacccattggttatacttttctctctctaacgattggaaaattatcaagtcagttaacatggtgattcaattttgagaatggctggttatagcttttcatgtactccttcaattcctaaggaaaag

SEQ ID NO: 62462 - DNA, 330 bp, Zea mays
  Clone ID: LIB3075-008-Q1-K1-C8
aattgtataagtagttcatgttatcgaaatgaaaacaataaaggatcacaacgcgcgcgcgtagttgtagatgatgaattataaacacatatgactgagctcaaagttgtttaatcatcatctgttgcgaaatgaggaagacaattggtgtcttgaagctgtgttttcgactgtgtctaaagcgtaaatgtaacgtatattgtgtcttcgcctatgcttaagacattggactagttgattggtcaatttaatttattaaatgttttgattggtgtaatgaatataataagtcgtgcatgccgcatgactaggctttcagtctttcactta

SEQ ID NO: 62463 - DNA, 455 bp, Zea mays
  Clone ID: LIB3075-008-Q1-K1-C9
attgttggacgcgttcccctcctgcacgcaacctcatctcgtcctccagatcctggatgggcgtcctccttgataccttgcctcgcgagtgctctcggtgagctactttgttttgatttatcaggaaatccgtttgcttcatgttatgcaggctcagatctgattgctggattcggcatcttacgggcttgaatagagctaggactgggagaaaacaacaaacccgcgttggatcctgtatcggttagtccttgccttcaaggttcatgttgttttgttttggtggtcgagcatcgcatgttctgcttctggttccagatctggagaaatttctaagtcgtcgtcgtcgtcgtcgttcggttcggagcggatctgaggcgacgatggctggaggcggcgggatctcttgttctgcagtcctgcttcacctcgatggatgatgtctctgcgctgat

SEQ ID NO: 62464 - DNA, 241 bp, Zea mays
  unsure at all n locations
  Clone ID: LIB3075-008-Q1-K1-D1
ctccaataaaagccagcacatccagtcaaatcgagagacctcagccctcangcaagccgaccgccgacgtaccaccgcgccaacccgagagaaagatggagatgatcaagaggatcctcatcgccgcgctcctcgtagtcgccgtctcgggcaccggagtgctggccttcaacgaggccgccgccgccggagccccaaccgtctacgagtcatttgtgtacggcgaagcccccgctggcgc

SEQ ID NO: 62465 - DNA, 279 bp, Zea mays
  Clone ID: LIB3075-008-Q1-K1-D10
cccacgcgtactaaaataatgaagagccgtagtatggcatgatcggccgcgctcttggggctagccctcgcactagtgggggtcaccgtcccacatgtagcgtaggtaaagaagaagagagcggccgttagcggcgaggtgtgggacgcgaagaacatccaggacgacttgtgctcgacgctgtgcgagggcaacaaggagaccgacctggacgtgtgcaaagagtgctgcgctctctacgaggaatcaacctgttgctgtactgcaggatccaacaca

SEQ ID NO: 62466 - DNA, 425 bp, Zea mays
  Clone ID: LIB3075-008-Q1-K1-D11
cactgatccaagacaaaacatggctgtgaatgtgagcaacatgtggtcgtcgatgtaggcacatgtggcgatggctaaggcgttggtgttcttggtgagcggcgcctcgtgcggtcctcccaaggtccccctggtaagatcatcacgaccacctatggcaaggactggctggacgctaaagcgacatggtatggcaagccgacgggcgccggtctcgacgacaacggcggcggctatgggtacaaggacgtgaacaagccccccttcaatagcatgggtgcatgcggcaacatccccatcttcaaggatggtctgggttgtaggccctgcttcaagatcaagtgcaataagcctgcagagtgctccagcaagcccatggtggtgcacatcacggacatgaactatgagcctatcgcggtgtacca

SEQ ID NO: 62467 - DNA, 57 bp, Zea mays
  Clone ID: LIB3075-008-Q1-K1-D12
atggcgcgggttttctttttataggaaccaaacaaacctcccctttaaagcaaccaa

SEQ ID NO: 62468 - DNA, 345 bp, Zea mays
  unsure at all n locations
  Clone ID: LIB3075-008-Q1-K1-D2
gaatctgcgtgataaggtgtctacaggcaacgcanaatttaacttttggaggtcaacgtgatgtgctttttatcctgtgttatcaagaacttacgtgcaggagaccctgccctgcagaaggatgtttctctcctccgtccccccaccccacaccccaaaataaggattcgcagtgacattttaatttggtttactgccctttgaggaagaattaccttttttgatgaggtgaaactataaccttgttaattctcaaacaaatactcttctcccatgttcatagccattatgaggtcgcctgttcaatttnnaaaaaaaaaaanaaaaaaaaaaannnnnnntnna

SEQ ID NO: 62469 - DNA, 433 bp, Zea mays
  Clone ID: LIB3075-008-Q1-K1-D3
cttcgatttggtaccaatccttaaaacaggggactgttgtcttacaccagattgcgtacaaaatttgcgaatgaagtacgtaacaaagaaaggaaacgagaacatttgccgacttgactttgtattcctagattgcaccttctccaaatgcttcctcaagctaccgagcaaggactcagcaatccgacaggttatatcttgcatatggaagcatatgcatgcaccatttgtcttccttgcttgtgatctgcttgggcatgaagatatactagttgaggtgtcaaggactttcggaacaaaaatttacgttgacccgaaattggattgttttaaagcactctcactgacagcccctgaaatcatcactgacgattcatcttctcgctttcagatggttgggttccaccaattacatgatagagcaagcaaagag

SEQ ID NO: 62470 - DNA, 360 bp, Zea mays
  Clone ID: LIB3075-008-Q1-K1-D4
gccatgggtgtggctcgcatcctcgcgcacctattctatcccatcctccttatgtccaccgcgcccgtcgtgcgggccatcaccgacgccgtcggcggcacccggatacctccaggaggcgtgcaacaagacgctgttccccaaggtgtgcatgcacgctctcaaggacaacccaaagtgccaggcggagacggctgtcaccccgcgccggctggccgagctgctcgtgtacgtgtcggacgaggtgggcatgaccgtggccgcctttgaccaccacgagctcaacgccatcaacgacgacgacgttctgtacaagtgcatagacacctgcttcgaggacattgaggaagacgtggcgca

SEQ ID NO: 62471 - DNA, 438 bp, Zea mays
  unsure at all n locations
  Clone ID: LIB3075-008-Q1-K1-D5
ntncggcttgatggtaagccgcataaagttacagatatgggatactgctggtcaagaacgttttcggggtattacaaccgcctactacaggggtgcaatgggaattttgcttgtctatgatgttactgatgagtcatctttcaataatataagaaactggataaggaacattgagcaacatgcttccgacaatgtgaataaaattttggtaggcaacaaagctgacatggatgaaagcaaacgcgctgtaccgacttcaaaagggcaggctcttgctgacgagtatggcatcaagttttttgaaacgagtgcgaagaccaacctgaatgtggagcaggtttttttctccatagcaagagatatcaagcaaaggctttctgaatctgattcaaagccagaggatcgcacgatcagtattaacagacctgatggcggtga

SEQ ID NO: 62472 - DNA, 430 bp, Zea mays
  Clone ID: LIB3075-008-Q1-K1-D6
gtcgtggcagacgtacgtggacgagcacctgatgtgcgagatcgagggccaccacctcacgggggcggccatcgtcggccacgacggcgccacctgggctcagagcaccgcgttccccgagttcaagcccgaggagatggctgccatcatgaaggatttcgacgagccggggcacctcgccccgaccggcctgatcctgggaggcaccaagtacatggtcatccaaggcgaacctggagctgtcatccgtggcaagaagggatccgggggcatcactgtgaagaaaacagggcagtcactcatcattggcatctacgacgagcccatgactcccgggcagtgcaacctggtggtggaaaggctgggcgactacctgctcgaacaggggatgtaacaacaaccccttcccctggaatgcatgttgatgatg

SEQ ID NO: 62473 - DNA, 455 bp, Zea mays
  Clone ID: LIB3075-008-Q1-K1-D7
ggcgagcggacccaccccgcccaactgtcgttatccggattcaggtccctcccaagtccgagctgttcacctcccgccgccccctcgcgccgtcaaggcctccggaaccggtcgcaagcggcgtaggacccccgccgctacagagccctcgtccgtcgcacttcgccgccgcgtcggagtcatccagctcgtcgacgcctggcggggagatccccagtgcgaggggaacctccacgacgggaccttccttcctgatacaggaaggcagggttcatgagcggcggcacgcctgcagcaagcagtagcctgcgggcagcactctcatactgtgtgaggcaagtccgtgcctatgactaccaccactacctctgccttctccacctggccccggccatgcgcaaggccgcgttcacctttcgcgccttcaacatcgagacagcaagggccatggatgt

SEQ ID NO: 62474 - DNA, 142 bp, Zea mays
  Clone ID: LIB3075-008-Q1-K1-D8
cggcaaatagatgatggatggatggttacaaggctgccatgaaaatgcaccctttccccagaccccagcgtatagtataacgctctccccaaactccaagagggaagacaactccaaagtacaatgcaatcttgattctgtc

SEQ ID NO: 62475 - DNA, 448 bp, Zea mays
  Clone ID: LIB3075-008-Q1-K1-D9
cccacgcgtccgcccacgcgtccggaaataattgggaataaatagttcgtgaatccctgaagcgtgcatatatatattcctgccaagataaaggtaatggagtcgtcacgcaggttccagccggccgtcatcctgcttctcctgctcattgtgtccaccgatatggcacaggcaagggaatgcgagaagtacagtgagcgatttgttggggcatgcatgatcgcagacaactgcgccaatgtgtgccgcggtgagggcttcttggccggcaggtgcagcaccttccgccgccgctgcatctgcactaggcagtgctaaacaagatcgctcgatcgctcgccatgcatcgacaacctattcttaataacgttcattatctcgttcttatttatgacgaatgtcatgtatgttctggtgactgtcatgtatattctgatgactgtcatgt

SEQ ID NO: 62476 - DNA, 382 bp, Zea mays
  Clone ID: LIB3075-008-Q1-K1-E1
cagcatcattttgtcaaattaacgaatgaatggcatacatatgatagggggcgatcgatgatcaaacatatcttgttggagttaaatattatttatagagaagctacgccagagcgacaatagaactggtagtatggttggtgtttgtatatactatcgtcgcgccgcctcctcctccgtcatcgtccgaccccaccgtccaacggcacggcggccggccgcgacgacgtcaatgcatggtgtgcgatcgagccaggccagctgcgtgccccctgcccagccagccagcaggcagatcagaccgccggccgccgccttggcgctcagttcatgctgcgggcgcagcgcgtgatggcggagcagccgcggcggtaggggttgg

SEQ ID NO: 62477 - DNA, 391 bp, Zea mays
  Clone ID: LIB3075-008-Q1-K1-E10
cccacgcgtccgcaagcagcaacagcctgtatccggcagtcctcgcctccgcctcctggaccctgaccgtcaacagaggaagacgaggatgtcgggatccaaggtgtacaccctcgaggaggtggctaagcacaacaccaaggacgactgctggctcgtcatcggcggcaaggtgtacaatgtgaccaagtttctggaggatcaccctggaggcgatgatgttctgctgtcttccactgccaaggatgctaccgatgatttcgaagatgtggggcacagcagcactgcccgtgcaatgatggacgagtacttagtgggtgagattgatgcagccacgatacccaccaaggtgaagtacacgccccccaagcagccgcattacaaccaggac

SEQ ID NO: 62478 - DNA, 393 bp, Zea mays
  Clone ID: LIB3075-008-Q1-K1-E11
tggaaggatgaagttgccaaattgacccgtggcgatttccttctccagacaggaaaaattgtgaacatcaaggagtttctgtttgcaagtttcactatttaaaagcaggtcgtgtcacttgtgcggagttaaggactggaccgaggcagtattatcagtttctggatatggattgttgtgctagtttcgatgcaggtgtcaaacaacaattaggctgaagaggtgagcaacatttaaggaggtgctgatgcttgctgataacctatgaaaaggcgttgctgtagctgactacttggtttgtggtcagataattctggacgtgaattttgatatgttggccagattagctgccaaataggtatttcgtatctcttgatttatgggattcacatt

SEQ ID NO: 62479 - DNA, 448 bp, Zea mays
  unsure at all n locations
  Clone ID: LIB3075-008-Q1-K1-B3
tcggccattctttttcggccaattcggccccgtccggtaaccagaaaattgcctgatgaccaagcagttctgcaaccgctggcaggcatgtcacacacaggcttgtaaaatgtccaggcctcgtctcgtttcctcttcgctcccccgtgacgtcagtacgccacccatcctcaccggctgtcggcaccagcccgccgccgacccccgccgccgtgtcacgactcacgacccattgtggtttcagatcagacccgaatcgcgagcagcgatctgtacgtcgtccccgttcgcacgcctagcgcgatggcgcacccgatgtacggctccgggccactcagatccaggaacgcggcgaactcggacgaaatccagctgcggatcgacccgggtgcacgggacctcgacgaggagatcgacgggctgcaatcanggtccgcatgctcaaagg

SEQ ID NO: 62480 - DNA, 407 bp, Zea mays
  Clone ID: LIB3075-008-Q1-K1-B4
tgatgctctcaagtccatgtacagtggtgaaaagatagggaaacgtcaggtcatgatcaggccgtcatccaaggtgatcatcaagttcctgacggtcatgcagcgccatggctacattggtgagttcgagtacgtggatgaccacagagctgggaagatcgtggtggagctgaatggaagactgaataaatgtggtgttattagcccacgttttgatgtaggtgttaaggagatcgagggatggacggcgaggcttcttccatctcgccagtttggctacatcgtcctaacaacttctgctggaattatggaccatgaggaggcccgccgtaagaatgttggtggcaaggttctaggtttcttttattgaaaatgtgtttttttgagccacagatgcgttcaagaac

SEQ ID NO: 62481 - DNA, 444 bp, Zea mays
  Clone ID: LIB3075-008-Q1-K1-B5
ggaggggcccaaggacaggagactgatcttgagattcaggccaatgagatgctgcaccacagggcgaacttaaatggataccttgcataccacactgggcagcccctggataagatcaacgtagatactgaccgtgactacttcatgagcgcgaaagaagcaaaggagtatggccttattgatggagtaatcatgaatcccctcaaggcccttcaaccacttccagcttccagttagtcatgaagtgtgctagaactccgtcaaacatttttgttgtatcaatgtgtatgttggaagccctggctacgtaatattctacgtccaaatgcatcaaagattgtacaaaacaagatatgcggttaggatatccatccttggtgatggatattggaactaaactaacctaacccttagagttaaattgtcaactctatttttctaagg

SEQ ID NO: 62482 - DNA, 436 bp, Zea mays
  Clone ID: LIB3075-008-Q1-K1-B6
acttcacactactctccgcggctctgccgtccgttctcctctcgccgccgccggccgcgcctgcaccctcgcggcactcgcatggcggcgccggctctccgtatcactgcgcggctgggacttgcacttgacggtgccaccgccgcgagacggcgcgaggcctcggcgcctgtggcggtgccggccgcgccgtggctgaagaaggcggcggtccggtgccagcgagccgtcggtgccgctgttgccgagaagaaggatgcgccggtatcggttgcgcaggagagaagcggcgacgggggcgcggcgccggagctcaccgtcgtgatgaagttcggcgggtcgtcagtggcctcggccgagcggatgcgggaggtggcagacctcatcctcagcttccccgaggagcaccccgtcgtcgtgctctcagcgatgggaa

SEQ ID NO: 62483 - DNA, 452 bp, Zea mays
  unsure at all n locations
  Clone ID: LIB3075-008-Q1-K1-B7
gttgatggactatgatgcactgaaggctgtgcaatctggattgggtaccgcagctgttatcgtgatggacaaatctacggatgtcgttgacgcgattgctaggctgtcctacttctacaagcatgagagttgtgggcagtgcacgccttgccgagagggcacaccctggctctggatgatcatggagaggctcaaggttggtgacgcgaagctggaggaaattgacatgcttcatgaggtcacgaagcaaatcgaagggcatactatctgtgcgcttggggatgctgcggcatggcctgtgcaggggcttatcaggcacttcaggccagagttggagcggaggatccgcgagcgagcttgaaaggagctggtggcggcttctgcataatgtgccagccatgttgccctgtactaggttnctgatctctttctaccgaaatatacaaactgat

SEQ ID NO: 62484 - DNA, 427 bp, Zea mays
  Clone ID: LIB3075-008-Q1-K1-B8
gttctttcaggaaagacaactctacagaaagcttcgatttggaatgtcaagagaaacatggggacattgttccgactagctcatcccctgaaaggaagttttcttttagttcttgctcatcaaatgggctccttttgtccaaagagagctctaaacagcaaactagcatccacaaccttgacaagtgtaatggagggcatttgcatgtatcagatgaaacattttctgaagctgctcctaagacacataaatcagcagaggaccatgatgatagatccaaacctccacttataagaggtcgatttagagttatacctgggcatgttgactcaaaggctcaaccacctggcctacagaagtgtcacagcatgcagacaatttctcgccttccatcattaagtataccctcttccgcagaaagtgcatc

SEQ ID NO: 62485 - DNA, 387 bp, Zea mays
  Clone ID: LIB3075-008-Q1-K1-B9
cggacatcgacgaaagctatagccagctagtaacaagagcaaaaacaccatcatctcatccgcccgtctcaacgccaccccaatggcccagagcacgaggatggtggcgctggccctggtggtcctcctggtggcggcgacggcgtcggtgcccacggccaccgcgtacggctgctacgacgactgctacgagcggtgcgccaacggcaagaaggacgaccccgcctgcaccaagatgtgcaaccaggcgtgcggcagcaccgacaagggcgccgccgccggcgcgccggcttgatcgacccgggcttcatcggcgcgcgggctcagctcgatatcagcatcatatacaatcgctgctccgtcgctcacgtcagcccatgcatgatc

SEQ ID NO: 62486 - DNA, 423 bp, Zea mays
  unsure at all n locations
  Clone ID: LIB3075-008-Q1-K1-C1
cgcgtncgatcaaaccatancatcaatcatgtctggtcgttcgtggacaataatggcgcctctcctggcggggatgctgctcgtcgggctcgccgtgggctccgaggaggaggaggacggcggcggcaaaaagaagccccacgtcaaccacggcaagtttaaggcggagccgtggacggacgggcacgcgacgtactacggcgggcgcgacgggttaactgacaccacggacggcggcgcgtgcggctacaagggcgagctggggaaagactacggcaccctgacggcggccgtgggcccgtcgctgtacaccaacggcaccgggtgcggcgcgtgctatgagctcaagggccccaagggcaccgtggtggtgacggccaccaacgaggccccgccgctcgtgagcgggcagaaaggcgagca

SEQ ID NO: 62487 - DNA, 411 bp, Zea mays
  Clone ID: LIB3075-008-Q1-K1-C10
gcaagggcgacgtgaccatccaggtggatggcaatctgctggcgaccacggacctaagggggtacaaggaccatggtaattggatcgagattctacgcgtggataacctggtcatcaccggcaagggaaaccttgacgggcagggcccagccgtgtggagcaagaactcctgcaccaagaagtacgactgcaagatccttcccaactcgctggtgatggacttcgtgaacaacggggaggtgtccggggtcacgctgctcaactccaagttcttccacatgaacatgtaccggtgcaaggacatgctaatcaaggacgtgaccgtgacggcgcccggggacagccccaacacggatggcatccacatgggcgactcatccgggatcacgatcaccaacaccgtcattggcg

SEQ ID NO: 62488 - DNA, 402 bp, Zea mays
  Clone ID: LIB3075-008-Q1-K1-C11
cagagcggcatttcgaataacacaggtgagcgcgacgatgggatccctcgctaataacatgatggtcgtgggcgccgtccttgcggcgctcgtcgccggcgggtcgtgcgggcccccgaaggtgccacccggccccaacatcaccaccaactacaacggcaagtggctcaccgctagggccacctggtacggtcagcccaacggtgccggcgctcctgacaacggcggtgcgtgcgggatcaagaacgtgaacctgccaccctacagcggcatgacggcgtgcggcaacgtccccatcttcaaggacggcaagggctgcggctcatgctacgaggtgagatgcaaggaaaaacctgagtgctcgggcaatccagtcacggtgtacatcactgacatgaacta

SEQ ID NO: 62489 - DNA, 275 bp, Zea mays
  Clone ID: LIB3075-008-Q1-K1-C12
tgtgaatgtgagaaccatgtggtcgtcgatgcgggcacaggttgcgatggttgtggcgtgggtgttcttggtgagcggcgcatggtgcggtcctcccaaagtccccccaggcaagaacatcacggccacctatggaaaggactggctgaaccctaaaccaacatggattggaaggccaccaggtcccggtcccaacaataccgggggcggttgcggttccaaggacgtgaacaagccccccttcaatagcatgggcgcatgcggcaacatcccca

SEQ ID NO: 62490 - DNA, 461 bp, Zea mays
  Clone ID: LIB3075-008-Q1-K1-C2
cgccgagccatgggcgttgatcaagtgcatgtgcgtcttcttagtctcgcttatgctcaccctggccgtcaataacgcccaggaagaagattcacagcggacgctcccgccgttcccctgcatcccaggccagccacgacccccgtggctcccaccctgcccgccagcgccagctgagtgctacacgtcggtgtcggggctgatgccgtgcgcggacttcctcacccacatcgggctggcaccggcaccacccacgagcgcctgctgcgacggtctcaggtcgctcgtcaccaacgcgcccatctgcatgtgccacgtcgtcaatggcgacatcaacaagctcctaccggcgcccatgatacccgtgcgcatggtggcgctcccccgcttgtgcgtcgtccccttcccacgagccacgattcgccagtgcattaaaggccatgtgccacctatgaaccctc

SEQ ID NO: 62491 - DNA, 401 bp, Zea mays
  Clone ID: LIB3075-008-Q1-K1-C3
ggcgcaaaatgctcttctttctggatgctcagccggaggtcgagcagcaatactacactgtgacagattccatgatctgtttccagcgaaaacaaaggtcaagtgtttttctgatgctggatattttttcgatgggaaggatatctccgggaacttttacgctaggtcaatctataagagcgttgtgaatctacatggatcagccaaaaatttaccagcttcatgtacctcaaagccaaagcaatcacctgagctgtgtatgttcccacagtatgttgtcccgacaatgcgcacaccattgttcatacttaatgcagcctacgattcgtggcaggtcaagaacgtcctagcacctagtccagctgatccgaagaagacttgggcccaatgcaagcttgaca

SEQ ID NO: 62492 - DNA, 401 bp, Zea mays
  Clone ID: LIB3075-008-Q1-K1-C5
tttattggggcgaaaagcgatgagtcaagaagaatggtggagaagaaagtcgaggccgccgcgggcgaacttgcgatgggccaacacagagaccatggcgtgctgctcagggggtttgccgggggtcgggaagggtgtattcgtgaaggccgatgggttggagcgctctgtggtggcatgattcctcgacggacttggtggtcaccatggaatcgcgctccgtcgccgagaggactccctgcgcaaccatcctcgaagcgaggttgcgaggcacctacattctacattggagaagtacctggagttgcaccaaaaaggtcaagaacaggtaccactggaggaacatgaaggatgctacgatgagttcggagaggtctaggtcgtcgtctcctagtcaacta

SEQ ID NO: 62493 - DNA, 396 bp, Zea mays
  Clone ID: LIB3075-008-Q1-K1-C6
gccaacattcctaccttcgacaaccccggcatttggagcgtcccgtccaacctctgggagcggtactacctcggggagcagttctacatcaacgtcatctcgccggcgccggccctttgccaacagtacaacatgccccacaacccccttcgcttcggcaagggcctggggcttccccttccgccattctacgcccccgcgcgctaaaaaccaccaaggcgccgctttcacctcgtgttctgaccattcagtctaactaatccattcctgtgctgctcggcgaaataaaatcatcaaaaagaacaaagaccaaggaagcctatggaagggagaagggacctttggtgggggtgagccaaatgagaacgcacggatatatctattgatgtaatcttg

SEQ ID NO: 62494 - DNA, 398 bp, Zea mays
  unsure at all n locations
  Clone ID: LIB3075-008-Q1-K1-B2
gctggctgctcgtgccgtccggccgtccctgctctgctggagtgctggacgctcggagaggcggagagcggacgccggcagagacgcanagggcagaccgtgtcctctctccactgtccagtgatccagtctcctccggcctccgcggccgtgggtgcacggagcctgacagccgatcagccggccgcgagcccgccgcgaggacaaaggaggccgccggaccggagcctggagactggagagccagccgccagagcggaggtatcctgttgccggcttgccgctgttggatctagcggccaggagggcgatttggtgccgttgccgtactgccgtgaaccaagagtgacttgctgtggcgctcggcgatggggcccatattgccatacactataagc

SEQ ID NO: 62495 - DNA, 468 bp, Zea mays
  unsure at all n locations
  Clone ID: LIB3075-007-Q1-K1-H7
agctgcctgatggtcaggtgatcaccattggggcagagaggttcagatgccctgaggtcctcttccagccttccttcattggtatggaagctcctggcatccatgagaccacctacaactccatcatgaagtgcgatgtcgacatcaggaaggacttgtatggtaacattgtgctcagtggtggcacgaccatgttccctggtattgcggaccgtatgagcaaggagatcactgcccttgcgccgagcagcatgaaaatcaaggtggtggcaccgcctgagaggaaatacagtgtctggataggaggatccatccttgcctccctgagcaccttccaacagatgtggatctcaaaggctgagtatgacgagtcatgacctgngattgttcatcggaagtgcttctaagctctgggtcccncttcggctcccatttaattattccttgagtgtttttcatataagctac

SEQ ID NO: 62496 - DNA, 331 bp, Zea mays
  unsure at all n locations
  Clone ID: LIB3075-007-Q1-K1-H8
nccacgcgtccgtctagatcgcgagcggccccctttttggttacctgttttgaagttcactgatccaccaatctaataaagacgccacctatattacagtctctggtcgctgccatgtgtgtacactcgattgtaactgacattggctaccgaatgaatatcatgcccctctagcctgtgtaagagcacctgtggttcggttaagggagtaaaactaaacccgttgtagagatgcaaataaataaataattacagtgtagaatgccacggacaatcgtccttggaattgttatatttgcaaatcatcaagcgacagttccttcggtgataa

SEQ ID NO: 62497 - DNA, 424 bp, Zea mays
  Clone ID: LIB3075-007-Q1-K1-H9
tgttgctgaaggcaatgtaaaaaaatcggagcaagtttttaataggatgaaggatcttggattcccagttacaacattttcttccaatcagcttctgctactctacaaaagattggacaagaaaaagattgctgatgttctcacaatgatggaaaaggaggatgtgaaaccatctatctttacttacaaggtccttgtagacgccaagggaatggttggagatgtagaagctatggagaaagtggttgaatcaatggtgaaagatggcattgagccagatctcacgtttaatgctacaattgccagacagtacatatttaatggtcagcgtgataaagcagagacacttttggagtcaatggagggtgatgatatccagaaaaaccgtgctgcttgcagtttctattacctttatatgcttttc

SEQ ID NO: 62498 - DNA, 288 bp, Zea mays
  Clone ID: LIB3075-008-Q1-K1-A1
cggacgcgtgggttttataataacacagttgagcgcgacgatgggacccctctctaataacatggtgggcgtgggtgcctttcttgcatctcttccggggggtatgttgggcccccaaagtggcggccggttccaacattatcaccaactactaacgggagtggcttaccgccagggccacctggtacggtcagaccaacggtgccggcgctcctgacaacagcggtgcgtgcgggatcaagaacgtgaacctgccaccctacagcggcatgacggcgtgtggcaacg

SEQ ID NO: 62499 - DNA, 400 bp, Zea mays
  unsure at all n locations
  Clone ID: LIB3075-008-Q1-K1-A11
atggcggtgccgctgttgactcagaagatcgtgaagaagcgggtcaagcagttcaagaggccccacctcgaccgctacaagtgcctcaagccaagctggcgcaggcccaagggtatcgactcccgtgtcaggcggaagttcaagggatgcaccttgatgcctaacattggatatggctctgacaagaagaccaggcactatcttcccaacaagtttaagaagtttgtcgtgcacaatgtttctgagctggagttgcttatgatgcacaacaggacatactgtgctgaaatcgcacacaacgtgtccactaagaagcgcaaggaaatcgtggagcgagctgctcagcttgacattgtggtcaccaataagctngcccgtctccgcagccaggaagatgagt

SEQ ID NO: 62500 - DNA, 392 bp, Zea mays
  unsure at all n locations
  Clone ID: LIB3075-008-Q1-K1-A12
ggttacaataatttttcacatagctgatggaacttctgtttgtgtgaagccaacagatgggccctcctgctaattagaaaccaatttttttagactttttcagcctcctctactgctcatgttgctggcttgtaataggtgggctaggggttatctagagatgacaaggccctcaagttggctttccagcactggatcgaagcgatgagtacaaacgggcagtggggattggtgggttttactgcccattcttgctcttttcatggtacaattatcctgtttttttcctacagtgatgttttattttgtggcaccatctttcgaccataaacaaatacactcactttgatgaatgttgatatactttcagcattcaatngtagatagaattc

SEQ ID NO: 62501 - DNA, 303 bp, Zea mays
  Clone ID: LIB3075-008-Q1-K1-A2
ctcggcattgtttctcgggagtcgattgggaggatcctatgcgtcccattgaagcgcgcaaatgagatcataggaacaactactgaagaaatggtgatgcgagcccaacaagcttcgggataattacatcattcagtcaaaacttatgcgatgcaaaagccttgcgcgctgatgcattcttttgagcactttgctggtgtagaggagatgttggtattctttcatctgctcatccttctctctttatagtgtacgggcagatcaacaagtggactgtagagagcacacgatttacatgtacag

SEQ ID NO: 62502 - DNA, 366 bp, Zea mays
  Clone ID: LIB3075-008-Q1-K1-A3
aaccggggcgacccacgcgttcgcggacgccttggttgcttcgtaccttaagccaattaggctatgaccttcacgacgtgaaggcgtgggtggacagatgctgaaggatgctggttttcataatgtcatcgcggaagatcgcactgagcagttcttgaatgttctacagagggagctaggtgaagttgaaaagaacaaagacgctttcctggcagacttcacccaggaggactatgacgacattgtgaatggctggaacgcgaagctgaaacggagctctgccggcgagcagaggtgggggttgttcattgccaccaagtgatttggcctggcagcaggagggctcttcggaataagaatggatgt

SEQ ID NO: 62503 - DNA, 455 bp, Zea mays
  Clone ID: LIB3075-008-Q1-K1-A4
tcggccaagccttccgaaaaccatggttgtgaatgtgaaacccatgtggtcgtcgatccgggcgcgggttgcgatggctgtggtgttggtgttcttggtgagcggcgcatggtgcggtcctcccaaagtccccccaggcaagaacatcacggccacctatggcaaggactggctggacgctaaagcgacatggtatggcaagccgacgggtgccggtcccgacgacaacggtggtggctgcgggtacaaggacgtgaacaagccccccttcaatagcatgggcgcatgcggcaacatccccatcttcaaggatggtctgggttgtgggtcctgcttcgagatcaagtgcgataagcctgtggagtgctccggcaagcccgtggtggtgcacatcacggacatgaactatgagcctatcgcggcgtaccacttcgattagcaggcacggcgttcgg

SEQ ID NO: 62504 - DNA, 404 bp, Zea mays
  unsure at all n locations
  Clone ID: LIB3075-008-Q1-K1-A5
ctnccggccgtgggccggcccgcccgacccggggccctatatatgagggagaggacccctcactagggtttcctccgacggcgccgacaaaaccagaccatcaaacaagtgccagcgccctctcgcagtcgccgcaatggagagcaccttcatcatgatcaagcctgacggcgtccagaggggcctcattggtgagatcatcagccgttttgagaagaagggcttctacctcaaggccttgaagcttgtgaacgtggagaggtcgtttgctgagaagcactacgccgatctcgcctccaagcccttcttccagggcctcgtggactacatcatctctggccctgtggtggccatggtctgggagggcaagagcgtcgtcacaactggccgcaagatcattggcg

SEQ ID NO: 62505 - DNA, 434 bp, Zea mays
  unsure at all n locations
  Clone ID: LIB3075-008-Q1-K1-A6
ntccgcgccacaccggagcccatggagctcgccggagctacgccatccgccatccaaagccgagcggtgctcttctccacccggccgaacccccgtcgaacccttcctgtcacacgtacaaactcaaggttgaagacgacccaaaatattttatgtatttttgaaatttcttttgattcaatttgtgaattgtatatttattatgttgtaataagagcatgttgcgattcgaaattcacgtgtatgcgcgctatggaatttctggtagatatatgcggttagtagtgcaccgtgattattcttgttattcgatgcgatgacttttagaatgttggattagagagaaatatgacgaaaatttagtagtcacacgttggtgataaaaacactagatatgaaattttatagttaattttggtcacatttgacttttg

SEQ ID NO: 62506 - DNA, 341 bp, Zea mays
  unsure at all n locations
  Clone ID: LIB3075-008-Q1-K1-A7
cgtncgcgccggaccnnatcccattgagctcgccatatctacgccatccgccatccaaagccgagcggtgctcttatacagccggccggacccccgtataacccttcctgtcacacgtacaaactcaaggttgaagacgacccaaaatattttatgtatttttgaaatttcttttgattcaatttgtgaattgtatatttattatgttgtaataagagcatgtttctattctaaattcacgtgtatgcgcgcaatggaatttctggtagatatatgccggtagcagtgcaccgtgaatattcttgttattcgatgcgatgacttttataatgtttcatttt

SEQ ID NO: 62507 - DNA, 365 bp, Zea mays
  Clone ID: LIB3075-008-Q1-K1-B1
agcattggttgtctgttctggctgctcgcccgaatggtcctccagatgcgcggtacaattcgtggaggacacaagtgggacatcatggtagatcttttcttctacagagacccagaggaagcgaagcagctggaggaagaagaggctctggttgcacctgactatggcgcggttgcagaatacactgcaccaggcgctgacaactggggcggtgaatggggtgctggcgaagctgcagctccagctgctagcattccagctgctggcgcagactgggctgctgctccagctcctcctgctgacggtgtctgggacgcagctgtggctccacctccagcagcagcccccggatgggaacaaggcgc

SEQ ID NO: 62508 - DNA, 110 bp, Zea mays
  Clone ID: LIB3075-008-Q1-K1-B10
cggacgcgtgggcggacgcgtgggtttttttttttttttttttttttttttttttttttgtggtgttttttttttttgtgttttttttttttttttgtttaaaaacgcga

SEQ ID NO: 62509 - DNA, 378 bp, Zea mays
  Clone ID: LIB3075-008-Q1-K1-B11
cggacgcgtggggccgcctcccggctcgcgactcgcgagtcacaggcgcagccgagcgtggcttggggacgaggctacatcgcgatgtggtggagggcggtgaggcgccggtgggtcgcgacggcgcggcccgcgtcctccgcggcggcgggggcggagaagagctgccgcgccgtggtggtgccgcgtttcggtgggccggaggtgctcgaggtcaggcagggcatgcctgtgcccgatctgaagccgcaggaggtgctcgtgcgcgcacgcgctgtctctatcaaccccctggacctccgaatgcgatgtggctatgggcgctccatattcgaaccactcctacctctgatcattggtcgggacattagcggtgaa

SEQ ID NO: 62510 - DNA, 435 bp, Zea mays
  Clone ID: LIB3075-008-Q1-K1-B12
cggacgcgtgggcggacgcgtgggcggacacggtcgagaacgtcaaggccaagatccaggacaaggagggcatccctccggaccagcagcgcctcatcttcgccggcaagcagctggacgacggccgcatcttggccgactacaacatccagaaggagtccacgctccacctcgtcctccgcctccgtggtggcggcggccagtgatctggtctgctgatcgcctcccgccatggggactggctagctcttgccgctgcctgccagtgcgtgctcgtttcgtctttcattacgttatgtcttgctcaggccgtctcatgcatcttcatcagtctcttgtcttaggtcgtcgtttcttcttcacattggtaggaacgcacgttgtgcagtgctttgttaaaacaacttggagtaataaatcttgcatatgggtcct

SEQ ID NO: 62511 - DNA, 459 bp, Zea mays
  Clone ID: LIB3075-007-Q1-K1-H6
gaaatgttttactttagtcccatgcatccaccattgacagaagctgcacaacgagcccttgagtgggctgtcaatgaaaaattgaaatcaggtgaggatggagaagtaaccgccaatcatttgctactggggatatggtcagataaagagtcggctggtcataaaatcctgtattcgcttggatttgacgatgagaaagccagtttactggccaaaacggctggtgaagaggctgcaatgagtcttagagagcaaggagagcacctaatttattcgtcaacttaagttggtattgtgcactagcttttatgcacttcttggtgcctcgagacgttgacctggagaggctgcctctacaaactttagaacttattatggagatatgctagggcagatacgatatttgtactctcacgattgccgatgcctgtgaaaacgttgcgctttggttgtcaaaaa

SEQ ID NO: 62512 - DNA, 420 bp, Zea mays
  Clone ID: LIB3075-043-Q1-K1-D12
ctgcccggcacagtgctagccctcgcaagagcccaccgccacagaggagccccactcctgcaaagcatgccaatggaaaagattcacctctttcacgctgtgtttctccattaccgaagcgtgcaacctccggcagccctggcagtgatggcaaggagtaaagcttgctgatttggtgatgcctagaaaacagccttctcacggagtcacgggattgcagaaccttgagaaggttgattgagcacaatggaagtagcagtctgcactcaaccgcgatccaaggttgctagttcttttaatggcttatagaattgtgttttccagttgtcaaaaatatgcgctggtttgtatttttggcatatactgtgtttttatacccttgcactgcatcatctactttatatatgcatcagtttctcg

SEQ ID NO: 62513 - DNA, 352 bp, Zea mays
  Clone ID: LIB3075-043-Q1-K1-D2
gcgggtgaaccagcagcctccaataaaagccagcacatccaaataaaaccgagagacctcagccctcaggcaagccgaccgccgacgtaccaccgcgccaacccgagagaaagatggagatgatcaagaggatcctcatcgccgcgctcctcgtagtcgccgtctcggccaccgcagtgctggcctgcaccgaggccgccgccgtcggcgccccagccaactccgagtcgtggggctgcggcgaagcccccgctggcgccgacggcgccggcgccggcaccggcaccgacgtgatgctcctccgaccgggcgctcaggacgagtacaacatgccggagaccagcttctgttg

SEQ ID NO: 62514 - DNA, 409 bp, Zea mays
  unsure at all n locations
  Clone ID: LIB3075-043-Q1-K1-D3
atcttcggggtgatcgattacacagcattatgggtcgcgtgaagctacagatcaagaggatagagaacaacaccaatcggcaggtgaccttctccaagcgtcggaatggcctcatcaagaaggcctatgagctctccgttctatgcgacatcgacatcgcgctcatcatgttctcgccctccaatcgcctcagccacttctccggcaggcgcaggatcgaggacgtgatcacgaggtacatcaatctcccggagcacgacagaggaggagttgttcggaatagagagtatctgatgaagatgctnggtaaactcatatgtgacggtaacatagccgtacaactcacacctaattaagagccaatctatttcaacgtaaaggagcttcagcaggagattaagacgtacca

SEQ ID NO: 62515 - DNA, 429 bp, Zea mays
  unsure at all n locations
  Clone ID: LIB3075-043-Q1-K1-D4
gattgtgcagggtctgtgagaacatccccattgttctttgtggtaacaaggttgatgtcaagaacaggcaagtcaaggccaagcaagttacattccaccggaagaagaacttgcagtactatgagatttctgccaagagcaattacaactttgagaagcccttcctttacctcgctaggaagctggcagggtaattagatgttttgttcttttctgctgtgctaacctggtactggtgtttatacactgcagcaaactattgctgtgctaacttgctactggtgtttatgtttagggatcagaaccttcactttgttgaagctgntgctctgaagccaccagaagtgcagattgatatggccctgcagcagcagtaagtgttttcagctcttcctttgatttctggcacagcaaaaattagccgtgcaa

SEQ ID NO: 62516 - DNA, 434 bp, Zea mays
  Clone ID: LIB3075-043-Q1-K1-D5
cttaatcgtgaaaaagtacagtatcaacaatgcacaggctctcagtcctacattgcaaaggcttttatattgaagcaagaaaaatataaggacgcggaacctagtgcaatagatcttttcaaggagatgcattgtagcaaaaagaaaggttttagtgaaaatgttcagaaagctattgttgacatggaagaaatggtagcagcaccagttcaggatggacaacaaccaaaatctcctacagaagttgtttctaatgtgctaccaggctccagtgtgttcctacgcaatgttggtcttaagtctgcatcccagaaaagctccacaacgactgtttctgcaaaggttcaacaacttcaggatgaactcgagaccgagaagcaagaaaaagatggccttcgggaagaagtggaaaccttgaaggctcaagcacaagc

SEQ ID NO: 62517 - DNA, 349 bp, Zea mays
  Clone ID: LIB3075-043-Q1-K1-D6
gcgccgagttccgcacgttcatcgaggcggtcttcgagaaccccgagaagagcatcgacaccatgcacatcgacggctacgccttcttcgccgtcggcatggggcccggcaaatggacggcagcgtcacggagtacgtacaacctcctggacacggtgagccggcacacgatccaggtgtacccaaggtcgtggacggcggagatgatgacgttcgacagacgcggtcacgtggagctggcgctccaacatctgggagaggcagtacctcggcgagcagctgaacgtgagcatgattagggcggagcggtcgctcatggacgagtacaacatgcctgaaaccagcctac

SEQ ID NO: 62518 - DNA, 430 bp, Zea mays
  Clone ID: LIB3075-043-Q1-K1-D7
catcgtgaagcccctgctttcgttgagcaggccactgagcagcaaattcttgttactggaatcaaggtcgtggatcttcttgcaccctaccaaagaggtggaaaaattggtctcttcggtggtgcaggagtgggtaaaactgtgctcattatggagctgatcaacaatgttgctaaggcccatggtggtttctctgtgtttgctggtgttggagaacgtacccgtgaagggaatgacctgtacagagaaatgattgaaagtggtgtcattaagctaggtgacaagcagagtgaaagcaagtgtgctcttgtctacgggcagatgaatgagcccccgggtgctcgtgctcgtgttgggttgactggtttgactgttgctgaacatttccgtgatgctgaaggacaagatgtgcttctgtttattgacaaca

SEQ ID NO: 62519 - DNA, 410 bp, Zea mays
  Clone ID: LIB3075-043-Q1-K1-D9
tgcagcttcccgtgctgttcaggaacttaatggtaagaagataaatgacaaagagtggtatgttggaagagctcagaagaagtcagaaagagagatggaactaaaaaggagatttgagcagatcttgaaagatgctgctgacaaatatcaaggactgaacttatatctcaagaacttggatgatagcattggagatgatcaacttcgtgaattgttctcaaattttggcaaaattacttcatgcaaggtgatgcgtgatcaaaatggtcttagcaaaggctctggatttgttgctttctcaactcgtgaggaagcatctcatgctttaactgaaatgaatggcaaaatgatatctggaaaaccattgtatgttgcatttgcgcagcgcatagaagatagaaaagcgatgt

SEQ ID NO: 62520 - DNA, 319 bp, Zea mays
  Clone ID: LIB3075-043-Q1-K1-E1
ttagcctgttgggtacctgggatggtagaggttgtgagaagtggaatacagctcaatcgacaatgctgcaagctcttgtctccatgcaagctctgattttgaatgacaagccatattacaacgagccaggatatgagtcctatgccaacactcctaatggagagcggctggctttggactatactgacaacacctttctgcactcatgcaagactatgtcatactcacttcggaggcctccagagcactttgcagatcttgacgctggccactttcgggtgcatgagcacacgattatcgcggcatgcacacactacat

SEQ ID NO: 62521 - DNA, 424 bp, Zea mays
  Clone ID: LIB3075-043-Q1-K1-E10
cagaaaagtagatgttcgaatctgttatcttcattggatggatacagttttaacttttaacataacatttcttctgttgattgatgctcccatccatcagtatcttgactgagtatttctaacaaggaaaagaaaaaaaagaggtataccaatttgctatcggtgtagttgcaatgactgaaattgtttttgcttacaagaaaaagaaaaaaaacggtataaccagaagacgatcatggtttccctatcaaggtgtcagccgacaactaacaattgcggtatgtttccttttggaataatcaagtgctctgctccggagtttggacaacagtacatacattctcccagcaggctgcttgatgctgcatcttcctggaacatcagaagttattgatttcatttgccctcaaaatatcagatgtat

SEQ ID NO: 62522 - DNA, 368 bp, Zea mays
  Clone ID: LIB3075-043-Q1-K1-E12
ctggcttctcctccccctcttaccaagtcctcttcgggttagggttacttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggcggtggccgtggcggccgtggctaccgcggccgtcg

SEQ ID NO: 62523 - DNA, 311 bp, Zea mays
  unsure at all n locations
  Clone ID: LIB3075-043-Q1-K1-E2
gaccaatgggaccgattgatttgtttattaaaacgagaccacaatttcggcactggcaacatttaacagcaaaacaaggccaaaataaccctacttcaaaaacgttgcagttcacgacttctgctccaaatcgaaatccgtaaaagagcactgctcatcttgtaccagtgaaaaaaaaagaaacttcagattgatacactagttatttgacggatgcttntacagctttctctgccgcatcatcaagatcttctgcagtgatcaaaggcattccactttccttaagaatcctctttccttggtctacattg

SEQ ID NO: 62524 - DNA, 287 bp, Zea mays
  Clone ID: LIB3075-043-Q1-K1-E3
gaaagaagtcgcctaattctttcgatcgaattaggcgccttcttcgtagcacgctccgtctttatttgtaatctgaagcttacaggaacatttgagtggatcatggacggattggtaggcctcttgaaagtccgtgtggtgaggggcatcaaccttgcctaccgcgacgcaagaggcagcgatccgtatgtcgacctacgacttggcatgaagtaacttaagacgagcgtgaagaagagatctgtgaaccctatctggcacgaggagctaactctgaccgtaacaga

SEQ ID NO: 62525 - DNA, 433 bp, Zea mays
  Clone ID: LIB3075-043-Q1-K1-E4
cccacgcgtgcgcggacgcgtgggcgtcgttcgttcctcaagtgatcttaatcgtcgagaagttaccagctagcggagatcatcggcaatgtcgaacatggggcaatccttccaggccggcaaggcgcaggcccagggcgagtgccaggcggagcgcgcagcgcagtgcgttagggacggcgccggcgccaccgcctgcgccgtgaccgacaccgtcggagccgcggccgacagcgcgcagctgcaggagcaccgcgccgtcggcaccgttcagcaggctgctgagcaggtggcgcagacggcggcgggcgcggcggcagccgtcaaggacacggtggcgggcgcggcggcggccgtcaaggacacgggggcgggcgcggcggcaggcgccaatgacgcggtgaccggcggccactgaccgactcacgcgcgt

SEQ ID NO: 62526 - DNA, 429 bp, Zea mays
  Clone ID: LIB3075-043-Q1-K1-E5
ggcgaaacaaggccacaccaccagctgaccgtcgaacggaacgagcccggcggccggaagggagagagcgcgccagagcggcgccgaacaaccctcgtccaccgcactctcctggaccgtggccatggccatggccgccgcgtcccgatcccgggcgctgtgggcgtcccgcgccgccgcctacctcaggatctccaccttccccagggccttctccaccgtgctgaaggatctgaaatatgctgacactcatgaatgggtgaaggttgagggcgattcagcaaccgtggggattactgaccatgcccaggatcatctgggtgatgttgtctacgtggagctgccagaagttggcgtcagtgtatcccaggggaagaacttcggtgctgtcgagagcgtgaaggcgaccagtgatatcaattcaccagt

SEQ ID NO: 62527 - DNA, 417 bp, Zea mays
  Clone ID: LIB3075-043-Q1-K1-D11
gtgggatcgagttgtttcactgcacgagcacatcctccggcgaccaccggcctccctctgcgtcctatagcgaccgaccaacgcgccgagcgaagatgtcgtggcagacgtacgtggacgagcacctgatgtgcgagatcgagggccaccacctcacgtcggcggccatcgtctgccacgacggcgccacctgggctcagagcaccgcgttccccgagttcaagcccgaggagatggctgccatcatgaaggatttcgacgagccggggcacctcgccccgaccggcctgatcctgggaggcaccaagtacatggtcatccaaggcgaacctggagctgtcatccgtggcaagaagggatccggtggcatcactgtgaagaaaacagggcagtcactcatcattggcatttacgacg

SEQ ID NO: 62528 - DNA, 150 bp, Zea mays
  Clone ID: LIB3075-043-Q1-K1-E6
acgcgagcaaatatcctaactatcaacataggcctagtatcgaacgcaacacagcgtactgggagacgaggacatcgcttgcagacaggggcattaacgtcgatcatggctgaatctattagaatcatcaaggtctggatttataggaga

SEQ ID NO: 62529 - DNA, 392 bp, Zea mays
  Clone ID: LIB3075-043-Q1-K1-B8
ctgatgacttgacagatcctgctcctgctactacctttgcccatcttgatgctacaactgtgttgtcacggcagatctctgagcttggtatttatcctgctgtcgatccactggattccacatcaagaatgctttctccccacgtgctgggtgaggatcattacaatactgctcgtggtgttcagaaggttcttcagaactacaaaaatcttcaggatattattgctatcttgggtatggatgagctcagtgaggatgacaagttgacggtcgctcgtgcaagaaagattcagcgtttcctgagccagcctttccatgtcgctgaagttttcacaggtgctccagggaagtatgtggagctgaaagaacatgtgaacagtttcaagggtgtt

SEQ ID NO: 62530 - DNA, 400 bp, Zea mays
  Clone ID: LIB3075-043-Q1-K1-B9
gttttacacagaatgcccgctgaaggtggtagctgctaatgtgtgtatccctaacaaggttatagctcccaaaattccatggggcacacacacatgagattgcgactgatcgtcagacgcatgccaaaggtcagaggatcaggatgagtgcggcataattgacgcattggaggcagcaataacacgtgttagaatatccgctccaaagagaaatcggctttgtagtcccgaaattaccattcagcatgaatgctcgtcaaacttgaagaataatctctgctcggctttctgacctgacctagcttatagcacctgatcggagtggcgtatattcttctcgctgagaaggtcgatgtgatttaggtgttggacatgcgaggataataactcagcttttcca

SEQ ID NO: 62531 - DNA, 435 bp, Zea mays
  Clone ID: LIB3075-043-Q1-K1-C1
gcttggagtaagggagagcttggctgaggctgtaagtgctgttataagcatccttggcatgcagccttgtgaggggactgacgtggtcccaagcaattcaaggtcgcacacttgtctgctctctggtgtgtttattggcaacgtgaaagtcttggtgagactttcatttggaatcagtgcaccgaaggaggtggccatgaagctggcagttagatctgatgatccagagatcagtgacaagatccacgaaattgtcgctaatggctaaaaacaatagtagaatcgtttttttttactctttttttggtttgacttgcatgctacgggaagcttgaagggattcaattaattctagtatatgtaagtctggtttccagttgaatccatcatttgtcgcaccatcattcttcctttgacagtgcatcagtttttttt

SEQ ID NO: 62532 - DNA, 403 bp, Zea mays
  Clone ID: LIB3075-043-Q1-K1-C10
gaggtgtgatgaggagcaagttggcacaggttacccgaatgataaagcggaaggcgacatgtcccatttgcaagatgcgaggccgcatgagcagcgcggtcgtgtagacagatgactgtggcccatgatcgctcgttctatggctcacaggtcgtcgttggagaagctgcaacagctcctgtggattatgatgagcttgcaaccagctcgggaaaagagaagatcgtctaggagatccagcgagcatatgctactgagaactagaaggcgaacgcgaaccctgttgaaccagacctataaaccgacatgatctcctatgtacccatacagggaactagcgtggtctctgaagaaccaaatcccaatgatgcagcttatcctaccactgtgcataagcgcgagg

SEQ ID NO: 62533 - DNA, 354 bp, Zea mays
  Clone ID: LIB3075-043-Q1-K1-C12
tcgccctggcgcgcgacctcctggcccgctgcgtcggccaaatctccggcaatctgcacaggcgtcgtattctggcccagcggctcgacctgtccttccccgagaaagacgacgacttgcgtgccgatctggagaagttcggtgccattgaggcgatcgctttatgccgacacctgttcatggcggtgactgtcttcagggacgaagcgagcgtgccggtcgctttccggaggcaagaggaaatatcacctgtgctgtacagcgccgtcccgacttcccaccttgcgctctgcacgagcgttattcatgcaaacagcatcaatgctaattcgtactccagcacatcaactgcgt

SEQ ID NO: 62534 - DNA, 328 bp, Zea mays
  Clone ID: LIB3075-043-Q1-K1-C2
tcgcgccgccaaagtgatcaccaagcactacgcggaagaaggcgtgtggaagaactgggtgtggcacacggaggacgacctgttcatgaacggggccatttttaatccgtgcggcggggcccccaagcaggtcgacaccaacgagtgggtaaagcccaagccaggaacctacgttacaaggctcacccgcttcttcgcacactgtcctgctgcacgggcaagccgtgctgaaagccggtgggcatcaggctgcttcttctagctcatggcctggccatgccaggtcgcgctggctgcgtttcatttcatggaagaaagcaaggatgga

SEQ ID NO: 62535 - DNA, 429 bp, Zea mays
  Clone ID: LIB3075-043-Q1-K1-C3
ggagactgcaattagtgcttctttcacaaatttagcaaccactacattcacagatttcgtcttccaggcagctgtgccaaagttcatccagttgcgtttggacccagcgagcagcagcactcttcctgccagtggaaatgggtcagttacacaaagcctcagtgtcaccaacaaccagcatggccagaaaccacttgcaatgcgtatccggatgtcttacaaagtgaatggtgaggacaggctggaacaagggcaaatcagcaactttcctgctgggttgtagggccacctgtgtctatagggtttgggttgctctttcagacttatgcttgcctgctagtgagttgtgtacactggtagttggtttttggccgtccattatctctttatatatatagtgtacagtagatggcagcgattaatgatata

SEQ ID NO: 62536 - DNA, 375 bp, Zea mays
  Clone ID: LIB3075-043-Q1-K1-C4
cggacgcgtgggatcgcggatacctcgaggagcagaaagcctcgtcgcatgaaagagagagaaagttgtggccgccgccgatgtctgctgcccgtgctgccggtctgtggccggagtggggctatggtcgttcacggggctgtggtgatccttggcgcggagtcacaggagctagggatggacggaatcacccctaattcctcgttgttggtttgggcaccgccgcgggccgttgtgccgcgcggtcagtgcatctgcaccacgaattcgtgaggtcacgaggatctgaagatcaccctggtaactggaatctcaagtgcaggagaagaacatgtggttcaagagggccacgcatcgaggagttcgattcgatct

SEQ ID NO: 62537 - DNA, 436 bp, Zea mays
  Clone ID: LIB3075-043-Q1-K1-C5
tcgccgactccgagcgcctcatcggagatgcggccaagaaccaggtcgccatgaacccgatcaacaccgtctttgatgccaagcgtctcatcggctggaggttcagtgatgcgtctgtccagagtgatatcaagctgtggcccttcaaggtcatttctgggcctggtgagaagccaatgattgttgtccagcacaagggtgaggagaagcaggttgcagctgaagagatctcctctatggttcttatcaagatgcgtgagattgctgaagcttaccttggtagcacgatcaagaatgctggggtcacagtccctgcctacttcaatgactcacagaggcaggccacaaaggatgctggggtgattgctggccttaatgtgctgcgtatcatcaacgagccaacagctgcagctatcgcctatggtcttgacaagaa

SEQ ID NO: 62538 - DNA, 416 bp, Zea mays
  Clone ID: LIB3075-043-Q1-K1-C6
ctctcgtgtatcttccaggtttcccatttctccttttgtgtttaaaggataaactagattgctttgtttcaggaaccttgctcaaattgcaaaagtaaagatcatgaaaagagctggtagcctctgggaggaacttcgcattcatcacagcattcggtccatcgtgtgtctgaatttgcctagtttttctggaggtttgaatccttggggcacacctggcacgaggagagcagaagatagggagttcactgcaccttttgtcgacgatggacttcttgaggttgttggcttccgtgacgcctggcacgggctggtcctgctggcccctaatggaccacggaactcgcattgcccaggcccataggatccgctttgaatttcacaaaagcgcaacataccacacgttcatgagggtt

SEQ ID NO: 62539 - DNA, 433 bp, Zea mays
  Clone ID: LIB3075-043-Q1-K1-C7
cctgagggggatcgtcaacccccttggcatcaaggtgagcgacaagatggagcccggcgagctggtgaagctgatcgagatactgaacccgacgaacaagcccgggaggatcaccgtcatcacatggatgggggcagagaacatcacggtcaagttacctcaccttatccgcgcggtccgccaggctggacagagtgtcacctgcatcactgacccgatgcacgggaacaccatcgagactccttgcggacgaaagactcggtcatttgactccattctggccgaggtacggtccttcttcgacgtgcacgaccaagacggaagccagcctggaggtgtccaccttgagatgaccgttcagaacgtgaccgaatgcacggtcgggtcaagcaacgtcaccttcgacaacctgagagaccgttaccacacgcaa

SEQ ID NO: 62540 - DNA, 406 bp, Zea mays
  Clone ID: LIB3075-043-Q1-K1-C8
cggaaacattcacccagacagcccagctgcaaaatatctgaaggagcgtggcgttgaaaggaaggacttcaactcatatggtagccgaagaggaaatgatgagatcatggctaggggaacctttgccaacattcgtcttgtgaataagttcttgaagggtgaggttggacccaagacaatccatgttccatctggggagaagcttgcagtttttgatgctgctatgaaatacaagaatgaagggcatgacactattatcctggctggtgccgagtacgggagtggaagctctcgggattgggctgcaaagggcccaatgctgcagggagtgaaggctgtgatagcaaagagcttcgagaggattcaccgcagcaatcttgctggcatgggaatcaatcctctatgc

SEQ ID NO: 62541 - DNA, 369 bp, Zea mays
  Clone ID: LIB3075-043-Q1-K1-C9
gaggcgcgtagacgaactcgtcggcgcacttctgccgtatgctaaagcgtcagcagcgaggtcatgtttgcaagatgagatgcctaacatcatagaggtcatggatgacagaaacgggggcccatgagcgcacggtcgatggctcaacgggcggcgctgtataagcaacagcaactcctgacggagaacatgagcttgcatccatctcgtgtaaagagaacatcgtcaaggagatccagcgagcagatgcaactgagaactggaaagcgaacgcgaaccctgaggaaccataccattaaaccgacttgatcttcggaaaactcaaggagggaactagcgtggtctctggagaaccatttccaaaagatg

SEQ ID NO: 62542 - DNA, 313 bp, Zea mays
  Clone ID: LIB3075-043-Q1-K1-D1
gtctaattatacaactctcagtctagggaactcactcatcttaagggtggacatgaaccaatcggtggcactaccatacaaggggaggacagacatggccatagcatgaatgtcattgcatgcgtttccattgccatgctccttgccttgtgcacattatataacctccaaactcactaggtctatacttactacattctatttgatacccgagcgtgcatgcaccgcctgaccatctattggaagccccgttaaatggcgacagaatgatgcatagaatcgtgcaaagtcaaacggacaatgagagctacac

SEQ ID NO: 62543 - DNA, 425 bp, Zea mays
  Clone ID: LIB3075-043-Q1-K1-D10
tgcaggagtgggtgctggacaagatctgattgtcctgaagattgatgacacaagcggcgtgtgtggcacatctcaggcgtggtctataagcctgtcggtgctaacaacgttaattgagcaggcactgaatgacgctgccttcgactagtaagggcctggacgaatatctgatcaactcgtacatcatcttcatgcatgttcaactgcttaagtgcgagttcgactccaaggtcacctctcacatgcgaaaaggagtactgacccaactacctggcactgatgctcaagaacgtctactgtgacagctacattggagccatggacgtcataggacaaaggctaattcacgtacgatactgtgaagcacttctggtgctccatctgcacgtaggacagtgactaaccgcttaagggacccgtcaccg

SEQ ID NO: 62544 - DNA, 433 bp, Zea mays
  Clone ID: LIB3075-043-Q1-K1-B7
gccacaggcacctgctgcaccacctcagcagtaccaatcccaaacccagttccctcaatatgcacagccacctcagcctgcaaatgttaacccttcaactccccatgtgccccatgcaccccagcaaccagaggaaactatgccttatgcaccagctcagagctatccacctaatgcaatcgctgcaccttatatgcaaccacctagtggacctgctcctccttactatgggcagcaaaaccctagcatgtatgaacctcctgcaggccgggctaaccctgggccaccatcatcctacggttctggtgggtacgggccacagggtggaggtagtttctctgaatcttatggttacactggatctccttcccaccgtggcaatgctggaatgaagcagtcttcaccttttgctcaatcctctggaggaagcggc

SEQ ID NO: 62545 - DNA, 389 bp, Zea mays
  Clone ID: LIB3075-043-Q1-K1-A3
gggcacattacccttctgtgaagggtgcaaaagttgtaacagacaagctgacaatgcgcacaaagggttatggttttgtgaagtttggtgatcctaatgagcaagctcgtgcaatgactgagatgaatggcatgctatgttcttctaggcctatgcgtattgggcctgctgcaaacaagaaagctactgttgttcaggagaaagtaccaagtgctcagggagttcagtctgacaatgatcctaacaatacaaccatttttgttggtggtcttgaccccaatgtcactgaagatatgttgaaacaagttttcaccccttatggggacgtaatccatggtaagattcctggtggcaaaagatgtggttttggtcaatatgctaacagatct

SEQ ID NO: 62546 - DNA, 349 bp, Zea mays
  Clone ID: LIB3075-043-Q1-K1-A4
acgcggacgcgtgggcggacgcgtgggtgggtctgctgcccaggagctcatcggcatgggcgcgaaggcgatcctgatggcgaacaacttccctatcggctgcgtaccgacatacctgagcgggtacaggagcggcaaccgcgcggactacgacgagcacgggtgcctccggtgggtcaacgacttctcccagaggcacaaccgggcgctgcgcggcgaggtcgaccggctcagggcgcagcaccccggcgtgaagctcatctacgccgactactacggtgccgtcatggagttcgtcaaggacccgtacaggttcggcatcggtgaccccctcacggcgtgctgcggt

SEQ ID NO: 62547 - DNA, 428 bp, Zea mays
  Clone ID: LIB3075-043-Q1-K1-A5
accggaaggacgcccacacgtccctgtacaccatccggcaagggaagctgctgacgcctaagcagaaggcagaccccgagaagttcgcggattgcatccactggtgccttcctggcgtgccggacgtgtggaaccaaatactctacacgaggattctttcgaaatcatcatggcattctaattttagcccccctccatcccagtctctgcctcttcctccccaatgagaatcagaagtgggggcttggtttttgtcggagaatgtatgatttttcattctttttccttcctttttgggtagattgagtaaaatgatagcacgaaaaggaaaatgaatgttctgattactgatggtatagcatgtaagaagattcagctgaagtgtaaattagttgtgagttagccaattgagaaaacaacagcgacct

SEQ ID NO: 62548 - DNA, 424 bp, Zea mays
  Clone ID: LIB3075-043-Q1-K1-A6
gcggctcggcccataacgaagccgctagggtttttgcccagtagttggcttgcatagttgcatgtacacaatttctcgcgctgctaccgccgcttcgttctctaaccttggctcccgctccctccgcaggagcatctcaacaccgccttgaggaccccccaactcgccggctgcagccatggtgaaatattcgacggagccaaccaaccccaccaagtcaaccaaggccatgggccgtgacctacgtgttcacttcaagaacacccgtgagacagcttttgcccttaggaagttgtcactcaccaaggccaaaaggtaccttgaggatgtgattgcccacaagcaggccatcccgttccgcaggtattggggccgtgttggacgtaccgctcaagctaagtctcgtcactcaaatgggcaagga

SEQ ID NO: 62549 - DNA, 295 bp, Zea mays
  Clone ID: LIB3075-043-Q1-K1-A7
atcagagtctacggaagggggcgcagcttcttacagtctagcggacaacgccctgacaggggttatggctctagaggcgtgtacagcctaatgagcaagctcggtcacggactctactgaagcgcatgctaataccgtgtacgtctctacggttttggactcggttacacatgaagactactcgtctgtaggaaatgacaccaagtgctaacctggcttaggcctgactatcttatttatctatcgaatattgttaccgtaggattttgtcacaatgttagtgatcattctacct

SEQ ID NO: 62550 - DNA, 283 bp, Zea mays
  Clone ID: LIB3075-043-Q1-K1-A8
atgatactcgccgacggcctcttcaacttcctgtccatcgtggcgtgcacgctgcacaccatgcgcaagaggcgcagcaggcagcagccgataataatccaaggcggcggctgcggtggcggtagtgaagccgacgacggtgacacgcagccgctaccgttccactgcctcaacgctgctgccgagcaaccgaagaagagcttcgatgatcgccgccgggcgcaggtgtttctgcgtgaccacatatccaactcggtcaacatcgtgtgctacgtcctcctgt

SEQ ID NO: 62551 - DNA, 324 bp, Zea mays
  Clone ID: LIB3075-043-Q1-K1-A9
cggacgcgtggcatcggatcggcactagatcggaacgaagggcctgcaggccctctggccggtcgtcgatcgaggaaccaagctgctgctgctgctaccggacgacaccatccatgatacggaggaccaccgtgtgcctaggcctggtgcttctactactggcggcgtcgactgcgacggcacatttctcgatcggcgacgtggacgagtacttgaacaggcgcacgcacgagtcccgccacaggaaccactgcggcgcgcacatcaatgacctcatctccagtgctgcgcgctttcacgccaacgtggatgcacgcgcgtatg

SEQ ID NO: 62552 - DNA, 431 bp, Zea mays
  unsure at all n locations
  Clone ID: LIB3075-043-Q1-K1-B1
cgaccgctcgtcgccgccgtccaaatcgtcgggcttctccgccttcgtgcgcgcctacttgcgcttcctcgacacccgctcgctcttcatcgcccaggatctagatgccgtcgccgacacgggcgagaccgacggcgaggacgcgaggctggatcacgtgaccaagcagcagcacctgctgcacctgctcctgcaaatccgaccgtacggggacggcatggagctgggcctcatcttcgaggcgatggactgcgtcgttatcgagatcttcgaggtctacagcgagatatgcacgggcattgcccggttcctcgtcgccgttctcggctcggccccgatgacgccacgggcacggncgggagagacgttggcggcagcgaggcggccgaaggcagtgcaagggatgcgggtactggaaaatgcccgcgagc

SEQ ID NO: 62553 - DNA, 327 bp, Zea mays
  Clone ID: LIB3075-043-Q1-K1-B10
gttttacacagaatgccccctgaaggtggttgctgctaatgtgtgtctcactaacaagggtatagctcccaaaattccatggggcacacacacatcagaatgcgactgatcgtcagacgcatgccaaaggtcagcggatcaggatgagtgcggcataagtgacgcattggaggcagcaataacacgtggcagaatatcccatccaaagagaaatcggctttgtagtcccataattaccattcaggacgaatgctcgtcaaactcgaagaatgatacctgcacggctttctgacctgacctaacttatagcacctgatcgtagtgacg

SEQ ID NO: 62554 - DNA, 419 bp, Zea mays
  Clone ID: LIB3075-043-Q1-K1-B11
cacacatccatcaaagaaacaggcacacaagaacaaatacctcgccaccaacaatggcctccaggtcctccatcctacttgcaacggcgatgctggttgcgctgtttgcggttggtttgtgcaccaccccgctcaccttccaggttggcaagggatccaagcctggccacctgatcctcacccccaatgttgcaaccatatctgacgtggagatcaaagagcacgggggcgatgacttctcctttacgctcaaggagggcccgaccggcacctggacgctcgacaccaaggccccgctcaagtaccccctttgcatccgctttgctgtcaagtccggtggctaccgcatcgtcgacgacgtcatccccgccgatttcaaggccggcaccacctataagaccacactcagcatctaatca

SEQ ID NO: 62555 - DNA, 425 bp, Zea mays
  Clone ID: LIB3075-043-Q1-K1-B2
gcagtaaccagctgtgtataaagaagatttagctccgcctattcctgttcttactcgatataaaaaggagcttggaatcaaggcttttgtaaaaaaagaggtccaagaagttagaacagttgatgagaggaaagctagcgaaattactcagcttacaatgccaaagctttgtgttcgtcttaacagtctatattacggtatcagccagttgagtaagttggaggacagcattaatgagaggtgggctcggaagaaaagtgaaaacactaacatcagacgaaaaagtgaaaagtcaaagagtgccgaccctaatcagaagaatcaatttgatggcagcagaaaagaaatcaatactgctattgatcgtctctgtgaatttactgggacaaaggttatattctgggacctgcagcagccatttgttg

SEQ ID NO: 62556 - DNA, 416 bp, Zea mays
  Clone ID: LIB3075-043-Q1-K1-B3
gcgcgaccgccgacgcccgacggcaggtgcaccaggtcttcgtcgaccccttcgcaaggcctcggttccatccttcgccggaggcgaccgcccgtcaacaggacttgatctactactcactagcggtgtagaggcgaagagaagaacttgaccatgagcagcataggcacaggttacgatttgtctgtcacgactttctccccagatggtcgtgtcttccaggtcgagtatgccaccaaggccgtcgacaacagcgggactgttgttgggatcaagtgcaaagatggcattgtcctgggtgtcgagaagctggtaacctcaaagatgatgctggaaggatcaaaccgaaggatccattcggtgcaccgtcactctggcttggatgttgctggtttagcaacagatggcaagcaaat

SEQ ID NO: 62557 - DNA, 414 bp, Zea mays
  Clone ID: LIB3075-043-Q1-K1-B4
gctgaacaactggaagatgctgtgcactatggtcgtgctaacctggcaagcttcttgacacacgaagcttttgagtggctgctgaaggatagtgtggccctgctggcgtacgagaagcctgcagaatcatgcttgggatacctgatgggctctccccagcgtgaattcgtggcagacgcagtgaacgcggctgtcctgtcgacgaaccccaccatgaaggaccctgagagctgcctctactcgtgtctcgagaggctactaaggcagctcacagtttgtagccttgagcgacgtgcattcaacaacgaccaaggagatgcattcttactccacaaagaaatgcaaaacctatgaaaggtctaggcgctcatagccctataggcatcaggattgttgcgcttctgaagtaaactc

SEQ ID NO: 62558 - DNA, 423 bp, Zea mays
  Clone ID: LIB3075-043-Q1-K1-B5
gacagaatctttggtatctggccaagctatttcttgatcacaagacattgtactatgatgttgatttattcttgtgatatgttctctgcgaatgtgatgaccggggatgtcatatggcgggatatttctctaaggaaaaacactctgaagaatcttataatttggcttgcattctcactctccccccataccaaagaaaaggatatgggaagttcctgattgctttctcatatgaactttccaagaaggaaggtaaagttgggacaccggagcgccctctttctgatcttggcctgctcagctatagaggttattggactagagtgcttctggaaattctaaagaaacataagggtaacatatctataaaggaactcagcgacatgacggcaataaaagccgatgacatcttgagcacgctgc

SEQ ID NO: 62559 - DNA, 381 bp, Zea mays
  Clone ID: LIB3075-043-Q1-K1-B6
agatgatgtgttgtttactatcctcggggctacatgtgtggactgtgaaggtcggggccgatgtacatagagatgccagggaaggtgtcccggagtttgagagagctttcagggagaggttctctacttacacattagctgctaagaggcatattgactccactaccatcttcgacgtccaaggggctcacatggatcatcctcgagcgcaagcaaactttgagatcgcgctgaaagcatgtcatccctggaatccttcagttgggagtaacatttagttccactgtgtggtttttgctctctaaatatattgctcggcatacatatgtttgtgatctcatagatttggattttgaaccgttccaagttcttaattttggt

SEQ ID NO: 62560 - DNA, 354 bp, Zea mays
  Clone ID: LIB3075-043-Q1-K1-A2
gccagatattggcttgcgtacttgtccacctttggcccattcgcataatgcttaaggtccgcatgctggttcatctcttggggctcatgagccgctcgtggatgctgcatgttaagcctccttgccttcttactctaaacatggggcacttgccagagacatgatcatgggggatataatgcacatcttatcattcctctggacaagtacacaagccattatatgtcgtgctcgactacccacttactgatggatgcgatctcacttcgggactctgccgtatgattctttccccttttctgctcatccaccttgtcattttaagcgactcttgctgttcgttctagatcgcga

SEQ ID NO: 62561 - DNA, 430 bp, Zea mays
  unsure at all n locations
  Clone ID: LIB3075-007-Q1-K1-G11
gagtgagaaagagagagagaggaaggaaaatgcttgcgccacgccgccgccgnctcggttcccgcgccgtcgctcccgccaccgggcgccgggcgctcgccacggcggaagtgcccgccgaagccgtcgaggactccacgttcgtcgagggcctgaaaaaaggtcgccccaacatcgagcccccagcgacgccccttctcctcatgcnaggcgcgcccgccacgccagctaccatccctaccaagctcaccgtcaacttcgtcctnccctacaagtccgagatcgccaacaaggaggttgacatggtaattgtaccagctacaactggtcagatgggtgttttgccaggccatgttgccacaattgcagagctcaagcctggtgttctctcagtacatgaaggaaacgatgtgagcaagtactttgtgag

SEQ ID NO: 62562 - DNA, 421 bp, Zea mays
  unsure at all n locations
  Clone ID: LIB3075-007-Q1-K1-G12
cgtcagcgagcgaccgcaccggcacggcgcccatccatccatcgccatcctctagcccagtccaaaggaaccctagccatgagcgccgcctccaagaagctcttccaggccgccaggtccctcgtcctctccgcttctaaccgctccgtcctcgccgccgagggccgcaccgccgcgctcgccacgctcaccaactttggcaggaagaccctccccaccgcctacttatcctaccacaagcagggatcccaccatgccgcgtcggggtggggagccatcgccgncgcagtcccagctgcagtttacatgctccaggaccaggaggctcatgctgcagagatggagcgcaccttcattgccatcaagcctgatggtgtccaaagaggcctgatttctgagattatgagccgatttgagagaa

SEQ ID NO: 62563 - DNA, 263 bp, Zea mays
  Clone ID: LIB3075-007-Q1-K1-G2
ccgacacgctcaagaacaagttgaacttcaggggcttcgtgatcacggactggcaggccgtggaccgcatcacgaacccgccgcaccagcactactaccactccatcaaggagacgatccacgccggcatcgacatggtgatgatcccctacgactacccggagttcgtcgccgacctggccaagcaggtgaagcaggggcagatcaagctggagcgcatcgacgacgccgtcagccggatcctccgggtcaagttcgccatg

SEQ ID NO: 62564 - DNA, 319 bp, Zea mays
  Clone ID: LIB3075-007-Q1-K1-G3
gttctaatcgcgagggccgccctttttttttttttttggttttaaaacctagaatacatcatagttgtgagatgtatagttgtcgattacatgcaacacacaacaggtcagcaggcatcgctttatttacaacagaacgcctaaattattcacaggcgtgcattcacatatgtgaaggaaaccgttttgtacatcaaggtgaggccacaccaaagttggcccaaggaatgacaaatcaaatagcataacaatgtgatctgatatgcctgtgaagcaagtctcatctcaattcttgacaattgcaataccttcagaagct

SEQ ID NO: 62565 - DNA, 160 bp, Zea mays
  Clone ID: LIB3075-007-Q1-K1-G4
cgacaaggtgcaagagacatgtctggggcatcatttgtatggctttaattttttttattatatatagataaggaaatattttccttaaaaatggagtacaagggattgttgagaactgcttttgttcatgatattaatatatatgatgaatatttcttgc

SEQ ID NO: 62566 - DNA, 458 bp, Zea mays
  Clone ID: LIB3075-007-Q1-K1-G5
atggcggcggcggcgcccgtgcgcgcctgggtggtggcgctggcgctggtgctggcgtgcgcgctgctccagccgcggccgtccgacgccgcggcgcattccgccccgcagtcgccggctacggcggtgtcgtcgggcgccgacaagcccaagtgcgtggccggcgccaggaacgaccacgcgtgccgcgtcggcgccgtgcacgacccggacagccaggaggaggagggctccagcgtcaccatcgacgcgcccgccgccgcgcccgacgacgtcggccacgacgacggcagcgactacaacgaccccgacgtgcccaacaacgaccagctcgtcgtcgtcggccactgaaagctgccgcgcgcgcgcgcgcgccgacccgtggaccatgcgtgcatgaagaagaatgcagggggtgggcctgggcctgtaacctgttaatggatcggattctcggt

SEQ ID NO: 62567 - DNA, 485 bp, Zea mays
  unsure at all n locations
  Clone ID: LIB3075-007-Q1-K1-G6
tccgccgcaccatggccgccatccgcaccgccatctcccacgtccagaacctcatgaagggggtcaccaagggctaccgctacaagatgaggttcgtctacgcccacttccccatcaacgcctccatcaccaacagcaacaccgccatcgagatcagaaacttcctcggcgagaagaaggtcaggaaggtggacatgcttgatggcgtgaccatcctccggtccgagaaggtcaaggatgagctcatccttgacggaaacgacgtcgagctcgtatctcgctccgccgncctcatcaaccagaaatgccatgtgaagaagaaggatatccgaaagtttttggacggtatctatgtgagcgacaagggcgtcatcgaagaggagcattgagcgacagtgtagccgaaatgccaggagatgaatatgaatgtcgtttgagttgcaattttgcgagactgaatgtgaaccttcttctcattccttaaa

SEQ ID NO: 62568 - DNA, 446 bp, Zea mays
  Clone ID: LIB3075-007-Q1-K1-G8
cggacgcgtgggttctgctgcagcgccgcctctcgtcctcccggcgtcatcgtcgccgccctgatctccgcaggccggcgtgtggcggagatccatccgtgcttgaactgactccttccttagctacaagtacctattatcaaccatgtttggacgcatgccaaggaagagtagtaacaataccaagtattacgaggttcttggtgtgtctaagaccgcaagtcaggatgagcttaagaaagcatacagaaaagctgccataaaaaaccatcctgataagggtggagaccctgaaaagtttaaagagctgtctcaagcttatgatgttcttagtgacccggagaagagggagatctatgaccagtatggagaagatgcccttaatgaatgaatgggaggaggcagcagcagtgatttccatagccctttcgacatttttgagcaac

SEQ ID NO: 62569 - DNA, 236 bp, Zea mays
  Clone ID: LIB3075-007-Q1-K1-G9
cgccccttggaaatcaaacttggctttgtttattggaggggtgacaatgggctctaacttgggtttgtttattggaggggtgacatcgggctctaaattttacactaagatttaaggatctgattaagatcaggccctatttctattcatttttaaactcatacaaacttcgcttcatatcctgtccacgtccaaaggcgaggtggttatggatcaccaaccattcacttgataaa

SEQ ID NO: 62570 - DNA, 427 bp, Zea mays
  Clone ID: LIB3075-007-Q1-K1-H10
gcaggcagagaaagagagagagagagagagatggatgaggagtacgacgtgatcgtgttggggacggggctcaaggagtgcatcatcagcggcctcctctccgtcgatggcctcaaggtccttcacatggacaggaatgactactacggaggagaatcttcgtccctgaatctaaccaagctctggaacaggttcaagggcaacgacagccctcccgagcacctgggcgtcagcaaagagtacaacgtcgacatggtgcccaagttcatgatggcaaacggcgcgctggtccgcgtcctgatccgcaccagcgtgaccaagtatctcaacttcaaggctgttgacgggagctttgtgtacaacaatggcaagatccacaaagtcccggcaaccgacgtggaggccctcaagtcgaacctgatgggcc

SEQ ID NO: 62571 - DNA, 378 bp, Zea mays
  Clone ID: LIB3075-007-Q1-K1-H11
gtgaagccgagggtgcttgagttcagcatggtcggtgaggaaaaggagttcaaggtgacggtgacgtcgcagcaggacaagctcgggatgggctacgtctttgggaggctcgtctggacagacgggacccactatgtcagaagccccgtcgtcgtcaacgccctcgcatgatctatccagttcgtgctaactagagtacactacctactactactacttgagggccttgtggatttttgtgacatcttagataagtagtaaggctctaaaatatatttttatttcttcttgttattattagtaaagaaatgagataggtttttttttgcttagctaaaagacatatcatctataataaattttggctctttgcatggg

SEQ ID NO: 62572 - DNA, 458 bp, Zea mays
  Clone ID: LIB3075-007-Q1-K1-H12
gcaaaggctgttcacatagcagtttctgacatggccgaaggtcttgatgctcctacatcactgcctgctagaatggtccagccaacggacgggaagctggtatggtttctggacaaggcggcggcatcattccttgactccaagaacgacgacgacgacgcttgctacgatcgtcacgagtgactaactctgaggatcgttggtcgttttgaagcgaatgaacggaggtgtgtgtaagtaggtggtggcgtatgatggaagacgcgctgttccccttttagctcgatgcatgggttaattttgttctgagggtttttagctccggaaatctgaaattgcccttggtccttttgcagtgaggtgatttaaaagcgatgaaatgtgtatgcgatgttgagtcgtcaaagaacaccggaatttaacttgggtcgtataatattatgtgctacattctatgc

SEQ ID NO: 62573 - DNA, 418 bp, Zea mays
  Clone ID: LIB3075-007-Q1-K1-H2
ccggaggccgtcaacctgctctgctctgccaagatcccatgcaccggcgtcaccatggacgacgtcaacatcaagtacagtggcaccaacaacaagaccatggccgtatgcaagaacgctaagggcagcgccaagggttgcctcaaggagctcgcatgcttctagaaccaccatcgacccatctctctagttatacaatgtgtttggttgttggatgctgagagattggttctcagctcagatgcaagctgcgcctagcctgtgtaggtttgtgctggtacattgagagctcttatttaaaaaaaaaaaaaaaaaaaaaaaaaaaaaaaaaaaaaaaaaaaaaaaaaaaaaaaaaaaaaaaaaatataaaaaaaaaaaaaaaaaaattttttatggattgatgttgtatattagtgat

SEQ ID NO: 62574 - DNA, 453 bp, Zea mays
  unsure at all n locations
  Clone ID: LIB3075-007-Q1-K1-H3
cggacgcgtggggaaaaggcagagaaggtttttgaggatatgtttgtgaaatggaaaaacctgtcttccaaatactacaccgctttgctaaaggtgtatgctaatcagaacctcttagacaagggtgaggaactagcaaagcggatggatgaggagggtgccaagtttgggaccccaactttgaatgcacttgtgaagctatatgctgacgctggagaggtggagaaagctgagtccctattgcacaagctatctctgaagaacaacgtcaagcccagttacagctcatacatgacactgcttgatagctactcgaagaaaggagacgtncacaactcggagaaagtgttcaacaagttgagacagataggctacactgggaggatcaggatgtaccagtttctgcttcattcttatctacatgctaaagcccctgcgtatggattcaaagag

SEQ ID NO: 62575 - DNA, 416 bp, Zea mays
  Clone ID: LIB3075-007-Q1-K1-H4
ttcagttttcatcacacgacaatggagtggggctagcaatggcatgggtcacctgaaccagctgctgcacctgtccccgctcctcgcatggcgggggtttcctatccacttcgccgcgccggagtcgcacctcagggaggtccgcgcgcgcctgcacggctgggccccgaccccgcgacggtgtgtttccacgcgatggacgtgcccgcgcacgacccccccccttccccgttcccggcgcacatgcaacccttgttcgaggccttctgcaccggcgcgcgggcctcgctagtcgcgctggagaggaggcggaagaaatgggggaggaggcgcgacgcacggacgaaagatgttgatttgatgatatagatggacggtccagattggttcgaggccgaactggtggagtcatacta

SEQ ID NO: 62576 - DNA, 472 bp, Zea mays
  Clone ID: LIB3075-007-Q1-K1-H5
gtacagaaggtatcgacaagatcagtggagttttatgagtcatcaagggatgctgtgacaccgcacgttgtcaaagttaaagagtttgctcatccctactaccaggaagccaagaagttttctaagccttacattgatcaaattgctgagatcactaagccacatgttgagaaagttagaactactctgaagccatacactaagagagcagttcatgcgtatgggtcatttcttgcgtctgcaaccacataccatcgacaggctcaggcgaccatcatggactacctccatcagcatggggtacccaagtcatttgcaacgaaggagttagtttggttcctggcttctgccttgctagctctgcctgtcttcgtcatatacaggcttgtagtagagaccttatgcaccaaaaagaacagaaggcctcgtggcggtaatggtaacggtaaccatggccagaagagacacaagc

SEQ ID NO: 62577 - DNA, 478 bp, Zea mays
  Clone ID: LIB3075-007-Q1-K1-E6
gcaaagatgcaatcaatcttatctcgtggctttgctcatgggacccacgaagaaggccaacagcagtggaggttttgcagcatcccttctttcagccatgcttctatgtcccaccttcacttcgcttcaaatctactggatatgcatcaacgccaccatcagctggggctaaaggagctgttgatcagaagaacattaggagatactacatgggtactgtacccaatgcgaggccaacagttaattactcgtacttgagaaacaatgctcctgcaagagcagttggtgcacaaaggaaattggagttggattatcagctcccagagactaataaccataataaggtgacaaaggcagaagcgatgaaccagtcttggtccagaccagcagcagtaaggagcaatgcaggaaatcatcttgccaacgacctgaacccccgtgtacctgaccttgccgagaagctgtctcagttgtcaat

SEQ ID NO: 62578 - DNA, 482 bp, Zea mays
  Clone ID: LIB3075-007-Q1-K1-E8
cccacgcgtccggtggaacccgccgcaagttactgatggcctccctgatgcgttttgtggagggtgggttggattcttctcatacgatacagtgcgttatgttgagacaaagaagcttccttttagcaaggcaccgcatgacgacaggaacattcctgacatgcatttaggcctctataccaacgtcattgtgtttgatcatgttgaaaagaaaatgcatgttatccactgggtgaggacggactgctaccaatctcttgacgaagcatatgaagatgggacaaatcggcttgaatctttgctatcaaaattacattgcttcaacgtcccaacgctttcttctggttctataaaacttaatgttggaggctttggatcggcgacgctaaagtcaaacatgtcaaaagaagagtataaaaatatcgttgtccaagctaaagaacacatcttggctggtgacatttttcaagcagttctaagcc

SEQ ID NO: 62579 - DNA, 400 bp, Zea mays
  Clone ID: LIB3075-007-Q1-K1-F1
gaaccatgtggtcgtcgatgcgggcacaggttgcgatggttgtggcgttggtgttcttggtgagcggcgcatggtgcggtcctcccaaagtccccccaggcaagaacatcacggccacctatggcaaggactggctggacgctaaagcgacatggtatggcaagccgacgggtgccggtcccgacgataacggtggcggctgcgggtacaaggacgtgaacaagccccccttcaatagcatgggcgcatgcggcaacatccccatcttcaaggatggtctgggttgtgggtcctgcttcgagatcaagtgcgataagcctgtggagtgctccggcaagcccgtggtggtgcacatcacggacatgaactatgagcctatcgcggcgtaccacttcgattt

SEQ ID NO: 62580 - DNA, 351 bp, Zea mays
  unsure at all n locations
  Clone ID: LIB3075-007-Q1-K1-F10
gagcggcatttcgaataacacaggtgagcgcgacgatgggatccctcgctaataacatcatggtcgtgggcgccgtccttgcggcgctcgtcgccggcgggtcgtgcgggcccccgaaggtgccacccggccccaacatcaccaccaactacaacggcaagtggctcaccgctagggccacctggtacggtcagcccaacggtgccggcgctcctgacaacggcggtgcgtgcgggatcaagaacgtgaacctgccaccctacagcggcatgacggcgtgcggcaacgtncccatcttcaaggacggcaagggctgcggctcaatgctacgaggtgagatgcagggaaaaa

SEQ ID NO: 62581 - DNA, 349 bp, Zea mays
  unsure at all n locations
  Clone ID: LIB3075-007-Q1-K1-F12
gcagaattagctgtaaaaagactgtatggaaaagaaatggttaccgaaattatgtttgatctgagagctagtggccaaagttcttcggagtccgaagccggctggtttgatcttttcagcaagcgttactggaaagttgtgagtgtgggggcagcactgtttttgttccagcagcttgctggtataaacgctgntgtatattactctacatcggtgttccgtagtgcaggcattgcatctgatgttgctgctagtgctcttgttggagcagccaatgtttttggtactatggttgcatcttctctaatggacaaacaaggaaagaaaagccttctgataacagcttttc

SEQ ID NO: 62582 - DNA, 306 bp, Zea mays
  unsure at all n locations
  Clone ID: LIB3075-007-Q1-K1-F2
gcgatggcggcggctgatgtggagtaccgttgcttcgtcggcgggcttgcctgggccaccagcaacgagtcgctggagaatgccttcgccttctacggcgagatcctcgactccaaggtcatcaccgaccgggagacggggaggtctcgcggcttccgacttcgtaccttctccttcgagaactccatgctcgacgctatcgagaacatgaacggcaaggagctcgacggccgtaacatcaccgttaaccaggcccagtcccgtggcggtggcggtggcggccgtggctacggcggcngtcgcggc

SEQ ID NO: 62583 - DNA, 327 bp, Zea mays
  Clone ID: LIB3075-007-Q1-K1-F3
gcataggtctacaagacgagacaagagaatgcctgtgagcaagatcgccgtgggcgctgcgggcgagctgttgcaaccagacaccgacaagggcgccgaggccgagttcatgtccatgctcatgttcatcttcagcggctcatgatcatgcatggccttaagtaagctcacggacggtggcgcctgcactcctgccggccatatcgccgcgtctgtggcagcacgcactatccctattactggccgtcttcgggggtgccaacatctgctgcggccacgtgaaccctgacgtgaccttaggtgcctttgtgggcgggaacatcagac

SEQ ID NO: 62584 - DNA, 483 bp, Zea mays
  Clone ID: LIB3075-007-Q1-K1-F4
agcagaatacatatattcagaatctccagagacggacatgactaaagtttcaagtcattttggtcgtggaaatgatccaaaaaagtttgcttctatgctggtgaactttatgagcaagtgttaccctggtgaagatgatactgcaattgcacgtggggtcctaatgtatctatctcaagggaacctgagagatgcaaatttacttatggatgagatgaaggaacaactaaaatctgttaactcggattttccgaaaacagatttgattcagttcatcatgtatcttttaccaacgcttgagagagatgcttatcctctttttaggacacttcgacagaagtataagacaagcacagatcgtgacgctgtgtttcaggagttactggacgaaatagctgcaaaattttacaatatacagcgccagaaccctttagaaggacttttcagcgaaatgttcaggatataatgcatgagaaaagattt

SEQ ID NO: 62585 - DNA, 464 bp, Zea mays
  unsure at all n locations
  Clone ID: LIB3075-007-Q1-K1-F5
cccacgcgtccgaaacaatccttgcacccctcccctccgtcaccccaccacatcgggccagcccaacgaaaatgtcgcgcgccacagctgcggtcctcttctacatcctcgccgtcgctgccctcagcgcggccgaggcaccggcagagtcaccgaaggcaggcagtcctgccaaggcaccggccgagtcaccgaaggcaggcagtcctgcagctcctgccaaggcacccgagtctgctgccacgagaactgcccccgctaaggcacctcaagccgcctccacccccgccgctgccgctgccccatcgtcgtcgtcgtctaggaagtctggtccagctgccgcgccgaccaccgtcgcctctacaccgtcttcttgcacggacgaggagttgagcccttcgccgtcggcatccaccgncgaggtggcgtcccctgccgctgatgggcctgctgagggaccggcg

SEQ ID NO: 62586 - DNA, 436 bp, Zea mays
  Clone ID: LIB3075-007-Q1-K1-F6
cgccgtcctacctctccgtctagagcatgcatctcggtttccccttccttccttccatcacacgtgcgcacggtgctgtatacacaatttaaaggagcgtgagggcagcggcttctctcgtttccttcttctctagctatttgtcccccctagctcgtttgttctctcgtcccgtcgtccggttcatttccgcttccgaggaataataatcaaccaaaggggctctgctctatctcaagaagacttcattcatgtgggcaccagcagtcactcactgccaggggcgggcgaccagggagattaagaggcgatggtccgctgcaatgcatgcatgcggatatatgcatgcgtaaacacatcgagacgccgtaaaattgttctgttatagttatgtatatgtacatgcatatgtctcctgattcaacttttgatgtta

SEQ ID NO: 62587 - DNA, 424 bp, Zea mays
  Clone ID: LIB3075-007-Q1-K1-F7
gtctggaagcatcaaatttcactattgcacgataaacaaaaggttaggagccagcccttcagatcttcggagtttcgatattgataaccatatagccgtgtgaggttgaaaggttctaaaccttttgcgattgaggagaatggttttggcatacaacaggcgcgcgcgcacacaccattggaacagatttaaagtaggtgctggaactgtaaatgattcggtatcaaaaaggctggtttagccattttaggagattatgcgtttcgatttcatgggagttgggaggacagaattgtatcatagtgcagtaactcttggttgtaggattgagttatcctgcatgccatggttgtggcgcttcgtcagcgaccgaatgcttgaatgtggttacgattctctgagctccttttcaaccattaattcc

SEQ ID NO: 62588 - DNA, 466 bp, Zea mays
  unsure at all n locations
  Clone ID: LIB3075-007-Q1-K1-F8
gtgacacctccgcccaccctcgccccctccctaccggcaccgcccagatggcctgctcccacatcgtcgccgccgcgggggtctcctcccccgccgcagcggcggctcgttccccggcgcattctcccgctgccgccttcgcgcgcctccggtcgacgcctcgtttcgcgagcgctggcttgtcggttaagggaaacggagcggcgttcccgttggtcgccgccgcggggccggccgcggcggcaccggtggccgacctggactggccgccggccacggagaagcagcccatcatcgtcatcgacaactacgacagcttcacatacaacctctgccagtatatgggggagcttggattgaacttcgaagtataccgcaatgatgaactgaccatangagatgtgagaaggaagaacccaaggngaantactatttctncaggacctggtgaaccacaggattcggg

SEQ ID NO: 62589 - DNA, 456 bp, Zea mays
  Clone ID: LIB3075-007-Q1-K1-F9
cgccagaacgcaggcggagctacattcgaaccaattcgacacctccatcagcggcgggctggtggatcagtcgatgctgatcggcgacgaacacctgctgcggcctaacccgagtatggtcaaggtctcctccatgcccgcgctctcctaccgtgagccggatgggtccaggatgctgccagcccatggcgccgggagcgacggcgacgtctcctcgctggggcaatgccctccgggacaggacctccaccgtggtgcgacatgggacttcaccttcgcggccgtgaagccggcgaagaggaggacggcgagcgaggtggggttctccgacatgttcgccgtcgcaccgccgggggattggttcggcggcgggtcgacggcgccatcgccggggccgtcatcggccgtcaccgacgaagagtttaacctggagatgcagcagttcatgtcaatgct

SEQ ID NO: 62590 - DNA, 460 bp, Zea mays
  unsure at all n locations
  Clone ID: LIB3075-007-Q1-K1-E5
aatccttgcacccctcccctccgtcaccccaccacatccggccagcccaacgaaaatgtcgcgcgccacagctgcggtcctcttctacatcctcgccgtcgctgccctcagcgcggccgaggcaccggcagagtcaccgaaggcaggcagtcctgccaaggcaccggccgagtcaccgaaggcaggcagtcctgcagctcctgccaaggcacccgagtctgctgccacgagaactgcccccgctaaggcacctcaagccgcctccacccccgccgctgccgctgccccatcgtcgtcgtcgtctaggaagtctggtccagctgccgcgccgaccaccgncgcctctacaccgtcttcttccacggacgaggagttgagcccttcgccgtcggcatccaccgncgaggtggcgtcccctgccgctgatgggcctgctgagggaccggcggctgctgatgcc

SEQ ID NO: 62591 - DNA, 389 bp, Zea mays
  unsure at all n locations
  Clone ID: LIB3075-007-Q1-K1-D12
cgaataacacagttgagcgcgacgatgggatccctcgctaataacatcatggtcgtgggtgtcgtccttgcagcgctcgtcgccggcgggtcatgcgggcccccgaaggtgccgcccggtcccaacatcaccaccaactacaacggcaagtggctcaccgccagggccacctggtacggtcagcccaacggtgccggcgctcctgacaacggcggtgcgtgcgggatcaagaacgtgaacctgccaccctacagcggcatgacggcgtgtggcaacgttctcatcttcaaggacggcaagggttgcggctcatgctatgangtgagatgcaaggaaaaacctgagtgctcgggcaatccagtcacggtgtacatcactgacatgaacta

SEQ ID NO: 62592 - DNA, 424 bp, Zea mays
  Clone ID: LIB3075-007-Q1-K1-D2
ctttctgtcaaaaacaatgtatctagaagaccgaactgtacgtttacaactctgggatactgcaggacaggagaggtttaggagtcttattccaagctacatcagggactcttctgttgcggtggttgtttatgatgtatccaatagacagtccttcctgaacacctcaaagtggatcgatgaagtgcgcaccgagagaggtggcgatgtgataatcgtgctcgttggcaacaaaactgatcttgtcgacaaaagacaagtgtccacagaagaaggagagagcaaggcaaaagaattgaatgtcatgttcatcgagaccagcgcgaaagccggctttaacatcaagcccgtgttccgcaagatcgcttgcaccctgccaggaatggagacattgtcagcaaagcatgaggacatggtggatgtc

SEQ ID NO: 62593 - DNA, 444 bp, Zea mays
  Clone ID: LIB3075-007-Q1-K1-D3
cggacgcgtgggtgaaatctcgccctcgttgcggtcgtccacatccttttctctcctcctcgcgcggcccaacctgattgttcttcaaccaagaggaagaaaggaaggaagggaccggaagcatcagccatgtcgaactcggcgtcgggaatggccgtctgtgatgaatgcaagctcaagttccaggagctcaaggcgaagaggagcttccgcttcatcgtgttcaagatcaacgagaacgtgcagcacgtggtggtggacaggctaggggagccaggcgagagctacgacgccttcacggcctgcttccccgccaacgagtgccgctacgccgtgttcgattttgacttcgtcactgacgagaactgccagaagagcaagatcttctttatctcttgggccccggatacatcgagggtgagaagcaagatgctgtacgcgagc

SEQ ID NO: 62594 - DNA, 72 bp, Zea mays
  Clone ID: LIB3075-007-Q1-K1-D4
acgctttatgtcaaagtgaaatagaaggttaaatagagagagaaaaaaataagagtcacttggagatgctct

SEQ ID NO: 62595 - DNA, 248 bp, Zea mays
  Clone ID: LIB3075-007-Q1-K1-D5
cggcacactgcaggaacggcaagggaatgatagctagcgctcttaattgatcagctgatcagatgatctgccgccacgcacacgtcgtcttgtatgggctggctgctacaatgcaaccggtagatctccctgcttagtttcttgagatcgagggctccagttcttgctttgcattctgcaaccgttgtccaaatgtccacaatctttgccttccgtcaaattttaatacatggtcggaacattgaggc

SEQ ID NO: 62596 - DNA, 476 bp, Zea mays
  unsure at all n locations
  Clone ID: LIB3075-007-Q1-K1-D6
cgatcgccaccgccgaccggactcccctcaaaggcggccacagcacagcgagcatgggagaccggcatcagcatgggcctggcagcggcgtggaggacccggcgacgctgctgcggcgggtgcagacccgcgcgcccaactcgacgcaggtggtggggttcctgacgctgctcgtctctggcgccgtgctgctgctgctgacgggggtgacgctgacgggcgccgtggtggcgctcgtcttcctgggccccatcgcgctgctcaccagccccatctgggtgcccgtcgccgtcgtgatctccgccatcgtcgccgacgcgctctccgtctgcgccttcgccgtcgacgcgctccccgtggccacctggatgtaccgctacttcacgggccgacaccccgtgggcgccgaccgggtggactacgcgcgcagtcggatcgccgacaccgncagccacgtcaaggactacgcgcgcgag

SEQ ID NO: 62597 - DNA, 467 bp, Zea mays
  unsure at all n locations
  Clone ID: LIB3075-007-Q1-K1-D7
gatcaccaagcactacgcggaagaaggcgtgtggaagaactgggtgtggcacacggaggacgacctgttcatgaacggcgccatcttcaatccgtccggcggcgcccccaagcaggtcgacaccaacgagtgggtaaagcccaagccaggaacctacgttacaaggctcacccgcttctccggcacactgtcctgctgcacgggcaagccgtgctgaaggccggtgggcatcaggctgcttcttctagctcatggcctggccatgccaggtcgcgctggctgcgtttcatttcatggaagaaagcaaggatggatcacaggttgtcgttctgctaattaatctacatacgtttgccttcaagtactgtgttgtggcattgttacacatcacagtacagtttggtcaaattttttttccacaaaggaagtanggattgatttaatcattgatttaatcccacacgcgt

SEQ ID NO: 62598 - DNA, 379 bp, Zea mays
  Clone ID: LIB3075-007-Q1-K1-D8
cccttgtagtctcctaataactagtttcctatcttgctccccaaaccagcgcaaaccctgccctgacaccggcggcgccatggtgctcgaggcaacgatgatctgcatagacaattcggaatggatgcggaacggcgactacgctccgtcgcggttccaggcgcaggccgatgccgtcaacctcatctgcggcgccaagacccagtcgaacccggagaacacggtaggcgtgatgacaatggccgggaagggtgttcgcgtgcttgtcactcccaccagcgacctcgggaagattctcgcctgtatgcacgggttagaagttggcgctgatgcaaacttggctgcggcaatccaggttgcccagcttgctctaaagcat

SEQ ID NO: 62599 - DNA, 448 bp, Zea mays
  Clone ID: LIB3075-007-Q1-K1-D9
gccgagcgatctcctctccctctccctctccgatccattctccagcgcagcgaagtaaacatgtgtgaccgggcaaagatgtcgtggcaggcgtacgtggacgagcacctgatgtgcgagatcgagggccaccacctcgcggcggcggccatcgtcggccacgacggtgccgcctgggcgcagagcacggcgttccccgagttcaagaccgaggacatggccaacatcatgaaggacttcgacgagccagggcacctcgcgccgacaggcctgttcctcggacctaccaagtacatggtcatccaaggcgagcctggtgccgtcatccgtggcaagaagggatcaggaggcatcaccgtgaagaagacagggcaggcactcgtcgttggcatctacgacgagccgatgacgcctgggcagtgcaacatggtggtggaaaagctgggcg

SEQ ID NO: 62600 - DNA, 411 bp, Zea mays
  Clone ID: LIB3075-007-Q1-K1-E1
gaatgagcaaggcgcaaaatgctcttctttctggatgctcagccggaggtctagcagcaatactacactgtgacagattccatgatctgtttccagcgaaaacaaaggtcaagtgtttttctgatgctggatattttttcgatgggaaggatatctccgggaacttttacgctaggtcaatctataagagcgttgtgaatctacatggatcagccaaaaatttaccagcttcatgtacctcaaagccaaagcaatcacctgagctgtgtatgttcccacagtatgttgtcccgacaatgcgcacaccattgttcatacttaatgcagcctacgattcgtggcaggtcaagaacgtcctagcacctagtccagctgatccgaataagacttgggcccaatgcaagcttgaca

SEQ ID NO: 62601 - DNA, 440 bp, Zea mays
  Clone ID: LIB3075-007-Q1-K1-E10
cgtcttctccctctcccctagatccttcgacgccgccctccctcagctcattccctgccgccgctcatctgctggccttgtctcactgccgcccaaccattttcctccctcaagctagcacgcagcctcaactcctctcccacctcacgcacgtctctcccagccgttccttcatttctctggctcgtccttctccatgaggtcgcgccctgctgcgccgtcgtgctggtcgccggctgagcccccttcagtgcctgacgccgcatctccctggtgctcacctctgtttccccctgcgttggacgacctcgcactccctccctgctccagatttctccatggtcgcccctttccttgccccgggtggcgagctcgcccctcattcctgctcgcctaatctccacttccctgttgcagccaccttccatggacgccagccc

SEQ ID NO: 62602 - DNA, 314 bp, Zea mays
  Clone ID: LIB3075-007-Q1-K1-E11
gtttttgtggccgcctacggcgttaaagatattctgcccgaaaagcccaggtactacacgatcctgaagcttgtggtggacaccaatggcgagacagacgcgaataatgttctgcaggagactctactgtgcgtgcgcgacaaacttgccaagcctatggtgcttatgcccaacgataacgtgctcccggcgcaggataaccacagacttcatagttacttcgacccgatcaagctggacgagagtaagacactcaccaccattctccacacgctgctctaggacactgacaagaaactcgagagtctaaacta

SEQ ID NO: 62603 - DNA, 368 bp, Zea mays
  Clone ID: LIB3075-007-Q1-K1-E12
gcaagagctgggaaaactaagaagacaactgttgctgttgcacctacattcgtctgtgctaatcgtgctgagaagagaggagagttttacacaaaattagaagaaaaacgcaaggctttggaagaggagaaactccaagcagaggccagaaagagggaagaggaagaagaagctctaagacaactgaggaagaacttggtcgtccgagcaaaacccatgccaagcttctaccaagagggacccccaccaaaggttgaacttaagaaggtgccttcaactcgtgccaagtcaccaaaattgacacggaggaaagagctgcagtgaaacccctcatacaccagagggaggaaatggcagtgcagtatgct

SEQ ID NO: 62604 - DNA, 350 bp, Zea mays
  Clone ID: LIB3075-007-Q1-K1-E2
gccttgcccggtgtgcaccgacgaaaccagcgacagcagcacagagacgaacggcgtggtatcctcctgcctcagctgcttcctagctgggggtgctctctaccgtttcgagtacgcagtcaacccggcgctcttcctcgccaaagcgcgaggagggacgtgcacgctcgctccctctgaccctgacgacacggtggctcgccgcgccagatacctgctgagcaacggtttcaggtgctacaacctgttcaagagcaactgcgaggacttcgcgatatactgcaagactggccttcttgtcgctgagcagggcgttgtcgggcagagcgggcaggctatctccatcatcg

SEQ ID NO: 62605 - DNA, 375 bp, Zea mays
  Clone ID: LIB3075-007-Q1-K1-E3
cgcgtgtcccacacggccgtcgccctcgcctttttgcgtttcccgcgtagagtttagggtttggtcgccgccatggcgatcctctcggcgctcgccaccgaggtgttcatccccgtcgccgccgtcatcggcatcgccttcgccgtcgtgcagtgggtgctcgtgtcgcgggtgaagctctccccggctgcagccgcgttcggcggcagcaagaacggctacggcgactacctcatcgaggaggaggaggggctcaacgaccacaacgtcgtcgtcaagtgcgccgagatccagaccgttatctgcgaaggagcaacatcgtttcttttcactgagtaccaatatgttggtatcttcatgttcatctttgctgtt

SEQ ID NO: 62606 - DNA, 406 bp, Zea mays
  Clone ID: LIB3075-007-Q1-K1-E4
gctaggaggaggggacacacacacgtacaaaccgagagcacacaccgtcccccgcccgcccgccgccgcgacacgcgcgccatggccatgctggctcgctccgccgcgcacctcttcttcttccttctcctcgtctccaccgcgcccgccgtgcggaccatccccgacgaagcccgcggccccggaaacaacatccacgaggcgtgcagcaagacgctgttccccaaggtgtgcctgcacgcgctcaaggacaaccccgagtgccaggcgggggcggtcacgccgcgccggctggccgagctgctcgtgtacgtgtcggccgaagtgggcatgaccgtggccgcgttcgcgcaccacgagctcaactccatcaaggacgacgtcctgtacaagggcctcgacacct

SEQ ID NO: 62607 - DNA, 460 bp, Zea mays
  Clone ID: LIB3075-007-Q1-K1-D10
cggacgcgtgggcggacgcgtgggatcgccatcgtcatcgcgcaccgcctccccgtgtgccctgcttctcgcccggcaccgtcgagctcggctgtggaaacagaacaaacccatcaaccatggcgaactcggcgtcggggatggccgtgagcgacgagtgcaagctcaagttccaggagctcaagtcgaagcgaagcttccggttcatcacgttcaagatcaacgagcagacgcagcaagtggtggtggacaggctggggcagccgggcgacacctacgacgacttcaccggctccatgcccgagagcgagtgccgctacgccgtcttcgacttcgacttcaccaccgacgagaactgccagaagagcaagatcttgttcatctactggtccccggacacctcgagggtcatgagcaagatgctgtacgcgagctccaaggaccggttcaagagggagct

SEQ ID NO: 62608 - DNA, 388 bp, Zea mays
  Clone ID: LIB3075-046-Q1-K1-C3
ccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctacggcggcggtcgcggcggcggcggctatggtggcgggcgccgtgacggcggttatggcggcggtggcggctacggcggtcggcgcgagggtggtggcggcggctacggaggcggtggcggctacggcggtcggcgcgagggtggtggtggcggcta

SEQ ID NO: 62609 - DNA, 348 bp, Zea mays
  Clone ID: LIB3075-046-Q1-K1-C4
cccacgcgtccgcacaaacgcgtcgcatccgctccacaggatcctctgcgccaccgcaaccgtgtgaccgcccgtgccgccggcgatcccgatccgtcgacccgtcccagccccgctcgcagccatgtcgccgtcggagccgacgcgggaggagagcgtgtacatggccaagcttgcggagcaggcggagcggtacgaggagatggtcgagttcatggagcgcgtcgcgcgctacgccggggggcgccgcggcggtgaggagctctcggtggaggagcgcaacctgctgtccgtcgcctacaagaacgtcatcggcgcccgcaggcctcgtggcgatcatcttctcat

SEQ ID NO: 62610 - DNA, 324 bp, Zea mays
  Clone ID: LIB3075-046-Q1-K1-C5
aactatgcaagacccatcccatcctactctatcaaacacgaatgttttatcgctccttgccctgtttaatcagggatgccactgtacatggttaaataatagggtagtttctcaaggcatacggagttatgtataggaactgttgtaccctataacttacaacggtgaggagcttcttgtcttgcgcatgtcgtcatgagatgcagctgcggcgaacgagggtgcatgtgttggtacacgcgaagagcgagcataggagtgcgatgacacggtatgacaggatgatgaaaccagatgtgccgatgctggtattgtaccatctgc

SEQ ID NO: 62611 - DNA, 80 bp, Zea mays
  Clone ID: LIB3075-046-Q1-K1-C6
tcgcttgtttgtttaattgtacatatacctttgcataaactcggtctacagtgttgttggagtggggttcgtgcagcatg

SEQ ID NO: 62612 - DNA, 307 bp, Zea mays
  Clone ID: LIB3075-046-Q1-K1-C7
tcgcagcagcctccaataaaagccagctcatccttttaaaaccgagagacctctgccctcaggcgggccgaccgccgacgtaccagcgcgccaacccgagagaaagatggagatgatcaagaggatcctcatcgccgcgctcctcgtagtctgcgtctcggccacctcagtgctggcctccaccgaggccgccgtcgccggtgccccagccgtctccgagtcgtcggcgtccgccgaagccctcgctggcgccgccggtgccggcgccggcaccgtcaccgccgctgtgccctccgtcagcggttcc

SEQ ID NO: 62613 - DNA, 321 bp, Zea mays
  Clone ID: LIB3075-046-Q1-K1-C8
cgtcgctgccgccgtcggcggtgttccaagtcggcgacgagcgcgggtggacggtgccggggaacggcaccgagacgtacaaccactgggccaagaggaaccggttccaggtcggcgacgtcctggacttcaagtacggcgccaacgactcggtgctgctggtggcgcacgacgactacaagcagtgcagcacggagacgccgctgggccggttcaccggcggcgacaccaagttcgcgctggaccgctacggcctcgtctacttcgtcagcggcgtcgcatgccactgcgaggcgggacagcggatgatcgtgcgggtca

SEQ ID NO: 62614 - DNA, 373 bp, Zea mays
  Clone ID: LIB3075-046-Q1-K1-C9
tcccatttgaaatcaacccatcctcgtttcctccgtctagcagcctctcaccctcatggccgggatcaagatcgggatcaatgggttcggcaggatcggaaggctggtggccagggtggccctgcagagcgacgacgtctagctcgtcgccgtgaacgaccccttcatcagcaccgattacatgacctacatgttcaagtatgacactgtgcacggacagtggaagcaccatgaggtcaaggtgaaggactccaagacccttctctttggtgagaaggaagttgctgtgtttggctgcaggaaccctgaagagatcccatggggttcccgtggcgctgaatatgttgttgagtctactggtgttttcactgac

SEQ ID NO: 62615 - DNA, 460 bp, Zea mays
  unsure at all n locations
  Clone ID: LIB3075-046-Q1-K1-D1
ttttgaatgattttgagtgggttgaactttttttgtggtcgatgttcatcacctcttggctcatacccttctcagagttcgcttgttccggctgatggccgtgtacgactcttcaaatgctacacatctacagaaattcctgtaacagggtctcatgatgtgtttagggggcatacattggaaagagtttttgtgaatctgctgctcgaagtcgcagaagacgaaatatcttttcggacagtagtcagagatttgaaaaccaaaaggccaatgctgcaattagttcttcttagctcanaagcatggttatcttctggttgctgctatgaaaatgataccaatggttcacatggaacatcagatctgcaggctagtgttaaactctngtattctgattataagaatgcttcagaagcagacttaaggacagttgaagagtgggcatccaaatacccggctg

SEQ ID NO: 62616 - DNA, 267 bp, Zea mays
  Clone ID: LIB3075-046-Q1-K1-D11
cacatgcaaagatattcttttctggaagcatattccaaaccaattcactgtatatctcgaagccgcactgtccgccccttgggtcctacaaagcgggcgagttctgcaacagcaaatgaaaatgacatgctcagtaatggccaagggtttgttagtactgacaaagtaaatagtcgtggacattcaatgtgtctgcatacgcccatgtttcccaagatagaaagtggaatggtggaagtagtagcgccccccaaaatagtatcacaa

SEQ ID NO: 62617 - DNA, 355 bp, Zea mays
  Clone ID: LIB3075-046-Q1-K1-D12
caacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaatggcatcacggcgccggccatgaaggtctgccaagaggagtgcgacaag

SEQ ID NO: 62618 - DNA, 296 bp, Zea mays
  Clone ID: LIB3075-046-Q1-K1-D2
gatttcttctattatatgtttgcggagatactcccttctgcgctggttctcttcgtccttcggaagcttcctcccaagcgggtatcggcgcaataccaccctattaactagggagttctttgtttttatgatgttacatgctaagaactccggataagctggaactgctgaaaacctacatccggttgtattgctgtaatattttatggaagcatcccagggttggcaagatgcatcatcaccatcatgctctatgagaaaagagttttgagtggtgctaatgagtttgggctact

SEQ ID NO: 62619 - DNA, 403 bp, Zea mays
  Clone ID: LIB3075-046-Q1-K1-D3
ccggaacgaacgacgcagcccaacccgttcccaccaaaccagcggcaccacccatggcttcggcggcggcgagatccggtctccggtcgctggcggtgcgcgccgccccgttgaggcgccgcatgtcctcctccgtccacgacgacgcctatgagacggccaagtgggagaagatcacctacgccgggatcgtgacctgcaccctcctggcggcgtacaacctgtccaagggccacccccacttcgatgagccgtcggcgtacccctatcttcacatccgcaacaaggagttcccatggggccctgatgggctggttgagacgaaggaccaccactgagccctgattagcacacctttcaggagctgtgcacgctaaaaggagtatatgggtgttcagtgatt

SEQ ID NO: 62620 - DNA, 312 bp, Zea mays
  Clone ID: LIB3075-046-Q1-K1-D4
caataagtgtagctccataaagtttgctgttgattggggcaactctcacaagcagaaggcacagaggataggaaagcaaggaagcaactttattcaaaaagagctcagcatggaatatgtatatgattacatgtttcacctcttaactgagtatgccaagctcctaaggttcaagccaagaaaaccacctgaagctattgaggtctgtcctgaatctctggcttgccaagctataggccgcgagaagaagttcatggaggactccatggtgagatccgccagcgatgctgggccatgtgacctggcttcttc

SEQ ID NO: 62621 - DNA, 389 bp, Zea mays
  Clone ID: LIB3075-046-Q1-K1-D5
cagcactgcgcctgccgcgactggcccggcgtcgaccccgcccccgccaccgccccggctggcgtgaagaaggccgccagcgtcgctgacgacgctgggaaggcctccggcaccgccgcctccactcccgcgcagggcggcgctgcgcagtgagattcgcgccgcccaccgcgtggtgttctgttccctgaggatcggaacccgccgtgtcgaacgaacgtgtggtcatccatcgttgccccgtttgagcatatcaatccccgttgggtcgtgtttttcgggtctgagtggatttttggcttttgatcaaaaaaaaacaaaaagaccaccaaattacccttaatatcaaactttcaacaacattttcaaacaaaaaaaaaagggcggcc

SEQ ID NO: 62622 - DNA, 362 bp, Zea mays
  Clone ID: LIB3075-046-Q1-K1-D6
aatcgattggagactcatgatctgggtactggtccagtgaaactaaattcaagctttaatgagatgcacagtgctgatagacaatgccttgactcagctgatgttcctgcttcaactcagcctctgtcagtttcacctgttttgatgagtgatgagcagcatgtcgatgacgcccattctgctgtcaaggccattgagcacctgggcaataatctggctaacataaagcagaaatccctgcatatggatgtcctcatgttagaggacgccaaagttgcttccatggctgcagtccctggcatgagggaaaatctgtcgacgctggatcaaaatcttttgatatttacttggagctctggctg

SEQ ID NO: 62623 - DNA, 348 bp, Zea mays
  Clone ID: LIB3075-046-Q1-K1-D7
cctcactctcgttccatttccccatctcccagatccaattcgcgagttcttcctcctctgccgccatggcgctctctgtggagaagacctcgtctggacgggagtacaaggtcaaggatctctcgcaggcggacttcggtcgcctcgagattgagctggccgaggtcgaaatgcccggcctcatggcgtgccgcgccgagttcggcccgtccaagcccttcgccggcgctaggatctcggggtctcttcacatgaccatccagaccgtcgtcctcatcgagaccctcaccgcgctcggcgccgaggtccgctggtgctcctgcaacatcttctccacgcaggaccacg

SEQ ID NO: 62624 - DNA, 336 bp, Zea mays
  Clone ID: LIB3075-046-Q1-K1-D8
acaagactaggagaagtagttgggttataaaggctggatctcatgcaacgatgatggccaacacccttcgcacaccaatcattgtatttacacagacaggctccatggctgtcctcctgagccactatcgtccctcgtctacactatttgcatttacaaacgaggaacgagtgaagcaactgctagcactctaccagggcgtcatccctattcacatgcagttctctgacgacgcagaagaaactttctccagagcaattagcagcttgctgaaagcacaatatgtgaagaagggagactacgtcactcttgttcagagcggagtgacttcaatct

SEQ ID NO: 62625 - DNA, 430 bp, Zea mays
  Clone ID: LIB3075-046-Q1-K1-D9
attaatgtgccgatcgacgcatgcgtccacgcacgcgtggtctccaccgacacgcttggactcaagccgagaagagtgcctggccgggagagcgtacgataatagatccgcatgcatattcttgtttggcggagacgggagacatggagcggatcttctagcggttctacaccaactgcgaacgtaagatctcgctgctcggagctgacagaagcgctactgactctggggtccacctctgacgacgaagtgcagcgcatgatggcctaaatcgacaccgaccgagactgctgcatctacttgaacgagttcatgaccttctgcaacgccaaccctgatctgatgaaagacgacgcacaggtcttctgatccattacatcttcgtccatacgattgaatagatgatgaacctgcttatatacacacacac

SEQ ID NO: 62626 - DNA, 382 bp, Zea mays
  Clone ID: LIB3075-046-Q1-K1-A9
ttcacttcctcgctggcccataaatatatatttatctatcgccatcgagcatttataggcggacagaataattaacatcatggggcaagcctcacggctcgtcctcctcgccgtcttggcgctgctgtccggcggcctcctgccgcacgcgctgggtaaggcctggcgtggcaggcgacacggaggcgccttcaacctgtaggtccacgacatctgctttcgcacgatgccccctttgataggctcgctgacgaccggccgtataacgagctacctcgtattctgatcactgcataacgatatcctgatattggcacacggttcatcttgcatcgactgatcctcacatttccgaatatgccgatttttccattagtggatt

SEQ ID NO: 62627 - DNA, 273 bp, Zea mays
  Clone ID: LIB3075-046-Q1-K1-B1
cggacgcgtgggctccgctacctgtggggcggtggccgccactagcgcgagggctagcaccaagagcgcggccgatgatgccatgctgcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggcatcacggcgccggccatg

SEQ ID NO: 62628 - DNA, 396 bp, Zea mays
  Clone ID: LIB3075-046-Q1-K1-B10
ctccgatccatcaacaatcgccgagagcgatcgagagataaataaagatgaagaaagtggcatcatcgtcagccgttctcttcgtgctagccctgacgctagtttgtgccccgctgatagcagaggcaaagaagaagagagtcgccgccgccgccgccgaggagaagaaggtgcaagacaacttctgctcgacgctgtgcgaaggcaggaaggggatggacctggtggtgtgcaaggagtcctgcgacctctcacagcgctccaacctggtgctgtacgggcggatccagtgcaagggcaagtgcaccgagcaaaaaggcatcaccgcgccccaaatgaaagggtgccaaaaggcgtgcgacaaggactacacgggcaaagcgggtgaggtgacca

SEQ ID NO: 62629 - DNA, 426 bp, Zea mays
  Clone ID: LIB3075-046-Q1-K1-B11
cccacgcgtccggaaaattgaggagcagactggcactgtaagaacaaattgtatagattgtgtggatcgtaccaatgtgactcagagcatgattggggggaaaattctggaaagccaacttcaacgtataggagttcttagtgctggtgatacaataagcaaacatccagcctttgatacaaactacaaaattttgtgggccaatcatggagatgcaataagcattcagtactctggaactcctgctctgaagggagattttgttcggtacgggaagcgaactactcagggaattctaaacgatttgaggaatgcacttgctagatactacttgaataacttcgttgatgggactaagcaggatgccatggatcttcttcaaggacataacatgacatctgttagtcgagacatggcagtgccaag

SEQ ID NO: 62630 - DNA, 443 bp, Zea mays
  Clone ID: LIB3075-046-Q1-K1-B12
caacacatacaggaaaagcaagcaagaatcatcggaataatggctcgtgcatgtgtgtggctcgtcgtgctcctcctggccgccatcgcggtggcaccgttcgcggtcgccgcacgcgtggacgtcgtggagggtaggtccatggcatccgccgatgcaccggaggcggcggccgatgctcccgctcctagccccgactccgcctcattcccagactcatcgtcagaggcgcccttcagcagcagcttcttcgactagacgcaaaaacctcttcattctctggaataactaacagtatatacgttgcaccctgatgatatataaacatgtacgtgcatcaatgtatggaatgcgagtggcaaacacatggaatgtgcttgcccaaatattgcgtatttctttatttattatatgtctctctcgcgggggttttatttttctta

SEQ ID NO: 62631 - DNA, 469 bp, Zea mays
  unsure at all n locations
  Clone ID: LIB3075-046-Q1-K1-B2
caaacatttgcttattagtccggttcacttccaggctagggtcgcaaggatcgggcgacctttgggtggagatgaaggggttcttcatggcatcacagtaaaaccacattgcatgttaagaatggcagtttttaatggaactataaatttcatgagttcactgttgagtcttcatccaggacctcagtgggcagcagcgcagcagaggtggaggtccatcgggagaatgtggagacagcgacgacgagcccaaccgtgatttcgccaaattcggcccgtggggcggcgacggaggacagccgcatgacatcggaacactaccctgccgtctagacaggatcaagatcagcagtgggcttatcatcgactcgatcgagttctcgtacgctggccctgacagccagtaccgtaccgcatgccccttgngtggtcatggangagacatcagctctgtgagtgtgatgaacat

SEQ ID NO: 62632 - DNA, 372 bp, Zea mays
  Clone ID: LIB3075-046-Q1-K1-B3
cccacgcgtccgcccacgcgtccggccttcatggcctacgaggagaacgtggcgggcgtgttggcgcgcaccatggcggccgtgtcgccgtacgcgacgatgcacgacgacgtgacgtccgccgcggaggagcagcactcggcgctcatcctgctgccgttccacaagcaccggtcggtggacggagggctggaggtgttccacccggagatccaggcactgaaccagagcatccagcgcttctctccctgcaccgtgggcatcctcgtcgaccgcggcctgggcggcgtgccgggcgccgggtgccgcgtggcggcgctattcttcggcgggcgcgacgaccgcgaggtggcagcgctggcgatccgtatg

SEQ ID NO: 62633 - DNA, 345 bp, Zea mays
  Clone ID: LIB3075-046-Q1-K1-B4
tacgtcgcgttggtgcatgtctccaattggattttggtggagggaagaagaagggaggaaagggggaggattcaaggtggtagacttccggatcgtacttagggatttgcccgaacttccggtaaaggtacttgatacatgttgggaatgaggggagtagcagcacgtccactctcactctcacaatagctctgccgaggtgcagccatgatttaattagaaatttattgtcaaaggaagtttgattttttaactagtcgtgcgcactagttaattcagttcatgtcgtatgtttaacttctctttgctagccgattaatagtacttagtatgttcttgtcatga

SEQ ID NO: 62634 - DNA, 313 bp, Zea mays
  Clone ID: LIB3075-046-Q1-K1-B5
cgcgttcgctcacgtattcgggaggctttttcctccactagaacgagggctaccacggggggcgcatcatatgatcccatgctacgatcgcggctaatcacaaccacgacaacttctgctcgacactgctctagttcaagatcgggacggtgccggtccagagccaggagtcctgcgacctatgcctggaggacaacctgccgctgatccgcacgatccactgcaagggccagtgctcctatcacaacggcatcaccattcccgtcatgaacgtcctgcacgatgagcccgacacggcgtacctggtgaaggc

SEQ ID NO: 62635 - DNA, 468 bp, Zea mays
  unsure at all n locations
  Clone ID: LIB3075-046-Q1-K1-B6
cccacgcgtccggctggcgacatactattagtggatggaggaatgatgtcgcttgctgtgaagtctaaaacagccgatacagtcaagtgtaaagtagttgatggtggggaattgaaatcacggcgccacctaaatgtccgtggaaagagtgctactttgccatctatcactgagaaggattgggaagacataaaatttggtgtcgaaaacggtgttgatttctatgcagtttcctttgtgaaggatgccaaagttatccatgaattaaaagactaccttaaaagtgctaatgccgatatacatgtcattccaaaaattgaaagtgcagattcaataccaaacctgcagtccattattgctgcttcagatggngcaatggtggcgcgtggagaccttggtgctgaacttccgattgaggatgttcctttgctacaggcagagaatgtccaaacatgtcgaagcatggaa

SEQ ID NO: 62636 - DNA, 400 bp, Zea mays
  Clone ID: LIB3075-046-Q1-K1-B7
cgtggacgaagaggattctgaacctgaatgggtggaatacaaaatcaaagagacgaacatattcactgtggacaaatatcagcagatagggttctttcctgaagaaaaggcatttgctctgaggtatcagactgctggaatgctggagactgttcttcgggttggcacgcttggagaagatgatactggtgaagaatctcccaaaaacctgaagataccttctcgcaagccatctattgcatgtgaaaatcgtctttactcccttgaaggcaatggtcgaatgagggctttccacataatggatccaaagggagtgcttgacacacttgttatttttcatgagaagaggatccttctgaattaaccccaaccttttattcctttagagtgcccacagtga

SEQ ID NO: 62637 - DNA, 415 bp, Zea mays
  Clone ID: LIB3075-046-Q1-K1-B8
ctaccctcgtcgtcgtctcactcaccccgccttcacgcctccctcaccaaataaggtcccggccttttccgacattcacaggggggacaggaaatcagcggccatggcctcgattccggcgacgaccttcgccgtcatcttatccgtcctcttctgtgccgcggctggcaccgtcgtcgacaacgacctccccgactacgtcatccagggccgcgtctactgcgacacctgccgcgccgggttcgtgaccaatgtcaccgagtacatcgcgggcgccaaggtgaggctggagtgcaagcacttcggcaccggcaagctcgagcgctccatcgacggtgtgaccgacgcgaacggcacgtacacgatcgagctcaaggacagccacgaggaggacatctgcgaagtggtcttggtg

SEQ ID NO: 62638 - DNA, 325 bp, Zea mays
  Clone ID: LIB3075-046-Q1-K1-C1
cacgacaagatggcgtgcacagacaatgcgatgagagccttgttcctcctggtcctcttctgcatcgtgcatggtgagaaggaagagtcaaagggcatcgatgcgaaagcgtccgggcctggtgggttcttcgacatcaccaagttgggcgccttcggcaatggcaagacagacagcacgaaggctgtgcaggaggcatgggcatcggcgtgcggcggcactgggaagcagacaatcctcatacccaagggcgacttccttgtcggacaactcaacttcacaggcccttgcaagggcgacgtgaccatccaagtggatggcaatc

SEQ ID NO: 62639 - DNA, 448 bp, Zea mays
  Clone ID: LIB3075-046-Q1-K1-C10
ctcccggctcccctgcctgcgcgccgtctcctccaggctccagcgcctcgcggccacggcgtgcgtaccacggctgcacggccgatggcgtaccccgcggcgccgcacacgagcgcggccttcctcgccagcttcgcgacgccgctccccgcgcgctgcgcctcgcccccgacccggcgccgcgcggtgtctgccgccgtcatcgccaccaccaccacctgcgtattcgccgacgccccccgggggatcaagggggaacaagccgactcgggcgcccaagccgcggcggctgcggctgcgccgaaggacctcagcccggacaccgtggccttcatcatccttggggggggcgccgggacgcgcctttttccggtcaagcgtacaagggccaagcccgtggtgcccgtcgggggatgctacaggctcattgacattccgatgagcaact

SEQ ID NO: 62640 - DNA, 432 bp, Zea mays
  Clone ID: LIB3075-046-Q1-K1-C11
tgcttctgctacctttaaggaactattgacatgacataaagcaaccgttgctgaatttctgtccaacaattatgattggttttttgaagaattcaactctaggttgctgtcatcaaccaacttgatagcttgcctttttgcgccgctcctcagccatcctctccatctcggtgtcacacactccgcatacgcacctacgagagtcgagtgacagcgagcgagcgagcgagcgaagccatggctctccgcaccctggcatcgaagaacgccctatccttcgcgctcggcggcgcggcccggccgtcggcggcgtccgcgaggggggtgacgacggtcgcgctccccgacctcttctacgacttcggcgcgctggacccgccatctcgggggagatcatgcgcctgcaccaccagaagcaccacgccacctacg

SEQ ID NO: 62641 - DNA, 291 bp, Zea mays
  unsure at all n locations
  Clone ID: LIB3075-046-Q1-K1-C12
gtcgtcctccattctgtcgccgctgtgttcgtgcctctcctcgctccccgatcgctggccctgggcgccgcgttcgccgccggatctgggcgcgcgacggtgccccagacgaaccgatggcgcgggcggcgcttcgattgggcgtgcgcgcgctcgcgctcctcgtnctcgtgtgagtggctctgcttccactcgtcagttccgacgatgggtacagacactgcgagggtgtcgtcaggggctgggcggatgcctcgtctgggcgcgtgaaggacggggacacactgagcc

SEQ ID NO: 62642 - DNA, 466 bp, Zea mays
  Clone ID: LIB3075-046-Q1-K1-A8
cttccagaaaccactcctggaatctggaacactgggtacaaaatgtaacacgcaagtggtaattcctcaccttactgaaaattatgggacttcacgagaccctcctgagaagcaggcacccatgtgcacagtccattcatttccacacaatattgaccattgtctaacatgggcccgctcagagtttgagggtttgctcgagaagactccaaaggaagtcaactcttttctgtctaatcccgctcaatatgctgcctccatgaaaaaggcaggtgatgctcaggccagggagttgcttgagcacgtatgtgaatgccttgagaaggagtgttgtggaacatttgacgattgcataacgtgggcaagactgaaatttgaagattacttctccaatcgtgtgaagcagctaacattcacgtttcctgaagatgctgccactagcatgggagcccatttctggtgtgct

SEQ ID NO: 62643 - DNA, 138 bp, Zea mays
  Clone ID: LIB3075-045-Q1-K1-G7
cccgtcctgcatggggttgtaagctgtctttataatttcacggcaagtcgtgtgcctgaaccttcatcttaagttgttggcggatcccttcgtcttgtttcggttgcaccccgtgatggtatggattggttgctgacc

SEQ ID NO: 62644 - DNA, 420 bp, Zea mays
  Clone ID: LIB3075-045-Q1-K1-H1
cgctagggccacctggtacggtcagcccaacggtgccggcgctcctgacaacggcggtgcgtgcgggatcaagaacgtgaacctgccaccctacagcggcatgacggcgtgcggcaacgtccccatcttcaaggacggcaagggctgcggctcatgctacgaggtgagatgcaaggaaaaacctgagtgctcgggcaatccagtcacggtgtacatcactgacatgaactacgagcctatcgctccctaccacttcgacttgagcggcaaggccttcggctccctggcaaagcccgggctcaacgacaagattcgccactgcggcatcatggacgtcgagttcagaagggtgcgatgcaagtaccccgccgggcagaagatcgtgttccacatcgagaagggctgcaaccccaactacct

SEQ ID NO: 62645 - DNA, 431 bp, Zea mays
  Clone ID: LIB3075-045-Q1-K1-H11
agcgggtccaaggactttgtgcaatgcttgtggattgatgtgggcaaacaagggtaccctgagaagttgccccagggcaaaaggtgaatctcctgcggttgcaactgagcagggaacaagtgacaacaaagccctggcaacactgaataataacaatgttgctgcaagcaatggcgaagccacaagtgcagcaaagaaaggagtgccaaaggcgccgtgacagtatatagacattattggcagagacaaagatttcggattctttgcctatagctagacaagacaccccgttagaaatatttcgtaatgataatgattgtcatcaagtgtacattcattcttgcttgacagtgttagacgtgtaattaatataagcttgccgattgtgtaacaagtaacccatatggcatcttgtgtgttacaacttacac

SEQ ID NO: 62646 - DNA, 342 bp, Zea mays
  Clone ID: LIB3075-045-Q1-K1-H12
cggacgcgtgggcggacgcgtgggcaagtacaagatcaaggtgcgcgggcacaacgtgttctgggacgaccagaactcgcagatgcagtgggtgaagcccctcaaccttgcgcagctcaaggcagccatgcagaagcggctcaagtccgtcgtgtcacgctacgccggcaaggtcatccactgggacgtggtgaacgagaacctgcacttcaacttcttcgagacgaagctgggccccatggcgtccgcacagatctaccagcaggtggggcagctggaccgcaatgccatcctattcatgaacgaattcaacacgctggagcaacccggcgatcccaaccc

SEQ ID NO: 62647 - DNA, 425 bp, Zea mays
  Clone ID: LIB3075-045-Q1-K1-H2
acacacacaaaagcaaaaagcatcatcacaataatggcccgcgcgtgtgtgttcctcggggtgctcctcctggccgccgtcgcggtggcgccgtttgcgggggctgcgcgtgtggatgtcgtggagggcaggtccatggcgtccgccgacgcgcctgaggcggcggctgacgcgcccgctcccggtcccgactccgcctcatccccggactcgccgtcggaggcgccctccagcagcagctcatccgactagccgcgcacaacgcagttcttgtcatgatctatctagcaaataaaaagatcatatgtctcgtttgattctctggaataactaatagtatatatgctgcgcccggatgatatataaatatgtgcatcaaatgcgtgcggcaaacgcatggaatgtgcttgcctagctagctaatt

SEQ ID NO: 62648 - DNA, 339 bp, Zea mays
  Clone ID: LIB3075-045-Q1-K1-H3
caagatgctccaaatcgccggcagcttcatcagcaagatgaagccgctttcaccgtcagctccagcgcgaactgccacgccatgatcacctacatatgcgcagcgtggttcttctaactaagagagcgggatcgagaagaaattgaagccgctaataattagccatcgttctctagagttcctttcttcgtttgttttggtgtgtgttccttttccccgtttttttttttgttttagtgtgagttctctcttctgtaaataagatgcaggtttcatggccattgtgcctggctctggttgtgaacctgagaatgagattacatgttttctttctgattc

SEQ ID NO: 62649 - DNA, 371 bp, Zea mays
  unsure at all n locations
  Clone ID: LIB3075-045-Q1-K1-H4
ggtgtccttctccaccgacttgcgtgacgcctaaccaagccccgcaccggcccgcccccgcccccgcctccctttcgccgcaggggacggggtcggcacggggcgatgaggagcagcgaggccatggagctcctgggcttccatccctactccaggccctccccttccgaggtgaaggctgcgtatagaagaatggtgatggagtcccatcctgatcgtgtcccaacgcatctgaaatcgcaggctgagtcaaaattcaaggagatcgcagaagcatattcttgttcgaaggacggaagaagatcagggagtangatggaagtcatgtatgcgttctggtgttcgactagcacgggagatcaaatagacgt

SEQ ID NO: 62650 - DNA, 363 bp, Zea mays
  Clone ID: LIB3075-045-Q1-K1-H6
actaaaccgaagctttggaagccacgcccgccaccatgattaccgcagttcgactggaatcaacagcaatatatgatgtagtgatggtcttcggtgcacggggtctgtacctagggttgattcgtgcagcaggaagtcctggcgaacaacggaccttcatcgccgggcatcggtcgccgcagaaccgcgcaacttcgggggcagcctgtctcgcctatcgattggagcgcgaggtcgcgtgtcatctgaaaagcaagttggtacctggaatctcaagtgccaggcaagttatgcccttgatcacttcttttacccactcatgttctaattaatcataatgatctggatacggtaattttgatg

SEQ ID NO: 62651 - DNA, 238 bp, Zea mays
  Clone ID: LIB3075-045-Q1-K1-H8
gctatcctgtggcaactcaagaggactattttttctacaattgctaaggaacttgaaatgggactctaaatagaaagagaggagggatgcttacattctcatttgggctaatatcaagggcatggaatcaggcaaaacttcacatattgaaagcttcaaggacaaaacgattgcagatggggagtatcttccatgagctcctaaatgctgtgcagagcaagcgttgtagactggaaca

SEQ ID NO: 62652 - DNA, 429 bp, Zea mays
  Clone ID: LIB3075-045-Q1-K1-H9
cggacgcgtgggcggacgcgtgggtccgtattcccaggcaggcaggtcggcgaggagggcgggaagaccgaagaccgagccgggcgggggctcgggacgggaacgggacaggaccccaaaatcttagatccttcctgcccgcccgcccgtgcccgtcgacgcgtcgttcttgccggccgcgccccacctccgtcctctcctcctgcagggggatcggatacgccacaggctgcgcgatggtgctgtgggtcttcggctacggctccctcatctggaaccccggctttgacttcgacgacaaaatcctcggctttatcaagggctacaagcgcacctttaatctcgcttgcattgaccacagaggcacaccggagcattcggcgaggacctgcacgcttgaaaccgacgacgaggccatatgctggggaa

SEQ ID NO: 62653 - DNA, 144 bp, Zea mays
  Clone ID: LIB3075-046-Q1-K1-A1
tcgacccacgcatacgcggacgcgtaggatcaccggccgttaagcgtttaatctcccaattccacccaatatctcatggcgtcttctccaacgcacttatcctcgcaccactatatccaggagcgtcgaagtgatccacccgcc

SEQ ID NO: 62654 - DNA, 186 bp, Zea mays
  Clone ID: LIB3075-046-Q1-K1-A10
acaagatggcatgcacaaacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgc

SEQ ID NO: 62655 - DNA, 448 bp, Zea mays
  Clone ID: LIB3075-046-Q1-K1-A11
caaagaaacaagcgcacaagatcaaatacctcgccgccaataatggcctccaggtcctccatcctgctcgccatggtgatgctggctgcgctattcgccgttggtttgtgcaccaccccccctcaccttccaggtcggcaagggatccaagcctggccacctgatcctcacccccaatgttgccaccatatccgacgtggagatcaaagagcacggtggcgatgacttctcctttacgctcaaggagggcccgactggcacctggacgctcgacaccaaggccccgctcaagtaccccctttgcatccgctttgctgtcaagtccggcggctaccgcatcgccgacgacgtcatccctgccgatttcaaggccggcaccacctataagaccacactcagcatctaatcaatctctggtgatgaaaatagattcaaaagagctcatcta

SEQ ID NO: 62656 - DNA, 299 bp, Zea mays
  Clone ID: LIB3075-046-Q1-K1-A12
gttagtatatacttatgttttctaaatacaagagactgtataatacaaacacagcggtgcaacgtgcgcaacggtttttaagcgaagataattgcacgagcataaaactggggtaataaataaatcacgctaccaaagaagagtgctgatgcttgcaactaagtgtacatgattccataatgaacatcataaacgtagcgatggccctttctattgtaatgatctcttaaaattttagcccgacatacgaatacctggatctgttatctgggctgacagttttgaccaaattgaacgtg

SEQ ID NO: 62657 - DNA, 124 bp, Zea mays
  Clone ID: LIB3075-046-Q1-K1-A2
tttacgcaatcgtgaacatgatcctggcgattcaaggcgaaacctgagctgatatgcgccgcgcgacggcatccttcggcatcactgggacaaaatctggactgtcactcaagattgggatata

SEQ ID NO: 62658 - DNA, 432 bp, Zea mays
  Clone ID: LIB3075-046-Q1-K1-A3
gggtcccccttctctttctcatggcggcggctgcggcgtcgacgccgcagggagtggcggagcggcggggcatcccggcagcggccttcgttgaggacgttgaggcctacctccgccaggtcgggctcgacgtcaattccgcgctcgcttttctccaggaaaggctgcagcagtacaaaatagtggagatgaagcttctagcacaacaaagggatcttcaggcaaagattcctgatatagagaagtgcttggatattgttacaacattacaagctaaaaaggatttgggtgaggcactcatagctgatttcgaattgtccgaggggatctactcccgtgcaaaaattgaggatactgactcggtgtgcctgtggttgggtgcaaatgtgatgctggagtactcttgcgatgaggccaatgccctcttgaaga

SEQ ID NO: 62659 - DNA, 368 bp, Zea mays
  Clone ID: LIB3075-045-Q1-K1-G6
cagatcgagtggctccctgattcaattggaaagctcactggacttgtcacccttgacatttcggagaatcggatcttggccttgccggaagcaattgggatgctttcttctttggccaagcttgaccttcacgctaacagaattgctcagcttcccgagtcgattggggatctttccaacctgatatatctcgaccttaggggcaatcagcttgcatcattgccggccagtcttggtaggctggtgaagcttgaggagcttgatgtgagtgcaaaccatcttacctcactccccgactcaataagaagccttacacgcctgaagaacgtgatcggcgaaacaaacgaccttgatgagctgccatacac

SEQ ID NO: 62660 - DNA, 362 bp, Zea mays
  Clone ID: LIB3075-046-Q1-K1-A5
ccaacaccctctccaccttccatcccgatcaccgccgccaccgctttcgttccacgtcccgatggcaccggtagatctaacccccaggcagccccggaaggcgtatggcggcgacgccggcgcctactacgagtggagcccagccgacctgcccatgctcggcgtcgcctccatcggcgcagccaagctctccctcgccgccggtgggctctcgctccccagctactccgactcttccaaggtcgcgtacgttcttgaaggcactggcacctgcggcatcgtcctgccggaggcgaccaaggagaaagtgctggccgtgaaagagggcgacgccctcgcggctccccttcggcgtggtcacg

SEQ ID NO: 62661 - DNA, 401 bp, Zea mays
  Clone ID: LIB3075-046-Q1-K1-A6
acacgagcgcgggcgcgcacaagttcgccaacccccacgccccaccccccaccccccgcgtgctgcgcgtcgttggaaccaaggattggattagcctcgccgaggaggaggtggtggtcggcgaggggctcgcggggatggggatctcgaggccccttgtgatggcgatggcggtggcgctgctgatcgccgtcgccggtgcgaccgccgaggagcaggagcccctgctggcggcggacgcggtggccggcgcggtggaggcggcgctcggggaggtggagaccgcggcgctcatggccgagctggggcaactccgggcgaagatctcggcgctagagtcagacatagaagagcgatctcaagaactgaagaataaggatgatgccatcatgaacctggag

SEQ ID NO: 62662 - DNA, 248 bp, Zea mays
  Clone ID: LIB3075-046-Q1-K1-A7
gaggaacagtgtgccgctggagcgtgctgtggccaaagatacaactagagattatgaggatattatgcttgccctcctaggggcggagtgaggaggcgtgcctcaactcgatctcatctgctgctacttgtttgatggggccaaaaatctgcatcgatgtggtatccacatggccgtgtttttgaataataatattgtaacacgtagcctgcattagcagcgcgtattaaataaaggaacttcctgat

SEQ ID NO: 62663 - DNA, 457 bp, Zea mays
  Clone ID: LIB3075-007-Q1-K1-B8
gccagcggaactctatggtgaatggcgatgctgccgcggcggtgaatggagacgcgatcgatgtgacagttgttccggacgacgacgacatggtcgaggttgctgtcaatccgtccgtggcggtcgagatcggagagtcggctgacgttccagagaaagaaatggaggccgagatggtcgacgattacgtggatataggcgacgagatgccgacagtgaattaccagtcagtggagatcgagagggattccccggcggctgccagcagctcaagcggatcaggaagtggctcgtcttcatccagcgattccgactcggactccgattctgacggggacgatgccagcgccccgcactaggtgtggctgttgttgctggtttatctgactgtactgtaggattagcgatgagtaggtgactgaaaaggttccatttgatgaggcgttttgaagaacgg

SEQ ID NO: 62664 - DNA, 413 bp, Zea mays
  unsure at all n locations
  Clone ID: LIB3075-007-Q1-K1-B9
ccgtccgtatggagaacgaatctggnncatcacatccttctaccaacgagggctccgtgtgggcttcccgagggaacatcccgcgtnncctcctcaactgagggcgcnnccctgatacccaaagggctaaccccgtgagaaagatgatcccacgatcaatggttcgagaccccttcaacacccccgcttatgtaccgtnncgccatccaggcccgtccctgggtctctgtatgccanngtggtcgtacccacaaggtnnatcgtgctcgacttcgggaagaatcggtgtcagccacacttgtcnccccatctacgaagggaaatacgcccttccnncaacgccatccccttcgtctcgaccctggctgggccgcgaccnctcaccgactacctcatgaaagatcccctgactg

SEQ ID NO: 62665 - DNA, 365 bp, Zea mays
  Clone ID: LIB3075-007-Q1-K1-C1
cccacgcgtccgtgcagtcatctcctccatcaccaccaaactcaacaacagccagctcgcgagaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggcatcacggcgc

SEQ ID NO: 62666 - DNA, 455 bp, Zea mays
  Clone ID: LIB3075-007-Q1-K1-C10
gtcgcctaattctttcgatcgaattaggcgccttcttcgtcccacgctccgtctttatttgtaatctgaagcttacaggaacatttgagtggatcatggacggattggtaggcctcttgaaagtccgggtggtgaggggcatcaaccttgcctaccgcgacgcaagaggcagcgatccgtatgtcgtcctacgacttggcaagaagaaacttaagacgagcgtgaagaagagatctgtgaaccccatctggcacgaggagctaactctgaccgtcacagatcccagcctagctctgaagctggaggtgttcgacaaggacacgttcagcagggacgacccgatgggggacgcggagatcgacgtggcgccgctggtggaggcggcgaacgcgagcccggaggcgagcctgaggaacggcgccatcatcctgtcggtgcggccgagcgccacgaac

SEQ ID NO: 62667 - DNA, 463 bp, Zea mays
  Clone ID: LIB3075-007-Q1-K1-C12
cgatcaccaacaccgtcattggcgtcggtgacgactgcatctccatcggccccgggacctccaaggtgaacatcaccggcgtgacctgcggccctggccacggcatcagcatcggcagcctagggcggtacaaggacgagaaggacgtcacggacatcaacgtcaaggattgcactcttaagaagacgatgttcggcgtccgcatcaaggcgtacgaggacgccgcctccgtgctcaccgtctccaagatccactacgagaatatcaagatggaggactcagccaaccccatcttcatcgacatgaagtactgccccaacaagttgtgtactgccaacggcgcctccaaggtcaccgtcaaggatgtcaccttcaagaacatcaccggcaccttcttcaccccggaggccgttagcctgctctgcactgccaaggtcccatgcaccggcgtcaccatggatga

SEQ ID NO: 62668 - DNA, 226 bp, Zea mays
  Clone ID: LIB3075-007-Q1-K1-C2
gagacgacgagatccatcgccatcagagaatcctagcccacccagaccaggtgccccacggcggtgccggcgatggcaacccgctactggatcgtctctctccccgtgcagtcttccggcgccaccgcgacctcgctttggtcgcgcctgcaagatggcatcttccgccactccttcgacaccccgctgtaccggttcaacgtcccggaccttcgcgtcggcaccc

SEQ ID NO: 62669 - DNA, 438 bp, Zea mays
  unsure at all n locations
  Clone ID: LIB3075-007-Q1-K1-C3
atttccaagctcctcctcgcgattccaatccacgcacgcctcctccgcttccgcctcgctcaggcttatagtcagtgatggaacacaaggaggcgggctgccagcagccggagggcccaatcctatgcatcaataactgcggcttcttcggcagtgctgcgacgatgaacatgtgctccaagtgccacaaggagatgataacgaagcaggagcaggcccagctggctgcctcctccatcgatagcattgtcaatggcggtgacggcgggaaaggacctgtaattgctgcatctgtaaatgtggcagttcctcaagttgagcagaagactattgttgtgcagcccatgcttgtagctgaaaccagcgaggctgctgctgtaatccccaaggccaaggaaggcccagaccggtgcgcggcctgcangaagcgtgttgggc

SEQ ID NO: 62670 - DNA, 430 bp, Zea mays
  Clone ID: LIB3075-007-Q1-K1-C4
gaaacaacaagactgacagcgacgatgatgccacagctgcgtagcctcgtcgcgctggtcctcgtggccacggccatagccgccgctcccggcgttgggtttgtcgtcaccggccgcatctactgcgacaactgccgcgccgggttcgagacaaacgtgtcccacgccatccaaggcgcgacggtggagatggagtgccgccacttcgagtcgcagcaggtccacgacaaggcggaggcgacgacgggccccggcggctggtacaggatggagatcagcggcgaccaccaggacgagatctgcgacgtgcgcctgctcaagagccccgaagcggactgcgccgagatcgaccacttccgcgaccgctgccgcgtcccgctcacccgcaacgacggcatcaagcagagcggcgttcgctacgccaacccca

SEQ ID NO: 62671 - DNA, 421 bp, Zea mays
  Clone ID: LIB3075-007-Q1-K1-C5
tgcagttcctccgaggcagcggctgcgggggctgtgggttcccggtggtggcgtgggaggtgttgcggcggcacttctctaagaagcggtccgtggacgtgaggcggatcaaccccaaggtgcccaaggaggaggccgtcgccatttccggccgactcctccagatcctctccgaccatgggcccctcaccgtcgccaacacctggaaccacgccaaggatgctggcatcgctggcctgaacagcaagacgcacatgaagatcctgctgaaatggatgacagggagaaatgtcgtgaagctgacctgcgtgcacgtgggcaacgcgaagaagttcctctactccccgttcactgaaagcagcagcagcagcgccggtgcattaccgtcattcacatcgggctcgcagtgacggtcagtcgc

SEQ ID NO: 62672 - DNA, 476 bp, Zea mays
  Clone ID: LIB3075-007-Q1-K1-C6
gtcgcgccactcctcgctcatggcgtcctccactctgccagccttccccttccgtgcgtctcttcccggacttacgtccccggatcctgctaagcttaaccacgtatctgtttgaagacccgttcgccgtcttcccgttgcggcctccgcggcaccgtcgggcgccgtcgccgcggcgacggagcgcaagcgcttccgggagcgctacgggctcaacccagacgacttcgaggaagatgcagaggaggatccaagggaagagagcatggacaggcggagccgcggagacagcagcagtctgggagaggggagcaaactgtggaagctgcagttactccagcgaaggtggcggagcctcgggagactcacaaatcacaatcaatacgtaatgcagttacttcaggtttggacagaaaccgttcctttgttttggtcgtgtaatgtcagagcaattatatcgatctattactcttctg

SEQ ID NO: 62673 - DNA, 433 bp, Zea mays
  unsure at all n locations
  Clone ID: LIB3075-007-Q1-K1-C7
gtgagagaccgagggagagagaataagaacgccctgtgcggatctccctcaaacgcgagacgctgggatggatgacctcggggccgcgccgctcgcaaattttggcccgcgccttgggaatttctcgccatcgaagttaaatccgccgtagatccgttttcgccgtggccagaggattccgcgccgctaagcttgcgtgaggttacgagtcacctgaagatcatcctggtatctggaatctcaagtcccaggtcaagaacaggtaccgcaggatgaggcgcatggaggatgctgcgacgagttcgtgagaggtctaggtcgtcgtctcccagtcaacttttggttgctggaccgttgtctccttataatgtaattatttattttgtacaaaactcttattatatagtaaagatgtgacattcgaaaaanaaaa

SEQ ID NO: 62674 - DNA, 475 bp, Zea mays
  Clone ID: LIB3075-007-Q1-K1-C8
gggcaaccttcgatactacccgtacaacattaactggaactatgggttacttcctcaaacatgggaggacccaacttctgcaaattctgaggttgaaggagcatttggggataatgatcctgttgatgttgttgagataggtgaaaggcgtgccaatgtcggggatgttcttaaggttaagccattggcagctttagcaatgattgatgagggagagcttgactggaaaattgtggccatttctttggatgacccgaaagcatctcttgtgaacgacgtggatgatgttgagaagcattttccggggacactgactgccatcagagactggttcagagactacaagatacctgatggaaagcctgctaacaaatttggtctgggcaacaagcccgcaagcaaggaatacgccctgaaggtcattcaagagaccaacgaatcatgggagaaattggtaaagaggaatattcccgct

SEQ ID NO: 62675 - DNA, 461 bp, Zea mays
  unsure at all n locations
  Clone ID: LIB3075-007-Q1-K1-C9
cccacgcgtccgacggaaccagaaagcaaacgcaaacaagaagcaaaccagcaatggcccgcgcctgcgtcttcctcgtcgtgctcctcctagccgccgtcgccatggcgccgttcgcgggcgcggcgcgcatcgacgtcgtcgagggcaggtccatggcgtccgcggacgcaccggaggccgtcgccgacgctcccgctcctgctcctggccccgactcctcctcgaccccgtcgccggcacccttcagcagcagctctttcgactaagccgccggcagagatatctacggcgtccgatcagtctttggcgccacctataacctatcggatcctgcaaagctatatatgattctatggtataatgtgtggntgcggcaaacgcgcgggaataatgtgcttgcgtgattggttttctctctctttntttggttaataatgtaaaacaggcatacggcgatg

SEQ ID NO: 62676 - DNA, 450 bp, Zea mays
  Clone ID: LIB3075-007-Q1-K1-D1
ggcgcttggggctgttcgttgtggtggtgcggtaggaagagacgatggcgcgaggtggcgcgtgggccgcggtggctgcggcggccgtgtggtggatggcggcggaggccggggcggtatggctggagattgcgccgtcagggactaagtgtgtgtcggaggagatccaatccaacgttgtcgtcatcggcgactactccgtcctctatgatcaccaccacgcccagactaccatctacgtcaaggtcacattctcttttggagacattgttcataagagagagaacgtttcgatggggcaatttgcatttaccacagcagatgcagggaactaccttgcctgcttctcaattgatggtgaggacagagggttagtggtgaagctagatcttgactggaaaattgggctggctagtagagactgggattctgttgccaaaaggaaaagat

SEQ ID NO: 62677 - DNA, 463 bp, Zea mays
  Clone ID: LIB3075-007-Q1-K1-B7
gtgtgctaccacatcatagctgccggattgaacggttacatggctacggtgacaaatcttaagaatccagtgaacaagtggcgatgcggcgcgactcctatttcgtctatgatgactgtgaagcgatggtcgcgtggcccttcagccacccaaattggaaagcccgctgttcacatggctagcgttgacttgaaaggaaaagcatacgatgtgttgagacagaattcttccagctttttgttggaagatgtctacagaaacccaggcccgctccagtttgaaggaccaggtgccgattcaaagcctatttcattgtgcgttgaggatcaagactatatgggcagaataaaaaagttgcaggaatacttggagaatgtgaagaggattgtgaagcctgtgtgctcgcaggatgttcttaaagcggcgctgagtgccatgtcttctgtgacggaaacactgaaca

SEQ ID NO: 62678 - DNA, 450 bp, Zea mays
  unsure at all n locations
  Clone ID: LIB3075-007-Q1-K1-A12
agatcgtaggcggcgagcgcaccgccaccggaggggatggcgcggagacggggcggccccgcgccggcgacagcggtcgcctcgccggccgtgctcggcactgtggccgtcatggtgttcgtgtactactccacggtgttcgtcttcctcgatcactgggtcggcctcgccacgccgatcggcgccgcccacgccgccgccgtctcgctcgccgtcgccgcgtgcttcctcgccttcgtctgcgccgcgggcgccgacccgggcgccgtcccacccgccttcgcccccgacgccgaagccgcgcagggacaggggttgaaatcaaggtattgtgataaatgttgcatgttcaagccttctcgtacccaccactgcaaggtctgcagaaggtgtgttctgaaaatggatcatcactgtgtctggatcaacaactgtgtangatacgcgaac

SEQ ID NO: 62679 - DNA, 479 bp, Zea mays
  Clone ID: LIB3075-007-Q1-K1-A2
gctttccgtgccgctcgccgacctgtgggcaccgctgcgagagctgttcgagcggcctgagacgctcaagctggggttcaggtttaagcaggacctggtgtacctctcctccaccttctccgccgccctcgggtgcgattccggattcgatagggtggagcctttcttggatgtcaccaacatttattactatctcaagggccatgataggcagaagaagcttccaaaggagaccaagagtttggcaactatttgtgaggagctgcttggtatccttttgtccaaggaactccagtgtagtgattggtcatgccgccccttaagtgaagggcaaatacaatatgctgcgtcggatgcctactacttgctagacatatttgatttgttccaaaaaaggatcacaatggaaggaaaatgttcatctacaacagaacttacttcagacagacattgctcatcagtggtgatagaatgctctt

SEQ ID NO: 62680 - DNA, 308 bp, Zea mays
  Clone ID: LIB3075-007-Q1-K1-A4
atcacgacaagatggcgtgcacaaacaatgcgttgagagccttgttcctcctggtcctcttctgcatcgtgcatggtgagaaggaagagtcaaagggcatcgatgcgaaagcgtccgggcctggtgggtccttcgacatcaccaagttgggcgccttcggcaatggcaagacagacagcacgaaggctgtgcaggaggcatgggcatcggcgtgcggcggcactgggaagcagacaatcctcatacccaagggtgactttcttggcggacaactcaactttacaggcccttgcaagggcgacgtgacc

SEQ ID NO: 62681 - DNA, 462 bp, Zea mays
  Clone ID: LIB3075-007-Q1-K1-A5
cgggaaagtattgaatacacctgatgtttcacgtgtttatattggatcattcaatgacaaacgagtaaatgaatcagctgttggtccacttggaaaggaactatttgagagagagcaagatgatcttctttctgatctcaaagatatccccaagaaagcctgtgaccgccggatcaatgaatttgttaaacgtgctagagctgccaagatccatgcttatataataggtcatctaaagaaggagatgcctacaatgatgggcaaagcaaaagcccaacaacgactcatagacaatctgcctgatgagtttgcaaaggtgcaacgggaataccatcttccgtcgggagattttccttatgtggagcacttcaaagatgtcttgagcggttacagctttgacaagtttgagaaggtgaagcccaagatgatacaggccgtggatgatatgcttggatatgacat

SEQ ID NO: 62682 - DNA, 459 bp, Zea mays
  Clone ID: LIB3075-007-Q1-K1-A6
ctttcgttcctcctcgccccagcgacgcggcctcccgtagaccgagcaaggcaacgcaccactgagaggcacgcagaggagcaggaagccggagaccaagatgtcgtcggtgttcagcggcgatgagacggtccccttcttcggtttcctcggcgccgccgtcgtcctcgtcttctcatgcatgggcgcagcgtacgggaccgcgaagagcggcgtctgcgtggcgtcgatgggtgtgatgcggccggagctcgtcatgaagtccatcgtgcccgtggtcatggctggtgtgctcggtatctacgggctcatcatcgtcgtcatcatcagcactgggatcaaccccaaggccaagccctactacctttttgatggctacgcttacctttcgtccgggcttgcctgtggccttgctgggcttgcagctggcatggccatcggcattgttggtgatgctgg

SEQ ID NO: 62683 - DNA, 470 bp, Zea mays
  Clone ID: LIB3075-007-Q1-K1-A8
actttcctgagtaggagagagagttgagttaggagttgttgtgctgatcatctgggacgaccgagagatggaccaccacttcactgagatagaggggaagatggcgcacgagccactggcacacagctccaccttctccgatgagacgaaagacaaaatggagcacgattcactggtgtacagtccacgcagcatcgcgagggccacaaccaccggcatccctgtcggcgatcaaggcgtggccgtgctacgtgggccgcttatcgtgggtgcagggccggcgggtctggcatgcgcggcgttgctcaccatgttatacattccctacgtgctcctagagcgcgacgtgtgcgtagcctcaatgtggcaccgtcgcacgtaccgcaggttgtgtctgcacctacccaagcgctactgtgagctcccgctcatgcactttccacgcacctaccccacatatccaacccggc

SEQ ID NO: 62684 - DNA, 339 bp, Zea mays
  Clone ID: LIB3075-007-Q1-K1-A9
gatctttgcaagcagattttgaatgacaaacctgatgaccgtcagaaggacctaacattcatcccacttgccccagcttgtgttgtaattcgtgtattgaccccagtatatgctaccctccttcctgctggcccttttatctggagaatattctggattttactttggtcagttctgacctattttatgctcgccatattcaagataatcgtgggattgatactgcgctgccttgcaaattggtatgtaaatctacggctcacaagaaaacaacacgtggattgagtacatggcaccacaattctgctgctatcgttacatctgtgagtagaaattttg

SEQ ID NO: 62685 - DNA, 443 bp, Zea mays
  Clone ID: LIB3075-007-Q1-K1-B1
gttcaacttcaagaaggatagggatggctattggaagtggtttgctggcaacctggcctctggtggtgctgctggtgcttcctctttgttttttgtgtactccctggactacgcgagaacaaggttggctaatgacgcgaaggctgccaagggaggaggtgaaaggcagttcaatgggcttgtcgatgtctaccgcaagacactcaagtctgatggtattgctgggctttaccgtggatttaacatctcctgtgttggaatcattgtttatcgtggtctgtactttgggctctatgattccatcaagccagttgtccttactggcaacctccaggacaatttctttgccagtttcgctctgggttggctgatcactaatggtgctggtcttgcatcttaccccatcgataccgtccgcagaaggatgatgatgacatctggtg

SEQ ID NO: 62686 - DNA, 401 bp, Zea mays
  Clone ID: LIB3075-007-Q1-K1-B10
gcggtggcgacaaggtggcgacgaggcaagctgagcgggcgagcactacagcggcagcagatctcacggaatggcggcgaaagcaatctcgagccgcgtgccggaggagtggtacccgacgctggccggcgccatggtatccggaggcctcatgttcaccggctgcttcttgatttatgaagcaacttcatcccggaagagccgtagcctgtcaaaggagatcgcatcagcagttcgttgcttctggtgtcttggactgtgggtctatgatcgtgcttcttgcaagtggtgccaatgcctgatgactggctatggcccgtgtgtgcttgtgttctgcataccgagctgtagactgggttatgacacatcctgaacgctgatgtcctaacgaatatagagca

SEQ ID NO: 62687 - DNA, 453 bp, Zea mays
  Clone ID: LIB3075-007-Q1-K1-B11
cgctgttgcagtggccaagtaacgaatcactgtctcgttctcaatgggacacagtttcttttcgatgcacaggataacatctcgctcgatgttacagctctgccgtgaagggaggcacctcgatcgctggcgtatgtgacatcattgctgtcgcatctgggaaaggcggcgtaggcaagtccaccactgcagttaacattgctgtagcacttgcaaaggagtttaagcttcaggttggtttgctagatgctgacatctatggaccatccattcccacaatgatgaatctccatgccaagcctgaattaagtgaagacatgaagatgattccaattgagaaccatggtgtgagatgcatgtccattggttttcttgtagacaaagacgcaccaattgtttggagaggtaatgagtgctcttgagaagatgacaaggggagttgcttggggggac

SEQ ID NO: 62688 - DNA, 450 bp, Zea mays
  unsure at all n locations
  Clone ID: LIB3075-007-Q1-K1-B12
caagccagagctgttgagggaaggaaacctcgaggaggcagcaatggtggatgtttggatcgaggtggaggctaaccagtacaccgctgcactgaatcccatcctcttccaggtcctcatcagtcctatgcttgggggaaccaccgaccagaaagttgtggatgagaaccttgagaagctgaagaaggtgctagaggtgtacgaggcacgcctgaccaagtgcaagtaccttgctggagacttcctcagcctcgccgacctgaaccatgtgtctgtcactctctgcctgttcgctacgccctacgcatctgtgctcgacgcctacccgcatgtgaaggcctggtggtctggtctgatggagaggccgtctgtccagaaagtcgctgccctgatgaagccatctgcttgaaacggntgccctgtcaatcggtgaatggaataagccaagtc

SEQ ID NO: 62689 - DNA, 321 bp, Zea mays
  Clone ID: LIB3075-007-Q1-K1-B2
cgccgatgcaccggaggcggcggccgatgctcccgctcctagccccgactccgcctcatcccgagactcatcgtcagaggcgccctccagcagcagctcctccgactagacgcaaaaacctcttcattctctggaataactaacagtatatacgttgcaccctgatgatatagaaacatgtacgtgcatcagtgtatggaatgcgagtggcaaacacatggaatgtgcttgcctaattattgtttatttctttatttattatatgtctctctcggttgttttttatttttcttaatgcatgtaatataatttgttataccc

SEQ ID NO: 62690 - DNA, 398 bp, Zea mays
  Clone ID: LIB3075-007-Q1-K1-B3
ggccagccggcctatttatataatcaatggatgagaaataaagtcggcaagaattagaagggagaaaccctcctcttgctcgaccgtgggcagaagcccccggccgacgttcttgcccgtcgaatcgtcgatacccctctccaatccctcaccgatctagcgaccataacactaatacttgtttattgatgatttgaaatgtgagctagaacgtgctagaacctgatgggattgtatgttttacttcagtctgcacttactgttaacaatttcgttcatagaataccaatggccctggttttgacttttgagctatacatgtaatacatgatttaggatgttagcgtattctcttgctggaatgcatatgttaaagagtatagatgtgtatgagcata

SEQ ID NO: 62691 - DNA, 468 bp, Zea mays
  Clone ID: LIB3075-007-Q1-K1-B5
ttcgtacgccgtcgcggcacttctcgcgctcgcctctgtcgccgtcgtcgcaggggaggtctgcttccaggagaagttcgaagatggctgggaaagtcggtgggtcaagtccgagtggaagaaggatgagaacatggctggtgaatggaaccacacttcgggaaaatggaatggagatgccgaggacaaaggtattcaaacctccgaggattacaggttctatgccatttcagccgaataccctgagttcagcaacaaggataagaccctggtgctgcagttctctgtgaagcacgagcagaagcttgactgcggtggtggctacgtcaagttgctgggtggtgatgtagaccagaagaaatttggtggagacacatcgtacagcattatgtttggaccagatatctgtgggtacagcaccaagaaggttcacactatcctgaccaaggatggcaagaaccacttgat

SEQ ID NO: 62692 - DNA, 474 bp, Zea mays
  unsure at all n locations
  Clone ID: LIB3075-007-Q1-K1-B6
ctctgagttcatcaacttccctatctatttgtggtcgaccaaggaggttgatgttgaagtgccaactgatgaggatgagacaagtgaagaagaggattcaactccagaaactacagaggaagagacagaagaagacgaagacgaagagaaagagaaaaagcccaagaccaagacaataaaggagactacttctgagtgggaacttctgaatgatgtgaaggctgtatggcttcgcagcccaaaggaggttactgatgaagaatactcgaagttttaccactcactagccaaggacttcggtgatgacaagcctatgggttggagccacttcactgccgaaggagatgttgagttcaaagctttgctctttattcccccgaaggctgcacatgatctctatgagagttactacaacagtaacaagtcaaacctcaagttgtatgttaggagagttntcatctctgacgaatttga

SEQ ID NO: 62693 - DNA, 300 bp, Zea mays
  Clone ID: LIB3075-007-Q1-K1-A1
atcttgttgcaccctaccaaaggggtggaaagattggcctcttcggtggtgcaggagtgggtgaaactgtgctcatcatggagttgatcaacaatgttgctaaggcccatggtggtttctctgtgtttgctggtgttggagaacgtacccgtgaaggtaatgatctgtacagggaaatgattgaaagtggtgtcattaagctagatgacaagcagagcgaaagcaagtgtgctcttgtttacgggcagatgaatgagcccccgggtgctcgtgcttcgtgtgggtttgacttgttttgac

SEQ ID NO: 62694 - DNA, 309 bp, Zea mays
  Clone ID: LIB3075-006-Q1-K1-G2
ctgaagaggcattggctgatccgtattttaaaggcctctcaaaagtagagagagaaccatcatggcaggcaataaccaaaatggaggtcgaggtttaaccaagaaaggggacccaagaggatgtcaaggaacttatattcagggagatattagagtatcattcttaacttctcaaggattacatgaatggaactgagaaaacaaactttatgtatcctagtgctgttgacaatttccgaaggcaatttgctaacttggaagaaaatggaggaaagagtgtggcgcacacagctttatatgacacgaaac

SEQ ID NO: 62695 - DNA, 339 bp, Zea mays
  Clone ID: LIB3075-006-Q1-K1-G3
cggacgcgtgggcaggaattcacgtcgatcgcttgagttagtttgcagccaagatgaacgacgccgatgtcgggaagcaggtgcagcagatggtccggttcatcctgcaggaggccgacgagaaagccagcgagatcagtgttgccgccgaggaggagttcagcatcgagaagctgcagctggtggagtcggaaaaacggagggtgcggcaggagtacgagcgcaaggagaagcacgtggacgtccgcaggaagatcgagtactcgacggagctgaacgcggcgcgcatcaagctgctgcgggcgcaggacgacgtggtgaccgggatgaatgagagcg

SEQ ID NO: 62696 - DNA, 444 bp, Zea mays
  unsure at all n locations
  Clone ID: LIB3075-006-Q1-K1-G4
aagatcttcttcttctcctggtcccctgacactgcacgcaccaggagcaagatgctgtacgccagctccaaggacaggttcaggagggagctggacggcatccagtgcgagatccaggccaccgaccccagcgagatgagcctcgacatcgtcaggagccggaccaactgaccgtcatcgtccaataacgaccaagcaacaacacattcacactatatactcaattcacattgcatgcatcgntattattacatcatttatttcagaccccnccgccactgctaaccgtagtccataagagattcatcatccgtggactatgctcgatctcttncgtacgatacaattctcaaatatttctaattattttctaagtgaantattatatatgtactaattcattcaagtttcattttactgggaccattcttcaagtcttttttc

SEQ ID NO: 62697 - DNA, 341 bp, Zea mays
  Clone ID: LIB3075-006-Q1-K1-G5
gtgagccgccccgacggtcctcagccatcctctccatctgggtgtcacacactccgcatacgcgcctacgagagtcgagtgacagcgagcgagcgagcgagcgaagccatggctctccgcaccctggcatcgaagaacgccctatccttcgcgctcggcggcgcggaccggccgtcagaggcgtccgcgaggggggtgacgacggtcgcgctcctagacctctcctacgacttcggcgcgctggagccggccatctcgcgggagatcatgcgcctgcaccaccagaagcaccacgccacctacgtcgacaactacaacaaggcgctggagcagctcgacgc

SEQ ID NO: 62698 - DNA, 409 bp, Zea mays
  Clone ID: LIB3075-006-Q1-K1-G6
cggacgcgtgggcggcagttcagccgcggcttttgttccgccgttccggagatggggtccggcatgagcagcgcccggcggcgccgcttcggcctggaggcgtcgcgggggatgctgcccctgctggctctgcaggtgctcatcgagtacggccgcgcgggggcctcccgcccgcccgtcacggccgcgctgctcgccgccaactcactcgtctacctccgccccggcgcgctcgacggggtcctgccctcgctcgcgcgcgtctccttcaaccctcagctcatcatcgagtatggcgacttgacgcgctttttcctgtcacccttctaccacttgagtgaaagtcacctcttctacaacatgacgtcgctgcttgggaaaggcattcatctcgagacatcaatgggta

SEQ ID NO: 62699 - DNA, 383 bp, Zea mays
  Clone ID: LIB3075-006-Q1-K1-G7
agagttgctgacatcatacagattccagcctttctctgtcgccagactgatcttctagtggctgctgctaagactggaaaaattatcaatatcaagaaaggacaattctgtgcgccttctgttatggtgaactctacagagaaagtaaggcttgctgggaatccaaatgtgatggtctgtgagcgtggtaccatgtttggctacaatgatctatttgttgacccaaggaaccttgagtggctgagggaaagcaactgcccagttgtagctgatgtaacacatgctctacagcaaccagctggaagaaagcttgatggtggaggtgttgcaagcggtgggctacgagaactaataccgtgcattgcaaggccttctgttgctgt

SEQ ID NO: 62700 - DNA, 230 bp, Zea mays
  Clone ID: LIB3075-006-Q1-K1-G8
gatgtcgtggcaggcgtacgtggacgagcacctgatgtgcgagatcgagggccaccacctcgcggcggcggccatcgtcggccacgacggtgccgcctgggcccagagcacggcgttccccgagttaaaaaccaaggccatggccaccatcatgaaggacttcgacaagccagggaacttggggccgccaggccggtccctgggacctaccagagccatggccatccaag

SEQ ID NO: 62701 - DNA, 151 bp, Zea mays
  Clone ID: LIB3075-006-Q1-K1-G9
aacgaagcgaacggactgggctacttcgaggacctgcgagcggcgagcaacatggacccctatgtgggcgtctgcatgagcgccgagaccaacatcatgtgtaagcgctgtagcaccccgcttgcatgtcgtgtcgggttgctgcgggaac

SEQ ID NO: 62702 - DNA, 371 bp, Zea mays
  unsure at all n locations
  Clone ID: LIB3075-006-Q1-K1-H1
gccactcttgctctcaaggcgcttgggatctgcatcttctctgctgagatcgggaggcaagcggcgtccgagcgccattgggaggtgtacaggttcctcctggatgacagcaaggagttccccttggcaagcagcctcgctaacaggaactgtgtcgtcgatagggcgaggaagacgctgatgggatgctacaactgagacttgggtgggtgtcgatctgtatctgtctgcaagaatccaacgaagcagtgcaagtgcaatgcaaggctttccccatccacagatgcatttgcatgctatgctgcttcctggagttgtgcacggngatggtttgaaaccagagttatgcacagcacagactgaaatgaatg

SEQ ID NO: 62703 - DNA, 331 bp, Zea mays
  unsure at all n locations
  Clone ID: LIB3075-006-Q1-K1-H10
cccacgcgtccgcggacgcgtgggtgaagatatccaagtcctaagatataagcatggggagaagtatgaaccacactatgattacttcactgacaatgttaacactgtccgtggtggtcatcgctacgctactgttcttttgtacttaactgatgtaccagaaggaggggaaacggttttccccttggctgatgagcccgatgatgctaaagatgcaaccttgtcagaatgtgctcagaaaggcattgcagtgagaccacggaaaggtgacgccctccttttcttcaaccttaacccagacggcaccaccgactcggtgagcctncatggt

SEQ ID NO: 62704 - DNA, 315 bp, Zea mays
  Clone ID: LIB3075-006-Q1-K1-H11
acgatcgatcgtcacagccaacatcacccgccgaggttacgcgacagtcgacaggaggaaggaataagctcagtgacagacagcgaagggtgagaagcgtactgctctcgtgaccagagcactgcaccgacagacagagctcgttaatctctgacgacgaccagtggattaatacgcatggcagctatggccacttagcaggtcgttgtaacgcccgacggactgggcgtacatgacgcatccacgtttcgacgtggcgcctcacagggcctgaagggggtccaggcatatgtgacggttgacactcttattatg

SEQ ID NO: 62705 - DNA, 247 bp, Zea mays
  Clone ID: LIB3075-006-Q1-K1-H2
cggacgcgtgggcaagattacaaggagctgatgcagcttttttaggatagcaacagcatcgcccgttgaggaactgtaactttatgtgacggaatcacaaaaatttaccattgtatttgttcaagctacacgtgccacagttttttatgttgtgattggtaggtacggtgaagttagacctctagtgctattgggaagaaaaaaattaccattacatttatttaatatattttccttttttccttgt

SEQ ID NO: 62706 - DNA, 299 bp, Zea mays
  Clone ID: LIB3075-006-Q1-K1-H3
tcgcgccacggcgatgctagctacactattcgcggttggtttgtgcaccaccccgctcaccttccaggtcggtaagggatccaagcctggccacctgatcctcaccccgaacgttgccaccatatccgacgtggagatcaaagagcatggtggcgatgacttctcctttacgctgaaggagggcccgaccggcacctggacactcgacaccaaggccccgctcaagtaccccctttgcatccgctttgctgtcaagtctggtggctaccgcatcgtcgacgacgtcattcccgtcgatt

SEQ ID NO: 62707 - DNA, 351 bp, Zea mays
  Clone ID: LIB3075-006-Q1-K1-H5
gaagagagaaacgcgagcaaccagccatcgccctatgggcgccatggctcgatccgtcggcctcgtcatggcgccccttctgctcctctgactcctcgtcttcgccgcgggcagtgcgcggaccgtgggcgacaccgtgcaggacgcgtgcagcaagacccagctccccaagatctgcgtggacagtctcgccgacaagccggagagccacaatgcgacgccgcgcaagctggcggagctgttcatgaacatcgcggccgaaaaaggatccggtatggccacctttgtgcaccgtaagtacagcgacaaggaggacagcgacatattcaagtgctacgacagttgctccga

SEQ ID NO: 62708 - DNA, 420 bp, Zea mays
  Clone ID: LIB3075-006-Q1-K1-H6
ggacgcggtggacctgggcttgttcccagttcattactgccttttgatgtttcggttgtacttcgtgggccatactggatacgcattatatatcgcaagaaattttctgttgacatgcgctgctttgctggggatcaggtttggctccagccagctactcctcctaaaggtggaccttcagttggtggatcgttgccatgcccacagttccggcctttcataatggaacatgttgctcagggtctaaatgctcttgaacccaacttcatgaatgctacacaggctagtggacacttaaataacaatgcaggagttccacaaactgctcctagtgcaaatcgtttaaatgctacccctggtgtttctatggtcaggccaacatctggtgttgctaaccatgtagcagccagtttgagtcga

SEQ ID NO: 62709 - DNA, 455 bp, Zea mays
  unsure at all n locations
  Clone ID: LIB3075-006-Q1-K1-H7
atcgcgagcggcctcccttttttttttttttttaatctctgacaaatagaaagttataagcaggcaaaattataggtgcacttttctaactgatgcatacttcgttgccgttcatggagtggtgagtaaatgtaaacttaaaagctttcgcacagctcaaactaccaagagttcctccaggcaaaaccaccagctacaccgtcaactgcgacctataagtagatcagcgtctcttcttgcttgcctttgagctgctcttcgacgggctcgcgacaaggtagataaacagtccaacaaaagagacaacagacacaagtgacccgtatttcatcacaagcctcttagcccattcaaacttcttctctggaggtctctcagcgagaatatccagtgngaagatgggagttgagtatgccttctgaagaactgtctttgtgggaacacggtatgtaata

SEQ ID NO: 62710 - DNA, 298 bp, Zea mays
  Clone ID: LIB3075-006-Q1-K1-G12
gcggatctagagagcggccgtttgcgaagggtgctctgattccagaggtcgtggtggacaaaaggactgggtgtggtggcggaactggcggtcacgtagctgtgcgagacatcgaactgtcttgatactgcgactcatgcttgctttcattcagcatacaatgccatgttgggtatgctgcctgaggtggaacggtgagtgggttaagcaaggtttttagagcgtctgatgactttgccaagaggattgggacacgctctagactagcgcatgaagtgctgggtgcactgcatgctag

SEQ ID NO: 62711 - DNA, 375 bp, Zea mays
  unsure at all n locations
  Clone ID: LIB3075-006-Q1-K1-H8
atgaaatgtgatgtgatagcaagtggaattgttaatgctgccaaacaggttgacctgaaagttcctgttgttgttcggttggaaggcaccaatgtagaccaaggaaagaggattcttaaggaaagtggaatgactttgatcactgcagaagatcttgatgatgcggcagagaaagctgtaaaagcatccgtcaaataactagtgtataaatgtgaatttttttttttaaacaggggtacaagatgagcagtgctcttttacggatttcgatttggagcagaagtcgtgaactgcaacgtttttgaagtagggttattttggccttgttntgctgataaatgttgccagtgccaaaaattgtggtctcgttttaat

SEQ ID NO: 62712 - DNA, 380 bp, Zea mays
  Clone ID: LIB3075-045-Q1-K1-F10
gttgaacgaaagcagctccttgaatccacttctggcgagaaccagctacacgttgcagatgggtgtttccatggcgcttgtgtggaagatttgcgtttagattttactcttccaggttatcctgattatgtgcttaaagagggtgaaggaggcacacttgttaatatttataatttagaacagtatattacttcggtggtggatgctacagttaagtcagggataaagcgacaggttgaggcatttagatcagggtttaatcaggtgtttgacatgtcatccctgcacatattgtcacctcaagaacttgactatctaatatgtggccgacaagaaatttgggagtcggaaatcctggtggataacataaaatttgatca

SEQ ID NO: 62713 - DNA, 400 bp, Zea mays
  Clone ID: LIB3075-045-Q1-K1-F11
acggcacggccatggagcagctgaccgccgtaatgggcgcctccgagagctgcgaggacgcgtggaagggcgaggaggaggatgtccccgtcgccgcgcacgacagggagtacggtcggatggcgcacatcgccttcggattcacacaccacgccgacgtcgccgacgccgccgcatgaatcgattaattattatatatatatatgcatgctatctactatgatcgatcgcttctcgaccttcttgcatagatctgcatgcatattataatgtatattatattgatgccacgccgcatgcaggtctttccaaggcgtacgtactatatcaaattattttaatttccttacatgtatatgtatgtgctgctgttggatacgtacgtatatatatatcgtct

SEQ ID NO: 62714 - DNA, 62 bp, Zea mays
  Clone ID: LIB3075-045-Q1-K1-F12
gatacacgaacgcggcaccttgaatccatttgttgggcgcaccagctacaagttacatatgg

SEQ ID NO: 62715 - DNA, 328 bp, Zea mays
  Clone ID: LIB3075-045-Q1-K1-F3
acatttgagtggatcatggacggattggtaggcctcttgaaagtccgggtggtgaggggcatcaaccttgcctaccgcgacgcaagaggcagcgatccgtatgtcgtcctacgacttggcaagaagaaacttaagacgagcgtgaagaagagatctgtgaaccccatctggcacgaggagctaactctgaccgtcacagatcccagcctagctctgaagctggaggtgttcgacaaggacacgttcagcagggacgacccgatgggggacgcggagatcgacgtggcgccgctggtggaggcggcgaacgcgagcccggaggcgagcc

SEQ ID NO: 62716 - DNA, 187 bp, Zea mays
  Clone ID: LIB3075-045-Q1-K1-F4
cttcatcttcttaccagcctactacgacacttttattgtatctatcgagacacacctaacagaggcaacagtcatagcgggaacgcgaaccctgtacctccttggcgcgactgtcgcggcgctcttaaccacacctgctgacgtggacgctggcacgctggaggagatctgaaggggaacctccttc

SEQ ID NO: 62717 - DNA, 398 bp, Zea mays
  unsure at all n locations
  Clone ID: LIB3075-045-Q1-K1-F5
cccacgcgtncgcacgctttcttcacctgaccaacagccaagccgggaggcacgcttgagagccacacactgagacctcacgcgcggatggccgccgccgcgggcgggaccggcggctgcggctgccacattgtagcggtgccgttcccgggccgcggccatgtcaacgccatgatgaacctgagccgcctcctcgcagcccggggcgcggcggtcaccttcgtcgtcaccgaggagtggctcggactcatccgctcctcctccgccgccgccgctgccgagccggccggcattcgcatccgcaccatccccaacgtcatcccttccgagcacgggcgcgccgccaaccactcaggcttcctcgacgccgtcgccacagagatggaggcgcccttcga

SEQ ID NO: 62718 - DNA, 416 bp, Zea mays
  Clone ID: LIB3075-045-Q1-K1-F6
caaaaaccttcgggatatatttgctatcttgggtatggatgagctcagtgaggatgacaaggtgacggtcgctcgtgcaagaaagattcagcgtttcctgagccagcctttccatgtcgctgaagttttcacaggtgctccagggaagtatgtggagctgaaggaaagtgtgaagagtttccagggtgttttggatggcacgtatgatgacctccctgagcagtcattctacatggttggaggcattgaggaagtcattgctaaggccgagaaaatcgccaaggagtctgcttcataaggcggcttcttgcttgttgaatcctgtacaatcaagttccatttttggatttaagcgattgtttatgcttttcgcagttaggcagcacgagttggaggtccatctcctgctgagatgc

SEQ ID NO: 62719 - DNA, 402 bp, Zea mays
  Clone ID: LIB3075-045-Q1-K1-F7
ggactgccgtcttctgggcaagttcgacctttttggcattccgtcagctccgaggggcacaccccacatcgaggtgaccttggaggtggacgccaacggtatcctgaacgtgaaggcggaggacaagggcacgggcaagtcggagaagatcacgatcacgaacgagaaggggcggctgagccaggaggagatcgaccgcatggtgcgggaggcggaagagttcgcggaggaggacaagaaggtgaaggagcggatcgacgcccgcaaccagctggagacgtacgtgtacaacatgaagaacacggtgggcgacaaggacaagctcgcggacaagctggaagcggaagataaggagaaggtggaggaggccctcaaggaagcgctcgagtgggtggacgacaa

SEQ ID NO: 62720 - DNA, 425 bp, Zea mays
  Clone ID: LIB3075-045-Q1-K1-F8
cggacgcgtgggctacaaacacgtgacaccttcgcccaccctcgccccctccctaccggcggcgcccagatggcctgctcccgcgtcgtcgccgccgcgggggtctcctcccccgccgcagcggcggctcgttccccggcgcattctcccgctgccgccttcgcgcgcctccggtcgacgcctcgtttcgcgagcgctggcttgtcggttaagggaaacggagcggcgttcccgttggtcgccgccgcggggccggccgcggcggcaccggtggccgacctggacggccgcccggccacggagaagcagcccatcatcgtcatcgacaactacgacagcttcacatacaacctctgccagtatatgggggagcttggattgaacttcgaagtataccgcaatgatgaactgaccatagaagatgt

SEQ ID NO: 62721 - DNA, 428 bp, Zea mays
  Clone ID: LIB3075-045-Q1-K1-G1
cgccctagaatacacgcctcgtgagcatgcctttagatatgggagcgccaccatagccgtctgccgccgccgtccccgcttagcactcgtggtgcgctcccggacacctcgacggtggtgtggatcgtgtcccgggggagaatcggacgcggggagccacgttgtggggggggattgctcgccgccgagtcatccctgccgtggagccacgcatcacgtcgtcggggttctctacgccattatcattgcagtgaggtcacgaggatttgaagaatcatcctggtacctagaatctaaagtgccaggagaagaagatgtggttcaagaggagccacacaacgaggagttcgattcgatctatgtggcgtctcccagttgactttatggcgccaaggatggactttagttcgatctatatttatctttta

SEQ ID NO: 62722 - DNA, 324 bp, Zea mays
  unsure at all n locations
  Clone ID: LIB3075-045-Q1-K1-G10
cgaggcaaccacacgggcgacncacccgggttcacgatcaccaacaccgtcattggcgggggggactactgcaggggcatgggggccagaaccatcaaggggaacatcaccggcgagacctgcggccctggccacgggagcagcatcggcagcctaaggcgggacaaggacgagaaggacgccacggacaacaacgtcaaagatggcactctgaagaagacgacgatcggcggccgcatcaaggcgtacgaggacgccgcctacgagctcaccggcggcaagatccactacgagaaaatcaagaaggaagactcagccaacccc

SEQ ID NO: 62723 - DNA, 368 bp, Zea mays
  unsure at all n locations
  Clone ID: LIB3075-045-Q1-K1-G11
aaaagatggaaggaagcgagaacagtgaatagcaacttatgaagagttttgaggagaaaaaagatgccatgcttagctcgctgtggaaaattaatgtggtcgatattgagtcaacactttcacgtgtctgccaagcagttctgagagataacacggtctccaaagatgtcctgaagctgcgagcgaaagcgttgaaaaagctcggaacgatattccaaggcgcaaaatctatgtaccgtcgtgaaacagcctgcgcgttgaaacgagccanatcagcagctactcgccactgagccatgacaccggtacagggatcgattgtgatttttgcgggttggcttgtaattgttgctgtacatacatcgaaa

SEQ ID NO: 62724 - DNA, 241 bp, Zea mays
  Clone ID: LIB3075-045-Q1-K1-G12
aaaagacggaaggaagcagagaacagagaatatcacattaagaacaggctcaaggaaaaaaaggatgccaagcagagcgcgggggggaaaataaaagcggccgacaacgaggcaacaccgagacgaggctggcaagcagcaaagagagacaacacggcgcgcaaagaggagcagaagctgcgagcaaaaaagtggaagaagcacgaaacgaaaatccaaggcgcaaaaaaaacgaaccgga

SEQ ID NO: 62725 - DNA, 400 bp, Zea mays
  Clone ID: LIB3075-045-Q1-K1-G2
cacgcgtcagagaaaaacagccgatctcctctcccactccgatcgccctaccgatcggcgcctcgtgaagcttccctgtgccctccccgccgcccgcgacgcccatggagccgccgcacaccgaggaggccgccgctgctgcagcaggaggagcagagggcggcagcgcaagcccgggcaccggcctcgaagggccgatgctgaggctggggctggacggcggcggggagggggaggacggggagctgggggctggggaggaggcggacacgtggcttccagagcggcctggcgaggcggactgtggctactacctccgcacgggcgcctgcggcttcggggagcgctgccgctacaaccacccccgcgatcgtggcggcactgaggtgagcgcgtctcg

SEQ ID NO: 62726 - DNA, 332 bp, Zea mays
  unsure at all n locations
  Clone ID: LIB3075-045-Q1-K1-G3
ccctcaaatgcggatgacatatgaggtgcttgcatcgaggagtgcaccaaagaaaataaagctcctggcgacaagaaaacatgcgaagtgttgtgcaccaagctcacaaaaaagcctatcgaagaaagcgaacatgattgatgaagtagaactccgataatatatacactagtggatcagtggtcatctttgtagccatgtctaccacacgaaggccttgattatattgncttattgctttggttttggcttccaatagtatcctaattccttgttcatgtaacctaatgtcactcaaagcattttatatgcctcacttaattaaataaata

SEQ ID NO: 62727 - DNA, 272 bp, Zea mays
  Clone ID: LIB3075-045-Q1-K1-G4
cggacgcgtggggatggcccaaaacaagatgattgtgatggatcacctcctttccaccatacgggaggcggcaagatcgagggggggtccagaaaaaccctcaaatgcggatgacataagaggtgctcgcatcgaggagtgcaccaaagaaaataaggctcctggcgacaagaagacatgcgaagtgtcgtgcaccaagctcacaaaaaagcctagcgaagaaggcaaacatgaatgatgaagcagaactccgataatatatacactagtgg

SEQ ID NO: 62728 - DNA, 377 bp, Zea mays
  Clone ID: LIB3075-045-Q1-K1-G5
ggcaggccaggatggagctgcaatcagtgattttggagtatgtcggcatcgtgcgctcgacggggcggctgaagcaggccgagtggaggatcggtgacctggagtcggagtgggaggagttcctgttccggcgggggtggaagccgaccacggtgggcgtcgaggtctgcgagatgcgcaacctcttctgctgcgccaagctcgtcgtcaggagcgcgctggccaggcgcgagagccgcggcctgcacttcaccgaggacttcccgtacctggaagagagcaggaggaagcctacggtcatctttccggccgccgtgcatgagctcacgtggagcttcaagccgttgcaaaggcagctgcaagcagatgacaatgca

SEQ ID NO: 62729 - DNA, 414 bp, Zea mays
  unsure at all n locations
  Clone ID: LIB3075-045-Q1-K1-F1
ctaaaacgcagtctgtaggcatgttcatcgacttatgcaatgctcactgccaatcangatctcaagacacgtggctagccgatgggtctcccacggttaacaagacgcaaattggcaaggcggtgggggactggtactacgatagggaggtccctcggcagattgattgcccgtatccctgcaacccaacttgcaagaaccgtgatgatgattgagcaattgtataagtagttcatgttatcgaaatgaaaacaataaaggatcacaacgcgcgcccgtagttgtagatgatgaattataaacacatatgactgagctcaaagttgtttaatcatcatctgttgcgaaatgaggaagacaattggtgtcttgaagctgtgttttcgactgtgtctaaagcgtaaatgtaacgta

SEQ ID NO: 62730 - DNA, 419 bp, Zea mays
  Clone ID: LIB3075-045-Q1-K1-D1
gctccgctacgcttctgtgctcgtagtgcagactgcgctgcgagcgatggcggcgcggaacgagttcagattcaagaagcaggctacgggagcagttacaattcaggctcgctacaggtgctatagggctcataagtaccacaagaagctgaaatgcgcagccattgttgcacagtgcacatggagaggaaggatcgcgaggaaagagctcaagaaactcaagatggaagcaagagaaacgggtgcgctcaaggaagcgaaggacaaactcgaaaagaaagtggaagagctcacatggcgcgtgcagttagagaaacgactaaggacagacctggaagaagcaaaagctcaagaggtgtcgaaactgcagaactctatggaagcattacaggctaaactggacgagacaaacacaaagc

SEQ ID NO: 62731 - DNA, 279 bp, Zea mays
  Clone ID: LIB3075-045-Q1-K1-D10
cgactacttactgtcgtggtactagcatattctgctggagcacggcgaccgcatactgtggggcgccacaaacgggttcggggcggctcccgtctaggactgcgtaaacgtggaccgcatccactggcactacggcagccggttccacgccccggagctcaccgcaggctactacaacacgctgtgccactaccggtacctcaccatcgagcgccttctggcgcgccagggcgcctgagctaacttcacctgcatagagatgcaggaccacgagctgcc

SEQ ID NO: 62732 - DNA, 334 bp, Zea mays
  unsure at all n locations
  Clone ID: LIB3075-045-Q1-K1-D12
ctcacacacctcccccctcctttttagggagagaaagcaacgaaacgccgagagaggcgtgcgagcgggagcaaggagatggagcgggcggcgccggtgaggagctcccacacctccacggccgacctactcgcgtggccgcagccccagggccccgccccagcaacgccgtcgccgccgcgccggcccggtcagccgtcggaggctatcangaaggtggtgttcgggggtcaggtcaccgaggaggaggccgacagcctcaccaagaggaagccgtgctccgcgcccatgtggaaggagatgactgggagcggcattttcgcttgccgggagc

SEQ ID NO: 62733 - DNA, 275 bp, Zea mays
  Clone ID: LIB3075-045-Q1-K1-D3
caactatagtagtgattggctcgatgcccatgcgacatggtatggtaagccaacatgtgccagcccggacgacaattggggcggatgtgagtacaaagacgtgaacaaaggcccttttaacaacatgggcgcatgtaggaaccgccccatcttcaaggatggtctaggttgtggatcctgattcgagatcaagtgctacaagccagccaagtgctctggcaatcccctagtggtgtacatttcaaacatgaactacgagcccattgtggcgtacc

SEQ ID NO: 62734 - DNA, 434 bp, Zea mays
  Clone ID: LIB3075-045-Q1-K1-D4
tttctaatttgttgggggatactaggcgtatgaactagtatctatgcagtgggaactatatcagacagttattcaaaaatgtgcctgaacaccaatagtacgttggagaacgttgcttcgaccaggattactatcttcgatctgaaactctgataagcagaattgaagacaaacgatcgggtacttggggaatatggaatttatttactgttggtttacctagtacttgcctaccagccaggcgccccaggggacgacggcaaagatacagtctcgggtattaggatggcaaaggcagcgatagataaattctactccaagtatatgttgggatcacgtaagctggtgcttgacccacattcaacgatctttggcaaaaggatgcttgtcaaaagtgcgatcatgtgctattccaataacacaagatagatcag

SEQ ID NO: 62735 - DNA, 282 bp, Zea mays
  Clone ID: LIB3075-045-Q1-K1-D5
aggtgcctgatacgaacgcggtcctatactttgtgtacgtgaaggcctatacgtgcaaggagttcgaaaccgtgggccgaccccagacgaacgtggccttaatcggcgacggcgccgattagaccatcatcacggggaacatgaacttcaagatgaacctgaccaccaaggacaccgtcaccattctggcgatcggttactgcttgtttatgcaggacatgcctatggagaacacggcggaggccgagaaccaccagatcctggctctgcttttacaaagcg

SEQ ID NO: 62736 - DNA, 109 bp, Zea mays
  Clone ID: LIB3075-045-Q1-K1-D7
gtgatgctttggttggggctactaagcctttttactagtatctatcctggggcaactatggctcccaagaataaaaacatgggggttaacaccaaaagtactttggata

SEQ ID NO: 62737 - DNA, 418 bp, Zea mays
  Clone ID: LIB3075-045-Q1-K1-D9
ccaaaccgacgatggcgtcgaataagacggtcctcatcgtcgcggcgatgcttctcatcaggctcgtgctggaggccggccgggcggcgaccgccatggactgcaaggccgggtgtgacgaggtcacgggcccactccacatgagcatggaggactgcatgaagaggtgcaaggagatcgctgctaagcaggggcctagggacccttacaaggataacaaacttgacatcccatgaactaattaatgctcctatatcatctgcctatccatgcatgcattgcattgcgtatgcacactgtgcgtgcctgcccacaaagttcgacaacacaccgatctcgacggatttgtaatcgtgtccactccatcgagagatcgatcgatgcttgttattatacttgtattccacattatatataa

SEQ ID NO: 62738 - DNA, 186 bp, Zea mays
  unsure at all n locations
  Clone ID: LIB3075-045-Q1-K1-E1
cggacgcgtgggataaaaaaaaaaaaatnnaatttataaaaaaaaaaaataaaaataaaacaaggggggtttttttaattgtctttggggtttcaanttttctttcccaatcatattgggtttataacttttaaataccaacccctactttccttttcctgccccttttttttcttcttttggcct

SEQ ID NO: 62739 - DNA, 431 bp, Zea mays
  unsure at all n locations
  Clone ID: LIB3075-045-Q1-K1-E10
cccacgcgtccgcccacgcgtccgcccacgcgtccgcatttgccaagattgctcctgcatgccctgccatggcacaccccatcaccgtccgtaacctgttcgacgcgatcaccaactccaccggaggacggctgcatttccttatctaccacaagtatctcagaatcctgaacgaggcgttctgctctgcgaagcgtgtgctaggggggcacagagcccctgccctccagctctccgacgacgaagtgatccttgacatccacggcgctgcgacgaccaagccagttctccagcacatcggcacatccacatggcctgngaggctcacgctgacgaaccacgcgctctacttcgaggctatcggcgtcgatttctcgtatggagaggccgtcgtgtatgatctggcaagggacttgaaacagtcggtgaaa

SEQ ID NO: 62740 - DNA, 356 bp, Zea mays
  Clone ID: LIB3075-045-Q1-K1-E11
gaaacacgtctggcaccccttccatccatttctgcagcacatccgggcagcctaacgaatgggtttcgcgccacagctgcggtcctattctacatcctcgccgtcgctgccctcaccgcggccgaagcactggctgagtcaccgtatacaggcagtactgccaagtaaccggccgagtcacctaaggcaggcagtgctgctgctcctgccaaggcacccgagtctgctgccacgagaactgcccctgataaggcacctcaagccggctccacgccctgcgatgccgctgcctaatcgtaatcgacgagtaggaagtttggaccagttgccgagccgaccaccggcgtctatacacc

SEQ ID NO: 62741 - DNA, 379 bp, Zea mays
  unsure at all n locations
  Clone ID: LIB3075-045-Q1-K1-E12
gaagaagatcgcctgcgccgtcctcatcgtcgcctcggccaccgtggcgctggccgcggaggcgccggctccgtctccgaccagcggctcctccgcggtcgcacccgccatcgtcggggccgccgtggcctccttcttcgcgtactacattcactgagccgncggacgaggagcccggagccggaaggaagagaccaaggtggggggagagacttggctgggctgcgctgttctgctgctcccgcgcattcccgatgcgtgggcgtgctctgattgggcacgggcgtggcagtggcacaccttcgnctnccttttggttgttttttttacctcctctttctacttgattttcaattaacgaattggtatcgctgatgca

SEQ ID NO: 62742 - DNA, 227 bp, Zea mays
  Clone ID: LIB3075-045-Q1-K1-E3
caacgccatttagcacctacggcgaggtcctctagtccaaaatcatcctccatcgggagacgcacaggtcccgcggctttcgcttcgtcaccttctccacggaggaggcgatgcggaacgccatcgagggcatgaacagcaaggagctggacgggcggaacatcaccgtcaacgaggcccaatcccgctgctgccgtggaggcggcagctgtggcgggtacagtggt

SEQ ID NO: 62743 - DNA, 334 bp, Zea mays
  Clone ID: LIB3075-045-Q1-K1-E4
gtcttgcctcgtgaggctctaccacgacgttgttatcatatctgtcgtggacatcatatagcatggaggcgttaaaacatgttgggcgacaaaagaagtccctagcggaacctggacactacacgccatagtctcgctcaacttccccctttgaatgcccattgttgtcaaatatggtgcctactccatcaccaacgacctcattacagcgtagttccaagttggaaccacttataaaacaaaactcatcatggaagtagcttctgatgaagaaccatgttttacaagacctcatgtggcgcacgatatagcatgacactatttttttttggca

SEQ ID NO: 62744 - DNA, 328 bp, Zea mays
  Clone ID: LIB3075-045-Q1-K1-E5
gaaggtcattcaagagaagaacgttcttgaggttcatgttgagaaggggatgcaacacaaccagaagatcaccttccctggtgaagctgatgaagcgcctgatactgtcactggagacattgtattcgtcctccagcagaaggatcactccaaattcaaaagaaagggtgaagatctcttctatgagcacaccttgtctctgaccgaagcactttgtgggttccaatttgttcttacacatctggacaacaggcaacttctcatcaaatcagaccctggtgaagttgttaaacctgaccaattcaaggcgattaacgatgaggggatg

SEQ ID NO: 62745 - DNA, 97 bp, Zea mays
  Clone ID: LIB3075-045-Q1-K1-E6
ccttggcgacccatttaaacccttgtccaagggcggcattgtccagaacagctagttcaacagcgggctgatgggctggtcgacacaccggaacgtc

SEQ ID NO: 62746 - DNA, 414 bp, Zea mays
  Clone ID: LIB3075-045-Q1-K1-E7
gagagagagagtcccgaagcgagcacaagatgccaccgcacatcggccaggcggcgagcgagacaccttcacacgtctctgggccttcccctccccttgcgctccctctgtagctgggcccgaccgaacccccctaccccctggaatcatcctccgatgcggcgccgataggggctggcggatgagcggaatggcggggcacggcgagaagcggcgccatacgggaagggcccacaaaaagcccgacgaagaggatgaagaccgcatttcggatctgccggacgtactgcgcctgcacattctgagactgctgtcgctcaaatcggtcatgcagaccggtgcgctcttctcgcggtggcgccgcatctgggcgtaccgatggccggagccctactcggtgaccattcgccttcc

SEQ ID NO: 62747 - DNA, 418 bp, Zea mays
  Clone ID: LIB3075-045-Q1-K1-E8
cgaagagctagcgcgcgatggccaacaaccttctccgtccgctcgcgctcctcctggccgggctcggctgcgcgctgtgtccgcgcgccgatgccaccgcgttcgaggtcggcggcgacgacgggtgggtcgtgccgccggccagcgacggcggcaggtacaaccagtgggcatccaagaaccgcttcctcgtcggcgacgtcgtccacttcaagtacagcgaggactcggtgctggtggtgacggaggccgactacgacagctgccgcgcgtcgcaccccgtcttcttctccaacaacggagacacggaggtgacgctggaccgcccgggccccgtctacttcatcaagggcgagaccggccactgcgagcgcggccagcggatggtcgtcagggtcgccggccagggcgcaccccc

SEQ ID NO: 62748 - DNA, 302 bp, Zea mays
  Clone ID: LIB3075-045-Q1-K1-E9
cccacgcgtccggacctgcccaagaccagcgacaaggacgacgtcgtcaacttcagcctcgacttcgagaagctgcagcgcgtcacgctcgacctcatcaccgaggcgtccggcaccatgtccgcaggcatcgccctgccaccctccaacgccggagcgccctcctacggcgcggcggcgccttccgggggctccgccgatgcccccgccggcgcctccgagggccctgcgagcgccagcggcccgtctggtgacgacgcgccggcgtccggtgctggtgccagcgcgtcggctgctgatgc

SEQ ID NO: 62749 - DNA, 364 bp, Zea mays
  Clone ID: LIB3075-045-Q1-K1-C9
cgagaaggagtacaagtctgacattaacattttctccaatgctagctgcacaaccaactggcttgctcctcttgctaagggcatcaatgacaagttcggtatcgttgagggtctgatgaccactgtccatgccatcactgctacccagaagactgttgatgggccctcgtctaaggactggaggggtggaagggctgctagtttcaacatcattcccagcagcactggagctgctaaggctgttggcaaagtgcttcctgtccttaacggaaagttgactggaatgtctttccgtgtcccaacccgcgatgcttctgttgttgatttgactgtaaggcttgagaagtcaccaacctatgatgag

SEQ ID NO: 62750 - DNA, 330 bp, Zea mays
  Clone ID: LIB3075-045-Q1-K1-B1
caagggctgtggctcatgctacgaggtgagatgcaaggaaaaacctgagtgctcgggcaatcctgtcacggtgttcatcacagacatgaactacgagcctatcgctccctaccacttcgacttgagcggcaaggccttcggctccctggcaaagcccgggctcaacgacaagcttcgccactgcggcatcatggacgtcgagttcagaagggtgcggtgcaagtaccccgctgggcagaagatcgtgttccacatcgagaagggctgcaaccccaactacctggccgtgctggtgaagtttgtggcggacgatggcgacatcgtgctgat

SEQ ID NO: 62751 - DNA, 317 bp, Zea mays
  Clone ID: LIB3075-045-Q1-K1-B11
catatccaattaccaccctgagcactggcagtcatcatggagtgtgcgcacagcgttggtggccttgattgcattcatgccaaccaaccctggtggggcattgggctcattggattacaaaaaggaagatagacgggcacttggtataaaatcacgtgaagcaccgccaaaatttgggtccccagaacgacaaaaactaattgatgagatccatgagcaaatgctcagtaaggctccttctgtcccccaaacgctaccaaatgtgccaaacgaggagtctaacgaattacccgcatctgacccttctggcgagcatg

SEQ ID NO: 62752 - DNA, 405 bp, Zea mays
  Clone ID: LIB3075-045-Q1-K1-B12
acggcggccatcgagatactgcagcagttcgactgggaggtgcccgactgggtgatcgtgccgggaggcaacctggggaacatatacgccttctacaaggggttcgagatgtgccgtgtcctcgggctcgtggaccgcgtgccgcgcctcgtctgcgcgcaggcggccaacgcgaacccgctctacggctactacaagacaggctggaccgagttccagccgcaggtggccaggccgacgttcgcgtcagcgatccagatcggcgacccggtgtccgtcgaccgggccgtggtcgcgctcaaggcgacggacggcattgtcgaggaagcgacggaggaagagctcatgaacgcgatgtcgctcgccgaccgcacggggatgttcgcctgcccgcacaccggggtc

SEQ ID NO: 62753 - DNA, 97 bp, Zea mays
  unsure at all n locations
  Clone ID: LIB3075-045-Q1-K1-B2
attcatagcagaccagtagtactagtttnntttttttcgttaaagcaggtgcctgtgccttatgggggtaccacttgcctttcagggggggcctgcc

SEQ ID NO: 62754 - DNA, 269 bp, Zea mays
  Clone ID: LIB3075-045-Q1-K1-B3
aagcagcattggatgcaaacatatatgacactcaacctggagggcgaaagacagttggaaataatttgattgtgaaagatcaagtcaatgatccattgactgaaaagatcgctgaacttagagaacccacatttccattggatgatggaaaagatttgcagcgtaatgctagtcatgagttaccacaacatctcgaagacaatgatgttgccaaaaaagaaatcataccattacaatctctgctccctttaccagtacccaaatcacct

SEQ ID NO: 62755 - DNA, 432 bp, Zea mays
  Clone ID: LIB3075-045-Q1-K1-B4
cggacgcgtgggctctcccgtccggcactttcttcgatcgactagcctgcggcggcgccggcgccggcgaccagcggccatgcgggtggcacccagggtgctcttcctcgtccgcgacgccgcgggctacggcgctgccctcgccgacgcgctccgcccgccgcccgggctaacgagggagtcctcgcccttcgagctcccccttggaaagtacggcctcgacggagagaaggcgtgcgccgagctcctgagcttttccgattccagtggctctccacaggtgaccatttttgttctgccagactataagccacctcttgcagcgtgtgttgtaaatggggtcttggaactgatttcttctgaagctacctccactgagcgaactctaattgtcccatacatcacaagatcgtcaagctatcatcatggaac

SEQ ID NO: 62756 - DNA, 420 bp, Zea mays
  Clone ID: LIB3075-045-Q1-K1-B6
gacttactcgaggccatcatagataagacatttgaagatgctgatgcggataaggatggaaaaataaataaagaggagtggaaggaatttgcgttacgccaccctaacctgttaaagaatatgacactgccttatctgagggacatcacaaccgtcttccctagtttcgtcttcaacacggcggtggaagattagtcgctccaattgaaggcaataaagcagtactggggattgcttgaggtgcacaaggttcctgaaacctgacggctgttggtcgccttcaaccactgagaatccgatgtgttctgagcatcaaggcagccgccacctgaccatcactcctgctataaattataatataaattataaggctcatccggggtggcagatcggcagcgggaacttacctgatataatttc

SEQ ID NO: 62757 - DNA, 276 bp, Zea mays
  Clone ID: LIB3075-045-Q1-K1-B7
catccgcgtgctgatcacggtcatgaacacgttcaagcgcatgctcatgcgcatcctcgagaacttcccagacaaggtgcgcgccgaggtccacttcaacgcgacgctcaaccaccacatcatggaccacatcatcgtcctcgccgacatcatccgcttcaagacctgcttcctgatctagctgcatatgatgctatacgggacgccatgcgcctgggcgttcacctgtggactcatcgacaccatcatcgacagcaagatcggattccacatcgg

SEQ ID NO: 62758 - DNA, 244 bp, Zea mays
  Clone ID: LIB3075-045-Q1-K1-B8
ctcatccgcatacgttgcgatggtggtgtcttttgctggaaaggcggtagcggtgcagaaggcgctctcagacaagcaaaccgggtcagacctgctgcctgttgagatggctgtgctgcaagatggagaattcacctggttcactgataaagcagcggtgtccttgcttgagaacaagtagagtcccatggtaaccttggctcgaagccattttatctcataaaataaaagatccaggggcctg

SEQ ID NO: 62759 - DNA, 159 bp, Zea mays
  Clone ID: LIB3075-045-Q1-K1-B9
caaatgcgaagacggtctcatcgacgtttttcttagctctacggtgatcaccatccttaagggccacttaaacaaccacagcggcgtcattctctttggcgccaaccactcctggccgcaagatcagaacattcacttcatcgctgatttcaaccactt

SEQ ID NO: 62760 - DNA, 421 bp, Zea mays
  Clone ID: LIB3075-045-Q1-K1-C1
cggacgcgtgggaagaaagccaaagaaggggggcagcattcatgggccagaagcgctggcgttcgagggacctagccggcagtctatcgaggcaccgaaaacgaacaactgggacaacgtctggggaaactgagatcatgcctatgggtgcaacgagttgaatcatatagaagaagtgcaagggctatgacctatgggagcttgcttgccttttgattcatcaaaaagaagattgcggccagataccgcctttggtggcaacttatgggaagctgtgaagaagaaactgctgggcctctcttgcttttcgcagctttgctttgatgtacctgcgagggccatggcccatgacagtggtaggtttttctttaatcgcaactgtaagggttggtgaagaacggttttacagtgcactgatata

SEQ ID NO: 62761 - DNA, 416 bp, Zea mays
  Clone ID: LIB3075-045-Q1-K1-C10
ctttgatggacatcagcctggatacatttccctatgctggtactacgactacatgtgaatcgttatacatgggggttccatgtgttacaatggctggtgctgttcatgctcataacgttggtgtcagcttgctcagcaaagtcgggttggggaggctggttgccaaaactgaggatgagtatgtgagcatagcgttggatttggcatcagatgtgaatgccttgcaagaactgaggatgaccctgagggagctgatgatgaagtcgcccgtctgcgagggagagagattcacccggggcctggaagctgcatacatggacatgtggcgcacgtattgtgacggagacgtaccatctctcaagcgcttagcactgttagaggaacatcctgttgccaatgagccagactcggacaaa

SEQ ID NO: 62762 - DNA, 432 bp, Zea mays
  Clone ID: LIB3075-045-Q1-K1-C11
cgaaggttcttcagagtacaatatatgaagttgaccttgatcgaattcttcagagcatccatatttatttacaagaacttgggatggaagaaatacggagaagggctggtgctgatgacaagccattgataatggtcaaaactgtcttgcatgaacttgtgaagcttcggtgaacggcaataaagggtcacctttcaatggttcctataaatgctgaacgctcagcaataattctagcatacattgatctcaatctccaaacccttgcagccgctagaatgttgacgccatcggggcctatgggtcaaactcactggggtgatgctgcatcgaacaatccaaatccatctactcactcagctgacgcgcaattgaagcaagagcttgctgccattttcaagaaaattggtgacaagcaaacatgtaccattg

SEQ ID NO: 62763 - DNA, 394 bp, Zea mays
  Clone ID: LIB3075-045-Q1-K1-C12
ggcaaacggcgcgctggtccgcgtcctgtttctcaccagcgtgaccaagtatctcaacttgaaggctgttgacgggagctgtgtgtacaacaatggctacatccacaaagtcccggcaaccgacgtggaggccctcaagtcgaacctgatgggcctgttcgagaagcggctcgcccagaagttcttcatatacgtgcaggactacgaggaggacgaccccaagtaccacgagggcctggacctcaacatggtcaccaccagggaagtcatctccaaatacagattggaagatgatacggtggactttatcgggcattcgctagcacttcaccgagaccacaactaccttgacgagcctgctatcgaccactgtcaagaggatgaagctctatgc

SEQ ID NO: 62764 - DNA, 400 bp, Zea mays
  Clone ID: LIB3075-045-Q1-K1-C2
attcgaatttgtagagcgtgattatgctgcacatcttgatttaacagctaaagtctatggtcttcataaagcagaacagactattgagaaaattcctgcatcttgtaggggtgagattgtgtatagaacacttttggccaattgtgtttctgcatccaatataaaaaaatcggagcacgtttttaataggatgaaggatcttggatttccggttacacaattttctttcaatcagcttctgttactctacaaaaggctggacaggaagaagattgctgatgttcttgcaatgatggaaaaggaggatgtgaaaccatctctctttacttacaagattcttgtagatgccaaaggttcaggtggagatatagaagctatggagaaagtgattgaatcaatg

SEQ ID NO: 62765 - DNA, 421 bp, Zea mays
  unsure at all n locations
  Clone ID: LIB3075-045-Q1-K1-C5
cggacgcgtgggccgggactgggggttcgcgggggactacgtcgagggcaatgtggctcatgctgcagcangaacagccgggggagtacgtcgtcgccactgaggagtcccacaccgtcgaggagttcctgcaggctgccttcggctacgccggcctcagctggaaggatcacgtggtcattgacaagaagtacttccggcctgcagaagtcgacagcctcaagggggacgccaccaaggcgaggaaggtgctcaagtggaagcccaaggttgggttccaggagctcgtggagatgatggtcgatcacgacattgagctcgccaagaaggagaaggtcctggtggatgctgggtaccgtgatcccaagcaacagccatagaaacatcacagttgcttcttgctctgntggggctcggattc

SEQ ID NO: 62766 - DNA, 242 bp, Zea mays
  Clone ID: LIB3075-045-Q1-K1-C6
cagggagaagatgacccacatcatgttcgagaccttaacacccccgctatgtacgtcccatccaggccgtgctctctctgtatgcccagggccgtaccacaggtatcgtgctcgactcgggagatggggtgagccacaccgtccccatctacgagggatacgccctcccccacgccatccttcgtcttgacctggccggtcgccgacctcaaccgactatcctgatgaaagaatcctggact

SEQ ID NO: 62767 - DNA, 344 bp, Zea mays
  Clone ID: LIB3075-045-Q1-K1-C8
aaaaaaaccagcagctagcgatggctggagcccgggcactgctcatcgtcctcgcggctggcgtcgcggtcctggccgcgcgggcggcgtctgcaggcgggggagccgcggcggtggcggagatctgcatgaagactccgtcccccgacctgtgcaccaagacgggggggaagcacgccaacaagtacaagggggtggacgcggggacggtgctagagatgcaggtggacgcgttcaagaaacgcgtgaaggcggcgcggaggcttgccaaggaagaggtcaagacggccgcgacgcccgaggcgcggagggcgctgaacctctgaagaactactacctggacg

SEQ ID NO: 62768 - DNA, 368 bp, Zea mays
  Clone ID: LIB3075-045-Q1-K1-A8
gcctatagaagcaatcaggcgagcggcggatgtggcgcgatgggagagcacgtcgtgacggagcgtatccagcggaagctggaggaggccaacgctaccgtccaacagcacctcgccggcatccaggaccacgtcaacttcaccatgcagcaagcatacttcaagtgcgcatatgattgcttcgatcggcgccgtactcacgaagcgatcaacaattgtgtggagaattgtggtatgcctgtccttgctgtcaacaatgtttttgagagtgagatggccaagtttcaggaacggttgaaccggtcattgatggtctgtcaagataagcttgaagctgccaagctccaaaagatgaaaacagatgcaac

SEQ ID NO: 62769 - DNA, 394 bp, Zea mays
  unsure at all n locations
  Clone ID: LIB3075-006-Q1-K1-E6
caagcccagctgggaagcacaaaacacctctggtagagatggtcaggcaggaaagggtgatgcagacaactcctggagtaagaacagatcatcttcatctagcgcttggggcgctcccagtggaggagctggcggccgaggttcttggggaaagagcaacgaggatggctggaactcagcgggaggatcagccaaagagaagcctgcatggggtggtgggtcagaagcgtctaccaagaaagaggacaaaggtggtgaggggaacgggagccaaggaggacgtggtgtcagttcctgcgataaaggggcagatgatgcatggaacggcaacacgggtagtgatattgngagtggtggatggtaagattttcgccaaaataatatgaactctgtc

SEQ ID NO: 62770 - DNA, 390 bp, Zea mays
  Clone ID: LIB3075-006-Q1-K1-E7
gtgcgagcatatccacggcgatggaggcgagagcggccatgagctggtactgcggctcccttctggccgtggccatcgcgctgttcctgtccgtgtccctcggcgtgcgcgccgccggcgccggcgccggcgtcgacatcaaggtgtcgtgtgcagcgacgccggacccggacgtgtgcctacgcgcgctccaggcggacagcgactccaagaccccgcgggacctggcggaggcggcgctccgcgcggcgacgaccgcgggcggcgcggcgggcgactacgcgcggcacgagatggacgtggtgaaggacaacgacatgtggcagtgcctgaacgagtgcgccggggagatcgaggaggcgcttggaccacctggacgacaccgagggc

SEQ ID NO: 62771 - DNA, 465 bp, Zea mays
  Clone ID: LIB3075-006-Q1-K1-E8
ctcttcacaggtccacttccttggagttgaactcaagcaatagaataggtcaaggggccgaaattactcttgagaggagcttgactaccacttcagctagcagcaggtcaaatagaagcaagattgacaaggagcctgcagtcagtagaaacaagcagaacaatagggttgcaattttcagagatcgtgagtcagagcgcaaggatcctgattatgacagaagctatgacaggtatatgcaaagatttgatcctggatttggatttagtggcggcccatacacaattcaacccctctatacccctgctgttaactacaacactgaattcccccagcttgcgtcagcacaccgatcacctgttgctgtcgaacagcaacctcgtccaatagctcagcacatgcctgcatcatggtcggtggctcaagcatctaatgcaattggctatgggccaaatggtgtcatgg

SEQ ID NO: 62772 - DNA, 349 bp, Zea mays
  unsure at all n locations
  Clone ID: LIB3075-006-Q1-K1-E9
atcgcgcgcaggagcggatcgccgccgcaggagagcgttccgagtccgaatacgtacgggatggtggaggcgccggccggtctgagcgcggcggcgcaggtgagcgcgctgccgctgcaggtggatctcctgcagctgccgccggaggtgcccgcgccaggggatcccgccctgcgcggcgtcctcgacagcctcttcgcgcattggctctcgctaccgaacaccgncgtgctgctcgccagcctcgtgcacaaggccaaggccagcggcggcggcgccgtggcggntgtggctgggatgctgccctccatgttgctgcaggggggaaccggcgtgccggctattttcc

SEQ ID NO: 62773 - DNA, 291 bp, Zea mays
  Clone ID: LIB3075-006-Q1-K1-F1
ccctcggtgccctccctctcggcggcggcggctcaagtccccttcatctccggcgcggcaaatggcaggcggcagggttgcacatgctaccctcaagggccccagcgtggtgaaggagatcttcattggactgaccctgggtctgatcgctggaggtatgtggaagatgcaccactggaacgagcagaggaaaactacatccttctacgacatgcttgacaagggccagatcagcgtcagcttacatgagtatttgcgacatgtcatctcagatgatgaacattatccaga

SEQ ID NO: 62774 - DNA, 327 bp, Zea mays
  Clone ID: LIB3075-006-Q1-K1-F10
atccggcacaaggacgggcgcacggtcgacaacagcgccgagaggcagaaggtctcccggtgcctcgtggccgcggtggagcggagggccactcatggcgtcagggtggaggtgcgcgccgccgaccggtcgggcttgctatcggatttcaccagggtgctgcgggagcacggcctgtcgctgctgagagttgagctcaagaggcacaaggacgaggccttcggcatattttacctcgtcacggacaccggaggcgaggtgcgcgctgagtcgttgcgcgccgtgcaggcgagggtcgccgagatggatatctcgctcgacgttgtg

SEQ ID NO: 62775 - DNA, 416 bp, Zea mays
  Clone ID: LIB3075-006-Q1-K1-F11
cggacgcgtgggtcacgacaagatggcgtgcacaaacaatgcgatgagagccttgttcctcctggtcctgttctgcatcgtgcatggtgagaaggaagagtcaaagggcatctatgcgaaagcgtccgggcctggtgggtccttcgacatcaccaagttgggcgccttcggcaatggcaagacagacagcacgaaggctgtacacgaggcatgggcatctgcgtgcggcggcactgggaagcagacaatcctcatacccaagggtgacttccttgtcggacaactcaacttcacaggcccttgcaagggcgacgtgaccatccaggtggatggcaatctgctggcgaccacggacctaaaccagtacaaggaccatggtaattggatcgagattctacgtgtggataacctggtca

SEQ ID NO: 62776 - DNA, 282 bp, Zea mays
  unsure at all n locations
  Clone ID: LIB3075-006-Q1-K1-F12
cgcgtccggagcggcatttcttataacacaggtgttcgcgttgatgggatacctcgctaataacaggatggggttgggcgccgtccttgcggcgctcgtcgaccgcgggtcgtgcgggcccccgaatgtgccacccggtcccaacatcaccaccaactacaacggcaagtggctcaccgctagggccacctgntacggtcagcccaacggtgccggcgctcctgacaactgcagtgcgtgcgggatcaagaacgtgaacctgtcaccctacagcggcatgac

SEQ ID NO: 62777 - DNA, 416 bp, Zea mays
  unsure at all n locations
  Clone ID: LIB3075-006-Q1-K1-F2
ggagagcacttggcattagagctcaataattcggttcttttcttctgcaaggcaaaaatgatggaagatgctctttgcacttataagtgtatgagagagcaaaatatcggacccacatctcatactttttgtcatatgttgtgtggttattcttcaatggacatgcttagggagatcaccatgctgtggggagaaataaagcgcagacatgaatatggagagctagatttgaatagggacttgcttgatagcttggttntgaattttcttaaaggtggatatttttcgagggtgatggagatcattagttacatgtcaaaacataacatttactgtgacaaggggaaatacaggcgtgcctttctgaagctacacaagaacctgtataagaatttgaattcattgcatgacaaaac

SEQ ID NO: 62778 - DNA, 285 bp, Zea mays
  Clone ID: LIB3075-006-Q1-K1-F3
ccacgcgtacggagcctaaatagtcggcatttacattgttgtttcattatgaggtcgcttagttaatgagtttgatgaggcctgcaagaatgcaactggggtcaacatcaaaatggtgtgcctcaacaaaaggcctggatattatgcatatatatacagcgacccaacaaagatcaacaaggagctcaactggacagctcagtgtaccgatctcaatgcgcgcctatctttcgcatggttgtagcaaatgtcgcattcgtggtgctatgggccaaactcaatata

SEQ ID NO: 62779 - DNA, 400 bp, Zea mays
  unsure at all n locations
  Clone ID: LIB3075-006-Q1-K1-F4
cggacgcgtgggtgaaggaactggagactgatgatgtacctctgcacactattgaagtgatacatgcatattggcaagacaagaggcagaaaaggggaatgccacttattcgacattttcagtcggctatgtggaagatctacgagcagcagctgcatgaatgggaatcaaaagtatgcagaatgcagagttcgtcaaatgggtaccaagaaaagaaattgcctcccaagcctgcattgtttgccttctgtttgaggcctcgtggactccatgtaccatacaaggggccaaagcagcgttctcataagaagcttatgtccacaggctgccatagcttttcaagagagcatgatggcttttaccggcaagtatcaagcangagatacaatgaatgcactgg

SEQ ID NO: 62780 - DNA, 413 bp, Zea mays
  Clone ID: LIB3075-006-Q1-K1-F5
gcggccttcttaccgtcgcgttcaaattatcctcacaccccgcagcatctccacgccgtggcacgtcgtcgcgtcgcgtcgtctccgccgagaagatggtcggaccaggcctctacaccgagatcggcaagaagaccagggatctgctgtacaaggactaccagacagaccacaagttcaccctcactacctacagctccaatggcgttgctgtcactgctactagcacaaagaaagctgacctgatcttcagtgagatccattcacagataaagaacaagaacatgaccgtagatgtgaaagcaaactcagagtcaaatatcattactacagttactgtcaatgagattgcaacaccaggactgaagactatcttaaagctttgctgttctgatcagagatctggaaagttg

SEQ ID NO: 62781 - DNA, 242 bp, Zea mays
  Clone ID: LIB3075-006-Q1-K1-F6
cagaaaggaaagaaaccaggtttccttcaattgttgggtacacagacagtcagtgccatgtggcatggactatatcctggatatatcatattctttgttcaatcagcattgatgataaatggttcacgagttatataccgatggcagcaagcatcgagcagttcattcctgagccggatcctggcctttctaaaatgtgcttatacattggtggtgcttaactacttctgcattgggttcca

SEQ ID NO: 62782 - DNA, 431 bp, Zea mays
  Clone ID: LIB3075-006-Q1-K1-F7
cttggtaaaagaatagggcagttaaatgatgaaccgaatggttatgaagacgatgttctagaagacgatgagatatctcctagaaagccagaagctaaggctgtgtatgttaaagatgacttctttgattcactctcttgcaacccaattgacaatggagggaggaacggaagagtgaaattctctgagcagaggaaaatagacaccgagacctttggtgactcagcaaggcatcgaccaatgggcatccgaggtagggccccccgtggcggcgctcgtggtcgtggctattatggtattagaggatatggatatacgggtagggggcgtggctactcttacccaaatcaccagccgtgatacctcggtgtctggaagcacactgaatggcaatggtaaattggcaaattgcgtggtaaactgagattatc

SEQ ID NO: 62783 - DNA, 401 bp, Zea mays
  Clone ID: LIB3075-006-Q1-K1-F9
cgacaagatggcatgcacaaacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggcgacttccttgtcggacaactcaacttcacaggcccttgcaagggcgacgtgaccattcaggtggatggcaatctgctggcgaccacggacctaagccagtacaaggaccatggtaattggatcgagattctacgcgtggataacctggtca

SEQ ID NO: 62784 - DNA, 342 bp, Zea mays
  Clone ID: LIB3075-006-Q1-K1-G10
gcgatccaggtggagtgggccgagaagcggccgcctgatcgagccgaaccaacggccgacgcggcgcacgccatggtagcagctggcaatccaccttcaaaaccgtgggaacgtgcaggaaattcatctggcccagtgccttttaagccggcctctggtggtagcaccagtgatgttgttgaagcttctgggacagcaaaacatggagaagctgtatatgcttctggaaacaatgttgccttcaatgtgaacagcacaatttcaatgcctgtgcccccaaggccttggcagcagcaaggctatgaaaactcttatgggggttatggctccagtatgtatagc

SEQ ID NO: 62785 - DNA, 395 bp, Zea mays
  Clone ID: LIB3075-006-Q1-K1-G11
cactcgtagagagaaggaaaaatatccccaaaccctagctcccgatctcgatggcgaaccctcgcgtctgcttcgacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagttccccgacgagaagttcgtgcgcaagcacaccgtccccggtgtgctctccatggccaacgccgggcccaacaccaac

SEQ ID NO: 62786 - DNA, 388 bp, Zea mays
  Clone ID: LIB3075-006-Q1-K1-E4
cgtcgttctctcttcctggtccaagtgatcttgccaagttacgagcagcgagcagagatcagagcatccatcggcaatgtcgaacatcgggcagtccttccaggccggcaaggctgaggcccagggcgagtaccaggcggagcacgcggcgcagtgcgtcaaggacaccgccgcagccgcggccgacagtgcgcagctgcagcagcaccgccccaccggcaccgttgagcaggtggcgcagacgggccagggcgtggcggcaggcgtcaaggacacggtggcgggcgcggcggttggcgtcacgaacacggtggcgggcgtggcggcgggcgtcacgaacacggtcacgggcgccgtggcgggcgtcacgaacacggtgaccggcgcg

SEQ ID NO: 62787 - DNA, 327 bp, Zea mays
  Clone ID: LIB3075-006-Q1-K1-C8
gatccggagcagccgtagtcccaccgaccccgtcgccggtcgccctccatctcctcgccgctggctctccatctttgtacagcttctcttttcaataatcaagatgagccgtggtggtagtgccggtggtggtcaaagatctctgggttatctctttggaagcggtgagccccccaaaccagcagtggcaccagctgcaagtgctccacctgttgagaaaccatctgctgcaaagactgatgcggccaagcaggttgctgctgtggttaccagccaaaccaataactaccacatggctgatggtcataacactggcaacttacttac

SEQ ID NO: 62788 - DNA, 460 bp, Zea mays
  Clone ID: LIB3075-006-Q1-K1-C9
catcaaagaaacaagcgcacaagatcaaatacctcgccgccaacaatggcctccaggtcctccatcctgctcgccatggtgatgctggctgcgctattcgttgttggtttgtgcaccacccccctcaccttccaggtcggcaagggatccaagcctggccacctgatcctcacccccaatgttgccaccatatccgacgtggagatcaaagagcacggtggcgatgacttctcctttacgctcaaggagggcccgactggcacctggacgctcgacaccaaggccccgctcaagtaccccctttgcatccgctttgctgtcaagtccggcggctaccgcatcgccgacgacgtcatccctgccgatttcaaggccgacaccacctataagaccacactcagcatctaatcaatctctggtgatgaattaaatttcaaaagagctcatctagcgcacatgt

SEQ ID NO: 62789 - DNA, 71 bp, Zea mays
  Clone ID: LIB3075-006-Q1-K1-D1
atttggatagtcaatagtggtggcgttatttgtacatgaaggaataaagacattagaacaaaggttttttt

SEQ ID NO: 62790 - DNA, 344 bp, Zea mays
  Clone ID: LIB3075-006-Q1-K1-D10
cggacgcgtgggccgcagcatctcaaccccatggccaagatcaagatcgggatcaatgggttcggcaggatcggaaggctggtggccagggtggccctgcagagtgacgatgtcgagctcgtcgccgtgaacgaccccttcatcagcaccgactacatgacctacatgttcaagtacgacactgtgcacggacagtggaagcaccatgaagtcaaggtgaaggactccaaaacccttctctttggtgagaaagatgctgctgtgtttggctgcaggaaccctgaggagatcccgtggggttcgggtggtgctgaatatgttggtgagtctactggtgttttcac

SEQ ID NO: 62791 - DNA, 447 bp, Zea mays
  Clone ID: LIB3075-006-Q1-K1-D11
cccacgcgtccgggagggccggcgtcggcgtgcctagctcgatcttgaaccatagctagccagcatggcgcccagcagcagcatagcagtactgctgctcctcgtcgtcgccgtcgtcctctccaacgtcccctcctcgggcgccctggcctcctcgtcgtcgtctctgctgcaccagtcgtctccgtctgagagtgagactgagaccgacagtagcagcggagaatcttcgtcgtcgtcgtcgtcggaggaggaggaggccggcgagaaggagaaggagaaggagcaagagatggagaaggcggtcgcggcggagaaggctgcccagcaagagctgctcaagtacgccaaggagaagggcatcgtgtcaccgaccaacggcacggggtggtacaaaggcatcggccgggagttcgtggacgcccacaacgagctccgcgcgcgcta

SEQ ID NO: 62792 - DNA, 415 bp, Zea mays
  Clone ID: LIB3075-006-Q1-K1-D12
acggttctagatcgcgagcggccgacctttattattttatttataaataaaatcccatatacatatggcacagttctttcagctctttgatgcgcgcatgcttgctaccagacatctttcctaaaaaaaatttcaataatacccatttcaaattattgtagctgataccattcatcacctgtgactggcagcataaatgctaccaccctcatgactcgtaccgcgcacgcaacaatcaaaaacacaaactatctatgctacatcgtgaagacaactcttgaccaccttctcttatataaagacagaaaggcttgcagcttatactatgaagtcagatgcacggaaaaacctgactgctcaggcaatccattcacggagtacataactgacatgaactacgagcctatcaatccct

SEQ ID NO: 62793 - DNA, 360 bp, Zea mays
  Clone ID: LIB3075-006-Q1-K1-D2
tcggcttatgcactctctagaggtctattgactatgatgattgtcccttttgctctgtgcctcatgtgttacaccccactgtatacagtgttcaagcgtgaccgagaaaatgctagattggccagcatcaaggagcaggaacttacttgaaaagctttctaacaaggagtactgatgtagtttggattacatagtctacaacaccggcaacctggaggttttgattgaagtactttggttgatgtctaggatactcaagttttatgtttcttcagtcggatatcatttatgagtacacatcttgtacacaggcgatagattgtttgttctcgtcgtatgtaactggttcagtatacattc

SEQ ID NO: 62794 - DNA, 382 bp, Zea mays
  Clone ID: LIB3075-006-Q1-K1-D3
tctgcattgagcatcaggagcaaataaatttagatggaacatctgaagctgccccaactcttgtaggacatattcaccttgacaaggggcatttagaaaggataaacattagtactcaagacattctccaaaaatgtcaagaagtttctgggagatttggaaagaagaaaggacacctttgccacatctttaaaaaaattacttttgctacttgtgattgttcattcactcagatgccaatcgatggaaagctacataaggttccatgtgtgcagtttgctttttctgatgacattgtactatccgagtctattgagagagcagtgaatgtgatagctgactctgtctgctcagtgcttttagatacaattattaaaaggtg

SEQ ID NO: 62795 - DNA, 120 bp, Zea mays
  Clone ID: LIB3075-006-Q1-K1-D4
cgcgcgccttccacaagggttaccttgagccatgggcacagttgtggatcccgttccagcagtggtggttgaggtcactgagaacatgttgggtggcaagaaagttccagttgttttggc

SEQ ID NO: 62796 - DNA, 387 bp, Zea mays
  Clone ID: LIB3075-006-Q1-K1-D5
cggacgcgtgggaaagatttggaggctatggccaatctcaatataccaaaagatctaggaagtgatgaagcgaatcgttacttgatagaagcatgtgctaagtatgatgtgaaatgtccacctccccaaacgacatcacggttgcttgacaagttagttgggcatttcttggaggagacatgtgtgaatccaacatttatcatcaatcatccagagataatgagtccattggcaaagtggcatacgtctcgacctggattgactgagaggtttgagctatttgttaacaaacatgaggtgtgcaatgcatacacagagttaaacgatcctgttgtgcagagacaacggtttgaggagcaactaaaggatcgtcaatctggtgatgat

SEQ ID NO: 62797 - DNA, 246 bp, Zea mays
  Clone ID: LIB3075-006-Q1-K1-D6
ggcatcctgacggcgaacatgaccaactacctggcgtccaaggtctcgggcggctggggctggcgcacccccgtgacgttcggcgccatcccggccgccgtcatcgcgctgggcgcgctcgccatcccggacaccccggcgtcgttcgtcaagcgcggggacacggccacggcgcgcaagacgctgtcccagatccggggcgtcggcaacttgcgcaaggagttcgacaacctggccgccgagagc

SEQ ID NO: 62798 - DNA, 382 bp, Zea mays
  Clone ID: LIB3075-006-Q1-K1-D7
tcgaccttcttcagtgagactggcgctgggtagcacgtaccccgtgctgtttttgttgaccgtgagcccactgtcatcgatgaggtgaggactggcacctatcgccagctctttcatcctgagcagctcatcagtggcaaggaggatgcagccaacaacttcgctcgtggtcactacaccattggcaaggagattgttgacctgtgccttgaccgcatcaggaagcttgcagataattgcactggtctccagggcttcctcgtcttcaacgctgttggtggaagaacgggctctgggcttggttctctcctgctggagcgcctgtctgttgactatggcaagaagtccaaactcggtttcaccgcgtacccattcccccaag

SEQ ID NO: 62799 - DNA, 456 bp, Zea mays
  Clone ID: LIB3075-006-Q1-K1-D9
cacacacatccgtgaaagaaacaagcacatagaaacaaatacatcgctagctcgccaccaacaatggcctcaaggtactctatcctgcttgccacaacgacactggctatgttgttcgcattcggttcgtgcaccaccccactcaccttccaggtcggcaagggctccaagcctggccacctggttctcacccctaacattgccaccatctctgacgtggagatcaaggagcatggcggcgacgatttctcctttacactcaaggagggcccagctggcacttggacgctcgacaccaaggccccgctcaagtaccccctctgcatccgctttgctaccaagtctggcggctaccgtatcgccgatgatgtcatccccgccgatttcaaggccggcaccacctacaagaccactctcagcatctgatgagcctgtgatgagtgatgacgaataata

SEQ ID NO: 62800 - DNA, 325 bp, Zea mays
  Clone ID: LIB3075-006-Q1-K1-E10
gatccggagcagccgcagtcccaccgaccccgtcgccggtcgccctccatctcctcgccgctgcgctctcgatctttgtacagcttctcttttcaataatcaagatgagccgtggtggtagtgccggtggtggtcaaagttctctgggttatctctttggaagcggtgagccccccaaaccagcagtggcaccagctgcaagtgctccacctgttgagaaaccatctgctgcaaagactgatgcggccaagcaggttgctgctggggttaccagccaaaccaataactaccacagggctgatggtcagaacactggcaactttct

SEQ ID NO: 62801 - DNA, 416 bp, Zea mays
  Clone ID: LIB3075-006-Q1-K1-E11
catccctgcaaattaccgcgatggctcccaagatcctagtcatccttgtgttcctcgccgtggcctcaccggctgctctggccgccttcgatgtgatagagatgctggccgacaagcccacgtactccacgttcctgaagctcctgcaggacaccaaggtcgcgggcgaggcgaatcagctccggtcggcgacgctactggtcgtccccgacaaacttgccaagcctctggcgtcgctgcccgccgataaggtgcggccggcggtggagaaccacgtccttctcagttacttcgaccccatcaagctggacgagatgaagacacgcaccgtcatccttcccacgctgctctccgtcaccgacaagaaactcggcgtcctcaactacaccagggccgacgacgggcagatgtacttc

SEQ ID NO: 62802 - DNA, 339 bp, Zea mays
  Clone ID: LIB3075-006-Q1-K1-E12
acgcggacgcgtgggcggacgcgtgggagatcaccttccgtcgagcgagcagtcttccaattccaggcgatgactaataacatctcctggaacgccacgttccttggaccactatattcaggagcgacgaagtgatccacccgccagccatggagatgaagaaggtcctctgcgccgccctcgtcgtcgccgtctcagtcaccgacgtgctggcctctgtcgcctccgaggcgccctccgaagcgcccgccgacgcgagcggtggtgcggatggccctagcgcatgcggcgacgtcgccgacgtcgtgcccgacgtcggggcgctcgtcggctccttac

SEQ ID NO: 62803 - DNA, 282 bp, Zea mays
  Clone ID: LIB3075-006-Q1-K1-E2
ggcggatgtgggtacaaggacgtgaacaaggcccctttcaacagcatgggcgcatgtggcaacgtccccatcttcaaggatggtctaggttgtggatcctgcttcgagatcaagtgcgacaagccagcggagtgctctggcaagccccgggtggtgtacattacagacatgaactacgagcccattgcggcgtaccacttcgacctagcaggcacggcgttcggtgccatggccaagaagggcgaggaggagaagttgcgcaaggcgggcatcatcgacatg

SEQ ID NO: 62804 - DNA, 440 bp, Zea mays
  Clone ID: LIB3075-006-Q1-K1-E3
gccaagatctacggcaaggccatggagcagctgaccgcggcgatgggcgcctccgagagctgcgaggacgcgtggaagggcgaggaagatgtccccgtcgccgcgcacgacagggagtacgggcggatggcgcacatcgccttcggattcacacaccacgccgtcgccgccgcatgaatcatcatgtcatatgcatgcatcgcttctcttccttgtcgcattaattttcatgcgtccaatgattcatatctctatatgcatatctctctgctctgccttgttggctggctcttctcatcattccctagcacatcgcatagtattagttgcatgcattatattgatgatgcaggtatttcgtcgagcaacaaaggcgtactatcaaatggttttggaatacccaaaattagtgaattaaggggaactggttataaaaattt

SEQ ID NO: 62805 - DNA, 389 bp, Zea mays
  Clone ID: LIB3075-006-Q1-K1-C7
cggacgcgtgggattgtgggcgagtgcgtgcgttcgtgcagccacagacaggcgtccgggcaccatgtctttcaccggcacgcaggacaagtgcacggcgtgcgacaagaccgtccacttcatcgacctcctcacggccgacggcgccatctaccataagacatgcttcaagtgcagccactgcaaaggggtcctctcgatgtgcagctactcctccatggacggtgtgctgtactgcaagacccacttcgagcagctcttcaaggagaccgggagcttctccaagaacttcacgccaggtggcaagtcatcagacaagggtgaactgacaagggccccaagcaagctgtcgtctgcattttctggtacccaggataagtgcgcagcat

SEQ ID NO: 62806 - DNA, 456 bp, Zea mays
  Clone ID: LIB3075-006-Q1-K1-B11
gcaggtcgtgacggagcgtatccagcggaagctggaggaggccaacgctaccgtccaacagcacctcgccggcatccaggaccacgtcaacttcaccatgcagcaagcatacttcaagtgcgcatatgattgcttcgatcggcgccgtactcaggaagcgatcaacaattgtgtggagaattgtggtatgcctgtccttgctgtcaacaatgtttttgagagtgagatggccaagtttcaggaacggttgaaccggtcattgatggtctgtcaagataagtttgaagctgccaagctccagaagatgaaaacagatgcaactcatgaactggaatcctgtgtcaacagatctatcgatgacagcatcagggccctcccatatgtggtgcagcagatgaagtccaccctcaatatcaattagaggcattattacctttagcatatgaaccagatata

SEQ ID NO: 62807 - DNA, 456 bp, Zea mays
  Clone ID: LIB3075-006-Q1-K1-B12
cgacgcgggacgcctgcattcccttgcgcgggacgcgacaactccacgctacacagttcacacgccaagcgagggccgcatctagatccgcgccgccgagctgacttgactattgcaagtttgcaacccaccgtcacgccttcttctccccccgcgatctacccggcccgggcgccgttgctgctactgctattactaatactactaccgcgtcgtagcggaggcagggacttgaggagcgggtgggttgcgatggccgctgcggggaggaatgcgggcgtcctcgcgctcttcgacgtcgacggcaccctcacagcgccgcgcaagggggtgacgccagagatgctagagttcatgaagcagctgcgccagcatgtgacagtgggcgtggttggcggatccgatctggtgaagattaccgagcagctcggcagtacagttattactgattatgat

SEQ ID NO: 62808 - DNA, 162 bp, Zea mays
  Clone ID: LIB3075-006-Q1-K1-B3
ggttggcttctccttccccttcggttcgggttctggttcgtgaggttcttcggggttcggtttcgtgggtgagcggatcgagatggcggcgtcggatgttgagtaccgctgcttcggcggcggcctcgcctgggccacggaccaccacttccttcacaacgc

SEQ ID NO: 62809 - DNA, 387 bp, Zea mays
  Clone ID: LIB3075-006-Q1-K1-B4
cgtcgacgccaccgccggagaaagcgatgtggtcgtctcggccctcgtcgccgtcggcgccggggccgcggtcgtccccttcgccaggcgtatgctccgcctccgcaccgcccctgcttcgagccccacgtcctcgtcctgagcttcgcggtcctcctccgcctctcctccaagaacacatagggactattgtgaaggtattgatttgggatttctggagcttattatcagctcgtcgtacgtattcgcatgtcactggggacggagtagcagaataaatgaatgaaatgatcattcaagtgctcagttcagccactgtctattttttaaaaaaaaagctcctgacgaggccattttcgaactggacaccctctatagagaagacct

SEQ ID NO: 62810 - DNA, 409 bp, Zea mays
  unsure at all n locations
  Clone ID: LIB3075-006-Q1-K1-B5
attgaaacatttatgaactatcaggatagcatcaggagatgtgtgtgcattgtctatgacccatctagatctagtcaaggcgtgctagctctcaaagccttaaagcttacagactcgtttatggatctttaccgtaacaatggtttaactggggagaagtacaacctcttttctgtagctcatcattgtactagtttgtacaaatattttttatacaatgattttttgctgttgcaggttaagggagaagaaattgtcctgggttgatatctttgaggagataccattaaaaagttccaactcagcgcttgtcagtgcctttatgaaagagctggaacctgagtcacctgtaacccagtgtgacctgtaccgacttanattgtaaaccgccccctttatgaaaggaact

SEQ ID NO: 62811 - DNA, 342 bp, Zea mays
  Clone ID: LIB3075-006-Q1-K1-B6
gctcttcttcggcggctcgtccacgtcgtcggcgcccggcgtctccgaggcccagcaggcggaggcggtggcgaaggtcgtggcggccgtggcgccggcgccgccggcgcgcgtgtcggtggccggcaccagctacggcgggttcgtggcgtaccacgtggcccggttgctgggccccgacgccgtggagcgggtgtggtcgccagctccgacctgctcaaggccgacgccgacgaccaagccttgctccgccgcgccggcgccgagcgcgtcgaggacgtcatgctgccgcgctccccggaccggctgcggcgactggtgcagctcgcctaccaccgcccg

SEQ ID NO: 62812 - DNA, 344 bp, Zea mays
  Clone ID: LIB3075-006-Q1-K1-B7
aatggacccaaagctttgaagcctgtgccggtgattgttcgttgcaggtgctgcggccgagtgaagctaccccacttctattgctgcagtggagaaagaggaaacccaagcgagtcgaactcataaatgttttgttttcctactttgctcactatgctacgtctgaaatctggacatcgtaataccaatgaaataaattgtcagatcgctcttggtattcaccttgttctccttccaagcattgaatcaatacacacttactctagtttgaattcaaagtgtaagaccatcatcaagagcctttctaattttctgatatcatttgagtaaaacttattttttat

SEQ ID NO: 62813 - DNA, 290 bp, Zea mays
  unsure at all n locations
  Clone ID: LIB3075-006-Q1-K1-B8
ggcaagatngaaactgagctcaccaagatctgtgatggcatccctaagcttctcgaatgtgaagttgtgccgtcttccaccggtcccgagtccaaaggcctttattttaagaagaaaggtgactactacagataccttgctgagttcaagactggagctgagagaaaggacgctgctgagaacaccatggtggcatacaaggctgcccaggacattgctttggctgagcttgctccaactcaccctattaggcttggactggcactcaacttctcaggtgtctactatga

SEQ ID NO: 62814 - DNA, 415 bp, Zea mays
  unsure at all n locations
  Clone ID: LIB3075-006-Q1-K1-B9
cggacgcgtgggttcgttcggagcgcacacacacacaaccagatctcccccaaatccacccgtcggcacctccgcttcaagatgcagatctttgtgaaaaccctgaccggcaagactatcaccctcgaggtggagtcgtctgacaccattgacaacgttaaggccaagatccaggacaaggagggcattcccccagaccagcagcggctcatcttcgctggcaaacagcttgaggacgggcgcacgcttgctgactacaacatccagaaggagagcaccctncaccttgtgctccgcctcaggggaggcatgcacatctttgtgaaaaccctgaccggcaagactatcaccctcgaggtggagtcctctgacaccattgacaacgtcaaggccaagatccaggacaaggagggca

SEQ ID NO: 62815 - DNA, 445 bp, Zea mays
  Clone ID: LIB3075-006-Q1-K1-C10
cacagacccgtttccccgctagagttatcgttcctctgtagcgatggcgatcaagcggaccaaggcggagaagaagatcgcgtacgacaagaagctgtgcagcctgctcgatgagtacaccaaggtgctcatcgccctcgccgacaacgtcggctccaagcagctccaagacatccgccggggcctcaggggcgactcggtggtgctcatgggcaagaacacgctcatcaggcgctgcatcaaagtctacgccgagaagaccggcgaccacacctttgacccgctcatggacctgctcgtcggcaacgttggcctcattttcaccaagggagacctcaaagaagtgcgcgaggaagtcgccaagtacaaggttggggctcctgctcgtgttggtctggttgctcctgttgatgttgtcgagccccctggcaacactgggctggat

SEQ ID NO: 62816 - DNA, 394 bp, Zea mays
  Clone ID: LIB3075-006-Q1-K1-C11
gcccgaggcgtgtggcgcggtgggagcaggaaggagaggggaagaacagaaggggaaggcgggcggggccgcgatgtcggtgcggatcaaggcggttgtagaccggttcgtgaaggagctgcaggaggcgctggacgcggacatccaagaccgcgtcatgaaggagcgcgagatgcagagctacatcgaggagcgcgagcgcgaggtcgccgagcgggaggccgcctggaaggccgagctatcccgccgcgaggccgagatcgcacggcaagaagccaggctgaagatggaaaaggagaatttagagaaggaaaaaagcgtcctcatgggaacagcatcgagccaagacaaccaagatggagcccttgagatcactgtcagtggtgagaagtac

SEQ ID NO: 62817 - DNA, 461 bp, Zea mays
  unsure at all n locations
  Clone ID: LIB3075-006-Q1-K1-C12
cccgagaagagcatagactccctccacgtcgatggctacgccttcttcggcgtcgggatgggccccgggaagtggtcgccggaggtgaggaagacgtacaacctgctggacacggtgagccggcacacgatccaggtgtacccgcggtcatggacggcaatcatgctgacgttcgacaacgcgggcatgtggagcgtgcattccaacatctgggagcggtactacctcggggagcagttctacatcagcgtcgtctcgccggcgcgatcactgcgcgacgagtacaacatgcccgacaacgccctccgctgcggcaaggtcgtggggctgtcgctgtcgncgtcctacgcccccgcgcgctaagacgacgaaggcctcgttttctcctcgtggtctgaccatccaatccaaactcataagaacaaatacgaaagaagcgtagtgaaggggaacaaatgaat

SEQ ID NO: 62818 - DNA, 294 bp, Zea mays
  Clone ID: LIB3075-006-Q1-K1-C2
cgcccccttccaggctcccgtctccatgggtcttctctcaaacaggattgggagggagagcctcaaggcgggggatcatatctactcctggagggcggcgtgggtctacgcgcatcacggaatatatgtgggcgatgataaggtgatccatttcacaagaggaagaggacaggaggtcggaacaggaactgtcgtcgatattattcttgtgagttccaccccaaaacgaagcaacacgccttgcccggtgtgcaccgacgaaaccagcgacagcagcacagagacgaacggcgt

SEQ ID NO: 62819 - DNA, 433 bp, Zea mays
  Clone ID: LIB3075-006-Q1-K1-C3
atctgggattcctacagcgttaaagcgcagacgttcatgacagcgattgaggctgcttgcatgcttttgagaatagatgacattgtcagcggtatcaagaagaagcaggctcctggagcctcagctcccaagcaaccccaaattgaaactgagggtgatgccgacaatgagcagatgatcccagagtgagtagaggctgtgaccaacctgcactagcaaagttattatttactagtgccggaatagcactttgaatagagttcattttatttgagtgttggtggttagccttaggttttatatatagcttgatacactcgtccgagggttttttgtaatgtggttgctgcgcattttgctttggactgatggacgaactttgcctggtggatgccggaaatctacctaataccacgttatgcttgtggtttcc

SEQ ID NO: 62820 - DNA, 181 bp, Zea mays
  unsure at all n locations
  Clone ID: LIB3075-006-Q1-K1-C4
gtcgcgccgncgtcgtcgtcgaaacagcacatttctctctcgatctcagccatggccgaagtggggcaggcccaggacgccgtgaagctctttaaccggttgaccttcgacgatgtccacgtgaacgatatctcgctgaacgactacctgggtgtgactgtggggaaacacacgacatttc

SEQ ID NO: 62821 - DNA, 275 bp, Zea mays
  Clone ID: LIB3075-006-Q1-K1-C5
gccggagcttggctatacacctgatgttttcttctacaatgctcttatcaaggggctctgcgtcgagaaaaagagtcaagaggctcttgagctgctgcttaatataacggccgatgccggttccaactgtcttcccaatgtggtgtcgattagcacaatcattgatggcttctttaaagaaggtgaagtcgacaaagcttacttcctgtttgatgaaatgattggccaggggtttccacctgatgttgtgacatacagctcactcattgatggcc

SEQ ID NO: 62822 - DNA, 336 bp, Zea mays
  Clone ID: LIB3075-006-Q1-K1-C6
ctggtgcccaactggctttaagtgcggcattaactaccagcctccaagtgtggtgcctggtggtgacctggccaaggtgcagcgcgctgtgtgcatgatctccaactccaccagtgttgtggaggtgttctcccgcatcgaccacaagttcgacctcatgtacgccaagcgtgccttcgtgcactggtatgtcggtgagggtatggaggagggcgagttctctgaggcccgtgaggatctggcagcgctcgaaaaggactacgaggaggttggcgctgagttagatgagggtgaggaaggtgatgatggtgatgagttctagaagtttcctgatgc

SEQ ID NO: 62823 - DNA, 330 bp, Zea mays
  Clone ID: LIB3075-006-Q1-K1-B1
gacgacgcggaggcggagcgtccggcggcttcgcgtacctctccgcggcgtcccccgcctacgacgctgcgtgccgccgcatcggcaggtacgccggcgcggcggtgctgtccgtcgactaccgccgctcgcccgagcaccggttccccgccgcctacgacgacggcttcgcggcgctccgcttcctcgacggcgggcccgggcccgaccccgaccccggcgcgatcgcgggcgccccgccgatcgacgccgcgcgctgcttcctcgcgggggacagcgccggcggtaacatcgcgcaccacgtcgtccgccgctacgcgctggaccctt

SEQ ID NO: 62824 - DNA, 230 bp, Zea mays
  Clone ID: LIB3075-044-Q1-K1-G9
ggcggccaccgccccacaggtagcggaggcaaagaagaagagagcggcggatagcggcgaggcggcggaggcgaagaagatccaggacgacttctgctcgacgctgtgcgagggcaagaaggggacggacctggtcgtgtgcaaggagtcctgcgcgctcttccagcagtccaacctggtgctgtacggcaggatccagtgcaagggcaagtgcaccgagcagaagggca

SEQ ID NO: 62825 - DNA, 242 bp, Zea mays
  Clone ID: LIB3075-044-Q1-K1-H1
cctaagcgtccaaacaaaagttctctcgctcgctttttttttaaaaaacaaatgtgctatatgtatatgcgcgcatgcatgctagcagacatctttcctaaaaaaaatttaaataatttccatctcgcattattttagtagctaccattcatgttttctgagtagttgtataaatgctaccaccgtcatcttttgtacccggccggaacaaacgaaaaacacactatctatgctgtgttgtg

SEQ ID NO: 62826 - DNA, 308 bp, Zea mays
  unsure at all n locations
  Clone ID: LIB3075-044-Q1-K1-H10
caagaatttgggtcccttggttaagacagtgatgactcgttgcatccaatgtacaaggtgtgtgaggtttgctactgaggttgctggagttcaagaccttggtatgttaggtcgtggcagtggtgaagaaattggaacatatgttgagaaacttatgacaagtgagctatctggaaatgtcattgatatctgccctgttggtgctcttacatccaagccatttgcatttaaagctcggaactgggaacttaagggcacagagactattgatgttactgatgcagtgngatccaacataaaaattgaca

SEQ ID NO: 62827 - DNA, 312 bp, Zea mays
  Clone ID: LIB3075-044-Q1-K1-H11
ctcccacatctaactccccccgactcacgagttccagagagcctccatggcgacgcaccgtcgctgcctcccactcctcctcggggccgccgacctcgccctcgccgccgtccctgctcgcgcggcgctgggcggcgggcgcggcccgctgctgggcgggtggaacccgatccctgacgtgagcgactcgcacattcaggagctaggcgggtgggcgctggggcaggcgaagcaccagaagctggccgccgacgggctgcggtttcgccgcgtggtgcgcggcgagcaacaagtcgtgtccgggatgaacta

SEQ ID NO: 62828 - DNA, 350 bp, Zea mays
  Clone ID: LIB3075-044-Q1-K1-H12
cggacgcgtgggcggacgcgtgggcggacgcgtgggcggacgcgtgggatttatgctgaggaaggttcagaggctatggatgtggctgctgcccctgctgtccaggcaagctcgttttcctgacggagacaactgcccctgctgtatgttctgttatttttcagctttcacagcctaaagctacttgttctgttatttttcaggcattggcaagatacacacgaagggaggcaacttgcctatcattgactggcaaagattctatgttctcggggaactttaaattcacagctctgctgccggcaactcccagtcccagccccaaaaaagcctgtgcgatgaactgccgt

SEQ ID NO: 62829 - DNA, 334 bp, Zea mays
  Clone ID: LIB3075-044-Q1-K1-H2
cccggcggcgcgaagcggagggtgagaatatcggagttcggcgatgtcgaagcggcagggagcgccgaaacaccagaaccgctgcgcgtggaagccgaaccttggtcagaagatcaacgaaaccgagcccgggggcaggttccgacctctgtcagaaatcaccggcgtctgtcagcgctgccgggatcaaatcgactggaaacgcagatacggaaaatacaagcccattgttgagccagcaaaatgccagaagtgtaataagcgaaacgttcggcaagcataccataacattgctccaaggaccttggcatatgtgctaagtgctgcacatgtg

SEQ ID NO: 62830 - DNA, 289 bp, Zea mays
  Clone ID: LIB3075-044-Q1-K1-H3
caaccgtgtgccttttggagacgcgatgtcgtccggcaacaagatcagcgtggccttgctgagcgtggccctagtgggcctgctcctctgccacctcgccaccaccgccttcgtccaccagaaagacatccacgtcctcggcagcgtcgacggctccagcgacggcagcagccccgagtccgaaggccgcgtcgtctacgcggacatgaagctggctgatacggaatccgatgcgccggcgccggcgccggcgccggggccgtcgttcggttgaactgaaaagcgtgcg

SEQ ID NO: 62831 - DNA, 286 bp, Zea mays
  Clone ID: LIB3075-044-Q1-K1-H4
caagaatttgggtcccttggttaagacagtgatgactcgttgcatccaatgtacaaggcgtgtgaggtttgctactgaggttggtggagttcaagaccttggtatgttaaggcgtggcagtggtgaataaattggaacatatgttgagaaacttatgacaagtgagctatctggaaatgtcattgatatctgccctgttggtgctcttacatccaagccatttgcatttaaagctcggaactgggaacttaagggcacagagactattgatgttcactgatgcagt

SEQ ID NO: 62832 - DNA, 334 bp, Zea mays
  Clone ID: LIB3075-044-Q1-K1-H5
caagaatttgggtcccttggttaagacagtgatgactcgttgcatccaatgtacaaggcgggtgagggtcgctactgaggtcgcgggagttcaagaccttggtatgttaggtcgtggcagtcgtgaagaaattggaacatatgttgagaaacttatgacaagggagctatctggaaatgtcagtgatatctgacctgttggtgctcttacatgcaagccatttgcatttaaagctcggaactgggaacttaagggcacagagactattgatgttactgctgcagagggatccaacattacaattgacagtagaggacctgaagctatgcttgtt

SEQ ID NO: 62833 - DNA, 251 bp, Zea mays
  Clone ID: LIB3075-044-Q1-K1-H7
caacagatgatggatggttttggaggatactatgatgaatgcatgtactggagacaaaatgatgaaattcatgatgctcataaggaggcatctgctccatgttcatcagctcctgtctcacatcttggtgctcatcagcaagagtgttggcagcactcttcatatggaagtcaacatcacgataaccaaaatttacttgaaatggaagtcagggtaaggggtgaaatgtcccacattcaacaatgaatata

SEQ ID NO: 62834 - DNA, 276 bp, Zea mays
  Clone ID: LIB3075-044-Q1-K1-H9
gggcgcttcgccggcgacgagcatccgccaggtgcccagccatgtcgtccaatgcgggggcctccgtcgctcccatgggcggcggcgctgctcgtgcccgcagtcgcagcttcgggagcagcagcagcaacggccgggccgccgacggcaatggcgctggggtgttcgtgagggcgggggccgacaacgagatgtacgtgcgggcggataagatcgacctcaagaacctggacgtgcaactggagaaggcgccgtcccaagtgtggctggagcacc

SEQ ID NO: 62835 - DNA, 429 bp, Zea mays
  Clone ID: LIB3075-045-Q1-K1-A10
ctccacctatcttcttcagacgaccagcaggatgtacgagcaagaccacctaggaggcctctctctccctctccccagccacccgcgtagcgagagggagggcggaagaggatgagcgcgtccaggttcataaagtgcgtcacggtcggggacggcgccgtcggcaagacctgcatgctcatctcctacacctccaacaccttccccaccgactatgttccgacagtgtttgataacttcagtgccaacgttgtggttgatggtaacactgtcaacctcggcctctgggacactgcaggtcaagaggattacaacagactgagaccactgagctatcgtggagctgatgtttttcttctggctttctcactgatcagtaaggccagctatgagaatgtttcgaagaagtggatacctgaactgaagcat

SEQ ID NO: 62836 - DNA, 429 bp, Zea mays
  Clone ID: LIB3075-045-Q1-K1-A11
ccgcaagttcatgaacaaaccagtgagaattcttgtgaagagagatgagctgacccttgagggtatcaagcagttctatgtgaatgtggacaaggaagactggaagctggacacactgtgtgacctgtatgagaccctggccattacccagagtgtcatctttgtcaacacccgccgcaaggtggactggctcactgacaagatgaggagcagggaccacaccgtttctgccactcatggtgacatggaccagaacactagagacatcatcatgagggagttccggtctggctcctcccgtgtgctcatcaccactgacctgcttgctcgtggtattgatgttcagcaggtgtccctggtcatcaactatgatcttcccacccagccagagaactacctgcatcgtattggtcgtagtggtcgttttgg

SEQ ID NO: 62837 - DNA, 429 bp, Zea mays
  Clone ID: LIB3075-045-Q1-K1-A12
cgtccgggctcgtcctcctctcttctccatcgccgttggttctctcacgccacacggtcatccgatccctgtccaccgcgttgggagcgccgcagcccatggacgacaacgagagagagaaagagaatgagaatgagaaggagaagcactacgggactgacgtcgaggatgaagaagaggacgaggaaggtaacaagcgagtcgtggtgcttggcccccaggtccccctcaaggagcagctcgagctcgacaaggatgatgagagcctgaggaggtggaaggagcaactccttgggcaggtcgacacagagcagctgggagaaactgcggaaccagaggtcaaggtgctggacctgaccatcctgtcacctggcagaccggacctgatccttccgatcccgttccaggctgacgagaagggctatgcgt

SEQ ID NO: 62838 - DNA, 398 bp, Zea mays
  Clone ID: LIB3075-045-Q1-K1-A2
attcactggagatgactgttgtgagtatcatgtggtcgttagtgcaagtgcacgtgctggtggtggtggcactagcatttctggtaggcggtgcctggtgtggtcctcccaaggttcccccgggtaagaacatcacggccaaatatggtagtgattggctagatgccaaggcgacatggtatggcaagccgacaggtgctggccccgacgacaatggtggcggctgcgggtacaaggacgtgaataaggcccctttcaacagcatgggcgcgtgtggcaacgtccccatcttcaaggacggtctaggttgtggatcctgcttcgagatcaagtgcgacaagccagcagagtgctctggcaagcccgtggtggtgtacattacggacatgaactacgag

SEQ ID NO: 62839 - DNA, 431 bp, Zea mays
  Clone ID: LIB3075-045-Q1-K1-A4
agcagcaatggcgctgcttgcctccgactttcctcgcgtcatctcgtgcttcccaatccctatagatagaactggattgatccccatggacccatgattctctcagacgccactgcgcctgttcgacgacgcgaagccagaaggcctcgtggtcggggaggctgacgcagagagggacgatgggaacgggggtacccgcctacaacggcgctcggggcataatagttggtcaggcgtgatcataggggctcactagaggcgcgtgcatcggtccgtggggccgaagacggtcggtgcggcggcgattgctcgctgggatccgcaagaaccgccgtccgatcatcctgcgttgtcagcactctttccatcagcgccttcggtcacgaggatctgaagaatcaccctgggacctggaatttcaagtgccaagc

SEQ ID NO: 62840 - DNA, 314 bp, Zea mays
  unsure at all n locations
  Clone ID: LIB3075-045-Q1-K1-A5
gaaagaaatcaaatatatcatctcattgataaccagaaacgcagagggtagtacatgatcgccgcgacaaacagtggcgcgttgaaacacgtaccaccaccaccacgcgcacacctnctccggcggcgcgggcgactccatacatacacacgcccggcgacacctgacacagagacacacacgacacgagctggactcacgcacgccagaccagacgaatcatattttggagcaagaaccacgtattcagcgcggatctagcagaagaggtagccgaatgcggcggcggctagggaggccgcggcgaggggtac

SEQ ID NO: 62841 - DNA, 358 bp, Zea mays
  Clone ID: LIB3075-045-Q1-K1-A6
ggtggagcaccgagtacggcgacttcttcctgtcgtgggactcgcacatgctgctggagcacggcgaccgcattctgtcgggcgccacgtacgtgttcggcgcggcgcccgtggaggtctccgtgaaagtggccggcatacactggcactacggcagccggtcccacgcccccgagctcaccgcgggctactacaacacgcggcgccacgacgggtaccttaccatcgcgcgccttctggcgcgccacggtgccgagctcaacttcacctgcgtggagatgcgggaccacgagcagccgcaggaagcgcggtgcatgccggaagcgctggttccgcacgtgggcgccgcagcgcgcgc

SEQ ID NO: 62842 - DNA, 262 bp, Zea mays
  Clone ID: LIB3075-044-Q1-K1-G8
gttctcctggtaaaagagcatcgatggaggacttctatgaggcaagaatagacggcgttgatggagagaaaattggagatgttcggcgtatatgatggtcatggaggagtccgagcagctgagtatgttaagcagcaccttttcagcaatttaatcaaacacccaaagttcatcactgataccaaggctgctatcgccgaaacttacaacctcacagattcagaatttctgaaagctgatagctgtcaaactcgagatgctg

SEQ ID NO: 62843 - DNA, 241 bp, Zea mays
  Clone ID: LIB3075-044-Q1-K1-E7
atgatgatgggatcacaaaagcttgcagctgtcctttgcttccactgaaaactcatatcaagggcccggcaccagcctctgaccctgataaagcggacattgttgatgaagccataactttctttcgagccaatgttttcttcaaaaatttccatgtgaaaagctcagcagacaagttattgatctatctgacgttttatatcaatattgccttaaaaagactagacggttgccggacact

SEQ ID NO: 62844 - DNA, 276 bp, Zea mays
  Clone ID: LIB3075-044-Q1-K1-E9
agcttgtggagtgctccggcaagcccgtggtggtgcacatcacggatatgaactgtgagcctatcgcggcgtaccacttcgatttggcaggcacgacgttcggcgccatggccaagaagggtgaggaggagaagctgcgcaaggcgggcatcatcgacatgcagttccgaagggtcaagtgcaagtacggctccaaagtcaccttccaccttgaaaaggggtgtggccccaactacctggcgctgctggtcaagtacgtcgacggcgacggtgaca

SEQ ID NO: 62845 - DNA, 342 bp, Zea mays
  Clone ID: LIB3075-044-Q1-K1-F1
gtttgaaatggtagaattaagaatatttttctcatcccttgagatttctacgctattgatcttggttcctagtgtctcaggaaagaattacaatccgactctagcatgacttccatcggatcactaaaaaagactacttaaggtgatagtgtagaggattaggcataatgcgtgcgtttaattgcacggaacctttcagggaaaaaaatatttagttcagagggttggagggcaagatgcctctcggggatacatatgtcagtacgagattacaatgtcctaacggccaaatatactcaacactgttaaccttttttataaggtggctaataaaaaataaca

SEQ ID NO: 62846 - DNA, 307 bp, Zea mays
  Clone ID: LIB3075-044-Q1-K1-F10
gatcacgacaagatggcgtgcacaaacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcatgcggcggcactgggaagcagacaatcctcatacccaagggtgactttcttgtcggacaactcaactttacaggcccctttgcagggcgacgtg

SEQ ID NO: 62847 - DNA, 387 bp, Zea mays
  Clone ID: LIB3075-044-Q1-K1-F11
cgtacttgtattctagcagcaaagcaaagaggatcggatcagaagaaaagaatagttaggtccccggggtcgatcgaacgaaagctgttgtgctacccggcggccggcatgacgatgacacggacgatgtgcctaggcctgctgcttctactactggcggcggcgtcgacagcgacggcgcatttcacggtcggcgatgtggatgagtacgtgtccaagcgcacgcaggagtcccgccacaggaacaacgggtggcgcgggcatcgatgacctcatctccagtgcggcgcgctttcacgccaacgtggatgcacgcgcctatggccgtagatccgacctgcaggaggaggcaacagctaccgtattaaccaaagcggaagcacaaga

SEQ ID NO: 62848 - DNA, 259 bp, Zea mays
  Clone ID: LIB3075-044-Q1-K1-F12
ctcaagcgtgcagacttggaccacttcgtggtcaacaacgacgactcgccgcactcctcatgagactccccgacggcggactggtcttgacctgccgaggcagcggcggctcacgctcacgtctatcaccagcagcagcaagaggagcagcagaatgggggcaagcacaaaggcagctgggctcgaggacgagctggcacggtgaccaagctgcacatcacggcgccgcagagccctcagacggctcccgcgggcatgg

SEQ ID NO: 62849 - DNA, 242 bp, Zea mays
  Clone ID: LIB3075-044-Q1-K1-F2
gtgatttgaaataattgggaataaatagttcgtgaatccctgaagcgtgcatatatatattcctgccaagataaaggtaatggagtcgtcacgcaggttccagccggccgtcatcctgcttctcctgctcattgtgtccaccgatatggcacaggcaagggaatgcgagaagtacagtgagcgatttgttggggcatgcatgatcgcagacaactgcgccaatgtgtgccgcggtgagggct

SEQ ID NO: 62850 - DNA, 266 bp, Zea mays
  Clone ID: LIB3075-044-Q1-K1-F3
gtgatttgaaataattgggaataaatagttcttgaatccctgaagcgtgcatatatatattggtgccgcgattaaggtaatggagtcgggacacacgtttcagccgggcgttatcctgcttctcctgctcattgtgcccaccgatatggcacaggcaatggaatgctatacgtacattgagcgattcggtggggcatgcatgatcgcaaataactgctccaatgtttgccgggtagagggctttttgggcggcaagtgctacacct

SEQ ID NO: 62851 - DNA, 252 bp, Zea mays
  Clone ID: LIB3075-044-Q1-K1-F4
gtacatgctacggaggattgctgcaaagcttccgatatcccagggtcaccccaccagcaggggctcgagaccagggattaccgtatggtgagccaaaaatggggactgacgtccagctatgaaaaaaccactgcctccccctatatataatacttgcattggcagcctctctgcaaaaaatatattgggatgagactccgcaccgatattctttttctagaccctactcacatgggagccatctctattttt

SEQ ID NO: 62852 - DNA, 178 bp, Zea mays
  Clone ID: LIB3075-044-Q1-K1-F5
gtacatgctaaagaggattgctgcaaagctaccgatatcccagggtcaccccaccagcaccagctcgagactaggcaccaccatatgctgagccaaaaatggagactgctgccaagctatgaaaaaacaactgcctcgcccaacatataacattggcttggccggctattctccaaaa

SEQ ID NO: 62853 - DNA, 300 bp, Zea mays
  Clone ID: LIB3075-044-Q1-K1-F6
ggcaagcaagtggaggaagtggtggccatcaagaacaccgagattgcgaagcacctgtctcttccaccagtgaagctccactgcagcatgctcgctgaggacgcaatcaaggccgccgtgaaggattacgaggcaaagaaagggaagaagatggccaatgcagaggagcaggacaccccatgcccgtaagagcgacagctagtaaactgaagcgagcagagagtactgtatgtagtatgtaacggctaacgagcgaggtactcgtgtcgtgtgtgccaaaaagaagcatgtatgtaatgt

SEQ ID NO: 62854 - DNA, 240 bp, Zea mays
  Clone ID: LIB3075-044-Q1-K1-F7
cggacgcgtgggccaatccatacgtactccccgtgttttttttcctgtgcagttgttgtggtcgaggcggcaagcggcagcggtgacccacagaggaggaggcggcaagcgcggcgatcgatcgaagaggaggcaacgacgtttgaagaggcggtggcgggcgatgtgatgctttcggaagggatgctgctgtttctcgtcaggactgtacattacgggatgtctccttcgacgggagga

SEQ ID NO: 62855 - DNA, 274 bp, Zea mays
  Clone ID: LIB3075-044-Q1-K1-F8
gacgctagtttgtgccccgctgatagcagaggcaaagaagaagagagtcgccgccgccgccgccgaggagaagaaggtgcaggacaacttctgctcgacgctgtgcgagggcaggaaggggatggacctggtggtgtgcaaggagtcctgcgacctctcacagcgctccaacctggtgctgtacggccggatccagtgcaagggcaagtgcaccgagcagaagggcatcaccgcgccgcagatgaaagtgtgccaagaggcgtgcgacaaggac

SEQ ID NO: 62856 - DNA, 250 bp, Zea mays
  Clone ID: LIB3075-044-Q1-K1-F9
gcaccgcacggagagcaagcaagaaagcaaccaccgcactgccactacctaacagtggcccgcgcctacgtgtttctcgtcgtgctcctcctggccgctgtcatcgtggcaccgttcgcgggagcgacgcgtgtcgacgtcgttgagggcaggtccatggcgtccgtcgacgcgccggaggccgtcgcaccatcacccgggcctgactccgcctcgtcaccggactcctcgtcggatgcgccctacagca

SEQ ID NO: 62857 - DNA, 284 bp, Zea mays
  Clone ID: LIB3075-044-Q1-K1-G1
ctccgctgggccaccagctttgaccgccgcctcccttcccctccgctactgctcctcctcagcccactcccccgcaggagcggcggcggcggcggcgaggtcgtaccccacatcggcgagcggcggcggcaccgccggaggcaaaggcaagatgttcgggcgcgcgccgaagaagagcgacaacaccaagtactacgagatcctcggggtgcccaagtcggcgtcccaggacgatctcaagaaagcctaccgcaaggctgctatcaagaaccaccccgacaagg

SEQ ID NO: 62858 - DNA, 150 bp, Zea mays
  Clone ID: LIB3075-044-Q1-K1-G10
ccttgaagagacctttggcgccgacgatggggcgcgaggtccctggcaacgcactgatgttcggcgtgtacgaaggcactaagcagtacctggccggtggcccggacacgtacgtccttggcaggggcgtccacgtccttgcaggcggtc

SEQ ID NO: 62859 - DNA, 277 bp, Zea mays
  Clone ID: LIB3075-044-Q1-K1-G12
tcgctggttcagacaaggtcacgaacacgctctctatcattgacagcggcatcggcatgaccaggtccgaccttgtcaacaaccggggtaccatcgccaggtccgggacgaaggagttcatggaagcccttgctgccggcgctgatgtgtccatgattggccagttcggcgtcgggttctactctgcctacctcgtcgccgatagagttgtcgtgaccaccaagcacaacgatgacgagcagtacgtgtgggagtccccagcgggcgggtcgttcac

SEQ ID NO: 62860 - DNA, 174 bp, Zea mays
  Clone ID: LIB3075-044-Q1-K1-G2
cccacgcgtgcgtggacgcgaaggtgaacgacaatgtcgtctacatcgacctggactacgagacggagatggacactgcttaggccaggtatagttttgagaagagctacgagctggctgacagacatgtgattaacatcggtgcttagcgctagggcttctctgaggtactct

SEQ ID NO: 62861 - DNA, 257 bp, Zea mays
  Clone ID: LIB3075-044-Q1-K1-E6
atcacgacaagatggcgtgcacaaacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggtgac

SEQ ID NO: 62862 - DNA, 263 bp, Zea mays
  Clone ID: LIB3075-044-Q1-K1-G3
ggccgcccttttttttttttttttagtaaggaacaggcttcactttttcgcttcactgttgcgaaatttcgttttgaacaaaagaaattgactttcatatttttaaaatgtgataccgggccgagaaatgcttcccctagctgaccgggaacgagaaattggccgaggaaccagacttttcggtcggtaattcgaaccatggataggagtgaccaagatgcgtgtgtgccgccacgatatcactcatgcagtcgaagcagtac

SEQ ID NO: 62863 - DNA, 289 bp, Zea mays
  unsure at all n locations
  Clone ID: LIB3075-044-Q1-K1-G4
ctgaagcgtgcagacttggaccactttgtggcctccgacgacgactcgccgcactcctcatcagactccccgacggcggactgctcttcacctgccgaggcagcggcggctcacgctcacgtctatcaccagcagcagcaagaggagcagcagaatgggggcaagcacaaaggcagctgggctcgaggacgagctggcacggcgaccaagctgcacatcacggcgccgcagagcccccagtcggctcccgcgggcatggccggcggncacttcgacccgaccagccccc

SEQ ID NO: 62864 - DNA, 272 bp, Zea mays
  Clone ID: LIB3075-044-Q1-K1-G5
agcaaacctgcagtcatctcctccaccaccaccaccaagctcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaacatccaggacgacttctgctcgacgctgtgcgagggcaagaaggggacggacctggtcgcgtgcaagga

SEQ ID NO: 62865 - DNA, 232 bp, Zea mays
  Clone ID: LIB3075-044-Q1-K1-G6
cttgtcccagacaaggccacgaacacgctcttcatcatcgacagcggctttcgcatgaccaggtgcgaccttggcaacaaccgtgcgaccatcgccaggtccgggacgaaggagttcatggaagcccttgctgccggcgctgatgtgtccatgattggccagttcggcgtcggcttctactgtgcctacctcgtggccgatagagttgtgccgaccaccaagcacaactatg

SEQ ID NO: 62866 - DNA, 275 bp, Zea mays
  Clone ID: LIB3075-044-Q1-K1-G7
ggctgggtatggagtggctttggcagtaaaagatatctacgctgatgcctttggagaaagaaatttgggctctaacgcttgtgggcctgatggtaaaggatggacgacaaggaaaggtgaatgccaaaggttactacatttatgagaagggtgcgaagccaaagccagaccctagtgttaagcatgtgatcgaggagtaccgaaagcaggcaaacacaatgcctggtggaaagcctgttactttaatggatcaagatattttggagatgattttc

SEQ ID NO: 62867 - DNA, 267 bp, Zea mays
  Clone ID: LIB3075-044-Q1-K1-C2
atcggtcaaagacaaaagatgattgctgtgagcatcatgtggtcattagtgcacgtgcaggtgctggcggcgatggcactagcatttctggtaggcggtgcctggtgtggtcctcccaaggttcccccgggtaagaacatcacagccaactatggtagtgattggctagatgccaaggcaacatggtatggcaagccaacaggtgccggcccggacgacaatggtggcggatgtgggtacaaagacgtgaacaaggccccttttaac

SEQ ID NO: 62868 - DNA, 314 bp, Zea mays
  Clone ID: LIB3075-044-Q1-K1-C3
agacaaaacatggctgtgaatgtgagaaccatgtggtcgtcgatgcgggcacaggttgcgatggttgtggcgttggtgttcttggtgagcggcgcatggtgcggtcctcccaaagtccccccaggcaagaacatcacggccacctatggcaaggactggctggacgctaaagcgacatggtatggcaagccgacgggtgccggtcccgacgataacggaggcgggtgggggtacaaagacgtgaacaagccccccttcaatagcatgggcgcatgcggcaacattcccatctttaaagatggtctggggtgggg

SEQ ID NO: 62869 - DNA, 284 bp, Zea mays
  Clone ID: LIB3075-044-Q1-K1-C4
cccacgcgtccgaaacgtcagtcatgttatccacgagctctcatttggcccaaagtatccaggaattgacaacccactggatgatacttcaaggatacttcatgacacaagtggaaccttcaaatactatatcaaggttgttccgactgagtacaaatatctgtcaaagaaaatattgccaacaaatcagtattctgtcacggagtattttcttaccattcgcccaactgaaagggcctggccagcggtttacttcctgtatgatctctcaccaattacagtca

SEQ ID NO: 62870 - DNA, 143 bp, Zea mays
  Clone ID: LIB3075-044-Q1-K1-C5
gatcctcaacaacgaggagtgcttcatcctgaagctggaggctggcgccgcgacgctgcgggcgcggagcgctccggcgttcgacatcatccaccacacggtttggggctacttcagccagcgcacggggctgctcattcagc

SEQ ID NO: 62871 - DNA, 220 bp, Zea mays
  unsure at all n locations
  Clone ID: LIB3075-044-Q1-K1-C6
tcgatttcgaatttcacccagctccgcacgcgcctcaaccctttctctcnggcggcggcgccggcaaggcggcagccaaccggagcgggagctgcgatgaagaagatcttcggcgccaagaaggacaaggggccgcccccctccattcaggacgccaccgagcgaataaacaaacggggtgagacggtggacgagaagatcaagaagctggacgaggagc

SEQ ID NO: 62872 - DNA, 357 bp, Zea mays
  Clone ID: LIB3075-044-Q1-K1-C7
catgaaccctgaaaagtatgccgaagcagaatctgagtttcgagagttgaaagcagacagtgaggaggctactaagaagtttgaacacatagttagactaatgaatgaagagcttgctcgtttccaggagcaaaagacagctgatattggactcgcattccatgaatttgccaagggtcaggctaagctagctaaagacattgcggatgcatggcgcagcgtcctcccaaagctcgaagcttgttccacatcataaatgtgatttgtgtttcctcatgatgtttgggaatgggataggggggtggcaacttgtgagtttaggctttttttttccagcctggtttgacaactgatact

SEQ ID NO: 62873 - DNA, 232 bp, Zea mays
  Clone ID: LIB3075-044-Q1-K1-C8
cggacgcgtgggtgagaggacatgggagcataggagtgctgttggtgggacctgattgctaccgagtgtccagaaaggtttgcagaatttcagttggagtcaggctcgtgggctgaattcccatcagcagaagtttggcaacggtgtgttgattgtgagcaataatgagggtgcacaccgcaacaacggagcagtggacagccctagcgcagcgcagtttcagcttcaaaag

SEQ ID NO: 62874 - DNA, 217 bp, Zea mays
  Clone ID: LIB3075-044-Q1-K1-C9
cacccttcctgctccggcctctggctcggacacctgcgctcgccctcgtgcggacggagccgacagcggcaacgacggatgccgggcttcgccggcctctcaatgcagcagcagtcggagcctgccgatccggcgggccgggccttaccgccaccggcggtgccggcgccggcgccttgtgtcgcgcgcgcggtgcaccaccgccgggctagatctg

SEQ ID NO: 62875 - DNA, 165 bp, Zea mays
  Clone ID: LIB3075-044-Q1-K1-D1
gacgacgacgacgaaagtggtgaggacgttgactgacagtggtggcgtttgagaattcaggtgtggataccccgcaagatgatggataaccgcgttcgagtgttcaagtattgatatggataccgcaagaagttactaggagagatgctgcagccttttgggttt

SEQ ID NO: 62876 - DNA, 354 bp, Zea mays
  Clone ID: LIB3075-044-Q1-K1-D10
atgagccgcttgaggacgggcgcacgctggccgactacaacatccagaaggagagcaccctccacttggtgctgcgcctcaggggaggcatgcacatcttcgtgaagaccctgactggcaagactatcaccctcgaggtggagtcttcagacaccatcgacaacgtcaaggccaagatccaggacaaggagggcatcccaccggaccagcagcgtttgatcttcgctggcaagcagctggaagatggccgcacccttgcggattacaacatccaaaaggagagcacccttcaccttgtgcttccgtttaagggtggcatgcagatctttgtgaagacacttactggcaagacaa

SEQ ID NO: 62877 - DNA, 255 bp, Zea mays
  Clone ID: LIB3075-044-Q1-K1-D12
tcgggaagttcactgagactgtggaacttcagattggtatgaagaattatgatccacagaaggacaagcgtttcagtggctctgttaagttgccccatatccctcgtcccaagatgaaggtgtgcatgcttggtgatgcccagcatgttgaggaggccgagaagatgggacttgactacatggatgttgaggctctcaagaaaatgaacaagaacaagaagcttgttaagaggcttgccaagaagtaccatgctt

SEQ ID NO: 62878 - DNA, 247 bp, Zea mays
  Clone ID: LIB3075-044-Q1-K1-D2
accacgaacgctgttgtgtcatggagtgccgccaacaatagctttgttttgggatcctcatatctttggcacggtgctgctgccaaggtacttcaagcacaacaacttctccagctttgttcggcagctcaatacttatggcttcagaaaggtggatcctgacagatgggaatttgctaatgaggagtttctgagaggtcagaggcacctcctcaaaaacattaagcgtcggaaacctccacactca

SEQ ID NO: 62879 - DNA, 326 bp, Zea mays
  Clone ID: LIB3075-044-Q1-K1-D3
aatttacctgtgaagcaatcttttcatattctgcatgaacaggggattcctgtagctcctctctgggactcattcagaggtcaatttgtcggccttctgagcccattggatttcatacttatattgcgggagctagaaactcatggctcgaacttgacagaagatcagcttgaaacacacactatatctgcatggaaagaggctaagcggcaaacttgtggaagaaatgatggtcagtggcgagcacatcagcatctagtgcatgccaccccttatgagtccttgagggacattgcagtaaagcttttggtaaatgacatttttac

SEQ ID NO: 62880 - DNA, 221 bp, Zea mays
  unsure at all n locations
  Clone ID: LIB3075-044-Q1-K1-D4
cccacgcgtncgcccacgcgttcgaatttctctgtcttaagcacctgatcgttcgcttgtcattaggaacaaccattacccaggcatttgactatttctctttggtttctttccttgatgcgtctccttccttggagacttttatattaaatgtaaggtgttggcactgtcaattcattcggtcctgtaaattcatcttaccattctgtccatttagctta

SEQ ID NO: 62881 - DNA, 214 bp, Zea mays
  Clone ID: LIB3075-044-Q1-K1-D5
gcgaattctgtgcctcgtgtgggaagatatcttttatactttgatattggaaaaggcacttagtgatcgggaaagatgcccgccgagttgataatctatgccaacgcatttatttgagttacaggctattagagggaactagccactttaaagaattgcatgagattattgaagatgcaaaagcaaacattggaaagtgaggttgggccacttt

SEQ ID NO: 62882 - DNA, 215 bp, Zea mays
  Clone ID: LIB3075-044-Q1-K1-D6
gttctctcgggcatgcgagcgtggcggcggttccctcgggcgtgcaagcggtggtgatcccgagggccaacggcggtgccgccctgaggcaggcgacaggcggtggcgttccaccgggatcaagcgacggtgacgctcccggggcatgcgggcaagcatcatcgtcgctcccgaatcggacgagttgcagcggcgcaccccagacccagcggcaa

SEQ ID NO: 62883 - DNA, 293 bp, Zea mays
  Clone ID: LIB3075-044-Q1-K1-D9
aatgtgagaggcactcacatggttaagcaaaattaaaggcgcagtttgtgttaccaaatgcaagaaagaaagtaaagaaagcgctggcaagtgatgatgagactaaaagtgctgataaaagtccactatatcaagagtctgccgattgtagtttagcgacatcttctaatgatggtggtaatggaagttctagtgtgaatatgctacataagactaagatcatgacgcacctgaaaagcgtaagaccacgttcatggagataggatacaaggcctacaacaagcgtattggac

SEQ ID NO: 62884 - DNA, 247 bp, Zea mays
  Clone ID: LIB3075-044-Q1-K1-E1
ccatcccctcggctttgtggccaagccggcgatgctgccggatggttctgtcaatctcatgctctggaactgcgtcgtccccggcaaggaaggcactgattgggaaggtggatatttcccggtcactctccatttcactgaaaattacccaagtaaccccccaacctgcaagttcccacgaaggtttttccatgtcaatgtctatgattctggggatgtatgcctgtcaatacttggggatgcatgg

SEQ ID NO: 62885 - DNA, 302 bp, Zea mays
  unsure at all n locations
  Clone ID: LIB3075-044-Q1-K1-E10
acatcttacagcattatgtttggaccagatatctgtgggtacagcaccaagaaggttcacactatcctgaccaaggatggcaagaaccacttgatcaagaaggatgtgccttgtgagactgatcagttgactcatgtttacactttgatcatccgtcctgatgcaacatacagcattctcattgataatgaagagaagcaaactggcagcatctacgagcactgngatattcttcccctaagaaaatcaggacccagaggctaagaagcctgaggactgggatgacaaggagtacattcctg

SEQ ID NO: 62886 - DNA, 285 bp, Zea mays
  Clone ID: LIB3075-044-Q1-K1-C12
cgtccagaagcggttcaaagctgaccccggcaccgccgccggcctcctccgcctcgtcttccacgactgcttcgcaaacggctgcgacgcgtccatcctgatcgacccgatgtcgaaccaggcctccgagaaggaggccggccccaacgtctccgtgaagggctacgacgtgatcgaggagatcaagaccgagctggagaagaagtgcccgaacgtggtgtcgtgcgcggacatcatctccgtgagcgcccgcgactcggtgaaactgacgggcgggcccgagta

SEQ ID NO: 62887 - DNA, 305 bp, Zea mays
  Clone ID: LIB3075-044-Q1-K1-E11
cccacgcgtacgcccacgcgtccgcccacgcgtgcggtggacggagatgaagcgcaactgggggcaagtgtggcagaccggggaggaccttacctgcgagtagctgacgttacgggtgatgaccagcgaccaccgtaaggccacctcatggcacgttcttcccgctgactggaagttaggtgtcacgtaccacgcatgcaacaacttgtaacatttgagaacaagtttccaacattggcgcccacctttagtgaacttacttccacttgtgatctgatggctatgttcaacaaccaacgtgtagc

SEQ ID NO: 62888 - DNA, 416 bp, Zea mays
  unsure at all n locations
  Clone ID: LIB3075-044-Q1-K1-E12
cctcttagccaacctattagctgtccaacacctatttagggctgcgagccagaggaagaagtggcatttggagggggcccaagttccccaaatcttttcatagtgtccgaaggagacagaaccagtaaacaatccttcataggcagctttagctgaataaaccccattagcagcaatactgaaaatatgattatcctccacattgggatgcaacacaaattctgaaagcagattccaaaggtgaagataatccattaagaccccaacagatattactttcattaccttggaagtataattagtgggtgcatggattatgctctnttgaggtttaagctaaactattgttattgataaaataagttaaaccaaaatattgtactagcatgagtcatggttaataacatttctttttt

SEQ ID NO: 62889 - DNA, 112 bp, Zea mays
  Clone ID: LIB3075-044-Q1-K1-E3
ctactacgtaccacggtacggataatgggtacgtagctacatgaagctgtctacggataatgccgtccatttactcccctcacatgttttaaattttagtttcgcttctttc

SEQ ID NO: 62890 - DNA, 226 bp, Zea mays
  Clone ID: LIB3075-044-Q1-K1-E4
gtgtagggttctctgatcattcgttcgccacctcggcccaagacgtctcgctagggtttcgccacagccgccgccatgccttgccgcaagcttaggaaggtccgcggctgacgcccggctccacatgctggtccagtgaggaacccaccacagcctgcgcgctaggctcgttctacagctactgttcgtgatggtggtggtggctccattcttggaggaattgggt

SEQ ID NO: 62891 - DNA, 241 bp, Zea mays
  Clone ID: LIB3075-044-Q1-K1-E5
agggcatccctccagaccagcagcggctcatctttgctgggaagcagcttgaggacgggcgcacgcttgccgactacaacatgcagaaggagagcaccctccacttggtgctgcgcctcaggggaggcatgcacatcttcgtgaagaccctgaccggcaaaactatcaccctcgaggtggagtcttcagacaccatcgacaacgtcaaggccaagatccaggacaaggagggcattccccc

SEQ ID NO: 62892 - DNA, 469 bp, Zea mays
  Clone ID: LIB3075-009-Q1-K1-D8
tcgcggacgcgtgggttcgagatcaagtgcgataagcctgtggagtgctccggcaagcccgtggtggtgcacatcacggacatgaactatgagcctatcgcggcgtaccacttcgatttagcaggcacggcgttcggcgccatggccaagaagggcgaggaggagaagctgcgcaaggcgggcatcatcgacatgcagttccgaagggttaagtgcaagtacgactccaaggtcaccttccaccttgaaaaggggtgcggccccaactacctggcactgctggtcaagtacgtcgacggcgacggtgacattgtggcagtggacgtcaaggagaagggctccgacacgtacgagcctctgaagcactcctggggcgccatctggaggaaggacagcgacaaaccgcttaagggacccctcaccgtccgcctcactaccgagggaggcaccaagtccgtctacgacgatg

SEQ ID NO: 62893 - DNA, 272 bp, Zea mays
  Clone ID: LIB3075-009-Q1-K1-D9
ctgctatgtaataagtactttgatgttattgtgacatttatctctatacactctgttattatatgtgttgtcttctttcacgcatatatgagatgcacccggcttgtcccttaaattcgggtgtgacagcgcagtcagcgcaactctagtttaggagaaacacaaagatggagtggaaaaaaaaaaaaaaaaaaaaaaaaaaaaaaaaaaaaaaaagggcggccgatataaaagaaaaaaaaattacgtccgcgtgcgtggggggccctatc

SEQ ID NO: 62894 - DNA, 459 bp, Zea mays
  Clone ID: LIB3075-009-Q1-K1-E1
tcgaccttcccaagctagtcgaaggtttgaagcgtctagcaaagtccgatcctatggttctctgtacaatggaagaatctggtgagcatatcattgctggagctggtgagcttcatcttgagatttgcctgaaggatctgcaggaggacttcatgggtggtgctgaaattattgtttccccacccgtcgtctccttccgtgaaacggttcttgagaagtcctgccgtactgtcatgagcaagtctcccaacaagcacaaccgtctgtacatggaagcgcgccccttggaggagggtctcgctgaggccatcgatgacggccgtattggcccacgtgatgatccgaaggtgcgctcccagatcctctctcaggagtttgggtgggacaaggacctggccaagaagatttggtgttttggacctgagaccactggcccgaacatggttgtagatatgtgca

SEQ ID NO: 62895 - DNA, 406 bp, Zea mays
  Clone ID: LIB3075-009-Q1-K1-E11
gagctgaagcgaagagcagcggcgcaaaggatagggagccatgctcgcctcgccggcgctcgccggcgcccactccttcgcggcgtccgtgtatagaaacatcctcgttccctcgcctcccgtccccgcgccggcacgtcgcgcggcgctgtccgtcgtcgccaaggtcaaggtggccacgccccaggacgaccgcatcgcccgccacgtccgcctgcgcaagaaggtaagtggcaccactgagaggccgaggttgagtgttttccgctcaaacaaacatctgtacgctcaagtcatcgacgacacaaagcaatgtactctggcttcagcttcaaccatgcacaaatctctctccaaagaatttgaatactcggctgggccaacgatcgaaatagcacaaaagatc

SEQ ID NO: 62896 - DNA, 422 bp, Zea mays
  Clone ID: LIB3075-009-Q1-K1-E12
aaagaagtcgcctaattctttcgatcgaattatgcgccttcttcgtcccacgctccgtctgtatttgtaatctgaagcttacaggaacatttgagtggatcatggacggattggtaggcctcttgaaagtccgggtggtgaggggcatcaaccttgcctaccgcgacgcaagaggcagcgatccgtatgtcgtcctacgacttggcaagaagaaacttaagacgagcgtgaagaagagatctgtgaaccccatctggcacgaggagctaactctgaccgtcacagatcccagcctagctctgaagctggaggtgttcgacaaggacacgttcagcagggacgacccgatgggggacgcggagatcgacgtggcgccgctggtggaggcggcgaacgcgagcccggaggcgagcctgaggaac

SEQ ID NO: 62897 - DNA, 466 bp, Zea mays
  Clone ID: LIB3075-009-Q1-K1-E2
cccactcgtccggagctgatcaaggggataacgctcggtaacaaagacaaattccagcttacgcctctgccccagcaagttcttgtgttatggggagagcacgatcagatattccctgtcgagaaggcatttgaagtggcaagggaacttggcgcaaatgctaggttggaggtgctcgaggacaccggccacatgccccaggaagaggatccgaagcggttcaacgaggccatcctcaacttcttgcttccagctccagagtcgtctttgtaacgcgatgtggaagctattcaggtccaaggatcaccgggagagttcataatttaagatgtattctgcctgattgatgcagttatttgttggctcgatatcacttccaaggttgatggaatcagtaattaaatatgttattatggggattactatttatctgtcaacagatttcttcccccaatgaatgcttgca

SEQ ID NO: 62898 - DNA, 339 bp, Zea mays
  Clone ID: LIB3075-009-Q1-K1-E3
tcgaatccgaacccgccagctctacaccaccctttgttctgacggcgacggaccccgcgccggggccggctatgctctgctactcgctgccgccggtccggctgcccgcggaggacattctcttctgcgttgacgttgacctcgaggcccgcgccgagatgaattccgccgtcttctccgcatcagcgtcctctggctccacctagaccgcttcaccggatccgacgcagccctgggaggccgggggttcccaagcggcggtgccccggaccgcggtcaggcggacggactcggtcaggcaggcgctgttgctgatcgtccacagcaagctcaccatgt

SEQ ID NO: 62899 - DNA, 445 bp, Zea mays
  Clone ID: LIB3075-009-Q1-K1-E4
tcgattgggagcttcctcctgttgccggcccatccttaacacaccaaacaaggtatgacccatcacgtacagttgacccaatcatcgaagatggtcgctacggcttgttccgaaagaccggtctagcgaggttggacgcctcggtgttcaatggttacactcagatggcatatgtgcagatatcaggttcaatgttgagcacggacgatgtttaaagatttttcgtgggtgagcttgtttcgtttttggccaactgttgataggctttttgtacaacactgatgcgcttctatgcttacttagtttcttttaaccttccagaaattaatatttaccagaccacctttcaaatatttatgagggttgtgtttcttgggtaaagtcacttttctgtgaaatttggttctgaataatcacatgtacttctagggccaaaaaaataaat

SEQ ID NO: 62900 - DNA, 438 bp, Zea mays
  Clone ID: LIB3075-009-Q1-K1-E5
aaggacggcaagggctgcggctcatgctacgaggtgagatgcaaggaaaaacctgagtgctcgggcaatccagtcacggtgtacatcactgacatgaactacgagcctatcgctccctaccacttcgacttgagcggcaaggccttcggctccctggcaaagcccgggctcaacgacaagattcgccactgcggcatcatggacgtcgagttcagaagggtgcgatgcaagtaccccgccgggcagaagatcgtgttccacatcgagaagggctgcaaccccaactacctggccgtgctggtgaagtatgtggcggacgacggcgacatcgtgctgatggaaatccaggacaagttgtcggctgagtggaagcccatgaagctctcttggggcgccatctggaggatggacactgccaaggcgctcaagggccccttc

SEQ ID NO: 62901 - DNA, 413 bp, Zea mays
  Clone ID: LIB3075-009-Q1-K1-E6
gagcaaactatctatcagtagtactagcagtgtcgtttcgtcttggtctgtcgtggcgtggtagtaagaaatgcaagtgagcagcaccagtatctttccgtttgaatcagttgtaaggcagtcatggtcatggttggctctgccggatctatctgtcatgaactatctatattatatcattatcaacgttgaaatatatatacttcatagactcgataggttccgatgcacgtaccctgacggtcagaatatcgcgtcccacatctacaaaggctgcatgctcatgtacccgtgcatgctggtgtagcatgctgcgatacgaccgctatcgttcgcttctggaagtacagctcaactagctctctcattggaagcccatgacgttctctagattagccgtccggacgatgtac

SEQ ID NO: 62902 - DNA, 425 bp, Zea mays
  Clone ID: LIB3075-009-Q1-K1-E7
cgcccttttcctccgacatccacaaggggggaggggaaaacacgtacattcacccggcggcaataatggcctcggttccggctccggcgacgacgaccgccgccgtcatcctatgcctatgcgtcgtcctctcctgtgccgcggctgacgacccgaacctccccgactacgtcatccagggccgcgtgtactgcgacacctgccgcgccgggttcgtgaccaacgtcaccgagtacatcgcgggcgccaaggtgaggctggagtgcaagcacttcggcaccggcaagctcgagcgcgccatcgacggggtcaccgacgcgaccggcacctacacgatcgagctcaaggacagccacgaggaggacatctgccaggtggtgctggtggccagcccgcgcaaggactgcgacgaggtccaggcgctc

SEQ ID NO: 62903 - DNA, 462 bp, Zea mays
  Clone ID: LIB3075-009-Q1-K1-E8
cccaagaacaacaaaaaaggatcgaggaagataggctcaaaagagcataagttggattgttctcggcctcaccggaccaggtccgtagaggcctggcgcaccagaccggagccttgtgcaccgggctaccagtatggtcgaacctcgtagtcttgggaattttattataaaattcaccggattgtctacagtaaccggtcggtggtgcaccggaccctctccaacggctatcttccaatgggcgcgcactggccaacggctagctaacgtggcatccagtccgaaggtgcaccagactggtccagtgcccgtcagctatggaaaccgcccaatcatatcacaaactcagggcatgtggatctggttcagtggcgcatcgaatcagtccggtgcccccacaggcaaccagtttttaacatctttttagaaggggcaataaatatggggcctttgggtctacaa

SEQ ID NO: 62904 - DNA, 443 bp, Zea mays
  Clone ID: LIB3075-009-Q1-K1-E9
cccagataaatgtttcgcactatgtgacacagttctcatttggcaaaagactttccccaaggatgttgcatgaattcataagacttactccctatcttcgtggataccatgatagactagctggccagtcttatactgttaagcatggtgaggttaacgccaatgttactattgagcactacctacaagttgtaaagactgagcttgtaacacagaggtcctcaaaggaactgaaagtgcttgaggaatacgaatacacagcacacagcagcttggtgcacagcttctatgttcctgttgtgaaattccattttgagccttctcccatgcaggtcttggtaactgaagtcccgaaatccttctcccatttcatcacaaatgtctgcgctatcatcggtggggtcttcacggttgctggaatactggattccatctttcacaac

SEQ ID NO: 62905 - DNA, 461 bp, Zea mays
  Clone ID: LIB3075-009-Q1-K1-F1
attcactaatccaagacaaaacatggctgtgaatgtgagaaccatgtggtcgtcgatgcgggcacatgttgcgatggctgtggcgttggtgttcttggtgagcggcgcatggtgcggtcctcccaaagtccccccaggcaagaacatcacggccacctatggcaaggactggttggacgctaaagcgacatggtatggcaagccgacgggtgccggtcccgacgacaacggtggcggctgcgggtacaaggacgtgaacaagccccccttcaatagcatgggcgcatgcggcaacatccccatcttcaaggatggtctgggttgtgggtcctgcttcgagatcaagtgcgataagcctgtggagtgctccggcaagcccgtggtggtgcacatcacggacatgaactatgagcctatcgcggcgtaccacttcgatttagcaggcacggcgttcggcgcca

SEQ ID NO: 62906 - DNA, 442 bp, Zea mays
  Clone ID: LIB3075-009-Q1-K1-D7
tcgcgcctacgtgtttctcgtcgtgctcctcctgtccgctgtcatcgtggcaccgttcgcgggagcgactcgtgtcgacgtcgttgagggcaggtccatggcgtccgccgactcgccggaggccgtcgcaccatcacccgggcctgactccgcctcgtcaccggactcctcgtcggatgcgccctccagcagcagctcctcggactagatagctagccgctcgacgcacgatctcgctctccatctacacggcgatcgagttctagctttgtcggcatgcaatgcaaaattccgattcttcgggaataatcaagcaccaaaggaatgtgcttgcatcactcactactagtaccttgtttttatatatgtttcctctcctgacgctctccgattttaatcttcatgtatgcaacatatgtgatgaatggaaaaatcgatttgt

SEQ ID NO: 62907 - DNA, 459 bp, Zea mays
  Clone ID: LIB3075-009-Q1-K1-C3
ctgaaccacaccagtaaaagcatcgtgttcttgtcgcaggcggcagagagagaaattgagaagagagggatgggcgaggaactccaccacgccaccgcaaccactcgctgcgccgtcgccatagggcttcacgtgcgggctcgctcgagacagtggatccagcgcgggattccgttggaattcggtcggttcatcgcggagcatcgaaggagagggcatcgtcgcaattcaccccgtgccatggccaaagacctccgcgccattattcctggcgcgaagacacgtgtcatctgaaaggcaagttggtacctggaatctcaagtcccaggcaagttgtgcccttgaccacttcttacccaataatgttctttgatgtcacatgttcatgcataggtttaattttgatggaacccaataagttactctagattgtttatcccattaccttgtttacccctg

SEQ ID NO: 62908 - DNA, 467 bp, Zea mays
  Clone ID: LIB3075-009-Q1-K1-C4
gtcgtggacagcatgactgacaacctcagacctactctcgcagaggcaactgatgtggcaaatgcagttcttgatgggagtgtcgccattctccttggtgctgagactctccgtggtttatatccggtggagactatttcaacagtgggcagaatttgtgctgaggcagagaaggtatttaaccaagatttatactacaagcggactgtgaagtatgtgggagaacctatgacccacttggagtctattgcttcttcagcagtgcgagctgcaatcaaagttaaggcatcagtcatcatttgcttcacctcttctggacgagctgcaaggctcattgctaagtacaggcccatcatgcctgttctatctgttgtcattcctcgtctaaagacaaaccaactgaagtggagtttcacaggtgcttttgaggcatgacaatcactcatagttagaggcctcttacctat

SEQ ID NO: 62909 - DNA, 449 bp, Zea mays
  Clone ID: LIB3075-009-Q1-K1-C5
ggcaagattgaaactgagctcaccaagatctgtgatggcatcctcaagcttctcgaatctcaccttgtgccgtcttccaccgctcccgagtccaaggtcttctatctcaagatgaagggtgactactacagataccttgctgagttcaagactggagctgagagaaaggacgctgctgagaacaccatggtggcatacaaggctgcccaggacattgctttggctgagcttgctccaactcaccctattaggcttggactggcactcaacttctcagtgttctactatgagattctcaactcacccgatcgcgcctgcagtcttgcaaagcaggcttttgacgaggccatctcggaactggacaccctgagcgaggagtcctacaaggacagcactttgatcatgcagctccttcgtgataacttgaccctatggacttctgacatctc

SEQ ID NO: 62910 - DNA, 463 bp, Zea mays
  Clone ID: LIB3075-009-Q1-K1-C6
ctcacagcgataatttggcgaactatggaaagttatgccgtgaaagaacacataagttcatggttaaatctagacaagtgcaggtacttgacaatgaccatggaatgagcatgaggccaatgcctgtcattgttggtctcatatcttctagttcaaaggaaaagaagaagcatgcaccagtgaaaccatctgatgccaaaagaactcgtagggatcgcacggagatggaaaacgttatattcaagctttttgaaaggcagtccaattgggccctaaaggcactcgtgcaagaaactgaccatccagagcaattcctgaaggagatattgaacgatctgtgtgcgtataataaacgaggttcaaaccagtgaacgcatgatctcaagcctgagtacaagaaatccacaggggacactgatactgcttgaagatgagagacgactaggtagaatcgatagttctc

SEQ ID NO: 62911 - DNA, 454 bp, Zea mays
  unsure at all n locations
  Clone ID: LIB3075-009-Q1-K1-C7
cccattcacattcggccattctccaccgtccaaccaaccaccggcggcggcacaagggaagcgaagaggaatcaacgcgatgtctgcgaccacggcggcggtgcccttctggcgggcggccgggatgacctacatcggctactccaacatctgcgctgcgctggtacggaactgcctcaaggagcccttcaagtccgaggccgcgtcccgcgagaaggtccatttctccatctccaagtggacggatggcaaacaggagaagcccactgtccgcacagaatccgatgaataaagctctggtgccatagtggcatagtccttgctacagatgatttgaagtgttgttgcaagtttcctgaacatgctatttagctggcttgattttatagtcaatgctgaataataaatactttttacgacaattgtctntttcgttgctaattgcactcgccct

SEQ ID NO: 62912 - DNA, 442 bp, Zea mays
  Clone ID: LIB3075-009-Q1-K1-C8
gaggtgtcaagaggagcaggtcggcgcatggctgccgaaggaaaaagcggaggcggagatgtcggatttgcaagaggagaggccgcagagcagcgaggtcgtggagacagaaacgggggcccatgagcgcacggacgatggctcaccggccgtcgttggagaagcagcagcaacacctgagggagaagatgagcttgcaaccagcgcggcagaagagaagatcgtcgaggagatccagcgagcagaggcgactgagaactcgaaggcgaacgcgaaccctgaggaaccagaccaagaaaccggcgtgatctccgaagaacccaaggagggaacgagcgtggtctctgaagaaccaaaaccaaaggaggcagctgatcctaccactgcgcagaagcgcgaggaggcgttcgacgagccaaaaacggctgccggatcgaacgcg

SEQ ID NO: 62913 - DNA, 453 bp, Zea mays
  Clone ID: LIB3075-009-Q1-K1-D1
ggctcaccgaggcatacaaccatcgacggggcaacatgcctgaaagatcaactaagtcacttatgagtagatgggataccataaaaacacaatgctcactattttctggctacatggcaaatgtcctacgagagaactctagtgggttgtccgacgctgataagacatctctagcagcttctcgatttgctactatggagaagcgcccattcactcttttgcattgttggtctattctaaaggatgaaccaaagtggatggatcatagttccaataagcaagttcgaattattgaagttgcaccaattggatcgaacatcatcgacctagaccctaaagactcttttcttggtagcacaacatcaaagcaacatctaggtcaagatgcaagcaagggaaaaactaaaaaggctcgatcaagctcaatcactgtaagctcatcggatgaatatc

SEQ ID NO: 62914 - DNA, 201 bp, Zea mays
  Clone ID: LIB3075-009-Q1-K1-D10
ggccatttcatcgcagttggtctccaacggttctcctatttgatctcttatccgaccttctattctaaactctactctataggcaatgttgtctacggtgtaaaaacagtattttgtactctactctatatacagagttaatttgtactctactctatacagagttgtctacaatgtagaaacaatatcttatacggtcat

SEQ ID NO: 62915 - DNA, 446 bp, Zea mays
  Clone ID: LIB3075-009-Q1-K1-D11
caggacatgaagcccgccgctgctgcagtcgtcaaggtggtggctggtgactcgcctccctctgctgctagccctgctcctgcgccggcagtggccaacagcaatgggacgccacagaagccgcctcctattcctgcctctgccttcgacatgcccaagccaaacctgcggggccttaacaagcccaagtgcatcttgtgtggtaacatcgcccgctcccggtgcccattccagtgttgcaagagctgctgctacaaggctcagaatccttgccacatccatgttctgaagcagacaaacacattgccagataagccgtcacctgcaactgctcctgcaacaacagaacatcaatctaacaatttacctgcaaccagttcagcgtcaaggctggctgccttgcaaaagcttccccagcactttctgaagtttctgcaaacaaagaa

SEQ ID NO: 62916 - DNA, 347 bp, Zea mays
  Clone ID: LIB3075-009-Q1-K1-D12
gtggacagcctcgccgcatagccagagagctctgaagcgaccccgcgccggctggcggagctgttcgtgaacatcgcggccgagaagggatccgggatggccacgttcgtgcacgggaagtacaacaacgccaaggacagcaccgtgttcaagtgctacgacagctgctcggacgacgtcgaggaggccgtcgcccacctcaacggcctcgtgcgggagcccaccgacgccaagttcctggagctcaagtcgtggctctacttcacgctcggcggcacctacacctgcgaggacgcctgcaaggacctgcccaagaacggcgacaaggacgacgtcgtcaacttcag

SEQ ID NO: 62917 - DNA, 260 bp, Zea mays
  Clone ID: LIB3075-009-Q1-K1-D2
tcgtcgcgctggatacgtggttcctgctccaaaatatgattcgtctggtctggcgtgcgtgagtccagctcgtgtcgtgtgtgtctctgtgtgaggtgtcggcgggcgtgtgtatgtatggagtctgccgcggcggctgaggaggtgtgctcgtggtggtggtggtacgtgcttcgactctccactgtttgtcgcggcgatcatgtactaccctgctgcgttttctggttatcaatgagatgatttatttgattcttttc

SEQ ID NO: 62918 - DNA, 459 bp, Zea mays
  Clone ID: LIB3075-009-Q1-K1-D3
cggactcgtgggctcgtaggagagttcggcatggccggagacctgccgacttgatggagagttgatgcagatctgatctcgcagcatcgttgaggtagagcgtgctgataacgtgttgagaactacgttaccacggatcaccagatccgctcccttctcttccgtcagcagtagaggcgcaagaagatgtagagaacccgtctccattcccataagcacgacagaggaaacacacgagacactggatatagggttggacctctggcctctttctgatctctgtattatgagggggtgtacaggttccttatatagagatatgagacccctcatgggcaaagcaggtatttgcccacataaccctaattagggttacttaacaaatataacaaacaaatatcacgagaaagagggcatcactagtagaaaaaggctcaacacctgcgggacgatatattt

SEQ ID NO: 62919 - DNA, 449 bp, Zea mays
  Clone ID: LIB3075-009-Q1-K1-D4
tcgcgatgaggttgttgatcaagtgaaagaattattcacagaattctccactgatccaactactgctgatcagcttgttcaggcgaacccagctatttttactggatctgaggttcgtgtagaaaatgcagagtttcctctagcacacatcgcaatagctttcaaaggttcatcatggactgaccctagctccattccccttatggtgatccaaagcatattgggatcctggaacaggagcattggggttgggaactgctcagggtcttctttagctcgtggtatcagcaatgctaatttagctgagagcctgatggcgttcaatactaactatcgggacacaggaatatttggcatttatactattgctccgcctgacaccctgcaagacttgtcacggttaataatggcggagtttagaagacttgcatcccaggtgtcagaaacag

SEQ ID NO: 62920 - DNA, 460 bp, Zea mays
  Clone ID: LIB3075-009-Q1-K1-D6
cgctgttcgactgcatctcgcttcgcgtctccttgtcgggaaggggaggaggttgcgttgggggggaccgaagcgagatgccgctgtacgactgcatgctgctgctgaagacgacggtgaccagggaggtcctagcggaactggtgacgcggttggcgcgccgcgcatgccatcgcaacggggtcgtcaccgacgtcaagtcatccggccaggtcagcctcgcctacggcatcatgaagctcgacggccgtcacttccaggtccatcttatgcaaatgaccatgatggttcccccttcgttcccgcaagaactccactatctgaacaaggaggacaggctgcttcgctggctggtcgtgaagcacagagacacggtatacgggttggagttcttgaacgcggatggcggcagggacgagctgagaagtttcagccatggtcacacgaagggcgactacga

SEQ ID NO: 62921 - DNA, 454 bp, Zea mays
  Clone ID: LIB3075-009-Q1-K1-C2
cgcacggagagcaagcaagaaagcaaccaccgcactgccactacctaacaatggcccgcgcctacgtgtttctcgtcgtgctcctcctggccgctgtcatcgtggcaccgttcgcgggagcgacgcgtgtcgacgtcgttgagggcaggtccatggcgtccgccgacgcgccggaggccgccgcaccatcacccgggcctgactccgcctcgtcaccggactcctcgtcggatgcgccctccagcagcagctcctcggactagatagctagccgctcgacgcacgatctcgctctccatctacacggcgatcgagttctagctttgtcggcatgcaatgcaaaattccgattcttcgggaataatcaagcaccaaaggaatgtgcttgcatcactcactactagtaccttgtttttatatatgtttcctctcctgacgctctccgattttaatc

SEQ ID NO: 62922 - DNA, 284 bp, Zea mays
  Clone ID: LIB3075-009-Q1-K1-B10
ctggatattcttgaatcagatccagaagtttgagaagaagatcggcatataggattcccatcggacggatacagggttgaccgttctatgctattactgctggactctgtaataacattccagctgctttcgcaccatggtagttggttttggtagagacaagtctgttacaatttttttaccttagctttccaattattgtgtcgcaataatcgaattaattgttgctgggggattttttttggggggtgggtgggtggacatgcattttgtggctgggatgt

SEQ ID NO: 62923 - DNA, 447 bp, Zea mays
  Clone ID: LIB3075-009-Q1-K1-B11
cgggaaagtattgaatacacctgaggtttcacgtgtttatattggatcattcaatgacaaaccagtaaatgaatcagctgttggtccacttggaaaggaactatttgagagagagcaagatgatcttctttctgatctcaaagatatccccaagaaagcctgtgaccgccggatcaatgaatttgttaaacgtgctagagctgccaagatccatgcttatataataggtcatctaaagaaggagatgcctacaatgatgggcaaagcaaaagcccaacaacgactcatagacaatctgcctgatgagtttgcaaaggtgcaacgggaataccatcttccgtcgggagattttccttatgtggagcacttcaaagaggtcttgagcggttacagctttgacaagtttgagaaggtgaagcccaagatgatacaggccgtggatgatat

SEQ ID NO: 62924 - DNA, 319 bp, Zea mays
  Clone ID: LIB3075-009-Q1-K1-B12
cttttgtcctaatatcaatgaaattgtgcagcttgttggtaaagatgcgctggcagaatctgacaagattacgctggagacagcaaagcttttgagagaagattatttggcacaaaatgcattcaccccatatgataagttctgcccattctacaaatctgtttggatgatgcgcaacattattcacttcaacacattggcaaatcaagctgtggagcgggcagctggtactgacggccataagataacatacagtgtcataaagcatcgggtgggggatctattttatcggctaatattccaaaagtttgaagattct

SEQ ID NO: 62925 - DNA, 449 bp, Zea mays
  Clone ID: LIB3075-009-Q1-K1-B2
tcgctcgagtacatcaagaggaacgaggtggtgctcggcgccagcgactccatcaacgagttcggctgggacaacaagcacgccggcatcaacgtcctcatctcaaaggaggttctgatggggaaggacgagtacttccagtccttccgtgtcaacgccgacaacttcatgtgcaccctccttcccggcatctccaatcacccccagatccagtactccccaggcgggctgctgttcaaggtcgggagcagcaacatgcagcacgtgacgcagctgtcgttcctcctgctggcctactccaactacctgagccacgccggcgggcgcgtctcgtgcggctcgtcgtcggcgtcgccggtgcagctccgtcgcgtggccaagcggcaggtggactacatactgggcgacaacccgctgcggatgtcgtacatggtggggtacggcgcgcg

SEQ ID NO: 62926 - DNA, 453 bp, Zea mays
  Clone ID: LIB3075-009-Q1-K1-B3
aataatggctcgtgcatgtgtgttcctcgtcgtgctcctcctggccgccatcgcggtggcaccgttcgcgggcgccgcacgcgtggacgtcgtggagggtaggtccatggcattcgtcgatgcaccggaggcggctgccgatgctcccgctcctagccccgactccgcctcatccccagactcatcgtcagaggcgcccttcagcagcagctcctccgactagacgcaaaaacctcttcattctctggaataactaacagtatatacgttgcaccctgatgatatagaaacatgtacgtgcatcagtgtatggaatgcgagtggcaaacacatggaatgtgcttgcctaattattggttatttctttatttattatatgtctctctcggttgttttttatttttcttaatgcatgtaatataatttgttatacccaatatagacaatgtgtgc

SEQ ID NO: 62927 - DNA, 466 bp, Zea mays
  Clone ID: LIB3075-009-Q1-K1-B4
tcggtcgaaagcgcgtccatggcggttatagcgtcgacgctggactctctgttggacctgctgtcagggttcatactttggttcactgcgtacaagatgaaaaagccgaacaagtacaactatccaattgggaagaggcgcatgcagccagtgggaataatagttttcgcatcagtgatgggcacacttggcttccaagtgctgatcgaatcagggcgccagctcataactcaggagcacgcggatttcaagttcaagcaagagctctggatggtcattagcatgtcctctgttgcggtcgtgaagttcttcctcatgctctactgccgaacgttcaagaatgagatcgtgagggcctacgcccaggaccatttcttcgacgtaatcacaaactctgtcggcctggtctcggcgctgctcgctgtccggtacaaatggtggatggaccctgttggcgccatactga

SEQ ID NO: 62928 - DNA, 447 bp, Zea mays
  Clone ID: LIB3075-009-Q1-K1-B5
gggctccccaaatttgtccgatctgagggtgttcttgggctctacaagggaattgttcctctctggggtcgtcagattccttataccatgatgaagtttgcttcctttgagaccatcgttgagcttatctacaagcatgctgtgcctgttccgaagtctgagtgcagcaagactacccagttgggtattagctttgctggtggttacattgccggtgtcttctgtgctattgtttctcacccggctgacaaccttgtgtctttcctgaacaatgccaagggagctacagtgggagatgctgttaagaagcttggtctctggggtctcttcactagaggacttcctcttcgtatcgtcatgattggtacccttactggtgctcagtggggaatttacgatgcattcaaagtgatggttggactcccaacaacgggaggtgttacacct

SEQ ID NO: 62929 - DNA, 375 bp, Zea mays
  Clone ID: LIB3075-009-Q1-K1-B6
cggacgcgtgggtttttgatggtgacttgctttggttttcgatcggcaaacaaataacagtgtaggcagactttggcctagccgagcaagcaaatttcttccacgacaacagatccatgttcaaggaaccaaagaatgaatgtcagcattcttatttgcattggatcgaactatactatactaacaaggtggcaatgcctattcgtggccaatcatatgctatgctaccattcaaggcacaatgccttcacatctcgaatgctctactcctcgcacagggctacttcccccttctcttgtagaggcaagaggatgctccattggagatggcagtgctacattgtttctgggcggcgtgttggctgcttgaacctc

SEQ ID NO: 62930 - DNA, 420 bp, Zea mays
  Clone ID: LIB3075-009-Q1-K1-B7
cggacttccatagccgatgtgcatgtgatgtgcatggatctaagcccaaagaaacccaacaaggccagcgccagcgacggcggagcctactacgactggtcccccgccgatctgcccatgctcggcgttgcctccattggtgccgccaagctctgcctcaccgccggaggtcttgccctacccagctactccgactctgccaagatcgcctacgtcctccaaggcaaaggtatcttcggcgtggttctcccggaggcgaccaaggagaaggtcatctccgtcaaggaaggcgacgcgatggcgctccccttcggcgtcgtcacctggtggcacaacaacgccgacgccgctatctccgacctcgtggtgctcttcctcggcgacaccttcacgggccacaagccgggccagtttacaaac

SEQ ID NO: 62931 - DNA, 462 bp, Zea mays
  Clone ID: LIB3075-009-Q1-K1-B8
gagaacagaaacgatacggttaatagatatagcgaagaagggcagcaccaccagtagcagcagccatgcccgctcgcgctcgatggcgactcctcgcgctgccgctcgcgctcttactcgttgccgggtcggcgcatggcctcgtgaagccggaggcagccgcggcgcccaagccccccgtccccaaggccatatcggacctgagggacgcgatcgtgaaggggctgggattccaggccgaggggctcaaggtgtccgggttcgacgtgcgagacgcgctcgtggggcacgcggtggcgtacgagttcgacatcgaggtcggcaggaaggtcctaccggtgcgcctgctggaggacgtcagccggtgggacttcgtcgacctccccatcttccgttcccaggccgacgctgacgatacggcgctcgccgagatccggcgggccgggagggggagcatcgttg

SEQ ID NO: 62932 - DNA, 441 bp, Zea mays
  Clone ID: LIB3075-009-Q1-K1-B9
aacaagtgcaggaactcctcaggttgtaccactgcttatgaaagcaattggatggcaaggtggaagtatactggcattggagacattaaagcgtgtagttggtgctggtaatcgggctcgtgatgctcttgttgcacaggggcttaaggttggtcttgttgaagtactccttggtattcttgattggcgtgttggtggaagacaggggctctgtaatcaaatgaagtggaatgaatcagaggcttcaattggacgtgttttggctgtggaggtgcttcatgcttttgcaaccgaaggtgcacattgtgctagagttcgtgaagtcctgaattcctctgatgtatggagtgcttacaaagaccagaagcacgaccttttccttccatccaatgcacaatcttctgctgctggaattgctgggctcattgagagctcatcatc

SEQ ID NO: 62933 - DNA, 460 bp, Zea mays
  Clone ID: LIB3075-009-Q1-K1-C1
cgaatggatccaagcccccactctttgctggcatcatagcacttgtgatgagcatcgcaacgatggtccgtctgacccgcagcatgatgcctgggaaggttctcggtgctgccataggtggagctaccctctcagaaggtaaatcaaaagtacaagagcgccagcggtccaagctatcagaagaggctgtggaggaagctgaagacgccgtctctgcaaagcgcctctcggagcttgaggagaaggtcattgcactcctgacaaaacccgcatcaatgcctgctgataaggaggaggttctgcaggctgctgtctcccgcgttagtgcactggaagaggagcttgcagctacaaagaagaccttgcaggagactcttgagcgtcagttggagatcgttgcatacattgagaagaagaagaaaagcaagcgtttctttcgttggtagaagcaaacagcagt

SEQ ID NO: 62934 - DNA, 323 bp, Zea mays
  Clone ID: LIB3075-009-Q1-K1-C10
agaagcaaggttacaaaattattggttctcatagcggagtgaagatttgcagatggactaagtcgcagctgcgaggtcgtggagggtgttataagcactcattttacggcatagaaagtcacagatgcatggaagcaactccaagtttggcttgtgcaaataaatgtgtattttgttggagacatcacacaaatcctgttggaaagagctggaaatggaagatggatgaccctcttgacattgtgaatgctgcaattgaccagcatactaaaatggttaagcaaatgaaaggcgtaccaagagtaaagccagaaaaacttgac

SEQ ID NO: 62935 - DNA, 444 bp, Zea mays
  Clone ID: LIB3075-009-Q1-K1-C11
ggcgacttgatcgagtctcagaccgacatttcggaaactacccgcagcgcctctgtcgtgtatgggaaaagcgttgaggctgaggaggcgtacaggaacggttgccagtaccttcttggtcagtttgggcctccgttcgccacgctaaggcttgatttctccccaaccgtgcctttgccgtctcctgcttcgaaacctccgctccgagatattaggaagaacctcgaggacatgatttcgtcccgccgctcggctttgaacaaggcgacctcgtcggcagacgcccagctggaccctgttccagataagcttctgggggagatgcaggggctgttggcaaaagtcgacaggatgcttaccaggcctcatgctaatgctccttagccccgccaatctggagggttgtggctgtaacctattcggtagttaggcaactttggtgtc

SEQ ID NO: 62936 - DNA, 397 bp, Zea mays
  Clone ID: LIB3075-009-Q1-K1-C12
gcaaacctgcagtcatctcctccaccaccaccaccaagctcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaagcgaagaagatccaggacgacttctgctcgacgctgtgcgaaggcaagaaggggacggacctggtcgtgtgcaaggagtcctgcgctctctcccagcagtccaacctggtgctgtacggcaggatccagtgcaagggcaagtgcaccgagcagaaaggcatcacggcgccggccatgaaagtctgccaagaggagtgcgacaa

SEQ ID NO: 62937 - DNA, 416 bp, Zea mays
  Clone ID: LIB3075-009-Q1-K1-B1
cgcttcatctcatgcattttttttaccttttcctttcatcatttctacatatcagatcccataagatacagaacctagctagctactttaatttatacaaggaattacagttttcagttcaagcattcacctcaaaattggcttgacaaagttgacaacccgaggggagggcgaaaaaatagccccacagcttgtcgaaaagccaacatcatgggcaatgatgcaaccaaagaaaaaaaaagagtattccccatgcccttcacacaaatcgatcagcccatatccatctttagtcgaggattgtacaaacaatatctcgggaagagtcagatatcctagcagcctcagcgatcctgagagccatgatggatttgtatgctgcgagctctgcgtttgtcatgagagactgggctctg

SEQ ID NO: 62938 - DNA, 315 bp, Zea mays
  Clone ID: LIB3075-044-Q1-K1-A3
ctgctggggactggaccagggacagggagcaacaaagctgagtcctcctcctccatggcggtacggtggcggccgacgtttacaaaggcgagctgacgccgctgcagcggcacgtcgccttcttcgaccggaacaaggacggcgtcatctaccccgccgagacataccaagggttccgcgcgatcggggccggcgtcacgttgtctgccttcagctccgtcttcatcaacggcctccttggacccaagaccataccggtatatatgcatggcattggcatctctcccccctcaacaggcaacaccctcagcgaca

SEQ ID NO: 62939 - DNA, 262 bp, Zea mays
  Clone ID: LIB3075-044-Q1-K1-A4
ccgaaagtggtctgggagtactgtcaggattgtcaaacctatcttctttaagcttcaagcgaagtaatgctgttactgctgaaggaatgagagcctttgcaaatttagttaacttactaaatctcgaccttgaaggttgcctaaagattcatggtggccttattcatttaaaagatctgacaaagctcgagtcattgaatatgagatattgcaattatattgcggattcagatatcaaatatttaacagatctgacaaattt

SEQ ID NO: 62940 - DNA, 250 bp, Zea mays
  Clone ID: LIB3075-044-Q1-K1-A5
ggccgtcgagcgagcagtctcccaattccacccaataactaataacatctcctcgaacgccaggttccttggaccactatatccaggagcgacgaagtgatccacccgccagccatggagatgaagaaggtcctctgcgccgccctcgtcgccgccgcctcggccaccgccgtgctggcctcggtcgcctccgaggcgccctccgaggcgcccgccggcgcggccggtggtgcggctggccctagcgcaa

SEQ ID NO: 62941 - DNA, 245 bp, Zea mays
  unsure at all n locations
  Clone ID: LIB3075-044-Q1-K1-A6
cgcacgcatgatggctcctaccacctccttgctcgcgctcgtgttcctcttnctcctgcccgccgccgccgtngncgncccacccgctaccggcgacgctgccgccttcaacgtgacggagatcctcagccggtacccggagttcaagctcttcaacctcctcctcagcaagacccgcgtcgcgcgcgaggtgaaccgccggagcgccgtcaccgtgctggtcccggacaactcggccgtggact

SEQ ID NO: 62942 - DNA, 351 bp, Zea mays
  Clone ID: LIB3075-044-Q1-K1-A7
ccacgcgatcggagttgtgcgtgccttacaacgagattcagagcccgagcccgagccccagccccagaccaacgacgagaaaggacaatctgcggcggacctacccgaagtcggaggcagggcaaaaggcccgatcccccctccccgccggttgccgcgctcgtgccacggtgcgctagccccgtcgacgccggcggacagcgtgcactatgggttgctcctcctccgtgccagctagaaatactggagggctgaacactatcagcaacgatagctctccagacgccagttcaaaggacttgcgtgctaagttggtattgctgggagactcacgtgttgggaaaagttgca

SEQ ID NO: 62943 - DNA, 321 bp, Zea mays
  Clone ID: LIB3075-044-Q1-K1-A8
gcggcaaaacatatgaatgggtcggactgagccgccaacgaagcatcatgggtaaggtgaaaagatcgctgagccagttcacccctgctcaatgggacaaggatcagtggcatcctttcatggggccactgcggttcatccaagttctgttcctctgtgttgtcttcatgaccgtggagcttaacacattcttccttaagttttgcctgtggatccctccaaggaatcccttagtcgtgtacagattgatcctctggtggctgattgccatcccaaccatccgcgagtacaactcctacttacaagacagcaaaccggcga

SEQ ID NO: 62944 - DNA, 257 bp, Zea mays
  Clone ID: LIB3075-044-Q1-K1-A9
gcggcgctctcctcctcccggccgaagcaccttctgcgccccatcctgcggggtttggacgcctcagcgcgggccctggggcgggtggagccgcacgagttctccaagcccagcgagtacctgggcagctgggagcccgcggcggagcctcgggaggcgtgggcgcggctggaccggctgcgcaaggggtacgcgagcgaggtgcgggagctgcggcggcagtacgcctacgaggtgcaactgttgcaggccgagcg

SEQ ID NO: 62945 - DNA, 251 bp, Zea mays
  Clone ID: LIB3075-044-Q1-K1-B10
aaagagtttctgaggcaatcaagagttgttcgagtacgtctaattcagaactcaagtgctgttcccactacttgtcactttgctgaccaaaagaaggcaatcatggacaaaataaaacctctaattgatgcagccggcgcttctggtgtcaatattatgtgcttacaagaagcctggacaatgccttttgccttctgcacacgcgagaaaagatggtgtgaatttgctgaaccagctgatggagaatctac

SEQ ID NO: 62946 - DNA, 204 bp, Zea mays
  Clone ID: LIB3075-044-Q1-K1-B11
gagaacaagcttctcatcggctgagattgctgttagtgttgttcgtgtggccctgtcgttttttgtttgatcaacaacttcaccttttctcttgcctgggttagggcatacctttgtgggttgtttctgagtgcagtgttgttgctagcacctgacagtaatgaataacctgctgctacataaaggatactgttaattgttgtc

SEQ ID NO: 62947 - DNA, 221 bp, Zea mays
  Clone ID: LIB3075-044-Q1-K1-B12
gaaataattgggaataaatagttcgtgaatccctgaagcgtgcatatatatattcctgccaagataaaggtaatggagtcgtcacgcaggttccagccggccgtcatcctgcttctcctgctcattgtgtccaccgatatggcacaggcaagggaatgcgagaagtacagtgagcgatttgttggggcatgcatgatcgcagacaactgcgccaatgtgtg

SEQ ID NO: 62948 - DNA, 266 bp, Zea mays
  Clone ID: LIB3075-044-Q1-K1-B2
cgagatccagtccggcgttgaggaagctgaatcgctgattcggaagatggacctggaggcaaggagcctacagcctagcattaaggctggtttgcttgcaaagctgagggagtataaatctgacctcaacaacgtcaagagtgagctcaagaggatatctgcgcccaatgccaggcaggctacccgggaggagctcctggagtctggaatggctgatactctcgcggtgtctactgatcagaggggaagattgatgatgacaactg

SEQ ID NO: 62949 - DNA, 247 bp, Zea mays
  Clone ID: LIB3075-044-Q1-K1-B3
ggctagaggagaatgcagaggagcgtgagcgcgtcacagcgagtggaggagaggtcagccggcttaatctctgtggtggacaggaggtgggtcctctccgatgctggccaggtggattgtgcctttcaaggtcaattggggatactgatgtcggcgagttcatcgtaccgattccacatgtcaagcaagtgaagctcccaaatactggtggaagactaataattgcatcagatggaatatgggacgc

SEQ ID NO: 62950 - DNA, 214 bp, Zea mays
  Clone ID: LIB3075-044-Q1-K1-B4
attcaagcacctgctcttgccccgccaggcaacaactcagccgccgcaaccgccacatcaggcatgggcgcctgcgcaaccaagcccaagacgcttgaggggcaggccccacctgaggccgccgtctacacacccaagggtgcgcccgaggtcactccaatctccgatgaggttgcggctgatgaacaggtagctgagaacgtggtggtggagg

SEQ ID NO: 62951 - DNA, 291 bp, Zea mays
  unsure at all n locations
  Clone ID: LIB3075-044-Q1-K1-B5
cccacgcgtncggacgccgccgcccaaagaaagacgtcaactccaggagacaagatagtgagaactgaagagaaggatgggcttcgagaagcacatcctgagatccggcaccggccccaagccgataaagggccagaaggtcaccgttcactgcaccggctacgggaaggatcgtgatctgtccaagaaattttggagcaccaaggaccctgggcagcagccattcagtttcagcattggtcagggttcagtgatcaaaagatgggacgagggagttatgaccatgcaagt

SEQ ID NO: 62952 - DNA, 223 bp, Zea mays
  Clone ID: LIB3075-044-Q1-K1-B6
ccgtaagcaacatcggtgagtgaaggctggctggcgccctcgtaatgacgacggtctgatcctcacccgatgaacatgagtagattcaatatcataccatttgtttgtgtagggaatcgaaggctgtcgcgtaagacagttcggctaggccggatgacctgacggcttgacgaagagttggtgcagatccgatcccgtagcaacatcgagaaagagcgtgctg

SEQ ID NO: 62953 - DNA, 462 bp, Zea mays
  Clone ID: LIB3075-044-Q1-K1-A12
gaggagaaccagcagcctccaatattagtctttcagagaaactaataaaactctggccgccgccattcgagcgaacgagccaaccgatcccgttctcaaggcaatccgccgccgacgtaccaccaccaccgcatgatcgagatggaaatgaagaggatcctttttgccgatcttgttgttatcatcgcctttttcacctcaatgcttgccttcatctaagcctcccttactggtcccccaactttttttctatttgaatgatttgctttattttgtttttgcttttaattttatctttttttctttctcttttgttccttttcttttattagtgttaaatattttttattatttttttatagcatctatattttttttttattctatttttaaaattatggtctatcttttatattatatcttctttataatatttatatttttttagttttttctttttta

SEQ ID NO: 62954 - DNA, 238 bp, Zea mays
  unsure at all n locations
  Clone ID: LIB3075-044-Q1-K1-B7
cagaaagcaaacgcaaacaagaagcaaaccagcaatggcccgcgcctgcgtcttcctcgtcgtgctcctcctagccgccgtcgccatggcgccgttcgcgggcgcggcgcgcatcgacgtcgtcgagggcaggtccatggcgtccgcggacgcaccggaggccgncgncgacgctcccgctcctgctcctggccccgactcctcctcgaccccgtcgccggcaccctccagcagcagc

SEQ ID NO: 62955 - DNA, 242 bp, Zea mays
  Clone ID: LIB3075-044-Q1-K1-B8
gtggagcccgacgcacctgtggttctccacctgggcgttcctcctggggtcgctggccgcctacgtggcgctctgcctggccctggacgtggcgctggccctggccgcgcagcgcctgcgccggcgcctggcggttccgctgggccccgtgcccgcggcgcacgcgctgctgatggccggcgcgtcgtccgccatcttcgcggggacgctgctgtcggcggtggcggagatacgggacacgc

SEQ ID NO: 62956 - DNA, 247 bp, Zea mays
  Clone ID: LIB3075-044-Q1-K1-B9
cagcatttcgagtaacacagttgagcacgacgatgggatccctcgctaataacatcatggtcgtgggcgccgtccttgcggcgcttgtcgtcggcgggtcgtgcgggcccccgaaggtgccgcccggccccaacatcaccaccaactacaacggcaagtggctcaccgtcagggccacctggtacggtcagcccaacggtgccggcgctcctgacaacggcggtgcgtgcgggatcaagaacgtgaa

SEQ ID NO: 62957 - DNA, 223 bp, Zea mays
  unsure at all n locations
  Clone ID: LIB3075-044-Q1-K1-C1
gttacatgatgtcttgcctggatttttggcaggcctgttaatttatgcttcactgttagtgccttgttgccagcaccagatgtttctgtgtgtgtgtggtggtggtttctgtacatgaaagccttttgactggagaaccaaccatggctagtttaattatgaagttcacttgttgtacccatggnangataaactagctaaagacattgcagatgcatggcgc

SEQ ID NO: 62958 - DNA, 250 bp, Zea mays
  Clone ID: LIB3075-044-Q1-K1-C10
gagggcccgactggcacgtggacgctcgacaccaaggccccactcaagtaccccctttgcatccgctttgctgtcaagtctggcggctaccgcatcgccgacgacgtcatccccgccgatttcaaggctggcaccacctataagaccacactcagcatctaatcaacctctcatgatgaaatatatttcaaaagagctcacctagcgcattgtgtacaagacaatattatttttttcatgggcttttttt

SEQ ID NO: 62959 - DNA, 221 bp, Zea mays
  Clone ID: LIB3075-044-Q1-K1-C11
ccaagctctacatcatgcccaacctcgtcttctacaacatcgtgctcatggaccttgtcgtcatcggtgacttctactctatgctgaattgagtgaaggccagatgctactatgtacacggtgctcatagatggtattgccaccgtaggaagttgcaagatgcagcaaggatcatggatgagatggaaaccgctggggtgcagccaaatgaggattcatac

SEQ ID NO: 62960 - DNA, 304 bp, Zea mays
  Clone ID: LIB3075-043-Q1-K1-G6
accacgcgtccgcgccggcaaacagctggaggatggccgcaccttagcagactacaacatccaacaggagagcaccctacaccttgtgctccgtctccgaggtggtcagtaagtcatgggtcgtttaagctgccgatgtgcctgcgtcgtctggtgccctctccatatggaggttgtcaaagtatctgctgttcgtgtcatgagtcgtgtaactattgctttaataatggaccggttgtgttgtgtgtgcgtactacccagaactatgacaaatcatgaattagttctctctttgaaatcgaaa

SEQ ID NO: 62961 - DNA, 392 bp, Zea mays
  Clone ID: LIB3075-043-Q1-K1-G8
acgcagaggaaaaccagcaggctgcactatgagtcagtctacgaaactgattcaactctcgacggcatgatccatgctaacaagcggtccgtcctcctagacaagatcaacgaccggtaactacccgacgatccatgagtataagcgctcatatgcatactactattactttgactcatactatgacaagaagctcaataagtgtaatatgaataagctttcaggaagataacatgctattgctatatgtcctttgaggacgcaaatccggctaccttgtgctgctgatgatctaactgacatcattgtagcatcttgttagtggttaccttgatctggttactgttctaaggcatcgtctaccaacttcttacctttctttgtcacgcact

SEQ ID NO: 62962 - DNA, 251 bp, Zea mays
  Clone ID: LIB3075-043-Q1-K1-G9
acaacccgaaagctgacgccaccgctctcctgacaacgatccaacgtcacccaacccaccggtgctccccccaaaacccaccacaaggcttgcccaaggcttcccctcaaccatgccacactcgcgcccttcaccgaccccatacccgcgggcatgatccgctgcgatggaggactcgttgccatcgtccgtcgcacctgaccctaccacttcccctgcaccttgcacgcccccgtccccgaacccgcacc

SEQ ID NO: 62963 - DNA, 385 bp, Zea mays
  Clone ID: LIB3075-043-Q1-K1-H1
cgcagccaccggtcctctcctctcgtcgcttcttccgtctctcggcgtcgaatctcatccggccagtgaccacactctactagccgcccggaaggagttcttccgggattcgagccttgctgccctcacctctgcaggcccagcgtcgagcggagatccaatcggaaattcaactgacttcgtcttttgtcgcatccccgtcaggagaagcaatgtcaggagtgatcacaaagttcgcggttacatccatggtgatgtggatggcccctgatgcgatcatgtatgggttttactaccaggtgtttccaggtgtgagtcagatgtcatcctccgcgcatacacttgccagtgggttcctggcttgcatatcgggtaatctagggat

SEQ ID NO: 62964 - DNA, 360 bp, Zea mays
  Clone ID: LIB3075-043-Q1-K1-H10
ctagcttgctcttatccgcctgcagtccatggccaccgtcagtctcgcgctctcgctgcgattcgcgccgtcgtcgcgaccgctgagtctccaccgcaggaggcccgacgccgtgacctgccgcgcgaccaccaccacgttccaccggctcgacgccgtcgcagtgagagaggaagagtctaaatttcggagggccgcggcggagggctgtaacttggtgccgatcacgagaagcattttctctgatcatcttactccggtgctcgcgtaccgttgcctagtcaaagaagatgatcgtgaggcgcctagctttctgttcgaatccgatgaacaaggctcagatagtacatatatgggaag

SEQ ID NO: 62965 - DNA, 422 bp, Zea mays
  unsure at all n locations
  Clone ID: LIB3075-043-Q1-K1-H12
cgcagcgtcaattcagcctggcaggagctcacaggcatcggcgagcgtgcgctattcgtagattcccaccacgggttcgcagtgccgacggcggggtttggcaatctcgagagcaacacaatctattcagtgagcagcaagaaggtgaactacagcgtttcggcatttagcctggagacccgtacctcgaagaaacttgcgtgccgcctcaacgaccaggagatggcgatgcgtggtgagatgccatcgtggatcgtaccaagattggatgaagtctgaatctgcagggttgggagattcatcattgttgtgcaatcactgttgatatatggttctaggtaatttcttcggtatccttgcagttcgaaccagcaataatccctatataagttcactcctgtnaattcttgattctgtcgttt

SEQ ID NO: 62966 - DNA, 450 bp, Zea mays
  Clone ID: LIB3075-043-Q1-K1-H2
acgcggaaggagagcggcaggagggtcattaaatagaatctagctcttctgccttcatgttatgcaaatgatgtcagatagttaagagcgtggctcgctcctagacaagatgatcgacaagatcacccagaagatccatagatgttctctctcaccaactgcgtgcagcgctacacactcaaacagggacccgaacacaagcaaggttcaaactagaacgctctttttaagagaccatccattgccactggaggctactcgtactatgagcgaaacacatacaacgctgaagtacgggaagacgacacttagcatgagtacctgcttaaccctaaaacgtacattcctggaaccaagatggtcttccctgggctaaataagcctgaagagcgtgctgatctcatctcgtacctgaaggaagcaactgcatagctcattgacatgcctttt

SEQ ID NO: 62967 - DNA, 412 bp, Zea mays
  Clone ID: LIB3075-043-Q1-K1-H3
ccagacgctagacacgccaccgcatcgtctgcgccgcgagatcgagaatgtccatctctatgccgatcgcgatccctgctcctgccgtcaccgtcggcgcgccgacgcggctgacggtgcgagcggcagcggaggtgaaccgcggctctctctccgtcgcgcgcgccgtcgaacgggcggagacgggcgcgctcaggggatgcgcctggctgccaccgaaaccgctgggagcgggccagccgtaccggatcatgggggccgacgacgtgtgtgactcgtcggcgcacctcaacgcgcgcaccatacagtggatctacgacagagccagcgcagcgctatcagttgctaaaggcactgccatacacatatctttacttgtgccattatttgctcttcaggcaccttgcagcat

SEQ ID NO: 62968 - DNA, 335 bp, Zea mays
  Clone ID: LIB3075-043-Q1-K1-H4
ggtaccgattccaattcgacctacgcgtacgcgtccgctccggtccgtcaccccaccatactcgtacagaaccaacgaatatgtgtagcgccacatacgcagtcctattgtacgtactcgccggacatggcctcatagatggcgctgaacaagattagggaccaaaaggagctagtcatgacaaggtacactacgtgtatccggatgtaggcaggggtataattcatgcatacgcaccttactctggtaccgctagaactgtcgccgcttaaggacctcaggccaccttcagccgccacgatgccgctgccgcatctgctgctgcacctaagaag

SEQ ID NO: 62969 - DNA, 137 bp, Zea mays
  Clone ID: LIB3075-043-Q1-K1-H5
gtgacgcgtagccaccggtctgcacttgagctaatacgtcggacgtgtgcagggcacctactgacgaccgcgagagcacaatgtgggactatcataaggcgaattatcggccggactaacttaggcaggctaccgcg

SEQ ID NO: 62970 - DNA, 437 bp, Zea mays
  Clone ID: LIB3075-043-Q1-K1-H6
caaaggcaaagggcaaagcagaagttgcggttggcctcgtcctcctcttctccgtcgcggctcacatctctgcgtgcgtcgatggcgtcgttctcggaggctccccccgggaacccgaaagccggcgagaagatctttaagaccaagtgcgcgcagtgccacacggtcgacaagggcgccggccacaagcaaggtccaaacttgaacggtctttttgggagacagtcgggtaccactgcaggctactcctactctgcgggaaacaaaaacaaggctgtagtctgggaagaagacactttgtatgagtacctgcttaaccctaaaaagtacattcctggaaccaagatggtcttccctgggctgaagaagccgcaggagcgtgctgatctcattgcgtaccctaatgaagcaactgcatagctcattgacatgccttt

SEQ ID NO: 62971 - DNA, 236 bp, Zea mays
  Clone ID: LIB3075-043-Q1-K1-H7
acccgtcacggcgtgcgcttgactcgcgatctaatctacttttcgaccagagtgataatgttcatggctggggagctcgctatccccggtggggtcttcaccgtcgcagtgccgacgcggctgacggcgccagcggtagatgctgttaaccgtggctatttctccgtcacgcgcgcatgcggacggtctgggactgtctctctcagctcttgagaaggactctatgcaaaaccgct

SEQ ID NO: 62972 - DNA, 434 bp, Zea mays
  unsure at all n locations
  Clone ID: LIB3075-043-Q1-K1-H8
ctcccctccgtcaccccaccacatccggccagcccaacgaaaatgtcgcgcgccacagctgcggtcctcttctacatcctcgccgtcgctgccctcagcgcggccgaggcaccggcagagtcaccgaaggcaggcagtcctgccaaggcaccggccgagtcaccgaaggcaggcagtcctgcagctcctgccaaggcacccgagtctgctgccacgagaactgcccccgctaaggcacctcaagccgcctccacccccgccgctgccgctgccccatcgtcgtcgtcgtctaggaagtctggtccagctgccgcgccgaccaccgncgtctctacaccgtcttcttccacggacgaggagttgagcccttcgccgtcggcatccaccgncgaggtggcgtcccctgccgctgatgggcctgctgagggacccgc

SEQ ID NO: 62973 - DNA, 408 bp, Zea mays
  Clone ID: LIB3075-043-Q1-K1-H9
cggaggagtgcgtgcgtggtcggctgccgctcgcgcacggtgtaggaggcggtgccgaggccacgtggcgggtcttggggacgagctccgttagcttgaagcggtgctcgggaagatggcgccggccaatggccgtaccgtgctgatcttccgtgtgccgtgcgggtgcccataagagaggatggaggtctggggcgctaagaaaaggtgcgccggatgaagacgtatggaggccatgaaaaacaaacagctgatggctccttatctattatctaatgacagacatcctaaacaactcatagctgagttactttcgcatagcgttactaggagatgactactaactactagggcggtggctgtttggagaaattgctctcattcatatagccctattggactagtgga

SEQ ID NO: 62974 - DNA, 294 bp, Zea mays
  Clone ID: LIB3075-044-Q1-K1-A10
cccacgcgtccgcgtctcactcaccccgccttcacgcctccctcaccaaataagggcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctactgcgacacctgccgcgccgggttcgtgaccaatgtcaccgagtacattgcgggcgccaaggtgaagctggagtgc

SEQ ID NO: 62975 - DNA, 299 bp, Zea mays
  unsure at all n locations
  Clone ID: LIB3075-044-Q1-K1-A11
cgcctcccctggcagattcgccaatcacaatcgagcttccagttggaggagatcggctacgtttcctgtaggttccaatggtgcagcttccgggctccaagaagcggcacgccgagatggccacggcggcgaccgtgaaagcggaagtggagggtttgggctgcngcgatggttctcctcacaagcatgtcaagccaattgccgagccgncgncgcagccgtcaccttccgaggacttgccctttgatgtgcttgatggacctagcccattgggtctgcgactaagaaaaaagtcgatc

SEQ ID NO: 62976 - DNA, 424 bp, Zea mays
  Clone ID: LIB3075-043-Q1-K1-G5
gtcggagaccagcctccgctgcggcaaggtcgtcggactgccaatgccggcgtcctacctctccgtctagagcatgcatctgggtttccccttgcttccttccatcacacgtgcgcacggtgctgtatacacactttaaaggagcgtgagggcacatgcttatgtcgatagctacctatctagctataatgtgccaagctagcatcgacctgctctgtcagcatcgtggagctgtcaatacccgcttacacggaatcataatgacccaaaggggctcaggtctatgtcaagaagacttcattcatgtgggcaccagcagtcactcactgccaggggcggacgaccagagacattaagaggcgatcgtccgctgcaatgcatgcatgcggatatatgcatgcgtaaacacatcgagacgccgtaa

SEQ ID NO: 62977 - DNA, 428 bp, Zea mays
  Clone ID: LIB3075-043-Q1-K1-E8
gagccatgcggtgcttgccctccaggaggctgctgaggcataccttgttggcctgtttgaggacaccaacctgtgcgccatccatgctaagcgtgtgaccatcatgccaaaggacattcagctggcaaggaggatccgcggcgagagggcctaatcgccacctcaaacatcgtgacaaaaacatgaagtcctggggttattgttaatctggtgccattgtaaggacatatgagtagggtttgttttgtggatcgcaagtttctcttctgctactgttgctgctacctttgctggtgttattgctagggtcgaatacttaagttaactatgcgctgacagtctggactagcagtgttatgtgcgctgctggaccttgcgcgcattgctttggccgattttgtccgttaatgtcaaagaatggtgtttcc

SEQ ID NO: 62978 - DNA, 417 bp, Zea mays
  Clone ID: LIB3075-043-Q1-K1-E9
cttaactgaaggttgaatcagagagaagctaccaccaaaaggtcctacacattcttgatcaacttgagagagaggtctgatggtttcacatccgcatcctttccatgcttctccattgtgctaaagaaagtctacaactttgagaaaaatctggtcgattatgttatcttgattgagctttcttttttttttcttctagatggtatctgagcgccaaagaatcgaaggagcacctccggtggttgagagttccatgcctccgccgcctgtatatgaagaagtcaatggtatattcatgagaaatacaggtgcaaaattggtcgagactgtggagtatttcttggctgaagcaatccagtcataccaagccgaaagcgataccgagctcaacctttcaactggtgactacatagtggt

SEQ ID NO: 62979 - DNA, 262 bp, Zea mays
  Clone ID: LIB3075-043-Q1-K1-F1
acggggagaagtatgaaccacactatgattactttactgacaatgttaacactgtccgcggtggtcatcgctacgctactgttgtggtgtacttaactgatgtaccagaatgaggggaaacggtttttctcttggctgatgagcccgattatgctaaatatgcaactcttgtcagaatgtgctcagaaaggcatttctagtgagaccacggaaaggtgacgcccttctttttttcaaccttaacccagactgcaccacttac

SEQ ID NO: 62980 - DNA, 216 bp, Zea mays
  Clone ID: LIB3075-043-Q1-K1-F10
gcgggcatcaacagtgcctctcttctgcgtctgcggtggcaaacgacacggggcgagcagggtgcgcgaacctgaggttcgtaggcgtcgccttccgcccctcactgaagtcgtcgtcagcagctccctccagtctctgccacgattggactccatgtcggcggcgctcgcggtgacggacgaggtggccctgccgatccgggcggtgggggatct

SEQ ID NO: 62981 - DNA, 225 bp, Zea mays
  Clone ID: LIB3075-043-Q1-K1-F11
tcggcgggcatcaacagtgcctctcttctgcgtctgcggtggcaaacgacacggtgcgagcagggtgctcgaacctgagggtcgtaggcgtcgccttccggccctcactgaaatccgtcgtcagcagcttccttccagtttttgccacgaatgggacctcaatgcagctggctcttcgcggtgacggacaaaggtggccctgccgatccgtgcggtgggggatct

SEQ ID NO: 62982 - DNA, 293 bp, Zea mays
  Clone ID: LIB3075-043-Q1-K1-F2
ggcgacgagaagtggcgagcccgtagagcgtttttagttagaggctactggcggtgggccgctgcggtggcggcggccatgagcagcgtgagcgagagcactaccgtcagcaggtggtccgagctggccacgctgcgcgcgctggcgcgcgacgccgtggagcaacttctgctgtcgtggtccggcacagttgcgtgggcgtcgtcgctcgaggcgcgggccctatgaccacctgcacggtcacggtacgacagtcaaggtgatgcacctgctgctttgaggacccaagtgaa

SEQ ID NO: 62983 - DNA, 224 bp, Zea mays
  Clone ID: LIB3075-043-Q1-K1-F3
cgtaccgaattgccatttcggcctacacgtacgcgtacaagcatgtaccacactatcgttacttcagcttcaatgataacactttccgctttgggcatcgctacactgctgatccggtggactcaacttacgcaacatatggacgtttaacgcttttctccttggctgacgacccccatgatgctttctttccatacatgttagaatatgcttagaaacgtatt

SEQ ID NO: 62984 - DNA, 417 bp, Zea mays
  Clone ID: LIB3075-043-Q1-K1-F4
cctcgatcttaattacaggtcatagctaagcaggtctgacaggatgtcgtggcagacatacgtcgatgagcacctgatgtgcgagatcgagggccaccacctgacctccgctgccatagtcggccacgacggcgccgtttgggcccagagcaccgcattcccacagttcaagacagaggagatgaccaacatcatgaaggacttcgacgagcccgggttccttgccccgaccggcctcttcctcggccccaccaagtacatggtcatccaaggcgagcccggcgctgtcatccgcgggaagaagggatctggaggcataactgtgaagaagacagggcaagcgatggtggtcggcatctacgacgagcccatgacccccggccagtgcaacatggtggtcgagaggctcggcgacta

SEQ ID NO: 62985 - DNA, 424 bp, Zea mays
  Clone ID: LIB3075-043-Q1-K1-F5
gggagaagtatgaaccacactatgattacttcactgacaatgttaacactgtccgtggtggtcatcgctacgctactgttcttttgtacttaactgatgtaccagaaggaggggaaacggttttccccttggctgaggagcccgatgatgctaaagatgcaaccttgtcagaatgtgctcagaaaggcattgcagtgagaccacggaaaggtgacgccctccttttcttcaaccttaacccagacggcaccaccgactcggtgagcctccatggtggttgcccggtcattaaaaggcagaaatggtcggcttccaaatggatccctgttgccttggtcgataaggtccattacccacagggcaactgcaccgactagaacgagagcttctcgaaatgggctgccctaggggagtgcataaagac

SEQ ID NO: 62986 - DNA, 370 bp, Zea mays
  Clone ID: LIB3075-043-Q1-K1-F6
tctcgatcttaattacaggtcatagctaagcaggtctgacaggatgtcgtggcagacatacgtcgatgagcacctgatgtgcgagatcgatggccatcacctgacctgcgctgccatagtcggccacgacggctccgtttgggcccatagcaccgcattcccacagttcacgacagaggagatgaccaacatcatgaaggacttcgacgagcccgggttccttgccccgaccggcctcttcctcggacccaccaagtacatggtcatccaaggcgagcccggcgctgtcatccgcgggaagaagggatctggaggcataactgtgaagaagacagggcaagcgatggtggtcggcatctacgacgagccc

SEQ ID NO: 62987 - DNA, 344 bp, Zea mays
  Clone ID: LIB3075-043-Q1-K1-F7
acacgacctggggggttcagatcggatcggaagcttccataagtttccatcgggcttcgccgctcgccggtatggcgatccgcaaggggtcttcgtacgccgtcgcggcacttatcgcgctcgcctctgtcgccgccgtcgcaggggaggtcttcttccaggagaagttcgaagatggctgggaaagtcggtgggtcaagtccgagtggaagaaggatgagaacatggctggtgaatggaaccacacttcgggaaaatggaatggagatgccgaggacaaaggtattcaaacctccgaggattacaggttctatgccatttcaggcgaataccctgagttcagc

SEQ ID NO: 62988 - DNA, 356 bp, Zea mays
  Clone ID: LIB3075-043-Q1-K1-F8
ggctaaatgtgatggtattgtgatgatgtgaactgagagtacaacggcattctccaatggtctccaatccaaaaaatgtaatttgttttcattaaagtttgttaaattgttcttctaatttataaggaattataggatgtaatggcataatgccattctatacggtccatcaagaaatgaatttatgatttcaaattatttcatcaaatcgaattattattttttgtacaaattgttagtggaagtatcaccttgtcgacaatgtatgtcacaagtgatgataatttgtaatcattgaaatttctaatggattgaaaatcaataatgtcttgcagagtacttggacaagtagtttt

SEQ ID NO: 62989 - DNA, 310 bp, Zea mays
  Clone ID: LIB3075-043-Q1-K1-G1
agcacgcgttcggaagctgatgggtacgctgcactcgaatgccttggttctaggtatggatcccagacagacgatcagcggtgggccatggcttgcgtgcatgcgcaggtcatagggatcagcgacagcgccatctaggagctgtgatgtcggcatcgagaggctgatagagatcaagctgcgtcgaatggagaagctgcaagacctgcttgtcagcatgctggagctgtgaaacctgatggacacgcctgctgatgagcaacgggggttccagggcatgggctgcaacatttacgcatgcgaggacgag

SEQ ID NO: 62990 - DNA, 369 bp, Zea mays
  Clone ID: LIB3075-043-Q1-K1-G10
gttacttggaaggcactgataataccactgttgctgatgctcacgagctgaaggtgatacttgagcacatcgtggagaggatatcctgcatctctgacgctgctcgtactgatcgtccatgacagatcacagattactcgtatatcgaggacgctcttgctgctaaagcaacacacacacttaagcaccttgggctcactcatatatcgtgcttgtgtgctagtgaaatcggacacgtcgaaatcgcagaatcctgtcctttttgcgcatatcgaattcatccatatactatgaggacgatgcagacattggtgatccttctcaagaaggtgctgatttcctgaggtatgctcatgacttgccttggta

SEQ ID NO: 62991 - DNA, 219 bp, Zea mays
  Clone ID: LIB3075-043-Q1-K1-G11
tcggacgatgctcatcggtgctgaccccactcactgtcggctaccgctgcatcagggtcacgacgcaccactgctcttttgacgggactcggtatacgcaccatcgtctacgattctgaaaggttcacctctacaacaactacactcgcagctggcgcatctacgccagatgcgcaggcttaaaggcccacatcgcgtgccattgcatcaatctaccat

SEQ ID NO: 62992 - DNA, 266 bp, Zea mays
  Clone ID: LIB3075-043-Q1-K1-E7
atcgcgagcgcccccttttttttgttttttgtttttttttgttttgttttttatttcgaggcttttttttttttttttggggcttttaatagtttttttgggccaaaaaaatggacctttaaaattgttaaagtggaagaccggtgctaaaaatggtttccgtaaatgagcggtgatcataaagtgcccggggaaccagactttcgggagggtgattcgatccttgtttgggggatgctaatacagctttgtgtcgcgcataattt

SEQ ID NO: 62993 - DNA, 345 bp, Zea mays
  Clone ID: LIB3075-043-Q1-K1-G2
ggctaaatgcgatggtcattgcgatgatcagatctgagattgcagcaccttactacactgcgaacatccaaaaggagagcaccctccaccttgagctccgtctgcgaggtggtcagtaagtcatgggtcgtttaatctgacgatgtgcctgcatgccatggtgtactgtccatatggaggttgtcaaagtatctgctgttcgtgtcatgagtcgtgtcagtgttggtttaataatggaccggttgtgttgtgtgtgcgtactacccagaactatgacaaatcatgaataagtttgctgtttgaaattgaaaaaattgaaaatcaataatgtgttgcacagttctt

SEQ ID NO: 62994 - DNA, 381 bp, Zea mays
  Clone ID: LIB3075-043-Q1-K1-G3
accacgcgttcgggagctcatgggtacgctgcactcgacggccttggttctaggcatgggtcccaaagagacgaacagcgtgggccatggcggcttgcatgcgcaggccagacgcatcagcgacagcgccatctaggagctggctggcggcatctagaggctgatagagatcaagcggagacgaatggagaagctgtaagacctgcttgtcagcatgctggagctgtagaacctgatggacacgccttctgatgacaaaaggggatccagggcatggcctgcaacatcgacgcgttcgaggacgagatcacggatcctggcgcgctgtccatggccttcatacgcaacagggatgcggacgtgatgaggctggataacctt

SEQ ID NO: 62995 - DNA, 296 bp, Zea mays
  Clone ID: LIB3075-043-Q1-K1-G4
acggagaggagaaccagcagcctccaataagagccagccagagaaactaatataactctcgccgtcgtcatccgagcgaacaagccaaccgaccccgtccccaaggcaatccgccgccgacgtaccaccaccaccgcatgagcgagatggagatgaagaggatcctcttcgccgtcctcgtcgtcatcgccgcctcgtccaccgcagtgctggcctgcaccgaggccgtcgacgcgggcgccccaactgcctccgagtcgtccgccgaggcttccgatggctctggcgctggcgct

SEQ ID NO: 62996 - DNA, 400 bp, Zea mays
  Clone ID: LIB3075-008-Q1-K1-H12
aatcgatcacaataagatggcgtgtatagacaatgcaatgagagccttgttccttttagcgctcttctgtgtcgtgcatggtgagaaggcaaagtcaaaggacaacgatgcaaaagcgtccgggcccggtgggtccttcgacatcaccaagttgggcgcctccggcaatggcaagacggatagcacgaaggctgtgcaagaggcgtgggcatcagcgtgcggcggcaccgggaagcagacgatcctcatccccaagggcgactttctcgtcggaccactcaacttcacaggcccatgcaagggcgacgtgaccatccaggtgaatggcaatctgctggcgaccacggacctaagccagtacaaggatcatggtaattggatcgagattctacgcgtggac

SEQ ID NO: 62997 - DNA, 410 bp, Zea mays
  unsure at all n locations
  Clone ID: LIB3075-008-Q1-K1-H3
gcccctnttttttttttntttttttttgatcaaagaacccatnaattggtgtattacgtgtggttatccaatgagatcgcgacatcttattacaagatcacagttgaaatgcggaaagctgagagaactaagacgatgggggatcatcagtcctggccatgtgtactgacaacatgttgcaaaaaaaaatacaggtcgctggcaaataaatctgggcatctattcatcatcgtcaatgtagcgctgctcgttggctagcctggcgcgctcaagcatcttgtcgaggtcctccttgagcttctcatcaaactttaccagctggttcacaaacactgcaccgagacccatccccaacaaatgctcccatggatggcgcatgtaggggagcttgcggagagcgtttgagtaca

SEQ ID NO: 62998 - DNA, 352 bp, Zea mays
  Clone ID: LIB3075-008-Q1-K1-H5
ggaattgggtccaccattgctcaaggtatggcgtttggcacgggtagtgccatggcacacagggctgttgactctgtattaggtccccggaccatccagcatgagactcttgccacagaagctcctgctgctgcccctgctgctccagcgatgaatgctgatgcttgcagcttccattctaaggctttccaagattgtctcaacaactatggcagcgagatcagcaagtgccagtactacctacacatgctgaacgagtgccgacgcggtggtgtgtctgtctaagctgcctctgggattattcatggattttctttccggatgggggtatctcattaataaggcaccggga

SEQ ID NO: 62999 - DNA, 344 bp, Zea mays
  Clone ID: LIB3075-008-Q1-K1-H6
cctcgtccgacgcgcgtggggatggagtcctaacgtacaccgagaaggtcacgctctgggcggtcaagtctggaggacgagctgctcacaatgcgtcgtcggcattgagagaagtcatgggctcctacacaaatgcaatccgccgtcgtctacgtctcgaccaacggtaggaacaatgccctgacgtgcgccagatcacccactgcgatgtgtgcgaacccctgtgtccggccggggtcgcgctgtctaggcgcatgccccagccattaccacgaagacgcctgccctcacttttgtctgcatgccgccatgcatgtactcaatgaagaaaaaatatcatgcct

SEQ ID NO: 63000 - DNA, 411 bp, Zea mays
  Clone ID: LIB3075-008-Q1-K1-H7
ttactattgtgtatccaatgagattccaggactccattgatattgttttagcaacttccggcctgcaggaatttgtggaggcaagacgaacagctgcacttaataatgttccttcttgtatgtggtctccggtaccacctcttgagttaaaaggagtatctgctgatgcacttaatgcaaatgctggctttgttactttcgttgtttaccctcggcatgttgagggtaaaaagctagatagaacagtttggaatttgttgacatttcatgcttatgtaagctatcatgtaaagtgttctgaaggattcatgcataccaggatgaggcgcagggttgagtcgctgatccaggcgttggaccgggcgaagtctgatgcagagaagttgaagaaagtggtacacggtggatctt

SEQ ID NO: 63001 - DNA, 348 bp, Zea mays
  Clone ID: LIB3075-008-Q1-K1-H8
atcgagaggagaaccagcagcctccaatattagccagccagagaaactaataaaactctgggcgccgccatccgagcgaacaagccaaccgaccccgtccccaaggcaatccgccgccgacgtaccaccaccaccgcaggagcgagatggagatgaagaggatcctcttcgccgtcctcgtcgtcatcgccgcctcggccaccgcagtgctggcctccaccgaggccgccgccgcgggcgccccaactgcctccgagtcgtccgccgaggctcccgctggcgctggcgctggcgctgccgctggcgccgccgcctcggggccctccgccagcagcgggcgcgcccgcc

SEQ ID NO: 63002 - DNA, 379 bp, Zea mays
  Clone ID: LIB3075-008-Q1-K1-H9
cacctacgagaatactgaaggatgcacccagtggaccatcccagctgttcctacggttggtgatgctagggatgactggaagatcatccgcgctctttctgaggttgctggggctcagctgccttatgacagcctctcagctgtgagggaccggatcagtacggttgcaccaaatctagtacatgtagacgagagggagacgcccgcaatctctgcggaggttaagccgcctgtgaagcaacaagtcagctcgacaccattcaaagctgttgtggagaacttctacatgactgatgcaatcacccgagcttcaaagatcatggcccagtgcagtgcaaccttgctgaagaagtgaggttttgcacaccatcaagctaat

SEQ ID NO: 63003 - DNA, 446 bp, Zea mays
  unsure at all n locations
  Clone ID: LIB3075-009-Q1-K1-A1
aaataaactgcaggcagagggggaaggagagcggcaggagggtcattaaataaatctacttttctgtttcagggtaggaaatgatgtccgagagtgaagagcatggctcgctcctagacaagatcaacgacaagatcaacgagaagatccatgagtataagcactcgtcgtcgtcctcctcctcttcggactcagacgatgacaagaagcccaagaagtctaagaagaagaagctttttggaagaaaacatccattgcatcatgtcctcggaggaggcaaagccgccgaccttgtgctgtggaggaacaaacaggcatctgggagcatcttggtaggggtgaccgtgatctggttactgttcgagggcatcggctaccacctccttaccttcctttgccacgcactaattgngtttctcaccatctggttcatctggtccaatgct

SEQ ID NO: 63004 - DNA, 266 bp, Zea mays
  Clone ID: LIB3075-009-Q1-K1-A10
cacctttaccaccgaagagagaaacgcgagcaaccagcgatcgccccatggccgccatggctcgttccgtctccctcgtcgaggcgccccttctcctcctctccctcctcgtctccgccgcggccagtgcgcggaccgtgggcgacaccgtgcaggacgcgtgcagcaagacccagttccccaagatctgcgtggacagcctcgccgccaagccggagagccagaaggcgacgccgcgcaagctggcggagctgttcgtgaacatc

SEQ ID NO: 63005 - DNA, 273 bp, Zea mays
  Clone ID: LIB3075-009-Q1-K1-A11
gttgggaatgacagctcttattgaggttcatgatgaaagagagatggaacgtgtgctgaagataaatggagttaagcttattggtatcaataaccgaagccttgagacatttgttgttgatacttcgaacaccaagatgttgctcgagaaacatggggatatcatcaaggagaagggaattttggttgttggtgaatcacgtctgtttactccggatgatgttgcttatgttcaaaatgctggcgtttctgctgttttggttggggaattcct

SEQ ID NO: 63006 - DNA, 247 bp, Zea mays
  Clone ID: LIB3075-009-Q1-K1-A12
ccaagctcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgc

SEQ ID NO: 63007 - DNA, 192 bp, Zea mays
  Clone ID: LIB3075-009-Q1-K1-A2
tcggtccgctttgcttagtgttgtgctcgggaactgtaaaataatgtgcttacactagtgacctaccaacagcacaagtcatgcacaggtcaatcacacaaatatcatgtgtgcacctacttcccaaggttgattaaatccaaaaactaatctaaacctaaatcaaaaaacacataattaataaaaaggcga

SEQ ID NO: 63008 - DNA, 443 bp, Zea mays
  Clone ID: LIB3075-009-Q1-K1-A5
caaggaccagatcggcagcttcttctacttcccgtccatcggcatgcagcgggcggcggtcggctacggggccatcagcgtggtcagccgcctcctcatcccggtcccgttcgaccagcccccgccggagaacgaccacgtggtgctcatcggagactggtacaccaaggaccacgaggtgctagcccgccagatcgacgccggcaagggcgtgggccgtcccgcgggcgtgctcatcaacggcaagggcggcaaggacctggaggccgcgcctgccttcaccttcgaggccggcaagacgtaccgtctccgcgtctgcaacaccggtatcaaggcgtcgctcaacttccgcatccagggccactacatgaagctggtcgagctggagggctcccacaccctgcagaacacgtacgactcgctcgacgtccacgtcggccact

SEQ ID NO: 63009 - DNA, 455 bp, Zea mays
  unsure at all n locations
  Clone ID: LIB3075-009-Q1-K1-A6
gaagtggatacctgaactgaagcattatgcacctggcgtgccaattattctcgcagggacaaagcttgatcttagagacgacaagcagctctttgtggaccatcctggtgctgtccctatcactactgctcacggagaggagctaataaagcaaatatgcgctccatactacatcgaatgcatctcgaagacccaactaaacgtgaagggcgtcttccatgcggcgataaaggttgtgctgcagccgcctaaggcgaagaagaagaaaaaggtgcagatggggtcgtgctccattttgtgatctaatcatcggtagatgaagaaacatgggcgaacgtgccatggctttatcatcgtcgcgtcttgcttcagtggaacggcatgaatggtccccacccnctctaggtttactggcggctcggctgcagcgagttctcatctctctgtcgaggcat

SEQ ID NO: 63010 - DNA, 409 bp, Zea mays
  Clone ID: LIB3075-009-Q1-K1-A7
aatgatcgacccactcattcgttcataaatggatacctgttctttagcagcattctttttgcgtgccaattatactcgcaggggcagagctagatcttatagacgacgagcatctctttgtggtccattctggtgctgtccttatcactactgctcacggagaggagctaataaagcaaatatgcgctccatactacatcgaatgcatctcgaagacccaactaaacgtgatgggcgtcttccatgcatcgataaaggttgtgctgcagacgactaaggcgaataagaataaacacgtcacaatagggcatgctccattctgcgatctaatcatagggtgatgaagatacattggcaaaagtgccatatctttataatctcagcgactctcttaaccataacggattta

SEQ ID NO: 63011 - DNA, 462 bp, Zea mays
  Clone ID: LIB3075-009-Q1-K1-A8
ctggccgcgacctcaccgactacctcatgaagatcctgactgaacgcggctactccttcaccaccactgctgagcgggaaattgtcagggacatgaaggagaagctcgcctacattgccctggactacgaccaggagatggagactgccaagaccagctcttctgttgagaagagctacgagctgcctgacggacaggtcatcaccattggtgctgagcgcttccgctgccctgaggtcctcttccagccatccttcattgggatggaagctgctggtatccacgagaccacctacaactccatcatgaagtgcgacgtggatattaggaaggatctgtatggcaacatcgtcctctccggtggtaccactatgttccctggcattgctgacaggatgagcaaggaaatcaccgccctggctcctagcagcatgaagatcaaggtggttgctcctccagaaa

SEQ ID NO: 63012 - DNA, 437 bp, Zea mays
  Clone ID: LIB3075-008-Q1-K1-H11
acgaccgacgcgtgcgcctcgtccgacgcgcgtggggatggggacctaacgctaccttccttcagcgagcgcctggggaccgcggcggcggcgtcccagtgcgccgccgagccgagtagcccggtgcaggaccctgtcacccatctctacacatccacgacgagcctaaacgacgaggggcccaagtacgacctcgagctatccaagaaagaccaccggaagcatgggttctgggggcttgtggctcagaaagccaaagtcatgctggacgaaaacggcacaccacgccctcaggctaagacctctgaatcgctctggtcctacgatcgggtccaaggatcgttgggaggcaggctggacatcagagggaagatcaaggacgttcttcagcaggagggccttgctgtggtggccgacagcacgacgcccggcaccag

SEQ ID NO: 63013 - DNA, 236 bp, Zea mays
  Clone ID: LIB3075-009-Q1-K1-A9
cggacgcgtggggtcaacctttcaacttctgcttgtgttttcatgactgctattgggctggactatataacttaacaagaaaactacctttatacttctttttctggattttatgggggtctatcaagattggtggtgggcattaaacaacttttacctgatcaagaagcttaatctttttgtgctaaaaattaaggcaaagggaattccatctctggtggcatggatatccattc

SEQ ID NO: 63014 - DNA, 418 bp, Zea mays
  Clone ID: LIB3075-008-Q1-K1-F8
cggacgcgtgggttcggcgagttacggagttagtacaccacgacatctgcctgtcgccgtggctgggaggcgctcgacaccggtggccatcctcctcaccgcggccttcgtccccatctccttcgtcgttcgtccaatctttgacacgcacagatccgctgccgtggagctcttcaacttctccgccgacggatccttcgacgagttaaagcaagaggacccctgtgcattaaagaataagcacacaatagatcttcctaaacactgaacattgccttatatgcttataatatcaccaaccttaccttttaagttatagaatgtttactttgtatggtacactccgtataattatatatgtacgcctgtttatttcttttggagatagtttgtgtacgttagcagttcaggtctaaat

SEQ ID NO: 63015 - DNA, 395 bp, Zea mays
  Clone ID: LIB3075-008-Q1-K1-F9
cccacgcgtccgcggacgcgtgggcacgccgcccacggcaggagagagaaagcgggggcgagcaacagcaggccagggcaggcaggcgcaagaaacttcccccacctccacctcctcctcgccttccgcctttatttcttctcgtctccttcctcggtcctatctcctctcctgctccgccttttcctcatcggtccctcctcccctatcctctgctcctcatcccctgcgctccgtttcttcggggtttgaggcgagtgatctaggccatggcggccaccaagaaaaccaagatcgtcttggcccagccggcggttggggctccgacgtcgcggctgccgttcttttctcgcgcgcccggcccggtccgaggcgccggggacgaggcggcgcac

SEQ ID NO: 63016 - DNA, 397 bp, Zea mays
  Clone ID: LIB3075-008-Q1-K1-G1
cgttgatgacacagctgtgaaggtggttgatattgttgacacattccgtctacaggagcggcgctccttttgacaagaaatcatttgtgtcttacatcaaaaaatacatcaagaatctcactgctgtgttggagccagagaaagcggatgagttcaaaaagggtgtcgagggtgcaaccaagtttctccttagcaagctgaaggacctccaattttttgttggtgagtccatgaaggatgatgcgtctgtggtattcgcctattacaaggatggtgccactaatccgacattcctctatttctctcatggtcttaaggagatcaagtgctaagcgtgcggcgaaattagttacccatgttgggtactatctatgtactattattatatccaaaacta

SEQ ID NO: 63017 - DNA, 347 bp, Zea mays
  Clone ID: LIB3075-008-Q1-K1-G10
cgaagcccgtcgcggcggcagctgtgaagtcagagaggagcggcagcgaggacgacgccgagtcagaggcaatggcggaggtggctgccgcactccgggctgtcggggaggggttcctgcgtatggaggagcgcaggctggagctatcgctgcagatggagaaggaacggatggaatcggagatgaaacgcacccagacgatgctggacgcccagcagctcttcctcgaggccttcctcggtaagcaactgcagcacaagaaggcctatgtctccccttcctctgccgcaatggaagaggactgatcgatcgatgtatcccggctgctctctgtcaaacttgtgttc

SEQ ID NO: 63018 - DNA, 449 bp, Zea mays
  Clone ID: LIB3075-008-Q1-K1-G11
ggctagcaccacacaccgcaggtatggagaaggcgacgaggctggccttggcagcggcggtggttctgtgcctgctgctggcgaccgggccgcaggaggccgccggcgccgaggggatgctgtcgtatgataagttgctcagctgcaaggtgctgggcaactgcgacaagaacaggggccccggggccacccgcccggggaagcccgtaaacaagtacacccgcggctgcagcccgctgacccggtgccgcggcggctgatcatatctccggtggttctggtcgatgtgcgcgcaacgtcacgcgcgtgcaggcaccagcgccggccggcccctgagggcgggggcaaagggggcaaccgccctggtgggcctcgtaatctggaggaccccaattccgtgtacacattagtatactgcatatgagtttttgcatgtgtattacgtgatt

SEQ ID NO: 63019 - DNA, 429 bp, Zea mays
  Clone ID: LIB3075-008-Q1-K1-G2
gcgtccgcgacgcgtgggtgcggcccaggccacggtttttgcgtcggcagcctggggcgctacaaggggtagaaggacgtggaagacgtgcaggtgacggggtgcacgatcgccggcaccacgaacggcctgcgcatcaagtcgtacgaggactccaagtcgtcgctcaaggccagcaagttcctgtacgagggcatcaccatggacaatgtctcctaccccatcatcatcgaccagaagtactgccccaacaacatctgcgtcaagtccggcgcctccaaggtggccgtcaacgacgtcgtcttcaagaacatccacggcacctccaacacgccggaggccatcacgctcaactgcgccaacaacctgccatgccagggcgtgcagctcgtcaacgtcgacatcaagtacaatggatccggcaacaag

SEQ ID NO: 63020 - DNA, 456 bp, Zea mays
  Clone ID: LIB3075-008-Q1-K1-G3
cttccaaaattaatccacttgtgccttggcgctgtgctagggacctactagctccgtctggatgcctggggtgtgtctactacgtagggtcgtcgaccttgtacggtggcattggcatgcatgctgttgggatgggatcatgggagttgggagctgctgtggaacacccttccaaagaagctgacgtgtgggggcaatgccacccgataccttgaacagcaacgactctttcccaggcgggcgtgtctccacaaatctgtcatcacatacacaacacgtacgagaagtaccctggaaattgtatatacgacagtagttcgatcagtgtggattttccgcaatgacggccacgccggaaactacattatggtacacaataaaaccccgtgcttttcggcgggattacattagaaatcagatagaaatgtatagttattcggtacctttttggaaata

SEQ ID NO: 63021 - DNA, 459 bp, Zea mays
  Clone ID: LIB3075-008-Q1-K1-G4
tcggttctttccttggcttgtgtccggcccggcttttggcaccggcaaggaagggaccatgtcggagaaaaaacaatctttgccaagaggaaagaagcagtacgagttcgacctccaacgggagaaggaggccaaggagaagcaggccaagaagctgcaagccaagaaatccaagatgaagatagatggtgctgaaaagaaacgtaaaggtggccaatttaaggtcggcaagaaaaaggtgaagacgaaactttcagccttagcaaaagccaaagccgcgcaagccatggaggtcgacaagtgactgcggagcacaagcatcatcaccttaagcgtcgagccagagttggaactctgaattctgtgcccacatgaatagctcccgtcgggtgcagctgcagctgcagcttgttgaacctttctttctaaaaagaatgtcattcttgcttttttaagggt

SEQ ID NO: 63022 - DNA, 461 bp, Zea mays
  unsure at all n locations
  Clone ID: LIB3075-008-Q1-K1-G5
cgcgtncgcgacctgtttgatcttggcgatctgcgcgatgaactctacttcaaggcatttgtgtttccggggccatccaccactggaagctacatcgtggttcttattcatgagccacgttcacggctttcgtttgcacgaccgggagatgacaagtggacctcggttggacaaggtatcggatataaagactgcacatatgtggatggtcttttgtatacagtggattggactggagaaattgatgcttttgattttaccgcatcccctgttaaaatgacagtaattatggacagtctgaagtatcctccatgtgaaaacctgtacattattcaggctccatggggtgatctgctgcatgtttggaggactattgacgttccacccaatgctccatcgtgggaccctgaaaagtgcctggcagaaaccgtaaaaatacaagtgcataaagtggacttgga

SEQ ID NO: 63023 - DNA, 230 bp, Zea mays
  Clone ID: LIB3075-008-Q1-K1-G6
actagtgttataataggtgcagaaggcctcatatgtagtgaaggcgtatgcgttgtaagagcggcttgaccgcgtattatgacatctggataacaagcgaggccttggcaaactttatgatgtaaacagcaagcaacgttgttcatccattgggatgcagtttacatgttgaataatattcactgcaatttctcttcaaatgaaccaaagaggggtaatagttggtgctc

SEQ ID NO: 63024 - DNA, 391 bp, Zea mays
  Clone ID: LIB3075-008-Q1-K1-G7
gcccaaatggcacaattaggaacattataaatggcactgtgttcagagagcctattatgtgcaaaaacgttccaagacttgttccaggatggactaagcccatctgcattggaaggcatgccttcggtgatcaataccgagctaccgatgcagttctgaaggggcctgggaagctgaagctagtttttgagggaaaagaagaacagattgatctggaggtattcaacttcactggtgctggaggagttgccttgtctatgtacaacaccgacgagtcaatccgagcttttgctgaagcttctatgacaactgcttatgagaagaaatggccactctaccttagcaccaaaaacacaatcctgaaaaaatatgatggcaggtttaaggacat

SEQ ID NO: 63025 - DNA, 271 bp, Zea mays
  Clone ID: LIB3075-008-Q1-K1-G8
cggacgcatgggagcaaggatggatcacaggttgtcgttctggtaattaatctacatacggttgcctttaagtactgtggtgcggcattgttacacatcacagttcagtttggtcaaattttttttccacacaggaagtagggattgatttaatcattgatttaatcccacacgcgtgtatctacggatacagtttgcataacatgaaccacctttgtatgcgattggtctaaaaataaatataatgctgatctattgaattagaatgcag

SEQ ID NO: 63026 - DNA, 430 bp, Zea mays
  Clone ID: LIB3075-008-Q1-K1-G9
cccacgcgtccgcccacgcgtccggaaacatttagcctcaaagacagttgcacccaatgtgaacaagcttgttgctcttgttcaccgccctaatgaatcctttttccttgctccccaggcagataaagttactattgtgtatccaatgagattccaggactccattgatattgttttagcaacttccttcctgcaggaatttgtggaggcaagacgaacagctgcacttaataatgttccttcttgtatgtggtctccggtaccacctcttgagttaaaaggagtatctgctgatgcacttaatgcaaatgctggctttgttactttcgttgtttaccctcggcatgttgagggtaaaaagctagatagaacagtttggaatttgttgacatttcatgcttatgtaagctatcatgtaaagtgttctgaa

SEQ ID NO: 63027 - DNA, 420 bp, Zea mays
  Clone ID: LIB3075-008-Q1-K1-H1
gaagtcagttagttctcccattcagaaaggtgctaagaagaccaaaccccttaaccaggatgggttagtcatttctcccggccaggaagatgacaagaagccccttgtgcaggatgagccaatagtagtgtctcccatccagaagaataacaataagtatgttgatcaggagaagtcccttcagcaggagaagcaaatcatctctcccggacagaaagatgataagaagagcagcaaggtgggacctgactcagcatgtaatcatgtgcaacagaagaaagtgaaggctactgtatctaccggccgtgctgctaatactcatgtttctagttccaggcctcgctctgtttttatcccccaagcacattggcccagccagccaattgttgatcggtttgcgcatatacctgagcacctgat

SEQ ID NO: 63028 - DNA, 436 bp, Zea mays
  unsure at all n locations
  Clone ID: LIB3075-008-Q1-K1-H10
gtgggatcgagttgtttcactgcacgagcacatcctccggcgaccaccggcctccctgtgcgtcctctagcgaccgaccaacgcgccgagcgaagatgtcgtggcagacgtacgtggacgagcacctgatgtgcgagatcgagggccaccacctcacgtcggcggccatcgtcggccacgacggcgccacctgggctcagagcaccgcgttccccgagttcaagcccgaggagatggctgccatcatgaaggatttcgacgagccggggcacctcgccccgaccggcctgatcctgggaggcaccaagtacatggtcatccaaggcgaacctggagctgtcatccgtggcaagaaggcatccggnggcatcactgtgaagaanacagggcagtcactcatcattggcatctacgacgagccccatgactccgggca

SEQ ID NO: 63029 - DNA, 434 bp, Zea mays
  unsure at all n locations
  Clone ID: LIB3075-008-Q1-K1-F7
cggacgcgtggggaaaggcattgttcaatggcttgccaaacccttttactgccgcgagggaccacagcttggtcattgagcaagaaaccttcccacatgatgctttggaggctactgcatggactgaagatggacttatcatggctgctcgccacaagaagtacaaacacatccagggtgtccaattccacccggagagcatcatcacccctgaaggcaagaaaatcatcctcaactttgtcagattcattgaggaactggagaagcagcgttcgtaggggaggtagacgcgacaggtggtttcatttcatagatcagacggaagcagagacaaggcgcttaaagctgcgccaggttccggggctggcagttgaagcatagctaggaaacagctntccctctcttaatncgtttgtgtcgtggtgacataatct

SEQ ID NO: 63030 - DNA, 442 bp, Zea mays
  unsure at all n locations
  Clone ID: LIB3075-008-Q1-K1-E3
tcggccacgcgttcgnccacgcgttcggcgtattttttctggtgaggactacctaatccactgggggcaggggaaaaaaggttattaaaaaggttattttgcattttgaagcctggtcaacttgctaggccaccaattgcctaaaaaacccacctaactacctttctgggcacttctgggtaactacaacccccaccaggggtacaaagaagttgttacccagcaggataagcacgaagaaatagctttcgttgaagagatcgctagaacagcgccaattaagtacttgcaccggtacttagtgcagaagggggctgtgcctcaggactacgaggacttcaagagaatgctgacatccctatggtttgatttgtatggaagaggtggcaactctagctgctcttctgcctttgagcatgtgtnttgtggtgagatcaaagga

SEQ ID NO: 63031 - DNA, 477 bp, Zea mays
  unsure at all n locations
  Clone ID: LIB3075-008-Q1-K1-E4
aaaccggggcgacccacgcgttcggcacgaggcataccttggccggggaataaattggcatttgccaccgatgaaccctccgccggggccagaggcatcaccgtcgaaaccaccatctacatcgccagcagcatcaccatcggaatcaccaccagcagcatcgccaccagaatcgccgtcgacaccaccaccagagtccgtcgactacaccgccgacaccagcagcagcaccaccgaaatcaccgtctgatccaccaccagctacgccaccaaaatcatcatctgatccaccgtcgacaccagcagctacaccaccggcgactccatccccatcatcttaatcacgaaggatatttcaaaagcagtagtagtttagtcaaattaaatatgcgttttaggattctagttgatatgcgtccattantttgttcacatcgaatgcagcagtgtgttagctatgtagttgcatacctatca

SEQ ID NO: 63032 - DNA, 361 bp, Zea mays
  Clone ID: LIB3075-008-Q1-K1-E5
cgaccacgcgtccgtggaattgcatccacagaaacagggacccaaatgctggcccccttgataccgtgcaggtgggtgtgaggaaggtgcggaataaagtggttgggcaaataggagatgctttcctgacatatgaccgggttactggtgaattcaaggatgctggtaaggccactacagcagccagtgcaaaagcggcaaaacagtcacgcaaagaggcatataagataccatttcaacatgctgctcaagacggtgagaatagttttggtctctgactgcataagaaagacatgttcctgctgatttgatgtacctgtatcaatcaacgcaagtgagatttcacgattgtttctgggga

SEQ ID NO: 63033 - DNA, 454 bp, Zea mays
  unsure at all n locations
  Clone ID: LIB3075-008-Q1-K1-E6
aaaacgggcgaccgacgcgtccgactgatccaanacaaattatggctgtgaatttgataaccatgtggtcgtcgatgccggcagacgtttttatggttgtggcgttggtgttcttggtgagcggcgcatggtgcggtccttccaaagtccccccaggcaagaacatcacggccacctatggcaaggactggctggacgctaaagcgacatggtatggcaagccgacgggtgccggtcccgatgacaacggtggcggctgcgggtacaaggacttgaacaagccctccttcaatagcatgggcgcatgcggcaacattcccatcttcaaggatggtctgggttgtgggtcctgcttcgagatcaagtgcgataagcctgtggagtgctcctgcaagcccgtggttgtgcacataacggacattaacttttagcctatttctgcgttcctcttttt

SEQ ID NO: 63034 - DNA, 368 bp, Zea mays
  unsure at all n locations
  Clone ID: LIB3075-008-Q1-K1-E7
agcagccgtgtcttgtgtacaggtgtgttttgctattgttgatcgatgaagctgtaggtggacatgttatgatgcccattatattattctgttgtcggccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaanggggggggcctttttaaaggaccaaagttaacttccccgtctttcaaaaaaaaaaccttttttaaagtgcaacaaaaataaaattaacggccccggttttaaaaacgtaggaatgggaaaa

SEQ ID NO: 63035 - DNA, 214 bp, Zea mays
  Clone ID: LIB3075-008-Q1-K1-E8
gcatctgcttaatcagagtagcatacctttggctttgtggagacaatgttccctggtcgagggccactgccactgtaccttttttatcatgcaaacaagagttccgacttttacataaatacgtacatgtcaattattgacttaatgaacagttgtttgaataatgaagctagctcaatgaaaactaatagtgtggataacactagccacactc

SEQ ID NO: 63036 - DNA, 424 bp, Zea mays
  Clone ID: LIB3075-008-Q1-K1-E9
gtttccagtgtcttgccagtttgccaagagcaatgctgaaggtctgaacttctttgtggggaggatctagtaatggcagagaggctactcatgaaacacctcgatgcaccaggcaggtggctggcggagaagcatcggaggacgttgatgaacaagtattgtggacggtacctgcgggacaagcacctgcagcactacattatctacggggagacagtgcaagacagattcgaacacaatcgacgtctaaggaatccttcaacgacctctgtccagcaagcgctacatgggcttgcatactgtgtgtatggcaaacctgacgtgcggcgtttgatgttcgaggtgtttgacttcgaacaggtccagcctaaagcagtctgaggatcttctccattggtaccgatgctagacgtgctgaatgctg

SEQ ID NO: 63037 - DNA, 416 bp, Zea mays
  Clone ID: LIB3075-008-Q1-K1-F1
cccgatgacgagttcaaggccaaggtgaaggagtcgttcaacgatgggaaggagctcaccagcgacgccctggcgctcatcgagaaggggtcatcgctcctctccgtgctaaagggcggctcgaaacgacggttgctcgaggaggagggagaaccggcgcaagccgggcctgcactcgacaaggacggcatcccggagtgggtgcccgacagtgagcggagggtgctcaagggcggcggcttcaagagcacactcacgccaaatgtggtggtggcgaaggacggcagcggcaagttcaagaccatcaacgaggcgctcgccgccatgccaaagacctacgacggaagatacgtgatccaagtgaaggagggagtgtacgaagagtacgtgaccatcaccaagactatgaagaacgt

SEQ ID NO: 63038 - DNA, 366 bp, Zea mays
  unsure at all n locations
  Clone ID: LIB3075-008-Q1-K1-F10
gccgaggccattgacgatggcaagattggaccaagggatgaccccaagattcgctccaggatcttgtcagaagagtttggttgggacaaggatctcgccaagaaaatctggtgctttggccctgagacccttggacccaacatggtggttgatatgtgtaagggagtccagtatttgaatgaaatcaaggattctgtggttgctggattccagtgggcatcaaaagaaggtgctttggccgaagaaaacatgagagccatttgctttgaagtatgtgatgttgttctgcacgctgatgctatccacagaggaggtggtcaaatcatccctactgccaagagagtcttctatgcttnccagattact

SEQ ID NO: 63039 - DNA, 422 bp, Zea mays
  unsure at all n locations
  Clone ID: LIB3075-008-Q1-K1-F11
gttgtccataatgatgaagtaatagttagctgccataacatggttttgaagaacactgaggcaactgcgcacgctgaagtaactgcgataagagaggcttgcaaaaagcttgggaaaattgagctgtcggattgtgaaatttatgcatcctgtgagccatgcccaatgtgttttggtgctgttcatttatcccggattaagaggctggtgtatggagccaaggcagaagctgcaattgccattggatttgatgatttcattgctgatgctctcagaggaactgggtactatcagaaggccaacatggagataaagcaggcagatggaaatggagccatgattgctgaacaagtatttgagaagactaaagagaagttccaaatgtattgaaccgtggaaaatactggtgggatganttaaca

SEQ ID NO: 63040 - DNA, 409 bp, Zea mays
  Clone ID: LIB3075-008-Q1-K1-F12
cttcgatctcttccacttcggccacgcccgcgccctcgagcaggccaagatgctgttccggaacacctatcttctcgtcggatgctgcaacgacgagctaacctaccgctacaagggcaagaccgtcatgacccaagaagagcgatacgaatccctgcggcacttgaagtgggttgatgaggtcattcctgatgcaccgtgggttctcacacaggagtttattgataagcatcagattgactatgttgctcatgatgcgctgccttatgctgatactagcggaacagcaaatgatgtctatgaatttgttaaaaaagatggaaaattcaaggaaacaaaaaggacagacggggtttctacttcagatctcataatgaggatcttgaaggactattaccagtatgtcatg

SEQ ID NO: 63041 - DNA, 443 bp, Zea mays
  unsure at all n locations
  Clone ID: LIB3075-008-Q1-K1-F2
cgttccgtgattcttaagatggggcctcgaattgcttatttaaccaactnggcttctaacatgtccaggaggctttaagtttaacctgatgacatgtcataatttgggcgctaaactcatgtgcatgagatatattcttttgtgcacaatcgttttcttagcgggtgtctgattctgtatcacctttgtgtcgttgacttgttttatgtggctctgttattgcgggtgcagctctgttataagggctattaataaggtggtggttgttaaactatgtcctgcatatagtagagactgtgagctgatatgttttcagctaatcattaaggatcggaaatcttcatacaaattccatctctactgattattcacttgctgtagcttttgtgatccttaagatggaacagataattgcttatttaaccacgttggcttctaacgtg

SEQ ID NO: 63042 - DNA, 416 bp, Zea mays
  unsure at all n locations
  Clone ID: LIB3075-008-Q1-K1-F3
tcggatcaacggcccgccaaccaaccatcttcctttttccacccaatacctaataacatctcctcgaacgccaggttccttggaccactatatccaggagcgacgaagtgatccacccgccagccatggagatgaagaaggtcctctgcgccgccctcgtcgccgccgcctcggccaccgccgtgctggcctcggtcgcctccgaggcgccctccgaggcgcccgccggcgcggccggtggtgcggctggccctagcgcaagcggcgccgccgccgccgccgtgcccgccgccggggcgctcgtcgcctccttcctcgcctactacctccactgagcgacgacgcgcggngcggcaacgttgggatgcatcgtgtttggttcatccgattaattaattgttttttttatttacgtg

SEQ ID NO: 63043 - DNA, 371 bp, Zea mays
  Clone ID: LIB3075-008-Q1-K1-F4
tgcgataagcctgtggagtgctccggcaagcccgtggtggtgcacatcacggacatgaactatgagcctatcgcggcgtaccacttcgatttagcaggcacggcgttcggcgccatggccaagaagggcgaggaggagaagctgcgcaaggcgggcatcatcgacatgcagttccgaagggttaagtgcaagtacgactccaaggtcaccttccaccttgaaaaggggtgcggccccaactacctggcgctgctggtcaagtacgtcgatggcgacggtgacattgtggcagtggacgtcaaggagaagggctctgacacgtacgagcccctgaagcactcctggggcgccatctggaggaaggacagcga

SEQ ID NO: 63044 - DNA, 406 bp, Zea mays
  Clone ID: LIB3075-008-Q1-K1-F5
tccgtccgctcgcgctcctcctggccgtcctcggctgcgcgctgtgtccccgcgccgatggggcgcgttcgaggtcggcggcgacgacgggtgggtcgtgccgccggccagcgacggcggcaggtacaaccagtgggcatccaagaaccgcttcctcgtcggcgacgtcgtccacttcaagtacagcgaggactcggtgctggtggtgacggaggccgactacgacagctgccgcgcgtcgcaccccgtcttcttctccaacaacggagacacggaggtgacgctggaccgcccgggccccgtctacttcatcagcggcgagaccggccactgcgagcgcggccagcggatggtcgtcagggtcgccggccagggcgcacccccgacggcgccttccagcccggcg

SEQ ID NO: 63045 - DNA, 322 bp, Zea mays
  Clone ID: LIB3075-008-Q1-K1-F6
ggatgagctcagtgaagatgacaagttgacatttgctcgtgctaggaagattcaacggttgggtagccagcctttccatgttgggctaaattttacacgtgcacacctgaaagacactttgctctaagagagagtgaaaaaattcaccacggctttgatgatgacaattatgaccactcttaacaacagtcattctacatggttggaggaatagaggaggtcatcgccaaggcagagaagattgccaaggaatctgcatcataaggggtctacaggcaacgcaaaatttaacttttggaggtcaacgtgatgtgctttttat

SEQ ID NO: 63046 - DNA, 371 bp, Zea mays
  Clone ID: LIB3075-008-Q1-K1-E2
cgggacgcgtggggtggcgtcagctcgggcatggcgttccacgaagtggagacgccgcgtcgaggctgagacgccggggcatggtcggcgcgcagtgacggcggccggcggctcggttcgtgcgtgcgtgcccagcattcttgcccctgttgagtcatcggctcgtcgctcgctcgcgcccccgccgctcgccccgcgtccacagggtcgccgccacggggaggcgcagagggaaaaggaagatgagctgctttccgtgcttcggcggcggaaagggcaacaacgacgacgccgacgcggagagcccgggcgacgcggccccggcgtctaacatgacgccagccgcgatggtgcaggcgcccgccgcgtac

SEQ ID NO: 63047 - DNA, 454 bp, Zea mays
  Clone ID: LIB3075-048-Q1-K1-G10
tcgggcattgttgatattggagcagaaattctttgatcttctaagaaatgacaatgtcatgggcgctgtgaagactttacgatgtgacatcacaccccttggtgtgaatagaaaaagagtgcatgaactgtcgacttgtatgatttcttgttctccacagcagttgttccttgggttttcaaaacttggcattgattcttctagttcaaggtttaagcttctagaggaattgcaaaaggtgctccctccaactgttatggtgccagagaggaggttagaaaatttagttgagcaagcacttactgtacaaagagatgcttgctacttccataattctgttgatgggttgtcactgtacattgatcatcattgcgggaaagatcagctaccatctcgcacgttacatgttttgcatgcacatcatgatgaactgtggtttgtccaatttcaaaca

SEQ ID NO: 63048 - DNA, 419 bp, Zea mays
  Clone ID: LIB3075-048-Q1-K1-G11
ccaaaccgacgatggcgtcgaataagacggtcctcatcgtcgcggcgatgcttctcatcacgctcgtgctggaggccgcccctccggcgaccgccatggactgcaaggccgggtgtgacgaggtcacgggcccactccacatgagcatggaggactgcatgaagaggtgcaaggagatcgctgctaagcaggggcctagggacccttacaaggataacaaacttgacatcccatgaactaattaatgctcctatatcatctgcctatccatgcatgcattgcattgcgtatgcacactgtgcgtgcctgcccacaaagttcgacaacacaccgatctcgacggatttgtaatcgtgtccactcgatcgagagatcgatcgatgcttgttattatatttgtattccacattatatataag

SEQ ID NO: 63049 - DNA, 311 bp, Zea mays
  Clone ID: LIB3075-048-Q1-K1-G12
gcggcgaggcggcggaggcgaagaagatccaggacgacttctgctcgacgctgtgcgagggcaaggaggggacggacctggtcgtgtgcaaggagtcctgcgcgctctcccagcagtccaacctggtgctgtacggcaggatccagtgcaagggcaagtgcaccgagcagaagggcatcacggcgccggccatgaaggtctgccaggaggagtgcgacaaggcgtacgtggtgaaggcggccgaggtcaccaaggcctgcagcgtcacctgcgccaaggagaagaacccgcgcctcagcgagaactgcaag

SEQ ID NO: 63050 - DNA, 520 bp, Zea mays
  Clone ID: LIB3075-048-Q1-K1-H10
gacccacgcgatccactcgtccgttctccagcagcctatcgcggcgtaccacttcgatttatcaggcacggcgttcgtcgcgatggccgggaatggcgaggaggagaagctgcgcaaggcgggcatcatcgacatgcagttccgaagggttaagtgcaagtacgactccaaggtcaccttccaccttgaaaaggggtgcggccccaactacctggcactgctggtcaagtacgtcgacggcgacggtgacattgtggcagtggacgtcaaggagaagggctccgacacgtacgagcctctgaagcactcctggggcgccatctggaggaaggacagcgacaaaccgcttaagggacccctcaccgtccgcctcactaccgagggaggcaccaagtccgtctacgacgatgtcatccctgccaactggaaggccaacaccgtctacaccgtcaaataattaactttagtgctgacaatactttaagccgacctatgctagctatactagaatgggttggat

SEQ ID NO: 63051 - DNA, 429 bp, Zea mays
  unsure at all n locations
  Clone ID: LIB3075-048-Q1-K1-H11
cccgcgttcatcgacggacgagctcgccggcgagagagcgactgagatggaggcggcggcagcgggggccggcgtggagctgggctcttcgaagccccagatcgcgacgcaggcggagatggcggaggcccgggtgccgctcgcctaccgcgaccagtgcgcgcacctcctcatcccgctcaacaagtgccgcgtcgccgagttctacctcccctggaagtgcgagcccgagcgccacgcctacgagaagtgccagtacgagctcgtcatggagcggatgctccagatgcagaagatccgcgaggcgcangagaccaaggtcaagggcggcgcctncattggcctcatcccggccaccgncaagctcgcctgatacgggtcccagcccgatccgcttgatttaggtctgtttgttggctatagcagcgt

SEQ ID NO: 63052 - DNA, 313 bp, Zea mays
  Clone ID: LIB3075-048-Q1-K1-H12
cggacgcgtggggtcctattggtctaatctgggagggtactatctcaacaaccgacaccacatcgagtcctacaatccttcagtatacggtaacataagtaaactagaggattgtaggatggatgtggtgtcggttgttgagatagtgtcctattggtctaatccgggagggtacttttcagaaggaaacgacataagccatttcggttcaaggtatgagatgcatgcttgaacccttggtcctggaactggggggaacatattcttaatatggaattattgtcgatctggggaaaaaacaatcaagctcatg

SEQ ID NO: 63053 - DNA, 495 bp, Zea mays
  Clone ID: LIB3075-048-Q1-K1-H9
gcaaaaccatcagatctagcagaactctctcgacctcatcggcgttggcggagcgcgtgttgaccggagatggcgccgagcgggtggaggaggagcgcggcggcgcgggtcgcctggcgcccggccacggtttgcctgtggctcgcgctcgccgtcgtcgcactgacgctcgcccaggctaagaaggacctgacggaggttacccacaaggtctacttcgacatcgagatcgacggcaagcccgcaggccggattgtcatggggctttttgggaagactgttcctaagacggcagagaacttccgagctctttgcacaggagagaaaggggttggcaagagtggcatagccctccactacaagggaagtaagttccacagaatcatccccagcttcatgctccaaggaggtgacttcactctcggtgacgggaggggtggtgaatctatctacggcttgaagtttgcggatgagaacttcatgatcaagcacact

SEQ ID NO: 63054 - DNA, 293 bp, Zea mays
  Clone ID: LIB3075-049-Q1-K1-A1
agatagtttaggtttgataatggatccaaaatatgttagcctatgcatcttcgtattacttgtattgcatggagatactactttggcagaaacttgcagggagtttgctaaatggcatccattctgctttagtgcaatgtgcaaggcaaattgttttatagaaggaaaaagctccgatggttcctatgcaaagggatatagatgtgattcacatggatttcattctatgtgtatttgccttttgtgaaaagttagttatcttaagacaagcggggatatattctatgttcata

SEQ ID NO: 63055 - DNA, 365 bp, Zea mays
  Clone ID: LIB3075-049-Q1-K1-A10
cagcgccgtcctgctccggcccctcgctgccgccgtggcgccgccgaagccccgcgcgatgccggtctcctcggcgcccgcgacgagacccagctccgacgccgagctactcagcgtcatcgactccgagatcaagtacgccgaggactgcgatgaccacgacagggttgaggagattccagaaaatttccctttcaaaatcagcgacgagaaggggacgaatgcagttacccttaaaagaacatatcagggtgagcagattgaggttgtggttcacatgcccagccttgtcactggagatgagcctgatcatgaccgtgatggtgaggatgaggacacggcgggagatgacaatgacgaagatg

SEQ ID NO: 63056 - DNA, 389 bp, Zea mays
  Clone ID: LIB3075-049-Q1-K1-A11
tgaaaattgttgttgggaagaatctggatctaatagtttttgatgaaacaaaagatgtacttcttgagatatatgcaccatggtgtggtcattgtcaatcgctggaacctacttacaacaatctagccaagcatctacgtagtgttgactcccttgtggtagccaaaatggatggtactaccaatgagcatccacgtgcaaagtctgacggatacccgacgattctcttctatccagctgggaagaaaagctttgagccaatcacttttgagggggagcggacagtggtagatctgtacaagttcatcaagaaacatgctagcatccctttcaagttgaagcgccaggagtcgagaaccgagagcactcgggcggagggtgtgaagagc

SEQ ID NO: 63057 - DNA, 457 bp, Zea mays
  Clone ID: LIB3075-049-Q1-K1-A12
cgccgccgctgcgccctcctctcggtcctgccgtccgtcgaggtaaaaggacagcatggtgagggtcagcgtgctcaatgatgctctcaagtccatgtacaatgctgaaaagatagggaaacgtcaggtcatgatcaggccgtcatccaaggtgatcatcaagttcctgacggtcatgcagcgccatggctacattggtgagttcgagtacgtggatgaccacagagctgggaagatcgtggtggagctgaatggaagactgaataaatgtggtgttattagcccacgttttgatgtaggtgttaaggagatcgagggatggacggcgaggcttcttccatctcgccagtttggctacatcgtcctaacaacttctgctggaattatggaccatgaggaggcccgccgtaagaatgttggtggcaaggttctaggtttcttttattgaaaatgtgtt

SEQ ID NO: 63058 - DNA, 136 bp, Zea mays
  Clone ID: LIB3075-049-Q1-K1-A2
acgcctctatgtgcaacagtagtagagaaggcattaatacttgttgctcacaatgcctaggttgtgttctttagtccagacaagaaaacatgttaatccgcagctgattaagagcttcaactcttgcaactactct

SEQ ID NO: 63059 - DNA, 299 bp, Zea mays
  Clone ID: LIB3075-049-Q1-K1-A3
acggcgctctttcttgagtgagagggtccaacatttggtaccagagctaggatggagacgccgccggcaaaggatggcctcaagatgttcgacggcatgggctcgacgagtgccgcgatggagcgcgtcatcaacagcagctccgttgagctcccgctgctgaccaaggcgaattaccacgagtgggcgttggttatgcaggtctcgctggaggcgatggaactgtgggacgcggtggaggccgtgtgcaaagagcgttccaaggatcggcgggcaatggccgccatcctgcgcggagt

SEQ ID NO: 63060 - DNA, 443 bp, Zea mays
  unsure at all n locations
  Clone ID: LIB3075-049-Q1-K1-A4
atcagccaagagctatccatacgcacagcgatgcaccagcacgagatactagccatcatgcgcctgtcgtccctcctcctcggcgtggccgccctctcggcgcgcgccgcggcgcagcaggtgccgccggtgggcggcagcgctctgaagccggactactacagccagtcgtgcccgcgcgcggagcggatcatcgcggaggtgatgcagacgaagcagatggcgaacccgacgacggccgcgggcatgctgcgcgtcttcttccacgactgcttcgtcaccgggtgcgacgcgtcggtgctgatcgcgtccacccagttccagaagtcggagcacgacgcggagatcaaccactcgctccccggggacgccttcgacgccgtggtgcgcgccaagctggccctggagctggagtgcccccggggtggtgtnctgcgccgaca

SEQ ID NO: 63061 - DNA, 445 bp, Zea mays
  Clone ID: LIB3075-049-Q1-K1-A5
atcgccgagttcaaggaggccttcagcctcttcgacaaggacggcgacggctgcatcaccaccaaggaacttggcactgtgatgcgctcattggggcagaaccctactgaggctgagcttcaggacatgatcaatgaggttgatgctgatggcaatggaaccatcgactttcctgagtttctcaacctgatggcacgcaagatgaaggacaccgactctgaggaggagctcaaggaggccttccgtgtgttcgacaaggaccagaatggcttcatctccgctgctgagcttcgccatgtcatgaccaacctaggcgagaagctgacggacgaggaggtggacgagatgatccgtgaagccgacgtggacggcgatggccagatcaactacgatgagttcgtgaaggtgatgatggccaagtgagatatgctcgctatttttaagc

SEQ ID NO: 63062 - DNA, 454 bp, Zea mays
  unsure at all n locations
  Clone ID: LIB3075-049-Q1-K1-A6
ctcgccgaccccaaggaggcccgcgccggcatcaaggaggtccacttcctccccttcaacccggtggagaagcgcacggccatcacctacatcgacggcaacggcgactggcacagggtcagcaagggcgcccccgagcagatcatcgagctgtgccggatgagcaaggatgccgagaagaagatccacgccctcatcgacggctacgccgaccgcggcctccgctccctgggcgtgtcgtaccagctggtccccgagaagagcaaggagagcgccggcgagccgtggcagttcatcggtctcctcccgctgttcgacccgccgcggcacgacagcgcggagaccatccgncgcgcgctccacctgggcgtgaacgtgaagatgatcaccggcgaccagctggccatcggcaaggagacggcgcggcgcctgggcatgggcagcaacatgtacc

SEQ ID NO: 63063 - DNA, 237 bp, Zea mays
  Clone ID: LIB3075-049-Q1-K1-A7
tcaatgaccggtggacaaccatttgctacagcagaaaaccgacaaggtgacgctcgcggagatcaactgcactgggccaggcgctgacgtgacaaaccgcgtgccatggtcgtggaggttctctcccgacgacgcggccaagtacctcaccatcgacttcatcaacggcaaagactggctgccggcgtactactactgatccgaccaacgactgctggatccatcaaacatgcatgc

SEQ ID NO: 63064 - DNA, 275 bp, Zea mays
  Clone ID: LIB3075-048-Q1-K1-F12
tcgggccacttcacgaggcactaccactttatgctgttcaagtcctgcgactcttcctccgaggacagggacacgcacttaacaaagacttcactctactactgatatactccatcgtacaaaactatccactaaccaataacatgcatctaaaccgttatcatccactccacgaactgactcatatgcacgatcacaaactgtcgtaaacacagcactattagccctagaacccgttacggtactaccttcaacagcaggtcctcaaaggtgac

SEQ ID NO: 63065 - DNA, 124 bp, Zea mays
  Clone ID: LIB3075-047-Q1-K1-H8
atttgaaacagttcagaattcatctataagattgcctacatatatatatgattctggcaaggcaaacgtgatgcagtcttgacgcatgttccattcggacatcatcatgcttgtcctgctgatt

SEQ ID NO: 63066 - DNA, 218 bp, Zea mays
  Clone ID: LIB3075-047-Q1-K1-H9
aaaaccatagtatcaatcatgattggccgttttttgtcaataatggccactatgctgacgaggaggctggtcgacttgctcggccgggcctccgatgtcgaggacgacctccggggcaaaaagaagcccaacatacaccacctcaaggttaaggcgtgtccatggacggacggtcacgcgactatctaaaagcggacgcgacgcgttaactgacacca

SEQ ID NO: 63067 - DNA, 472 bp, Zea mays
  Clone ID: LIB3075-048-Q1-K1-A10
atttcatgagagggaacaatatgtctatttcacatagacacaaatacaagataaggaaagagagttgaaaagggactataggttgctaaaggatgcaaagaatcaaagtggagcgcattttgatgagaagacagtgaggattacggctgacccagctttatggaaaaatatactgacttctcatgctaaggctaaaaagttctgcaacaagtcttttcctctatatgaggccttgggggagctttatgatgggcaaacagctgaagggacctactactacaccttcacccaacttttagatcttactcaagtaggaaatagagatgagtttctcatcatagaacatgaacaagatgaagtggaagaaaccttgccggcacatgaagaagatgatgtccatgttgttgaggcaggagatgcaacaggtttaaggcatgatccattgccgcagagaacgactactgctacaaga

SEQ ID NO: 63068 - DNA, 328 bp, Zea mays
  Clone ID: LIB3075-048-Q1-K1-A12
catactcactgcccaaccactcacattcccgttattactacgactaacaaccgagaggggcaactgggtcattctacaagacgtactgccagccaactgcacaccacacgcactgtacacttcccacttaccattatactatacttcgaactcccttccattcatcctactctgtggcctatgaaccttacggacccagctaactaagcttatctctatcgcatgactaagcatgcaccggtaaccacatatactactgacacttctgacacctagtctatgtcatgctttcgtactactttaagaggcaattctaatcatgtatgcc

SEQ ID NO: 63069 - DNA, 167 bp, Zea mays
  Clone ID: LIB3075-048-Q1-K1-A9
actttataccctattccttctacacttccaacttccaattctactatactttcaattaccttcaatacatcactctctttactctatatacctacatcaacaatctaattaactttattatattcatatatacattcaccctaccattatactactaactttaatct

SEQ ID NO: 63070 - DNA, 390 bp, Zea mays
  unsure at all n locations
  Clone ID: LIB3075-048-Q1-K1-B11
gatgtcatgcactaacatttcgangttagccttcntcctcctggtcctcagcatcatgattcattttcagaaggaanagtcaaatgtcatcgatgctaaagcgtccgttcctggtacctccttctacatcaccaagttggtcgcctccggcaatgtcaagacatacagcacgaatgctgtgcatgaggcatgtgcatctgcttgcggctgctctgggaagcatacaatcctcatacccaagggcgacttccttgtcggacaactcaacttcacaggcccttgcaaggtctacgtgaccatccaagtggatggcaatctgctggcgaccactgacctaatccattacaatgaccatggtaattggatctagattctactcgtggataacct

SEQ ID NO: 63071 - DNA, 305 bp, Zea mays
  Clone ID: LIB3075-048-Q1-K1-B12
gttattctgagattgtaacacaattaaacctgtcagatgatgatgtagtgcgtttgctccattctgtttcttgtgcgaagtacaagatccttaacaaggaaccggctagtagatccatctctcccaatgatgtttttgagttcaattcaaagtttactgacagaatgagaagaatcaaggttccactccctcctgttgatgagaagaaaaaggttgttgaagatgttgacaaagacaggaggtatgcaattgatgcatcaattgtgcgcattatgaagagccgcaaagttatgggtcatcaacag

SEQ ID NO: 63072 - DNA, 420 bp, Zea mays
  Clone ID: LIB3075-048-Q1-K1-C12
gcagttccccgaccacaccgttcctccgagcccattagcagccccgctccaggaggaagtttgttgttttaacaatatgtcgagggaggagaatgtttacatggccaagttggctgatcaggctgaaaggtatgaggagatggttgagtatatggagaaggtggctaagactgtagatgtggaagagctcactgttgaggagcgtaaccttctgtctgttgcatacaagaatgtgattggggctcgcctcgcttgatggcgcattgattctttcattgaacaaaaggacgagtgccgtaagaacgaagagcatgtgaaccttatcaaggaatatcgcgtcatgatcgacgctgaactgatcaatttctgggacgcttcttgaagctgcttgacttccacttattgccttcttatactgct

SEQ ID NO: 63073 - DNA, 283 bp, Zea mays
  unsure at all n locations
  Clone ID: LIB3075-048-Q1-K1-C9
caagatgtcatgcacaaacatttcgatgttagccttgntcctcctggtcctaggcttcatgtttcatgttgagaaggaanaggcaaatggcatcgatgctaaatcttcctgtcctgttggttccttctacatcaccaagttgttcgccttcggcaatgtcaagacatacaactctaatgctgttcatgaagcatggtcatcttcgttctgcttcactgtgaatcatacaatcctcatacccaatggcgacttccttgtcggacaactcaacttcacaagccct

SEQ ID NO: 63074 - DNA, 363 bp, Zea mays
  Clone ID: LIB3075-048-Q1-K1-D10
cggacgcgtgggcggacgcgtgggccgcaccctttcatcagcctgcctgtccactgttggcttggtgacttcctccgctccgctcccctccgctcccgaacggtcgatctttgcatggcagcagcagctggctccaaggggcgggcgatcgctggaagcttcgtcagccgcgtcctcgccggcaaggccgcctcgccgaggagggccgtgcacgcctcggcgtacgacaagaacctggaggaacaggtgcgcccggcgttcgtgccggacgatgtgatcggcagcgccgggagccccgacaagtactggagcccccaccccaagaccggcgtgttcggccccggcggcggtggaccccaagct

SEQ ID NO: 63075 - DNA, 442 bp, Zea mays
  Clone ID: LIB3075-048-Q1-K1-D11
taatccgggggtccacccactcgtccgtctccttatctctaacgatcttctttttcctactttcgctcccttttgctcatcgctagtgccttgcggtcttttacctcctgctctagcatctgctatccatacttacagtcttcgtttgatgctggaatcctgattggcaggttcaatcacatagctcgatcgccatgtctttcactgtctctcatgacaagtgctaagcctgcgactagactgtccacatcatcgacctgctctccgcctactgcttctcgtaccacatgacattcttcaagtgcatccactgcaatgacgtcctctcaatcagcagatactctctcatggacggagtccttttctttatgactcactctgtacagcttttcaactatacaggtaccctctcataaaacttttaacgttgagcatattcaaa

SEQ ID NO: 63076 - DNA, 382 bp, Zea mays
  Clone ID: LIB3075-048-Q1-K1-D12
ccgcacctggacctattgagcagcgttggactgtccgcagcaagagcccgatgagcccggcatcaagctctgaagaagatgatgtattttcatgggttggtattataatgtatctgccaacatctgatgctcgccaaaggaaggaaatcacagaggagttcttcagttacaggagcctggcgcgaagtctctgggatgattattccgcttatgaacactgggccaagatcgaggttccaaaagacaaggacgaacttgccgaactccaggcccggctgaggaagcgtttccctgtcgatgcatataacatggcacgtatggagctggaccccaacaaggtgctctcaaacgccaagttggagaagatgttccagtgttggag

SEQ ID NO: 63077 - DNA, 455 bp, Zea mays
  Clone ID: LIB3075-048-Q1-K1-D9
acgacgtcttttttccctttcgctcccgtttgctcatcggaggtgccttgcgataatggaccgggtgcacgagcatcggctagccatacttactgccttcgtttgaggctggagtcctgattggcaggtgcaagcacagagctcgatcgccatgtctttcaccggcactcatgacaagtgcaaagcctgctacaagactgtccacatcatctacctcctcaccgtctactgcgtctcgtaccacaagacatgcttcaagttcatccactgcaaggtcgttctctcgattagcagctactcttccatggactgcgtcctgtactgcaagactcactttgaacagctcttcaaggagacagggaccttctcaaagaactttcaaggtggagcatcttcaaacaagaacgacctctcaaaggctccaagcaagctatcatctgcattctctggaactc

SEQ ID NO: 63078 - DNA, 407 bp, Zea mays
  Clone ID: LIB3075-048-Q1-K1-E10
gaagacagacgacgactccacgagccccaagaagagagccatcgcggctgctgatgacgattgcaagcctgccggtgacgagtcaacgtcgtggaagcgcctcgtggacggtatgcgcccgctccgccttcgcgggcagctggagtactacccgtcgtcaccgccgtcaccgccgctgggccacgccgatgtgtaccatgacgtgatcctcccgccgtcgtcgcaggcacggttcggcttcgagatcaaggaggtgggcatgaccagccgctacgcgtccgctgaggatctgcaccagatggacagcgaccaggaagagggtgctgagggtggcgatgacggtgacagcagttgcccacacgccatcgacatgcatgcggaggagtcatcaccaagtctatgagcag

SEQ ID NO: 63079 - DNA, 453 bp, Zea mays
  Clone ID: LIB3075-048-Q1-K1-E12
ggcagggcatatttctcagcaacctcagcacacacttgtactggagatggcaatgctatggtcgcgacgtgctggtttacctcttcaggatcttgagtttgtacaattccatcctacaggcatttatggtgctggatgcctgattactgaaggttctcgtggtgaaggtggtatccttagaaatagtgaaggtgaacggttcatggaacgatatgctcctactgcaaaagatcttgcttctcgtgatgttgtttcaagatcaatgacaatggaaattagagaacgacgtggtgtagggccattgaaggatcacatttatttgcatctgaaccatctgcctgctgacgttctcaaagaaaagctccctggaatttctgaaactgctgtaattttggctagtgttgacgtcaccaaggagcccattccagttttgcctactgtgcactacaatat

SEQ ID NO: 63080 - DNA, 411 bp, Zea mays
  Clone ID: LIB3075-048-Q1-K1-F10
cggactcgtgggtgcgggcacaggttgcgatggttgtggcgttggtgttcttggtgagcggcgcggggtgcggtcctcccaaagtccgcccaggcaagaacatcacggccacctatggcaaggactggctggacgctaaagcgacatggtatggcaagccgacaggtgccggtcccgacgataacggtggcggctgcgggtacaaggacgtgaacaagccccccttcaatagcatgggcgcatgcggcaacatccccatcttcaaggatggtctgggttgggggtcctgcttcgagatcaagtgcgataagcctgtggagtgctccggcaagcccgtggtggtgcacatcacggacatgaactatgagcctatcgcggcgtaccacttcgatttagcatgcacggcgttcg

SEQ ID NO: 63081 - DNA, 411 bp, Zea mays
  Clone ID: LIB3075-047-Q1-K1-H7
gcgctgctaaagctctttttgtcaagctgttttctacagctatatctgaaagatggctggatggggctcttggtaaatcagctgcccctgacgaagagatacaaagtacaagcgttgtaaaggtgaaacgttctaaagaagaatgtggccacataatccatgagtattttctctcagatgaagtcccagaacttattcgaagccttgaatagctttctgttccagaattcaatcccattttccttaagaagcttgtgacgcttgctatggatagaaagagcagacataacgagatggactcagttctcctttcttcattgagattagaattgctttcaactgatgacatcattgaaggtttctgtatgcttttgcagtcagcacaagacactgtacttgacattgccgatg

SEQ ID NO: 63082 - DNA, 325 bp, Zea mays
  Clone ID: LIB3075-047-Q1-K1-G10
ctcaagctgaacgggactatgttcttgcagagtttaagagcggccagagccccataatggctggcgcagatgtggcagcacgcggtcttggcatgatgattcatttgaatattacgattaggtagccgttccaagtgctcaagggtgataagtcgcatgctcgctgtgctgcgactggtcgagtgaactgaacttgtggatcggtggtgtataccaaggtgccatcatgtctaaggtagataatttccgcccgtggtttacctcatttgagcgcgagcattgaccacgttacacaggcagtctaactttgagctatcatggtaat

SEQ ID NO: 63083 - DNA, 249 bp, Zea mays
  Clone ID: LIB3075-047-Q1-K1-G11
gcaaaatagtcgtgataatttttggattttatgtggaacctgggagaccagttttcaaataattgctcttagtgatggaggaattatccaaaccttcaggcaccccaaggttgtgtttaccgtgttgcacatttccttgaccgggaacgtggttgcaactggtagttatgacacaactgttatgatctggcatgcatttcgtggaagaccaattgataagaaaatcaggggtgccaattttgaactttc

SEQ ID NO: 63084 - DNA, 275 bp, Zea mays
  Clone ID: LIB3075-047-Q1-K1-G12
ctcctcgaggaccgccgtgcaggagcggagctccccgtcgcttctctctccgccttccgagaggcccgacccctgataccacgctgagggcggtggtattaggagattagcgatggcgaggtggcggccggcggcgctgctggtagtggctctggcggcggttctatcggcggcgtggcgggcggatgcgctatccgttaccgtgaccgacaccgagtgcattcacgagttcgtgccctatgagggcgacaccgtgttcgggaacttcgtcgtcg

SEQ ID NO: 63085 - DNA, 351 bp, Zea mays
  Clone ID: LIB3075-047-Q1-K1-G3
ggcacgacgtcgaagagcttggccaggaggcggccgtcgttgatgtcgccctccacgacgaaactcgtcgtggctgcccagcagcgcgcgctgcgccttcttgagcgaggggtcgtagtaggagttgaagctgtcgatgccgacgacgccgtcgccgcgtttgcggagcgccagcgagcagtgcgcgcccacgaagcccgcggtgcccgtgacgagcacggacagccccgcgggcgccccaggcgccgaccgccgccgcggcgacgccgacgcccggatctggcgcttccagtgcaacccgtcccaggacgcccggatctgtcgcgcccggtgctggtcatgttccacttc

SEQ ID NO: 63086 - DNA, 432 bp, Zea mays
  Clone ID: LIB3075-047-Q1-K1-G4
gtcgagtgtccaatatcagagaaccaggactgatttgtggccaccgccgtgcgtcttcacgatcgagggggaccgtgatcgggtcaaagttgcgcgcaataccttggggacttgctcctgggggtaatcatgagcgtggagccggggatcccacacaatttgtcgccggagttggagcaaactcgcgacaccggggaacaccgtgggcagcatcgatttttccacagccgtagacgagcaagcaaccgatgaccccgatactcagcaggtggataatactgagcaggagctcgttgaatgagaagaacaggtgattcaggaggaaccacatggcgaggagtttgatctgatctaggtggcgtgtccccagttgacttttgcgccaaggacgatccttagttcgttttatatttatctttaattttggaataa

SEQ ID NO: 63087 - DNA, 438 bp, Zea mays
  Clone ID: LIB3075-047-Q1-K1-G5
gttgatgacccagagctactggaacttgtagagatggagcttcgggagctcctcagtttctacaagttccctggtgatgagattccgatcatccgtgggtctgcgttgtctgctttgcaagggaacaacgatgagataggaaagaatgccattttgaaactaatggatgcagttgatgagtacattcctgatcctgtaaggcagcttgataaggctttcttgatgccgatagaagatgtgttttctatccagggtcgtggaactgttgttactgggcgtgttgagcagggaacaattaaaactggcgaagatgttgagatcttgggtttgacacagagtggtcccttgaagactacagttactggtgttgagatgttcaaaaagatactggaccatggagaggctggtgacaacgttggtcttcttcttcgtggtcta

SEQ ID NO: 63088 - DNA, 235 bp, Zea mays
  Clone ID: LIB3075-047-Q1-K1-G9
cgatcgagctttcgttatcctcctcgatcttaattacaggtcatagctaagcaggtctgacaggatgtcgtggcagacatacgtcgatgagcacctgatgtgcgagatcgagggccaccacctgacctccgctgccatagtcggccacgacggcgccgtttgggcccagagcaccgcattcccacagttcaagacagaggagatgaccaacatcatgaaggacttcgacgagccc

SEQ ID NO: 63089 - DNA, 444 bp, Zea mays
  unsure at all n locations
  Clone ID: LIB3075-047-Q1-K1-H1
gcagaagttgcggttggcctcgtcctcctcttctccgtcgcggctcagatctctgcgtgcgtcgatggcgtcgttctcggaggctccccccgggaacccgaaagccggcgagaagatctttaagaccaagtgcgcgcagtgccacacggtcgacaagggcgccggccacaagcaaggtccaaacttgaacggtctttttgggagacagtcgggtaccactgcaggctactcctactctgcgggaaacaaaaacaaggctgtagtctgggaagaagacactttgtatgagtacctgcttaacccctaaaagtacattcctgggaccaagatggtcttccctgggctgaagaagccgcangagcgtgctgatctcatcgcgtacctgaaaggagcaactgcatagttcattgacatgccttttgccatgaagagaaaaattgtttg

SEQ ID NO: 63090 - DNA, 283 bp, Zea mays
  Clone ID: LIB3075-047-Q1-K1-H11
tcctgatcgtcctgttcctcacagcagcagccatggcggccgagccggagaagcaggcggcccccgcggcacaggagacggccgtgcacatcgtgtacgttgaccgccccgaggacgccgaccctgaggagttccacatccgcaccctcacccccgtcctcggcagcgaacagaaggccagggacgcagtgctctaccactacaagaacgccgccagcggcttctccgcgaagctcaccccccagcaggtcaaggatctcaaggagcaaccaggtgtttctca

SEQ ID NO: 63091 - DNA, 367 bp, Zea mays
  Clone ID: LIB3075-047-Q1-K1-H12
aagaggatcctcatcgcctcgctcctcgtagtcttcgtctcggccaccgcaatgctggcctgcagggatgccatcatagtcgggtccccatccgtttcctagtcctccgcgtgcacccaaaccctcagtagttccacatgcgcaccctcacccacgtgctcggtagcgaacagaatgccaaggacgcattgctctaccactacaagaacgccgccagcggcttcttcgtgaatctcaccctccagcatgtcaaggatctcaaggagcaaccacgtgttctccatgttgtgccgagccagacttaccaactacatggtcctgggtctggcactcaccagggcacgacacacaccttgggccttatgtg

SEQ ID NO: 63092 - DNA, 417 bp, Zea mays
  Clone ID: LIB3075-047-Q1-K1-H2
cccacgcgtccgggacctccaggttatggtcctggagaaaactttcttcaggtcagttcaaggattactagctgtgagcagagtgtgataatggctcctagcgctatcgcaagaggagttggtccaccaggatatacgcctggagaacaccagggcaatggggctccatggaatacaagctatgagcgaagaccgtttacgagtcctgcgactagctcaagagaagtcggacctccaggatatgggcctgaagaaaaccaaggcagtggcatttcctgtaatacaagcagagagcaaatattgtttatgagccctacaaccatctcgagagaactttgttcaccaggatatttgcccagagaaaaccagcgcagtgacacttcatggaatacaagctgcgaatccggactatttatg

SEQ ID NO: 63093 - DNA, 101 bp, Zea mays
  Clone ID: LIB3075-047-Q1-K1-H3
gcttgcgtgtgtagttaagtaccgatcggtaattttatattgcgagtaaataaatggacctgtagtggtggagtaaataatccctgctgttcggtgttctt

SEQ ID NO: 63094 - DNA, 299 bp, Zea mays
  Clone ID: LIB3075-047-Q1-K1-H4
cccacgcgtgcggtcctagcgtctgccttttcagatacatcgactcgctcgggccgtccctgacgttgtacacgttcgaaggtgcggtagacggcaagcgagcgatttgattctacatgaatgccgagtacgactaccttttcaaacttttgctcattggtgactctggtgttgggaaatcatgcttgcttctcagattcgcagacgattgttatttggacagctatatcagcacaattggggttgatctcgaaattcgcacagggtgggcctgattcgtagaccatagcacgtccaat

SEQ ID NO: 63095 - DNA, 423 bp, Zea mays
  Clone ID: LIB3075-047-Q1-K1-H5
gcaccctccacttggtgctgcgcctcaggggaggcatgcagatcttcgtgaagaccctgagtggcaagactatcaccctcgaggtggagtcttcagacaccatcgacaacgtcaaggccaagatccaggacaaggagggcatcccaccggaccagcagcgtttgatcttcgctggcaagcagctggaggatggccgcacccttgcggattacaacatccagaaggagagcaccctacacctggtgctccgtctcaggggtggcatgcacatctttgtgaagacactcactggcaagacaatcacccttgaggtggagtcttcggataccattgacaatgtcaaggccaagatccaggacaaggagggcattccaccggaccagcagcgccttatcttcgccggcaagcagctggaagatggcc

SEQ ID NO: 63096 - DNA, 436 bp, Zea mays
  Clone ID: LIB3075-047-Q1-K1-H6
aaaaaaagggcaacctgatgcaacagatggtgggccaacaggaagagagctgaatatcggacaagcaagtttccattcagaaccgagcaacgcttcaaaccagttcatcccagaccaattgatgcagggacattatgtgcttggccacaatttcgggccaggtagctcacataaccttcacgacaatctgaaccagttcgatcaggcttcctcggctcctaccttgcaacaacagccgtttaccgggaatggtcaactgacccagggatatcctggtgatatgcatgcgttgcagtttgtggagccaaccccccagattgaccatcagaatggcgatgagggtcagtcgtcaataccagtgtgggattttctttgagctgcctgcctctggcactttgccatccttcccttcacgcgagaggccgcgtttcaccct

SEQ ID NO: 63097 - DNA, 324 bp, Zea mays
  Clone ID: LIB3075-047-Q1-K1-F9
cccacgcgtccgggacgcgcccgtctacgtcacggtaggcgatggcggcaacatcgagggcatcgcggacaacttcacgcagccgcagccgagctactcggccttcagggaggccagcttcggccacgccaccttggagatcaggaaccggacacacgcatactacgcctggcaccgcaaccaggacggcgccaaggtcgtcgccgacggcgtctggctcactaacaggtactggatgcccaccgacgacgacatcaactgatgagtgatgatcacatcatgcatatgccatcgccaccactcatcaccggatccgggagttcg

SEQ ID NO: 63098 - DNA, 465 bp, Zea mays
  unsure at all n locations
  Clone ID: LIB3075-011-Q1-K1-E8
cccacgcgtccggccgcctgggtggagtggagagctggaggcagatcgaaataaagagcaccgtccgaaccgacgtcctcgccgacgtcgtctcaaacgtgcccctcacgagaccgtcctccaaaatcctgaaacctatataattcccgctccatcaccggccggacgcctgatccgagtccctgagtcctgatagtacacgacaggcaccgcagcagaccggccggactcggcgccaagcgcgatggatttgtcatccgacgacgtgaaggcggcgaacatgcggcctgcggttgctgctgccgatggcacgtcgacacttctgcggggttggcgggagttcatgcggagcggcgcgccggcgaggttcctctattatgaggacggcaagtggatcgatatcaccggagaggcggtgccgcagctgcgccaggcgttccaggagagganggcgatggccgatgc

SEQ ID NO: 63099 - DNA, 275 bp, Zea mays
  Clone ID: LIB3075-011-Q1-K1-E9
gcagcgcgctgcccgcgctttccgacgcagcatgtcgcgcgcccgcgtcaggacggtcaaggacctcgccgaggaacgggcctcagtgctcgccgccagcagcaaggtctctgatgaggcggcggccgcggctaccgctgagccctctgcaggtgccaagaccttcagcagcaacgatgcccgcgacggcgccatggacagcgtgcaggacgagccgcatcagcagtgtcacgatgactatcaccccgagatcgtgccctataagatcatacacg

SEQ ID NO: 63100 - DNA, 456 bp, Zea mays
  unsure at all n locations
  Clone ID: LIB3075-011-Q1-K1-F1
catcggtcaaagacaaaagatgattgctgtgagcatcatgtggtcattagtgcatgtgcaggtgctggcggcgatggcactagcatttctggtaggcggtgcctggtgtggtcctnccaaggttcccccgggtaagaacatcacagccaactatggtagtgattggctagatgccaaggcaacatggtatggcaagccaacatgtgccggcccggacgacaatggtggcggatgtgggtacaaggacgtgaacaaggcccctttcaacagcatgggcgcatgtggcaacgtccncatcttcaaggatggtctaggttgtggatcctgcttcgagatcaagtgcgacaagccagcggagtgctctggcaagcccgtggtggtgtacattacagacatgaactacgagcccattgcggcgtaccacttcgacctatcatgcacggcgttcggtgccat

SEQ ID NO: 63101 - DNA, 406 bp, Zea mays
  Clone ID: LIB3075-011-Q1-K1-F10
acacacacgttcaaaccgcgagcacacacgtttcactttcacgacgactgcctgacacacgggccacgaacatgctggctcgctcctgcgggcacctactctcagcccccagctagagccctatgtctacgagggcgaagaatagaccacccctgctggcatttttgcgagaggttcttattctgccaaactaaagttagttgatgatgatggcaagtgcttcctggagatgagttactactttgagattagaaaggactggccaggaactcaatgatgtgtggaccagcatggctgactcgtcggagtatgttagagctcatagctaagccaagcacaagatgtggactcatcttcaagaatgattttcattcgctacttcatcttaaatcgcatttaatttgtt

SEQ ID NO: 63102 - DNA, 438 bp, Zea mays
  Clone ID: LIB3075-011-Q1-K1-F2
cggactcgtgggtcacaataagatggcgtgtatagacaatgcaatgagagccttgttccttttagcgctcttctgtgtcgtgcatggtgagaaggcaaagtcaaaggacaacgatgcaaaagcgtccgggcccggtgggtccttcgacatcaccaagttgggcgccttcggcaatggcaagacggatagcacgaaggctgtgcatgaggcgtgggcatcagcgtgcggcggcaccgggtagcagacgatcctcatccccaagggcgacttcctcgtcggaccactcaacttcacaggcccatgcaagggcgacgtgaccatccaggtgaatggcaatctgctggcgaccacggacctaagccagtacaaggatcatggtaattggatcgagattctacgcgtggacaaccttgtcatcaccggctagggaaagctcga

SEQ ID NO: 63103 - DNA, 443 bp, Zea mays
  Clone ID: LIB3075-011-Q1-K1-F3
gatttgggtgcttatctgcgactcttgcttgtggtgattgttctcttgtcagtggcattgcagttggacctctcatagctgcaacaccggtgcagcaggaagaaagaggcataagtgaataacgatgcacgagacgaacacgaggcgaagaggccacaaaagagacgatgtcagcggaagaggcgaagaggccacgagacccacgagacgccgcagcggcagtagtctgcagcaaggagcgcttaagtacgggattgcagcgaggtgcgacagagaaagagagaaaaccttgggtttcctggtcagcgaggtgcattttattttagaagtactataaatttaaattagggttggaaatggatgtttggtgatccgaattattcgtattcgtactcactaaaactgctaatatggatatccgtatccgtattcgatttcaatat

SEQ ID NO: 63104 - DNA, 470 bp, Zea mays
  unsure at all n locations
  Clone ID: LIB3075-011-Q1-K1-F5
gagttggcggcggtagttatcgcttccggcgatctcgcgcgtggagtcccgagtcgccaaggctgccgaaccctacggccaggccaagatttagtagtagctactataaatctgcagggtcgccagcactttggcctctcaacgcacgccccccgcccgacgtttccgatctcgtttctctcctcccgagtagcgaaatcttcgtacattctgagatgcagatcttcgtgaagaccctcgccggcaagagcatcaccctggaggtggagagctcggacacggtcgagaacgtcaaggccaagatccaggacaaggagggcatccctccggaccagcagcgcctcatcttcgccggcaagcagctggacgacggccgcatcttggccgactacaacatccagaaggagtccacgctccacctcgtcctccgncttcgtggtggcngcggccagtgatctggtctgctgatc

SEQ ID NO: 63105 - DNA, 328 bp, Zea mays
  Clone ID: LIB3075-011-Q1-K1-F6
gtgctgctacccttggaagcggagctgccatctctggtgtctccgctgctgtcgctaccatgatcttctactgagttcaccagctgggaccgtgtcgtcgagggtgggcacgtagttggctgtgcggtaattgctcgtctggtcgggagggaccaataacgcaagtgttgctttgctttgctcacttcgtttgctcttgtaactttatggggtcaaccgttatataactgaaacgatttgattaattgaaaaaaaaaaaaaaataacgataaaaatcacactaaaagatcgtaaaggacaagaaccataacaaggataaaataaaatg

SEQ ID NO: 63106 - DNA, 469 bp, Zea mays
  Clone ID: LIB3075-011-Q1-K1-F7
aactcactgaatgccctgtcagaggatggcagcctcctgagcatgccgccatgggttaatccatggcttctcctggccatgtccgtttcttttgggctgcatttcttgatcctctacgtgcctttcctggctcaagtgtttgggattgtgcccctcagtttgaacgaatggctcttggtgatagcagtggccttaccagtggtgctgatcgatgaggttctcaaatttgttgggcggtgcctgacagctcgtgcccgaaaacaatcagggaagaggaaggcagagtagatgctagtgatcatcggtattagaatctgtagcgccacgggaatcgatattggatgtgacaccccattgtttttgagttgctaaggtctctcgatcctttctgagtctttttagactgggaatgacagtccaggacaggcaaggatattctataggactcataatcagatcgcattgaaca

SEQ ID NO: 63107 - DNA, 415 bp, Zea mays
  Clone ID: LIB3075-011-Q1-K1-F8
gaacaagaatcgtcgtgggttcctcaatattatttctaaagaaaatctgaaacaagggataccttgtaatccctcttgaagatgtgaagcaatctaaaatctatgtaagaagataaataacactcaggagtcaagactagacaactagtcaccccaaagaattagccttttttagccgtgtacacctggaatctaatccagattggcaaccacagcatcggtaacttcctgggtggtgctgctaccgcccagatcctttgttctgtacgtgccttcagcaacgacacgcttcactgccgtctcgagccggtccgcaaatgacgggaactgcaaatgcctcaacatcatagcagatgacagaagcagcgcgacagggtttgctttcttctgctccacaaggttctcattcccaaca

SEQ ID NO: 63108 - DNA, 362 bp, Zea mays
  Clone ID: LIB3075-011-Q1-K1-F9
caacatgctgcgggctcgccgccgcctggacctcctgcaggtggtgctcttcgccgctgtgctgctcgtcgtcgtcgccgacgccggcgtgacgagccagtaccggcggaagctggaggcgacggtggagatgccactggacgccgacgtcttccgcgtcccgccggggtacaatgccccgcagcaggtgcacatcacgctgggtgaccaggagggcacggcgatgatcgtgtcgtgggtgacggccaatgagctgggcagcagcaccgtcatgtacagcgaggcgtcgccggacccggagaagatggagctccgggcggagggcacccacacgcgctacgactacttcaactacaccttcg

SEQ ID NO: 63109 - DNA, 466 bp, Zea mays
  unsure at all n locations
  Clone ID: LIB3075-011-Q1-K1-G1
cgaataacacaggtgagcgcgacgatgggatccctcgctaataacatcatggtcgtgggcgccgtccttgcggcgctcgtcgccggcgggtcgtgcgggcccccgaaggtgccacccggccccaacatcaccaccaactacaacggcaagtggctcaccgctagggccacctggtacggtcagcccaacggtgccggcgctcctgacaacggcggtgcgtgcgggatcaagaacgtgaacctgccaccctacagcggcatgacggcgtgcggcaacgtccccatcttcaaggacggcaagggctgcggctcatgctacgaggtgagatgcatggaaaaacctgagtgctcgggcaatccagtcacggtgtacatcactgacatgaactacgagcctatcgctccctaccacttcgactngagcgggcaggcccctcgctccctggcaaagccctggctcaacgaca

SEQ ID NO: 63110 - DNA, 462 bp, Zea mays
  Clone ID: LIB3075-011-Q1-K1-G10
gcgccctgatatgataacccctggagttgatgctcaaggccaacctattgaccctgagaagatgcaggagcattttgaggacttctatgaggacatctatgaggagttggggaagtttggtgagattgagaatctgaatgtttgtgataaccttgctgaccacatgattgggaatgtctatgtccagttcagggaggaagagcaagcagccgcagcttacaatgctcttcaggggcgcttttactctggccgccctataattgttgagtattctcctgtgaccgacttccgtgaagcaacctgtaggcagtttgaggagaacagctgcaaccgtggtggctactgtaatttcatgcatgtgaagcaaattggcagggatctcaggaggaagctgtatgggcgttctgcttccatgaggtaccatgggagaagccgaagccgaagcccgtcaccacaaaggag

SEQ ID NO: 63111 - DNA, 440 bp, Zea mays
  Clone ID: LIB3075-011-Q1-K1-G11
ctccattgatgcactctttggttgattttcggtggagcatttcgtcgaacacaggggcggagggcccagtatggtccagaaatcaaagtaaaaaaaagccctagtgtcttcgcatcgcgctcccgcacacagaccgaccagccgcagcccgtggcgcacctgcctgcgcccgccgcctccgtcatccactcaacctcgcccctcggccactgccgcgcggcgcccgcccgcctgccgcaccggccgaatcatccgacggcccttaagctgaggcggtgtggcctaagtagcaacgcggcggtcgccccgtgtctcgtccactttggccccgacaggctgtccacgggggcgcgaactgcccctcgccgggtcggtcccgaccggccgtagcagctcaccagagaactagcctctcgtcgggctttcccaggtctgcgcgt

SEQ ID NO: 63112 - DNA, 471 bp, Zea mays
  Clone ID: LIB3075-011-Q1-K1-E7
gcgccgcctggatcgagcagccgagcgactaatcgaagactcccttttccccgagcacaagagaaccatggcggcggcggcagtttacggcggcttcaaagggaagcttggcgtcgaggatgcccccgagctgcagctcaaccgcatccgcatcacactctcatccaagaacgtcaagaacttggagaaagtttgtgcggatttggtaaagggagccaaggacaagcatttgagggttaagggacctgtccggatccctactaaggttctccacatcaccactcgcaagtccccttgcggtgaaggaacaaacacatgggatcggtttgagttccgcattcacaagagggtgattgacctaatcagctcccctgatgtggtgaagcagatcacctccatcacaattgagcccggtgttgaggttgaggtgaccattgccgacgtgtaaggacgtgaagttcagcaatgtca

SEQ ID NO: 63113 - DNA, 389 bp, Zea mays
  Clone ID: LIB3075-011-Q1-K1-D12
atacattagatagtttaggtttgataatggatccaaaatatgttagcctatgcatcttcgtattacttgtattgcatggagatactactttggcagaaacttgcagggagtttgctaaatggcatccattctgctttagtgcaatgtgcaaggcaaattgttttatagaaggaaaaagctccgatggttcctatgcaaagggatatagatgtgattcacatggatttcattctatgtgtatttgccttttgtgtaaaagttagttatcttaagacaagcggggatatattctatgttcatatccgtcatttaaggtgttgttcaaataattttatgggataataattaactagtttgtttacttctagatatatgttatactacttaaa

SEQ ID NO: 63114 - DNA, 455 bp, Zea mays
  unsure at all n locations
  Clone ID: LIB3075-011-Q1-K1-D2
gatccgcgaaaaacaagtgagtgagaaagagagagagaggagggaaaatgctgcgccacgccgtccgccgcctcgtttcccgcgccgtcgctccgcccaccgcgcgccgggcgctcgccacggcggaggtgcccgcggaggccgtcgaggactccacgttcgtcgaggcctggaaaaaggtcgcccccaacatcgagcccccagcgacgcccctctccctcatgcagccgcgcccgcccacgccagctaccatccctaccaagctcaccgtcaacttcgtcctcccctacaagtccgagatcgccaacaaggaggttgacatggtaattgtaccagctacaactggtcagatgggtgttttgccaggccatgttgccacaattgcagagctcaagcctggtgttctctcagtacatgaaggaaacgatgtgagcaagtactntgtgagcagtggg

SEQ ID NO: 63115 - DNA, 434 bp, Zea mays
  unsure at all n locations
  Clone ID: LIB3075-011-Q1-K1-D4
ctgatctaatgtaggggcaggaggaagcccttccactgttccatctctttcccggagtaggtggtgggcacgacgaatgcccctcgcccccaccagattcgtgcaactcggcgcctcatccgatcggcaccggccgcccaacgcgctacagacgcgctgccgcgtcgggactctggaggacacggcggcggcttggtggattgtgggagggagggccttctcttggatttctgttgtcgaggacagggtcttgtattagctagctattcactggatgttggcgatggggacagaagagtgggagctctatccttgttcctacagcggctcacaggtgatagagtacaggccggtctctgaagacgaagacggcgacgacgaccagaacggggccgacgtggcagtgtcgctggacgccgttctnccagacgatc

SEQ ID NO: 63116 - DNA, 469 bp, Zea mays
  Clone ID: LIB3075-011-Q1-K1-D5
caaaccatagcatcaatcatgtctggtcgttcgtggacaataatggcgcctctcctggcgtcgatgctgctcgtcgggctcgccgtgggctccgaggaggaggaggacggcggcggcaaaaagaagccccacgtcaaccacggcaagtttaaggcggagccgtggacggacgggcacgcgacgtactacggcgggcgcgacgggttaactgacaccacggacggcggcgcgtgcggctacaagggcgagctggggaaagactacggcaccctgacggcggccgtgggcccgtcgctgtacaccaacggcaccgggtgcggcgcgtgctatgagctcaagggccccaagggcaccgtggtggtgacggccaccaacgaggccccgccgccggtgagcgggcagaagggcgagcacttcgacctcaccataccggcgttcctcaagatcgccgaggagaaggccggcatcg

SEQ ID NO: 63117 - DNA, 373 bp, Zea mays
  Clone ID: LIB3075-011-Q1-K1-D6
ctaacgatagcaccaatcatgtctggtctttcttggacaataatggcgcctatcctggcgtggatctgctcatcgggctcgccgtgagctccgaggacgacgaggacggcggatgcaaaaagaagccccacgtcaaccaccgcaagtttaacgcggaaccgtggactgacggtcacgctacgtactactgctggcgcgacggattaactgacaccactgacgtgcgcgcgtgcggctacaaggtctagctggtgaaagactacgactccctgacggcgaccgtgggcccatagctgtacaccaacggcacctgttgcagcgcgtgctatgagctcaaggtccctaagggcaccgaagtagagacagtcaccaa

SEQ ID NO: 63118 - DNA, 173 bp, Zea mays
  Clone ID: LIB3075-011-Q1-K1-D8
aaaatggatactggcagaagaaatatatggacttcgtagcacgcgtaggagtgatcgagtctgttttaatatgctatctcaggtaaaataataatttattggcacaggtttagccattcactaacttgtatcaattttgtgaactaaagaacttactattacatgtgggagcc

SEQ ID NO: 63119 - DNA, 389 bp, Zea mays
  Clone ID: LIB3075-011-Q1-K1-D9
tccaccaccaccaccaagctcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgctctctcccagcagtccaacctggtgctgtacggcaggatccagtgcaagggcaagtgcaccgagcagaatggcatcacggcgccggccatgaaggtctgccaggaagagtgcgacaaggcctacgtggt

SEQ ID NO: 63120 - DNA, 433 bp, Zea mays
  Clone ID: LIB3075-011-Q1-K1-E1
gtggcatgcagatctttgtgaagacactcactggcaagacaatcacccttgaggtggagtcttcggataccattgacaatgtcaaggccaagatccaggacaaggagggcatcccaccggaccagcagcgcctcatcttcgccggcaagcagctggaggatggccgcaccctggcggactacaacatccagaaggagagcacccttcacctggtgctccgcctcaagggtggcatgcagatttttgtgaagacattgactggcaagaccatcaccttggaggtggagagctctgacaccattgacaatgtgaaggccaagatccatgacaaggagggcattcccccagaccagcagcgtctgatctttgctggcaagcagctggaggatggtcgcaccctcgcggactacaacatccagaaggagagtaccct

SEQ ID NO: 63121 - DNA, 426 bp, Zea mays
  unsure at all n locations
  Clone ID: LIB3075-011-Q1-K1-E10
ctggagacgcgcacggccggcttctcgttcgccgtcagctccaacatgctcttcaccttccggatcgcgcaggcgttcctgtccatgatgtgctccatgcgcgccttcatcttcttcttcttcgccgcctggatcgtggtcatggccatcttcgtcctcacgctgctgccggagaccaagggcgtgtccatcgacgagatggtggaccgggtctggcgccgccattggttctggaagaggtgcttcgccgacgactacgacgcggccagggtctacgacaactgctagtgctaggcacgcgcgccgncggggattagttcttttgtcattgtaattagaaatcggcctgattaattgatttcgttgctatgacatttacaatgatgtcgtggcaatcaacaggccaaactatatagcatatgagaa

SEQ ID NO: 63122 - DNA, 368 bp, Zea mays
  Clone ID: LIB3075-011-Q1-K1-E11
caaacatacaaggaccaactttgccatgagagtcaacagtttcttgcgtcagctacgcactcagcctactcttaataagtttgttattaagttcgggctgcgcaggaagcacactcgccatgtcaacagatggattcgcttctgctccgtgtcgcgagcaagacacatcactattaatttcactcctggagtgaaagatcttttcatgggtccagccaacagcaagtacatcttccccctgaaccttttcagtggtccagaaggctcctctacacatgtcagaactcttcatctgggctatgtctgtctggacacaaccttcgctgatttcatgatcttggcaatcttaagaagctcactctgcacaa

SEQ ID NO: 63123 - DNA, 426 bp, Zea mays
  Clone ID: LIB3075-011-Q1-K1-E12
ggtccggggttccggcgacgacgtcacgcgcttcgcatgcgcctggagaactgttaaagcttccatgtgactgggcactgatatcagatccggaattgaggctctatgcgcagctctatgcataggatgaatatgcgttcctcaaagattatgctgaatcacacaagagactctgtgagcttggcttcactcattcgcagcacacgaccatccaaatcagatcttgcaaccgtcgtcgtgcttgcacagattgcctctggcgtagcagttgctgcaggcacagttatggctggctacttgtacgaggcttccaagatggtcaagtacagggcgacattcttctccacatagactctgctttagtaagtatgaagatcgaataacaggaccatatctgaggatcgaatagcgcatcatataaatgag

SEQ ID NO: 63124 - DNA, 463 bp, Zea mays
  Clone ID: LIB3075-011-Q1-K1-E2
cggacgcgtgggcggacgcgtgggccctgtcagaggacggcagccttgtgagcatgccaccatgggttaatccgtggcttcttctggccatgtcggtttctttcgggctgcatttcttgatcctctacgtgcctttcctcgctcaagtgtttgggatcgtgcccctcagtttgaacgaatggctcttggtggtggcagtggccttccccgttgtgctgatcgacgaggttctcaaatttgtggggcggtgcctgacagcgcgtgcccggaaacaatcagggaagaggaaggcagagtagatgctagtgatcatcggtatttagaatctgtagtgccacggggaatcgatattcaatgtgacacccccattgcttttgagctgctaagggctctcgatcctttcagagtgttttacgttgggaatatgaccgtgcatgacaggctaggatactctatagaattg

SEQ ID NO: 63125 - DNA, 430 bp, Zea mays
  Clone ID: LIB3075-011-Q1-K1-E3
tcgcacttgagcagcagctagctcaagggaaggagaaggctggaagtggaaagaagtgggttcttgcttgagctgagctcttgctgcccttgaatctgtttgggagtggagaacggagtatggggcgcggcaagatcgagatcaagaggatcgagaactctaccaaccggcaggtgaccttctccaagcgccgggccggactggtcaagaaggcacgggagatcggcgtgctctgcgacgccgaggtcggcgtcgtcatcttctccagcggcggcaagctctatgactactgctcgcccaggacctcgctgtccaggatcttggagaagtaccagaccaactccgggaagattctgtggggtgagaagcacatgaacctgagtgcagagatcgacagagtcaagaaggagaacgacaacatgcagattca

SEQ ID NO: 63126 - DNA, 449 bp, Zea mays
  Clone ID: LIB3075-011-Q1-K1-E4
atcggactcggaagcggaagcggaaacggaaacggaatcggggtcggattcgaagacggatctgaaggctgtgtccaagagcatcaaagcgatgtgctcgcagacagactacacggacgcgtgcgagaagagcctcggcaaggccgcgaacgccagctcgtcgtcgcccaaggacatcatccgcagcgccgtggaggtgatcggcgacgcgatcggccaggcgttcgaccgcgcggacctgatcctgagcaacgacccgctcgtgaagggcgccgtcgccgactgcaaggaggtgttcgcggacgccaaggacgacctcaacagcacgctcatgggcgtcgacgacaaggacggcatcgccaagcagggctaccagctgcgcatctggctcagcgccgtgatcgcgaacatggagacgtgcatcgacgggttccccgatgaagagttca

SEQ ID NO: 63127 - DNA, 412 bp, Zea mays
  Clone ID: LIB3075-011-Q1-K1-E5
cagagcagcatttcgagtaacacagttgagcacgacgatgggatccctcgctaataacatcatggtcgtgggcgccgtccttgcggcgcttgtcgtcggcgggtcgtgcgggcccccgaaggtgccgtccggccccaacatcaccaccaactacaacggcaagtggctcaccgccagggccacctggtacggtcagcccaacggtgccggcgctcctgacaacggcggtgcgtgcgggatcaagaacgtgaacctgccaccctacagcggcatgacggcgtgcggcaacgtccccatcttcaaggacggcaagggctgtggctcatgctacgaggtgagatgcatggaaaaacctgagtgctcgggcaatcctgtcacggtgttcatcacagacatgaactacgagcctatc

SEQ ID NO: 63128 - DNA, 436 bp, Zea mays
  Clone ID: LIB3075-011-Q1-K1-E6
cccacgcgtccgcggacgcgtgggcggccagcggcggcggccaaggcgcgatgggagcggctcccctggcggcgtggtgggcgcagccccggcggctgtgggtgctgccccggcgtcccatggcgcgctaccctgagccccgtccacggtggcggcgccccctagccgcggccctggcggcacgggcatggcggctccggcccagtgccggcgcatggcgcagccgctgcccttgcagcgcgggcggccaggccctccgtggcgcgcgggcagcctgggcgctgccggccctagccacggcccggcggcccggccccggtggctacccgtggagcggcggctatggccccgtccctggctcgccagcgggcggtcccggcgcggtacaggcgcgcggcccggtcacggatcggtgcgacacggtcgctctatggcg

SEQ ID NO: 63129 - DNA, 240 bp, Zea mays
  Clone ID: LIB3075-011-Q1-K1-D11
tcggtttggagaaactcccgcgttcgaggttatcgtgacattgataagactatggcagggcgcgcgcttcttctgcaactgggcttggcgcttagtcttttagatccacgccttcgacccggtggtgtacgaaccgttcaattaagacttctaagggacaagggtcagttccaagaaagatgaataccaaggtgagttgaagcatgcccagaatgaatctcatgaggactatggccttct

SEQ ID NO: 63130 - DNA, 471 bp, Zea mays
  Clone ID: LIB3075-011-Q1-K1-B9
gatcgtcggagcagagagagacttcctcgcctccatcccatcccgccgccgccgtctctacggtcgctaataagcagccgcatccagggatggagatgaagaagatcgcctgcgccgtcctcatcgccgcctcggccaccgtggcgctggccgcggaggcgccggctccgtctcccaccagcggctcctccgcggtcgcacccgccatcgtcggggccgccgtggcctacttcttcgcgtactacattcactgagccgccggacgaggagccggagccggagggaagagaccaaggtggggggagagacttggctgcgctgcgctgctctgctgctcccgcgcattcccgatgcgtgggcgtgctctgattgggcacggcggtggcagtggcacaccttcgtcttccttttgtttgtttttttttccttcctctttctacttgattttcatttaacgaattggtatcgctg

SEQ ID NO: 63131 - DNA, 458 bp, Zea mays
  Clone ID: LIB3075-011-Q1-K1-C1
ctcgccggcgggacggagaccacgtcgtcggccgcggagtggatcatgtcggagctgatgaggaacccggaggcaatggccaaggcgcaagccgaggtccgccgagtgctcgacggcaagagcccgcaagaccacgaagggcaaatggacaagctcagctacacgaggatggtggtgaaggagggcctgaggctgcacccggtgttccctctccttcttcctcgtctctgccgggagacgtgcgacgtcggcggcttcgaggtggcccagggcaccaaggtcatcgtcaacgcgtgggcgttggcgaggagccccgagcattggaagcatccggaggagttctggccggagagattcgccgacgacactagcgtcgccgcggcggcggactacgtagggtctcagtttgagtatatcccgttcgggagcggcaggaggatgtgcccttgaaacacctt

SEQ ID NO: 63132 - DNA, 468 bp, Zea mays
  Clone ID: LIB3075-011-Q1-K1-C10
cggacgcgtgggcggacgcgtgggggcggcagcgagcagcaagccccgccggaagacgagaacaaggagaaagagcggcagctggccaaggagaaggcgtacgcggcggagaaggtcgtccagcaggagatgctcaagtacgccaaggagaagggtctggtgtccccgaccaacggcacggggtggtacaggggcatcgcccgggagttcgtggacgcccacaacgagctccgcgcgcgctacggcgtgccgcccatgaagtgggacaaccagctggcgcggcaggcgcggcgctggtccaacgccatgcgcaaggactgccagatcctccacagcggccacgagtacggcgagagcgtgttcaggagctacgacgactggaacgccaccgtcagggaagccgtcttctggtggggcaaggaggaggccatctacgacaaggacaaggagaagtgcaagtacggcaag

SEQ ID NO: 63133 - DNA, 304 bp, Zea mays
  Clone ID: LIB3075-011-Q1-K1-C11
gccgcccgcgccgcatgagagtcatgacgacgccgcggcggcacgctgatccgtcgccctcgccctcttccccgccgcagcttctctcccgcctccgctccggggcctccagtttcctggcgcggcagtacagcacggagaagggaggcgataacaccggtccttcgaagccgaaaggtggtggctcctccgcgtcaaggcacctcaggccaggattcgtggatccttcatcatggaaacattttgactcaagggctgttggcattaaaccgggtgctatacatacagatgcatgggcggtttt

SEQ ID NO: 63134 - DNA, 456 bp, Zea mays
  unsure at all n locations
  Clone ID: LIB3075-011-Q1-K1-C12
ggcagtaccagtagcgcccggccttcagcttactacaacgaagccgctgatcctcctggggtcaccagagcagatcttgaacctgctccaagagacggtggcagggaaagccaggaaaggcgccgctccttctcgtttctgtggccgtttggcccgtcgagttccagatccagttcttaccagtacgaacagaatgttgatgagcctgcagtatacgatccaaaccagatagcatattctgagtggcactatgaccactgactgaaaccctgcagcaagtgcaagctatctgcaattcgtgccttcaaccctcagctttggagaggcattcatcagctgtaatggctgcttgccgtataaaaaaaggatggttcttgcctgttatattgtgttcagtgcatagccttgctccgtatgtcctncgtatatataaatcctttgcgtgtagtaagcggt

SEQ ID NO: 63135 - DNA, 475 bp, Zea mays
  Clone ID: LIB3075-011-Q1-K1-C2
tcgggtggtagcaagaacagcgcattacatgatcctagaattctgccacgtgatagcttgtcgaaggaaaagtacatgtccaaggaagagaagcagacatcaatcaatcattttcatgagaagctctttaaactgaaggacatgatgaagacagaggccgggaaaaagagagctgagaaaaggcataggttcatggaggaatttgtggctgaattctacgaagagtggagtggcagagcttgaggttgaacaaccaggttttgagcctatgtcaaagtgtgcagttggcgaaccatttctcaacaacccatgatgatgttgtctacctggcctactttttgccgatgaagccaggcaaataaacaatgcaaagcctattagattggatggacaaatcatacggtcctgtgataagctatcaacccactaccaattccgtggatgaagctgaattttctttcaaacagatgacatg

SEQ ID NO: 63136 - DNA, 259 bp, Zea mays
  Clone ID: LIB3075-011-Q1-K1-C3
cgaactctcctgatcactgtctgtctgtatgtgcaactgcgagcaaggaaattaattaaaagaagatcggcaccatggctggaacgacgacgacggtgatgcagatgatgcacgtgcaacatgcggcagcattgctgatgtgcttggctgtgttgactgcgtacacgccggtagtgtgatcatctgcagtgactactgatggatgatgcaacggatggaccatcgtatgacagatatactgtgccatcgcatgctacgg

SEQ ID NO: 63137 - DNA, 471 bp, Zea mays
  unsure at all n locations
  Clone ID: LIB3075-011-Q1-K1-C4
gcagaatgtaaaaaagcacctagctaactgggtggactctgttccacaagttctagtagaaaaggctgaagaatatctccctccgaatatgggcttcctcatcaagtttgttaaggatgatggtgagttgctgtacccatgcccctcttggatacattcagatataatggacgataacattcttatcgaggggatcataaaactgagttcttctggtgagagggaaagagtttatgactcacatcgggacaaaataaatgcaattcacatcattgatttcagtgatctgtccattggggatcctatatgtgacataattccgctgcacttggatattttccggngtgatagtgaccttctcaaggaatttctacggagctatcaacttccccttctgaggggggaatcaaccaccgatgtctacagatcagtgcgaaactcgaagttcatcanggcatcatatcgcgcgat

SEQ ID NO: 63138 - DNA, 401 bp, Zea mays
  Clone ID: LIB3075-011-Q1-K1-C5
cggacgcgtgggatcatcatcttctccgatccatcaacaatcgccgagagcgatcgagagataaataaagatgaagaaagtggcatcatcgtcagccgttctcttcgtgctagccctgacgctagtttgtgccccgctgatagcagaggcaaagaagaagagagtcgccgccgtcgtcgccgaggagaagaaggtgcaggacaacttctgctcgacgctgtgcgagggcaggaaggggatggacctggcggtgtgcaaggagtcctgcgacctctcacagcgctccaacctggtgctgtacggccggatccagtgcaagggcaagtgcaccgagcagaagggcatcaccgcgccgcatatgaaggtgtgccaagaggcgtgcgacaaggactacgtggtca

SEQ ID NO: 63139 - DNA, 469 bp, Zea mays
  Clone ID: LIB3075-011-Q1-K1-C6
gcatttctggcgagggaggcaggaatgttaccgttcacgccgcagaattcctgatcgatggcgatgaatcgacgatcaggagcggcatcaagcaactgagccgtgccctccaaatcttccggtttgtttgggaggccgcgaatactgactgtcatgccgccaatcacaatggtaaagatgttgtgggcaagaagaagaatgaagatgcaaagggtgtgttggagttgcaaggtcatctctggagtttcggtgttgaggagaagactctgacatacagaggagacgtgttccatatgcatcagattcagttaccatgaaatctcctttctccaacatatctttgtgcaaaatctagccatatagacaaaacatataagaggtgcgatctgaactgaaatgctactcttttcactagcgcttctctgaatctgtgcaaaggcgatgcaactgcatcctgggtgaaaaagac

SEQ ID NO: 63140 - DNA, 468 bp, Zea mays
  Clone ID: LIB3075-011-Q1-K1-C7
ccgaaactgaaaccaaaaataaactgcaggcagagggggaaggagagcggcaggagggtcattaaataaatctacttttctgtttcagggtaggaaatgatgtccgagagtgaagagcatggctcgctcctagacaagatcaacgacaagatcaacgagaagatccatgagtataagcactcgtcgtcgtcctcctcctcttcggactcagacgatgacaagaagcccaagaagtctaagaagaagaagctttttggaagaaaacatccattgcatcatgtcctcggaggaggcaaagccgccgaccttgtgctgtggaggaacaaacaggcatctgggagcatcttggtaggggtgaccgtgatctggttactgttcgagggcatcggctaccaccttcttaccttcctttgccacgcactaattgtgtttctcaccatctggttcatctggtccaatgctgcgtca

SEQ ID NO: 63141 - DNA, 463 bp, Zea mays
  Clone ID: LIB3075-011-Q1-K1-C8
ggcggcattgcggaatgggtgcaaggcagaatcgtaaagttgaggacgctcttccctattcttaaaccgctggactcacttgatgtgattggcttccaagagggcacagataccattttcattagcatagatatggaggtcttcgcagtcatgctcagatcggagcaggtgaagaaggtaggcaagacgggctccaaatatgccatggcaccctatgtgagcttctacactccagatcttgcaaagggcagattgctatcaccatgaagatgcagtgatccatccattaacatggccgtggcactattgacttcttaaggagatgatgagttaaagtgtttttccagtttggacggttatggaaaaaaagcaagttaccatgttcattcagaaaagtttagtttcttacctgtgcagtttaaggaactgtaagaacaggatatcatcgtcaaaatggctagtc

SEQ ID NO: 63142 - DNA, 371 bp, Zea mays
  unsure at all n locations
  Clone ID: LIB3075-011-Q1-K1-C9
atcatcgtccgcttcatagacggaactaccggtgagaaatcaggcgacgacaaagagaccacgaacgaccaacactcctagctgtctcgcgtacggatccatcgagctgtgtgtccttctggctgctgcacctgatgctcagagtagacactggctgctgctccggaaggaaactgactcccccgaccggcgatcatgctcctggatggctcgctggccgcctcgaccgaaacgctgacgcagaatgacgactggggctcgtggtgttgttacactatgtgccttatctttacttctttctgtccgctatcatccattacgctctgtgatgtagctagccgtactgcntattcatgacatcatgctagaga

SEQ ID NO: 63143 - DNA, 342 bp, Zea mays
  Clone ID: LIB3075-011-Q1-K1-D1
ataaccaaaccgactatggctgacattttgacgggaagcatcgacggcgggacacgtatgatcgcgctggcgctgcatgccggccgtccggcgacagacctgagctgccatggcctttgctgccaggctagcctgggactccacacgactactgcggactagcctaagtggtgcacggttatccgttgtcatctcgggtctaacatacagttacaaggcgaccactctggacatcccacgtagtcaacgatgcctccatcgcatgagcgtatgaataggtccatacggttatgcttggacactgcgagcgcatggcgaatatggtcaacgacataatgcact

SEQ ID NO: 63144 - DNA, 331 bp, Zea mays
  Clone ID: LIB3075-011-Q1-K1-D10
caaatatgtagcttatgtgacagaatgtttccagggacatacactcttccataaggcacttaaagaagcctttgaggtcttctgtaacaaaggtgtctctggcagttcgagtgccgagttgttggctaccttctgcgacaatattctgaagaaaggttgcagtgaaaagctcagtgatgaagccatcgaagatgcccttgagaaggtggtgagaatgcttgcatacatcagtgataaagacctgtttgccgagttctataggaagaagcttgcaagaagattactttttgacaaaagtgctaatgatgagcatgagagaagtattctgaca

SEQ ID NO: 63145 - DNA, 449 bp, Zea mays
  Clone ID: LIB3075-011-Q1-K1-B8
ggcagagagaggccagactgatgggaatggcatcgaaggagcactttgtgcttgttcatggtgaagggcatggagcctggtgctggttcaagctccgctggctccttgagggtgctggctaccatgttacatgcattgacctagccggaggcggcgtcgatcctactgaccccaacacaatccggtcgttccagcagtacgacaagccactcatagacctcatttcaaccttgccggagggggagaaggtgattctaatcggacatggtgctggagggctgagtgtgattcatgcaatgcacgaatttgttgacagaatcagccaagcattttttgtggcagctacaatgctaccatttggatttcaagctgatgaagataagaaagatgggttaccaactttgcctgagaacgagattgagttgacactttgtgctggagcagatgat

SEQ ID NO: 63146 - DNA, 437 bp, Zea mays
  Clone ID: LIB3075-047-Q1-K1-E4
gtgcagaagagaagcagaaggtcacaccgttcactgtcatgataggagggaaagcgtttgcaacatacactaatgccaaaagaatagtgaaattggtgaatgatgttggtgctgttgtgaacaatgatcccgaagttaacaaatatctgaaggttgtctttatcccaaattacaatgtatcagtggctgaagtgcttattactggtagcgaattgtcacagcatattagtactgctggtatggaagcaagtggaacaagcaacatgaaattctctctgaatggttgtgttatcattggcacccttgatggagctaatgttgaaataagagaggaggttggagaagataatttcttccttttcggtgccaaaaccgatgaagttgctgggctgaagaaagacagagaaaatggcctgttcaaaccagacccacgtttt

SEQ ID NO: 63147 - DNA, 415 bp, Zea mays
  unsure at all n locations
  Clone ID: LIB3075-047-Q1-K1-E5
cggacgcgtgggaggagctcgaggataccatctcaaagaaaagaaggcggcccattgacaacacaccattctacagtgatggggaaagcgaacagcttgattcacagttgaaaatgttcgagtcaggtgttctcaatgggctcaatgaacctgagctggagaatttagcagtgaacattcaggagcttgggaagggaagcatagatgatgggaacttgactcaagttagtgaccagtcagagctgaacgacgacttctgggcagagcttttggtcgaagattttggagacaaggcaggacagccagagttggagggaagaactgaagacgtgaatgaccttgctcaaacaactgggtatctgagttcttctagcccaaaatagaaccagntccctaatggttgccccacaatcac

SEQ ID NO: 63148 - DNA, 416 bp, Zea mays
  Clone ID: LIB3075-047-Q1-K1-E6
tctgcatctaacaagggagtcaagtacacaatcaacaggatgaggctgtaatgtcatctgctgattccaacagcattggtcttgctggacctggtgtgcccaggttgaactctagcgttcggcgaagcttgagcgttgctacgagcatgcatttgcataatgatgtggaagacctaaagatgttacttgaggcctacttcatgcatctggatggaattcgtaacagaatcttgtcggttcggcagtatatcgatgacacagaagactacttcaacattcaacttgacaaccagcgtaatgaactaatacaactccagcttacactgaccattgcatactctggcatagctgccaacactttcattgttggagctttagcaatgaacatgccgagctctctgtacaacaccgataac

SEQ ID NO: 63149 - DNA, 309 bp, Zea mays
  Clone ID: LIB3075-047-Q1-K1-E7
cgcctgggctaccgcgccgctactgcggcctcccgcgacaggtgcctagtctccatcaggtgccatgtcttcttcgggctcttcaccgtcgacgtgcactgccagctctgcatgtatacacccaagtcctttactgggtccgccgccgcccctatgtacttcgttaggtttagtatgttgttaagtttgtaattctagggtctggagggaagcatagatctcaagaggggtgaaatttggtggtaatttcctgagaatttcaaggagacaagggcgtggaggttggttctggagggatctgtgagcaca

SEQ ID NO: 63150 - DNA, 437 bp, Zea mays
  Clone ID: LIB3075-047-Q1-K1-E8
ccaagcccgacaagcgcctcatcctcatcggtccacctggctctggaaagggaactcagtctcctattatcaaggatgaatattgcttgtgccatttagccactggtgacatgctgagggctgctgtggcggccaagacacctctaggtatcaaagctaaagaagctatgaataagggagagcttgtttcagatgatttggttgtgggcattattgatgaagctatgaagaaaccctcatgccagaaaggtttcattcttgatggctttcctagaactgtgactcaagcacagaagcttgatgagatgttggcaaagcaaggtgccaatgttgacaaagtcctgaactttgcaattgatgatgctgtattggaagaacggattactggtcgttggatccactcagccagtggtaggacttaccactcaaaatttgca

SEQ ID NO: 63151 - DNA, 407 bp, Zea mays
  Clone ID: LIB3075-047-Q1-K1-E9
cccacgcgtccgcccacgcgtccgctcgtcacgcgagatatttctacgggacgggacccgcgttgcttccccgcctcgccgtcccgcgcgcgccagccgggcccggggaagccatgaactgcctccagaacctgctcaaggagcctccaatcgtggggtccaggtcgatgaggcggccctctccgctgaatctggcgatggtccgcggcggcagtcgccgatcaaacaccgtcaaaactttgcaggcccctggggcgtccacttccggtgccgagagcagcgccgtggagatgggcaccgagaagtccgaagtgtacagcactaacatgacgcatgctatgggagcagcgttgacatatagacatgaactcgggatgaactacaatttcatacgcccagacttgatt

SEQ ID NO: 63152 - DNA, 375 bp, Zea mays
  Clone ID: LIB3075-047-Q1-K1-F1
cgatcccgcacccctgactgtcagccgcgatccgctcttttttgcgtgcagcggcggagcaggagagatggcgtcggaggccaaggacgtgggcatcctcgccatggacatctacttcccgcccaactgcgtgctccaggaagagttggaaacacatgatggcgtgagcaaagggaagtataccattgggcttgggcaggaaagtatggcattttgcactgaagttgaggatgttatttcgatgagcttgacagtggtgaagtccctcctgaaaaactataacattgacccatagtgcattggacgtttggaagttggcagtgaaacagtaatagacaagagcaagtctataaagacatggctgatgcagatatt

SEQ ID NO: 63153 - DNA, 352 bp, Zea mays
  Clone ID: LIB3075-047-Q1-K1-F10
agcgagagagatccggagcagccgcagtcccaccgaccccgccgccggtcgccctccatctgctgggcgctgcctctcgtttctcttttcaataatcaagatgagccgtggtggtagtgccggtggtggtcaaagttctctgggttatctctttggaagcggtgagccccccaaaccatcagtggcaccagctgcaagtgctccacctgttgagaaaccatctgctgcaaagactgatgcggccaagcaggttgctgctggggttaccagccaaaccaattactaccacagggctgatggtcagaacactggcaacttccttacggaccgtccttcaaccaaggtccacgct

SEQ ID NO: 63154 - DNA, 326 bp, Zea mays
  Clone ID: LIB3075-047-Q1-K1-F11
ggcccctagccctcgccctcccttttctattgctccgaagcccgagttgcgagctgtctcctgcactcttctccttcactgtcgcagccgccccttgtagaagcttcgaggctgctgctgctgcgcccatggccgcggaaggcaagacgccgtccctcgccgaggagtattcacttccaccacaggaagttccagtggaaaaggcagctgaggagaagccctctagtggtactgagtctgaagctgctccctcaaccaatgatgaaactcctccatctgtagaagacaagaatggaacttctgaagtacaagatgctgctgaaaat

SEQ ID NO: 63155 - DNA, 421 bp, Zea mays
  Clone ID: LIB3075-047-Q1-K1-F12
gattagttcagtcaaggagatctcttcctgcagatatgttgtaacgattcaaagtcccatgctttgcaaaaacccgttattccaggaagaaaaacgaaccctctccatccactgcaatgagttgcctgctagagcggaatccagcgcggaggatgactcgcttccaaaagaagctcagatttccatcatccccgatcaggatgagctacatgatttcccagcctatgctacttgatttgcctccaataattatgtttgatgtagaaaaaaacaccattttggaggcgcatgggcaactgagcaacactatgtattaactatctcgtagatactacagcagaggctccttgtaaagcaggttgagacgatcattctgcagttcttattatataagatgattacgaaggtaacatgtttggga

SEQ ID NO: 63156 - DNA, 444 bp, Zea mays
  Clone ID: LIB3075-047-Q1-K1-F2
tgtcgttcttgaaataaaccctacctattgctgtagtgctgttgttgattacagaattatttactccgttctgaagttgaaagaatttctggacaacaagatatgcgacacaaatatttgacggtctcaaaccgtgctaaccacccaaagaagttcgaggtgctgccagtttatcagagttcttttgctgcaggggatgatttttcatcccttactgatgatagaaagacaagagcattggttcatgctatggtggagattctttttttatgtggaactgggaaaagagctgttgtagcatctgttgcacgtgccaatcgtgggaaaattgatgcagctttggaagatctttctgtcgaatcagcagtggatctgcagaaagttcttaaaacaagtacatttacttcaaggaaagatgcattcaacacccttttggctaacatt

SEQ ID NO: 63157 - DNA, 323 bp, Zea mays
  Clone ID: LIB3075-047-Q1-K1-F3
agcagttggctcaaaaagcaagagacaatatcttaaaaccagcagattatgagggtggcacgttcacggtatcaaacttgggaggtcccttcggaatcaaacaattctgtgccatcataaatcctcctcagtcagcaattttggctattggttctgccgagaagagggtgatacctggttccgccgatggcctgtatgagtttggttcgctcatgtcagctacactgagctgtgaccacagggttatcgatggtgcaatcggtgcggaatttctgaacgcattcaagggctacatcgagatcccgacttcgatgctgctgtga

SEQ ID NO: 63158 - DNA, 434 bp, Zea mays
  Clone ID: LIB3075-047-Q1-K1-F4
cggacgcgtgggcggacgcgtgggcggacgcgtgggcggacgcgtgggcggacgcgtgggggagttcagatgattgccagctcctcacatgtgggcaggaggaagccatcagacgctgggatgttaaatctggcaaatgtcttcatgtttatgaacatcctggcattggtttgagatcatgtgcttggtttcgagatggaaagcaaatattgtctggtctagctgatcaaaccttttgcatttgggatttagatggtaaggaagtagattgctggaaagggcagagatcggcaacaacatctgattttgctgtagcaaaagatgggaatcttataataagcttgagtagggacaatgcaattcttctatttgatagggagacaaaacatgagagaataattgaagagggtagtacaattacttcattttctcta

SEQ ID NO: 63159 - DNA, 74 bp, Zea mays
  Clone ID: LIB3075-047-Q1-K1-F5
tcgtctcgtgaaccacgcagtcctgtcaatataaagctcagcacatctcaaatacgaaccctgagagactctca

SEQ ID NO: 63160 - DNA, 428 bp, Zea mays
  unsure at all n locations
  Clone ID: LIB3075-047-Q1-K1-F6
cgttgtgcaggacctcaagcccgacatccaggtcccagatcttgacagagtcctgcgtcgcagcgcagagccagtagcggttgggtgagaagcagagagagtggatgatggagcccgcgttcagcgagtacagcctcttcccctcagccaaatcccacagcagagtaacaccgtccttcccgccggaggcgcacagcgacccgtcggggctcacagcgacggcgttaacatagccaccgtgcccatccagagtgcagcgcagcttgcagttggtaaggttccagaccttgacggtgcggtcccaggatccggagacaatggtgggctggaaggtgtttggggagaacctaacgcaggagacccacccgttgtggccctcgccgncgccgaggtcgccgccgatggtgtacttgcactcgccgagagtg

SEQ ID NO: 63161 - DNA, 79 bp, Zea mays
  Clone ID: LIB3075-047-Q1-K1-F7
aaaaaaaaaaaaaaaaaaaaaaaaaaaaaaattaaaaaaaaaaaaaaaaaaaaaaaagaaaaaggggcaaccgatacta

SEQ ID NO: 63162 - DNA, 434 bp, Zea mays
  Clone ID: LIB3075-047-Q1-K1-F8
aaaccacgagcgcgaggcacgacctacatcgaatcggccacgaaccaccatggcggcctcgcgcgcgctccttcccagcccgcaggtgagccctgcgagcgcgcgggtccgcctggccgcggccgtgccgtcgtcgctcacgctcgcggcgcgcggcggggccggggccggcgcgcgtctccgcgtgcagtgcgcgatcctgtcgtcgcccgcgcctgtggcgcccaccgagtcgaggccggcgcgccggatctcgccgtccgcgccggacggcgcgctgcggcccaagccggcggtgctggtcgccgagaagctgagcgaggccgggctggccgtgctgcggcagttcgcggacgtggagtgcgcctacggcatgtcccccgcggagctcctcgccaaggcggcgcagttcgacgcgctcatcgtgcgcagcg

SEQ ID NO: 63163 - DNA, 380 bp, Zea mays
  Clone ID: LIB3075-047-Q1-K1-E3
ctcatcttcgtctccgatctgccccccgctcagccgcggattctttcgctgcgtggtgggacggagccgagtagtgcggtggtagccgagcgctccggccatggcgttctatcggggcctcaccgcagtctcgagactgcgatcacgcatggcgcaggaggccaccacgctggggggtgtgaggtggctgcagatgcagagcgcgtccgatctcgatcttaagtcccagttgcaggaattgattccggaacaacaggatcgcttaaagaagctcaagtcagagcatggaaagacccagcttggaaacataactgtggatatggtccttggtggaatgagagggatgactggaatgctttgggaaacattcctacttgatc

SEQ ID NO: 63164 - DNA, 373 bp, Zea mays
  unsure at all n locations
  Clone ID: LIB3075-047-Q1-K1-C9
tgcttcggaggcgtaagatccgcaaaggtgtctcatgtttctccttgacgtttgctgcgttggctgggctaataggtgtcctggtggggctcctgatgagcctcatcttctcttcgccgccggttgatgcataagatgcgagaaaaaggttgcagcctatggaagcattaattgttcagaccgacatggggagaaagctcgctcgggaaaagaagaagatgaaacttttgtcgtagtagtctccattttcattcttttgttgcttgcaccgtagttatatgaaacgatgataacgggttgcagatctttgatctttccacccgtgcttggttcanaaaaaaaaaattaagataagaataataatatttaaacg

SEQ ID NO: 63165 - DNA, 404 bp, Zea mays
  Clone ID: LIB3075-047-Q1-K1-D1
cgacttctgctcgacgctgtgcgagggcaattaggggacggacctggtcgtgtgcaaggagtcctgcgctctctcccagcagtccaacctggtgctgtacggcaggatccagtgcaagggcaagtgcaccgagcagaagggcatcacggcgccggccatgaaggtctgccaggaggagtgcgacaaggcgtacgtggtgaaggcggccgaggtcaccaaggcctgcagcgtcacctgcgccaaggagaagaacccgcgcctcagcgagaactgcaagaggtcctgcaccccttctccttcttgaagcgaagccccttgaaatgaatgaaccatgcatgcatgcatgtatgcatgcgccggggtgacgtggccgtcagctcatgcgctgaacgagtctatacgta

SEQ ID NO: 63166 - DNA, 277 bp, Zea mays
  Clone ID: LIB3075-047-Q1-K1-D10
cccacgcgtccggcacagacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcatgaggcatgggcatcggcgtgcggcggcactgggaagcagacaatcctcatacccaagggcgacttccttgtcggacaactcaacttcac

SEQ ID NO: 63167 - DNA, 432 bp, Zea mays
  Clone ID: LIB3075-047-Q1-K1-D11
cggacgcgtggggccttcaccgtcaccgaactgaagtgatgtttaagaaaattttagaactgacgaggattgggtgggattggcactgatgttcttgctggtgcacattgtgaaacaatggatgttgttgctggtttggctttaatccataccgacttctaccgcttttacagtgttttcaaacattcagctttaatccgaagcgaacaactcatctgataccacgtcgctggcgaccctcacgacggatgcgcctagccgcgatgacttgatggcgcagaggccgtggctaccctcgcccccgactcatccgtcgtatcattagcgccaggcaggaagcacaagttgaacgccaccacaagcacggtgaggattttggcagcctccaccgtcaccgaactgaagtgatgtttaagaaaattttataactga

SEQ ID NO: 63168 - DNA, 450 bp, Zea mays
  Clone ID: LIB3075-047-Q1-K1-D12
cgcgctcgcacttgcggtcctcctcctggccgccgccgcggtggcgccgctggcctccgccgacggcgtgaagtccgtccccatccccggcgccaaggaggccgccagcggcgccaagatgttcgacagggaggccgacgccggtcacgacccggtcagcggcctgccggccgacccggcgcccgacgcgcgcccctaaggctacgcaccgtcgtcgttgtcgtcaccgccgtcgccgtcccgacccgttttcgctgaacaccacgcgccttgtacgtgtgcttgtgatgttcggcctctgcgtgcgttttgcattgcttgcgtgcgttttccttcggctgccgtgccgattggtcgtggtggacgcagcgccatggataacgggatctaagtactcacccgtgcttgctgtacctgtacccatttattttgccattctctctttttttt

SEQ ID NO: 63169 - DNA, 228 bp, Zea mays
  Clone ID: LIB3075-047-Q1-K1-D2
ccaaggctgctgaacactttacaaagacattttttcatactaaaccatgcctctaataaagacgcctaggttgtcactacagagagtctcctgctaccaaactctcacaccccatacctgacttgaccaacacgcacgccctgactgacgcataagctcatgcatacttgatttgatttaaacaccaattctgtacttttactgaacatgctactcttttcatcattc

SEQ ID NO: 63170 - DNA, 376 bp, Zea mays
  Clone ID: LIB3075-047-Q1-K1-D3
caaaggcacaacacatacaggaaaagcaagctagaatcatcggaataatggctcgagcatgtgtgatcctcgtagtgctcctgctggccgccatcgcggtggcaccgttcgcgggcgccgcacgcgtggacgtcgaggagggtacgtccatggcatccatcgatgcaccggaggcggcggtcgatgctcccgctactagacgcgactccgtgtcatccccagactcatcgtcagaggcgccctgcagcagcaactgctccgactagacgcaaaaacctcttcattctgtggaataactaacagtatatacgttgcaccctgatgatatataaacatgtacgtgcattagcgtatggaatgcgagtggcaaacacat

SEQ ID NO: 63171 - DNA, 408 bp, Zea mays
  Clone ID: LIB3075-047-Q1-K1-D4
gtgcagtgaagcatatttttgttgacaaaaatactgcaggcttcgtgtatctgcagttcgatagtgtaactgcagcagggaaggcccaacaagcacttcatggaagatggttcgccggaaagatgattacagcgacatttatgtccgatcaggaatacagtactaagttcccaaacttgtgagcatatgcggggaagagttggtcagacccgcatagttcgttcggagagtttgctagtgctgtatcgttggatggtagactagacgaacaccttattgattgtatgacaggatagtttcagttgcagcgctggtcgtgcgtacaatgtttgatgtactttatttacggcatcacacacagtgaccatcccttattttgtccaccgaatgaaatgccctatgatctcc

SEQ ID NO: 63172 - DNA, 336 bp, Zea mays
  unsure at all n locations
  Clone ID: LIB3075-047-Q1-K1-D5
aggagaaccagcagcctccaataagagccagccagagaaactaataaaactctcgccgccgccatccgagcgaacaagccaaccgaccccgtccccaaggcaatccgccgccgacgtaccaccaccaccgcaggagcgagatggagatgaagaggatcctcttcgccgtcctcgtcgtcatcgccgcctcggccaccgcagtgctggcctccaccgaggccgccgccgcgggcgccccaactgcctccgagtcgtccgccgaggctcccgctggcgctggcgctggcgctgccgctggcgccgacgactcggggccctacgncagcagcggcgcgc

SEQ ID NO: 63173 - DNA, 440 bp, Zea mays
  Clone ID: LIB3075-047-Q1-K1-D6
gtctgatcataccattgagagatcagactggtatggacgatccttctaataatgcctagtagattgtgactacagctatctcagtggtaacaatctctcaggccccatacctgacttgagcagcatgcacgccctgactgcagtgtatgctcaagcatacttgattcgttctgaacacccattctgcaattttactgaacatgctacgcttttcatcatttgaaaaaaggcgccttgatagcaatcagttcagtggaacgatcaacccattaatggaaaaactagccaatctcaaggagctgttagtactcgatatctcatttcataatctatctcaaacagtgtctgcagacattctttacctaatgcattttctcaaaaaatggcagacacctgaacaacagcaatctcacgggcaaaataccagatggtctgaaaaa

SEQ ID NO: 63174 - DNA, 441 bp, Zea mays
  Clone ID: LIB3075-047-Q1-K1-D8
cgttggaggcggtgctggcgctggcggcgtttatggcgtgggcggagggcgggctgcacgcgcgcccggcagccacgctgcttccctaatgccgcgcacctgggcgccggcctcgcatgggcgccactcgtgctgtgcaagccacgccgcggcgcgcgcggccctggcctgctgcgccgccatggccgcggccgccttggcttgcgcgcgcgggttcggcgcgcgaaaccccgtggttgccgacctcgcaaagccggccgtcgcctgggccgtcatcctcgccgtcgtcaactacaagatgctctgaggtcaccagagtcgagaaccagcccgccgtcgctattcacgcatgttcatgttcgatccatcttgtgcaccctcctctgcttctttctcgcgtgtgcagtgtttcgtctgtattactgaatctgaatgacgctt

SEQ ID NO: 63175 - DNA, 417 bp, Zea mays
  Clone ID: LIB3075-047-Q1-K1-D9
cccacgcgtccgtccacgcgtccgaactgattacagccgagcgatctcctctccctctccctgtgcgatccattctccagcgcagcgaagtaaacatgtctgaccgggcaaagatgtcttggcaggcgttcgtggacgagcacctgatgtgcgagatcgagggccaccacctcgcggcggcggccatcgtttgccacgacggtgccgactggtcgcatagcacggcgttccctcgagttcaagaccgaggacatggccaacatcatgaatgacttcgacgagccagggcaccttgcgccgacaggcctgttggctggtcctaccaagtacatggtcattcaaggcgagcctggtgccgtcatccgttgcaagaagggatcaggaggcatcaccgtgaagaagacagggctggcactc

SEQ ID NO: 63176 - DNA, 336 bp, Zea mays
  Clone ID: LIB3075-047-Q1-K1-E10
ggaaggaggagatcagaagcatcagccatgtcgaactcggcgtcgggaatggccgtttgtgacgaatgcaaactcaagttcctggaactcaaggcgaagaggagcttccgtttcatcgtgttcaagatcaacgagaacgtgcagcaggtggtggtggacaggcttgggggaccaggtgaaagctacgatgcgttcagggcctgctttcccgccaacgagtgccgctacgcggtgtttgattttgactttgtcactgatgagaactgccagaagagcaagatcttcttcatctcttgggccccagatgcatcgagggtgagaagcaagatgttgtac

SEQ ID NO: 63177 - DNA, 429 bp, Zea mays
  Clone ID: LIB3075-047-Q1-K1-E11
gagacttctcctttagagcagaatttaagatggaactatgcaccggaattgctgggtgagcctagtctttctgactcaaatgaaacaccaaagcagctgcctatagtcatcagtgcaaaacgaaccggcaacatagctcgctttatgaaccacagctgctcacctaatgtgttttggcaaccagttctctatgatcatggtgatgagggatatccacatattgcattctttgcaattaagcatattcctccaatgacagagcttacctatgattatggccagaaccagcgtaatagtattcaaatgggaacccattctggttttcggaagtctaaaagttgcttatgttggtccccgaagtggagaggttcctttggctaaaaaccagccctataaagaatataatggatcataatactccatttcaaa

SEQ ID NO: 63178 - DNA, 392 bp, Zea mays
  Clone ID: LIB3075-047-Q1-K1-E12
acctcctcttcccccgccgggcaacaactcagccgccgcaaccgccacatcagccatgggcgcctgcgcaaccaagcccaagacgcttgaggggcaggccccagctgaggccgccgtctccacacccaaggttgcgcccgaggccactccaatctccgttgaggttgcggctgatgaacaggtagctgagaaggtggtggtggaggagccggctgcggcggccgacgttgagcatcagaaggctaatgaggtgctcgctccagaggcggccgtcgccgagcccgaccacaaggaggaggaagccgtggagaagaccgtcgtcgaggaggagaagccagcggcagcagcccatgcagaggaaaaggtcgccaccgccgccgagaccacgacga

SEQ ID NO: 63179 - DNA, 425 bp, Zea mays
  unsure at all n locations
  Clone ID: LIB3075-047-Q1-K1-E2
gcgctggacaaggggcagatggcttcggcggctgcagcggtgatcccggacggccggcgatggagcaaaggtccgggctcctcgtcgtcgccggtgacgacggccattttcctcttcttcttcggtgtcgtggtcggcgtcctcgtgtccgcccgctggatcaccaccacgactcatctgtcgaccaccaatctggatcagtggagctcaaagctggctatcttaaccgcgacgcacaccacctcctgcatcccggccatccccgcggcaccgccgccgactcggccgacctactccctctgctgcccggcgccgccgcttcaccgtgacccgaccatgcccagcaacatctcccagaccctcgacctcgtgctctcccccaacgcctgctacgccttcacttgcgccgnctttcccgacccccc

SEQ ID NO: 63180 - DNA, 330 bp, Zea mays
  Clone ID: LIB3075-047-Q1-K1-C8
cgttttagatctctcaaaagaggcttttgcattttgtattgcatcgtttatattccagccttggaaggctgaagatggaaggagacattcttgcagttcaaatttggaggacactgaggctaattgttgcaggccttgattgtacaactagctgtctgcttcaggtcaatagcgaccttaaacttgtcgacccacctacagtgtctactgcgactttttttaccggcaataaccttcccttgttatctaattggactaacaatatatcttcttctgactaataaacgtctgatatattactctgaatcgttaaaccttttctttttaaat

SEQ ID NO: 63181 - DNA, 256 bp, Zea mays
  Clone ID: LIB3075-047-Q1-K1-B12
gaaggtcaggaaaattcatgatggctgctcaagcgctgtgaataggctccatactgtccttgagtgaacagagcagcagctcggatcaaacagaagacaagctaactatctagcacaagtggctgcaaaatctctacccaagggtctccattgccttacactgcggcttacaaatgagtactatttcactaactcaaagaataaagactttccctacgtggagaagctggaagaccccaaactctatcattatgcc

SEQ ID NO: 63182 - DNA, 261 bp, Zea mays
  Clone ID: LIB3075-047-Q1-K1-B2
atgaaatccattattgtatgttatttggagtttcgtttttgtcacatgcatgtaatgaacaacggtggcaatcatctataaaggttccattattcgctcgcgaaaaaaaaaaaaaaaacaaaaaaaaaaaaaaaaacaaaaaaaaaaataaacaaccaaaaaaaaaaaaagacaaaaaacgcgcatacacaagaaaaaaatatagaacagcgtcaaatcataaacaacgagacactatatggagcataacattaaaaatta

SEQ ID NO: 63183 - DNA, 383 bp, Zea mays
  Clone ID: LIB3075-047-Q1-K1-B3
caacaaccggctgacggaggccaaggccaacttcccgccgtacgggcaggacttccccggcggcgtcgccacggggaggttctccaacggcttggtccccggggacctcctagcttccaagctgggcatcaaggagctgctgccgccgttcatcggcaccgacctgcagctcgaggacctgctcaccggcgtggccttcgcctgcggcggcagtggctacgatccgctcacgtccaagctcgcggtaactttacacgtcgtcctccggaagctagctagctagctagctgcattaacacactcacgtactcctacgtactgactactgaagatgttatctgagactgagaacaataaaacccgtactactactactacgtacg

SEQ ID NO: 63184 - DNA, 446 bp, Zea mays
  Clone ID: LIB3075-047-Q1-K1-B4
gaacccgagcccctctccgcctccctccccgtcgcacagcctccacagcccgaaaccctcgccgccgatcggtttcggagaagagaagcaaatcaagatgtttctcggctcgctcccgcggcgcccgagcaaggaggctgcgtacaagcagctgcggtcgcacatcatcatcatggcctcctgcgccgtcgtcatccgcgccaccccttacatcctccatttcctcgcccgcgacggcgacatccaggaactcaagctcgatctgtaggcccgtccgttgcttccccaccttcagaggtgctacaaaggcaaccgttagttcgaggccactgcaaggtactatggagttagtggctacagtgcctgcttaagtttctttggtgttccaagtttagtgacaaaactgacaatggtgtagcaactgggttgtgctgcgaccagtattt

SEQ ID NO: 63185 - DNA, 423 bp, Zea mays
  Clone ID: LIB3075-047-Q1-K1-B5
cggacgcgtgggggaggcgagagttcgtgcgtgcagccacaggcaggcgtcggcgccatgtgttctttcaccggcacgcaggacaagtgcgcggagtgcgacaagaccgtccacttcatcgacctcctcacggccgacggcgtcacctaccataagacatgcttcaagtgcagccactgcaaagggatcctctcgatgtgcagctactcttccatggacggtgtgctgtactgcaagacccacttcgagcagctcttcaaggagaccgggagcttctccaagaacttcacgccaggtggcaagtcttcagacaagggtgaactgacaagggccctcagcaagctatcatctgcgttttctggtactcatgataagtgtgctgcttgccagaaaacagggtacccgctggagaagttaactctg

SEQ ID NO: 63186 - DNA, 439 bp, Zea mays
  Clone ID: LIB3075-047-Q1-K1-B6
gccccgagaagtacgagaacgaggagcgcctcgaggaccacaaggcgcagtgcagcttccgccccgtcgcctgcgccaacgacggctgccgcgccaaggtctccgtccgctgcgtcaaggaccacgacgccgcctgcgtgtacaagctgctccagtgcgagcagggctgcgacaagcgcctgctcaggcgcgacatggaccgccactgcgtcaccgtctgccccatgaggcccatgaagtgccccttcggctgcgattcctccttccctgaccgtgacctcgagaggcactgcgccgagttccttcagccgcatctgctcatggtccttaaggccatccataagaaaggccggtcggaacaagacctcaaggaccttgctcaaaagctggaaaagtttgatggagatggtaaactggctaaggctctggatgcaagacc

SEQ ID NO: 63187 - DNA, 436 bp, Zea mays
  unsure at all n locations
  Clone ID: LIB3075-047-Q1-K1-B7
gcagtatgatggttcaaatctagagcatcataaagcactggtggccctttggcatgcttcttttcctggaactgaacttctaggattagtatcagaccagtggaaggagatgggatggcaagggaaagatccatctacagatttcaggggtggtggttttatatctttggagaatttactgtatttctctaagaaatatccaaaatccttccatgagctccttcgtaagcagaatggtgatagagcattgtgggaatacccctttgctgtagctggtgtaaatattacattcatgctaattcagatgcttgatcttcaagcagctaagccaacgtcattggttggagcagttttcctaaatctactcttagaaaatgatcgagcgtttgacattctntactgcataaccttcaaactgatggatcagaaatggctt

SEQ ID NO: 63188 - DNA, 438 bp, Zea mays
  Clone ID: LIB3075-047-Q1-K1-B8
acgatctctgcccctccttccccaaaatcatctctctcccgatcttggcctccccagattcaccacctgctctcctctccggctacgaccttggctcatcctgattcggacacgcaacatggtttaccactctagtttcgctgatgatgatgggatcacaaaagcttgcagctgtcctttgcttccactgaaaactcatatcaagggcccggcaccagcctctgaccctgataaagcggacattgttgatgaagccataactttctttcgagccaatgttttcttcaaaaatttccatgtgaaaagctcagcagacaagttattgatctatctgacgttttatatcaatattgccttaaaaagactagacggttgccggacactagctgttgggactaaagcaatcattaatctgggattggagaaagttcctgtacc

SEQ ID NO: 63189 - DNA, 280 bp, Zea mays
  Clone ID: LIB3075-047-Q1-K1-C10
ctcgtccctctccctctcctctctcctctccctacccagttgcgcgagccggcgagccctagcaggcaaaagccatggcgtccatggttcttcgtgccgctgccgccgctcgtcttccctccctccgtcctcgccgcaacggcagcggggtgctcaccggcttgaggatcgggacagggcactacggcgtgcggctcgcgctttcttcgtccgcggcagcttctcccaaagagttcgaggtcgcttgccttcctgtcgatgatagcagattgtgcccggg

SEQ ID NO: 63190 - DNA, 392 bp, Zea mays
  Clone ID: LIB3075-047-Q1-K1-C11
agctgcctgccaacgtcgctgaccttctgtgatcattttgaagaaaaacagaactaaaagaacggtggtgggggtgatctggtaaggcttggttttgccgaaatattgtgggggaggagtgataaggtcggtggggtttctatgttaaagtcgtggtctcgggcaatatgcgatttttctttatgccatgttttgggaaattttgtagctgcctaggcctcgtgctgttgtggtggttcattagtatgaagacgaaggctctgctggctatgggagtcctttttctttttgttagtattttgtttaaaactatgtatgaccgaattatttgtcatccttgactcaattctgctgcaaaaaaaattaaaaaacatgaaacaggccatttattg

SEQ ID NO: 63191 - DNA, 436 bp, Zea mays
  Clone ID: LIB3075-047-Q1-K1-C12
caccgccaagaagtctcaagtgttcgctgttgccttcgctgtattagctgctggtgctatagttctgacactcaatgttctactgctgggtgggaacataatcttcttccaaagcctcagtcttctcggatactgtctgttcccgctggacgtgggggctctgatttgcatgcttaaggacagtgtcatactaaagatggttgtggtgacggtaacattggcatggagctcttgggcagcataccccctcatgagtgctgctgttaacccaaagagaaaggccctggcgctgtatcccgtgttcctcatgtatatctcagttgcctgtctcataattgctataaattaaaggcggcatggtttctacagaactatcaaaagaattaccagattttggtttctaaggggatcatcaaaatgcatattcctttttttt

SEQ ID NO: 63192 - DNA, 413 bp, Zea mays
  unsure at all n locations
  Clone ID: LIB3075-047-Q1-K1-C2
gccctgctcatactgcttgccctcgccgtatcgtccacccgcaacgcacaggaggattccatggccaacaacaccgggacgttggtgggcggcatccaggacgtgccggggagcgagaacgaccttcacctccaggagctcgcccgcttcgccgtcgatgagcacaacaagaaggccaatgctcttctggggttcgagaagcttgtgaaggccaagacacaagtggttgctggcacgatgtactatctcactattgaagtgaaggatggcgaagtcaagaagctctacgaagctaaggtctgggagaagccatgggagaacctcaaggggctgcaggaattcaagcctgttgaagagggtgctagcgcctaaggatggctncttctccatgtgcgagcctgaagctcaaagca

SEQ ID NO: 63193 - DNA, 256 bp, Zea mays
  Clone ID: LIB3075-047-Q1-K1-C3
gttgaatcctgtacaatcaagttccatttttggatttaagcgattgtttatgcttttcgcagttaggcagcacgagttggaggtccatctcctgctgagatgcttgtttttctctttgttgttcaaacactttacacccaaataagcaactgcagtgacattaattttggctgcaccaaagttacatgaactgaagaaacttgtggcctgtgtgacgcggatccatcagaacataaagttacggcttctggttggt

SEQ ID NO: 63194 - DNA, 187 bp, Zea mays
  Clone ID: LIB3075-047-Q1-K1-C4
cggacgcgtgggatttgcaaaatccccaccgtcacagttcaaatgggggtgcccaaatcaggggtggggatctcgtagtcaaggcttgcggtgaacgacgagtacaacgcaaaatttcatgaactataaccgcggcacatctttccgttcattgtgttcacgatcgatgacactgccatggagaaca

SEQ ID NO: 63195 - DNA, 386 bp, Zea mays
  Clone ID: LIB3075-047-Q1-K1-C5
gggccaccgtcataccctacactttcgcgccatgcgtagcggtgtgccgtgacccgaggtggggtcggtgctactagagcttcatctaggacactaggctggtgcatctcatgacctccaacatggtggccggcctgcagggcgacgtcccagcgatgcacctgaagggcgtacccttcgtcggcgtggccaagaaggtggcctgttgcgccaagcactttgtcggcgtctgctgtaccaccatgggcatcaacgagagctacacggtgctgagcttgcacgacctcatgcagattcacatgctgccctacgacaactccgtcattaacggtttatcctccgggatgatctactacttcagcttgaacggggttaagatgcacgag

SEQ ID NO: 63196 - DNA, 437 bp, Zea mays
  Clone ID: LIB3075-047-Q1-K1-C6
gaagtatcaagatttcttctgtccaatgctagatcgtggctcgaggaatataccctagatggtttccgttttgatggtgtgacctccatgatgtacactcaccacggattacaagttacatttacggggaacttcaatgagtattttgcctttgccaccgatgtagatgcagtggtttacttgatgctggtaaatgatctaactcatggactttatcctgaggctgtaaccattggtgaacatgttcgtggaatgcctacatttgcccttcctgttcacgatggtcaagcaggttatgactatcggatgcatatggctgtggctgacatatggatcgaccttatcaagcacagtgatgaaacttggaagatgggtgatattgtgcacacactgacaaataggacgtgcttagagacgtgtgtaacttatgctgaaag

SEQ ID NO: 63197 - DNA, 451 bp, Zea mays
  Clone ID: LIB3075-047-Q1-K1-B11
atcgatcacaacaagatggcatgtatagacaatgcaatgagagccttgttccttctagcgctcttctgcaccgtgcatggtgagaaggcaaagtcaaaggacaacgattcaaaagcgtccgggcccggtgggtccttcgacatcaccaagttgggcgcctctggcaatggcaagacggatagcacgaaggctgtgcaggaggcgtgggcatcggcgtgcggcggcaccgggaagcagacgatcctcatccccaagggcgacttcctcgtcggaccactcaacttcacaggcccatgcaagggcgacgtgaccatccaggtgaatggcaatctgctggcgaccacggacctaagccagtacaaggatcatggtaattggatcgagattctacgcgtggacaaccttgtcatcaccggcaagggaaagctcgacgggcaggggccagccgtgt

SEQ ID NO: 63198 - DNA, 431 bp, Zea mays
  Clone ID: LIB3075-011-Q1-K1-A4
ataggcgtcttcgtactcgcctacctacgcggctcatacctttcccccttctcccaattcccgccgtcgctccatcccgtaacgcgacaccatgagggagtgcatttcgatccacatcggccaggccggtatccaggtcggaaacgcgtgctgggagctgtactgtcttgagcatggcattcaggctgacggtcagatgcccggtgacaagaccattgggggaggtgatgatgctttcaacaccttcttcagtgagactggtgctgggaagcacgtgccccgtgctgtttttgttgaccttgaacccactgtcatcgatgaggtgagaactggcacctaccgtcagctctttcaccctgagcagctcatcagtgggaaggacgatgcagccaacaactttgaccgtggtcactacaccattggcaaggaga

SEQ ID NO: 63199 - DNA, 372 bp, Zea mays
  Clone ID: LIB3075-011-Q1-K1-A5
accgtgcgaataaaggaagtgatgacataccttccaatcttataatacggcatctacatgagctggatgggcctgccttactttcaaaggtgattagaagtaggccttaaaggggacccaagtgatgaattctcgatttcaagcttattccctggatttttaaggcctatattggatcctattgcttgtgcattccacacacttttgtgtgggctacctgcaagacctgaatgcacaggccagacattggatgggtcacagttacctggttcaggctccactgaggcaaacaggatgagagaaaggggccataaggcactggagcagagactggcagagaagctggctgcagtcaggaaggcggagggcacg

SEQ ID NO: 63200 - DNA, 426 bp, Zea mays
  unsure at all n locations
  Clone ID: LIB3075-011-Q1-K1-A6
ctgaagcccaacatggtgactccaggctccgactccaagaaggtgactcctgaggtgattgctgagtacaccgtccgtaccctccagaggaccgtccctgctgctgtgcctgctgttgtcttcctctctggtggacagagcgaggaggaggccacccgcaacctcaatgccatgaacaagctcagcaccaagaagccgtggtccctgtctttctccttcggccgtgccctccaggcgagcaccctcaaggcctgggctggcaaggtggagaacttggagaaggctagagctgccttcctcgccaggtgcaaggccaactctgaggctaccctcggcacctacaagggtgatgctgccgtcgacaccgagagcctncacgtcaaggactacaagtactgagttgcttctctttgcgtgcccgttttg

SEQ ID NO: 63201 - DNA, 437 bp, Zea mays
  unsure at all n locations
  Clone ID: LIB3075-011-Q1-K1-A7
actgaagatatgggtcctcgaccttttcctgtcaaggaggttcataaaatagcagtactagatattaggttagctaatgctgatcgtcatgctgggaatattctagcgtgcaaggagagagaaggtggcaactacaagctgattccaattgatcatggttactgcttgccagagaagtttgaagattgtacatttgagtggctctactggccccaagcccgtgagccattcaatgatgaaaccattgaatacatcaaatcactcgatgctgaagaagacatcaagcttctcaagatccatgggtgggagctgcctncacggtgtgctcgtgtcctgcgcatcagcacaatgcttttgaagaaaggtgcatctcgtggcttcacgcnctatgacatanggcgcatactatgcagggaaactgtgaatagggactctga

SEQ ID NO: 63202 - DNA, 428 bp, Zea mays
  unsure at all n locations
  Clone ID: LIB3075-011-Q1-K1-A8
gtgatgcgctcccttggccagaaccctaccgaggcagagctgcaggacatgatcaacgaggtcgatgcggatggcaatgggaccatcgacttcccggagttcctgaacctgatggcgaggaagatgaaggacacggactcagaggaggagctcaaggaggccttccgcgtcttcgacaaggaccagaacggtttcatctcggctgccgagctccgccatgtcatgaccaaccttggcgagaagctgaccgacgaggaggtcgacgagatgatccgtgaggccgacgtcgacggcgacggccagatcaactacgaggagttcgtcaaggttatgatggccaagtgaggagcggtccccgtgaaataagtatctatggattgaagcgaattatcaggcacacaagctgtactttgtcatgtncctttgag

SEQ ID NO: 63203 - DNA, 314 bp, Zea mays
  Clone ID: LIB3075-011-Q1-K1-A9
cgcatctcgtcaacctcaccgctaaccaggagtactgggcggagcgcgcggaggcggcgcacgcgtacaaccgcgcggcgtaccagaccgaccccgtggccgtcgtgcagcgcttcaacgacggcgtgcacagggcgacggcgacgcggtcgcggtccctggcgcacagggcgcggtgcccctgcacggcgtccaaccccttggaccactgctggaggtggccggcacgactgctcccgtgagctcaagtgactgtgcaggatccccatcgtcttacgtcacatgaccaccggcgggctgaccggcatgttcta

SEQ ID NO: 63204 - DNA, 409 bp, Zea mays
  unsure at all n locations
  Clone ID: LIB3075-011-Q1-K1-B1
tcgcgcccaagctctccgacttcgggctcgcgcagctcggccaggcggggggcagcatgccggtggcgtcgcccatgatgggctccttcggctgctgcgcgccggagtacgacaggaccgggcaggccaccatgaagtccgacgtctacagcttcggggtggtgctggtgcagctcatctccgggaggagggccgtcgacaccagcaagccggtggacgagcagaacgttgtcacctgggccatgccgatgttcaaggaccagaagagataccatgagctggttgatccactcataaaaaaggagtacgctgccaaagcgctgaaccaggtggtcgccatggctgcgatgtgcttgcangaagaggactccgtgcgaccgctgatggccgacgtcgtcatgacgctggg

SEQ ID NO: 63205 - DNA, 428 bp, Zea mays
  unsure at all n locations
  Clone ID: LIB3075-011-Q1-K1-B10
cggacgcgtgggcggacgcgtgggcgcggccacatcgacggcaagctccgctacgggttcaacggcatcttccacagggacaccgagacccccctcaagctcgccgagtacttcaacgtcaccgacggggtgttcagctacaaccagatgggcgacgtgccccccgtcgttaacgggccactccatgtcatccccaacgtcatcaccgccgagttccggaccttcatcgagatcgtcttcgagaaccccgagaagagcatagactccctccacctcgacggctacgccttcttcggcgtcgggatggggcctgngacgtggtcgccggagatgaggaagacgtacaacctactggacacggtgagccggcacacgatccaggtgtacccgtggtcatggacggcgatcatgctgacattcgacaacgc

SEQ ID NO: 63206 - DNA, 450 bp, Zea mays
  unsure at all n locations
  Clone ID: LIB3075-011-Q1-K1-B11
cagaaaacctaaacgtgaggttggcgaaaagagaaaagaactagagcatcccgtggagagaaggcggcggcagcgcctgtgggagatgtcaatcctgtgggagaagagcgcgggttggcgatggctggttcggcggacgcgtgactcgaagcccttctttttcacgttcgcggcgctgtgcggcgtcgtccccggcgtaatcggctacggcgtgatgcagctcaccggctcccgcaacgagcagctcgaggcccaccttcgctccacggcccgtcccgagaccacgatgatggggcaagtgaacagggagaggctggcggagtttctcggcgagctgcaacggaaagaggacacgaacgacaggtacgtggccgcgctgaggggggagaccctgaccaggaagcgctacgagcgcatncagcccgtgcctgccgncaacgcgcaagcgag

SEQ ID NO: 63207 - DNA, 363 bp, Zea mays
  Clone ID: LIB3075-011-Q1-K1-B2
tcgggcacgaaatctaacccacccgcctgcggctcctaagcgacggcggcggcagccatggagccgtggcgcgtatgatacggtggctcggctgatcggcggcgcacggaggcatcacgggcgttgcaacactacctggaccgctctgcaccttacacggcgtggcggtgcacgtgcactctcgtaggcggggcggcgtacgcactacgggtctactacatgcgcagcttgtacgtcgtgacataccgactgtgcatgtacctgctaaacctcatgatctgcttgatctactccatggtcgagcctgagctggaagcgctctaagctaggcccgggctatggatgcgatgctcctaaaagatc

SEQ ID NO: 63208 - DNA, 134 bp, Zea mays
  Clone ID: LIB3075-011-Q1-K1-B3
gaggaatgattctgtaggatgtgttgcgggtgaaaacttccttttttccccccttttaatcaggatagccctttgtgggctcaaacattgctgtaacggctcgtgtgaaaattgccaggtcatggtttaactct

SEQ ID NO: 63209 - DNA, 466 bp, Zea mays
  Clone ID: LIB3075-011-Q1-K1-B4
cggctgcacttcttcatggtggggttcgccccgctgacgtcccgcggctcgcagcagtaccgcgcgctgacggtgccggagctgacgcagcagatgtgggatgccaagaacatgatgtgcgcggcggacccgcgccacgggcggtacctgacagcgtccgccatgttccggggcaagatgagcaccaaggaggtggacgagcagatgatcaacgtgcagaacaagaactcctcctacttcgtggagtggatccccaacaacgtcaagtccagcgtgtgcgacatcccgcccgtcgggctgcccatggcctccaccttcgtgggcaactccacctccatccaggagatgttccgccgcgtgagcgagcagttcacggccatgttccggcgcaaggctttcttgcactggtacaccagcgagggcatggacgagatggagttcacagaggccgagagcaacatgaacg

SEQ ID NO: 63210 - DNA, 466 bp, Zea mays
  Clone ID: LIB3075-011-Q1-K1-B6
attaaaccgtgcttttttatttttgattatcgacggcctagcctgaagaacagtagaactcagactcgagcgctccaaagcgagccaccgccgatctgctcctccctcttgaccctcctccgtgcgctgcgcaggcatgaggcgcctcctcgtcggcgccctcgtcctttgtatcgccgcggtggtggagtccaagccgcctctcgactctctgggcatacccccgcaagatgaggcgtactacataggcggcgtgatcaaatgcagggacggatcgggcaggttttccagggaccagctcaacgacgacttctgcgactgccccgacggcaccgacgagcccgggacatctgcatgccctgaggcgaaattctactgcaagaatgcaggccacactccagtcacgatcttctcgtcacgagtgaatgacggcatttgtgattgctgtgatgggagtgatgaatat

SEQ ID NO: 63211 - DNA, 471 bp, Zea mays
  Clone ID: LIB3075-011-Q1-K1-B7
gcagacttcaatcttttgaaccaagcaccagatatggcagctcgtctccattcaactcgtgtattgggaacttttggatatcatgcacctgagtatgctatgactggccagctgacacaaaaaagcgatgtctacagctttggcgtggtccttttggaacttttgactggaaggaaaccagtagatcacacaatgcctcgaggacaacaaagtttagtcacatgggctactccaaggttgagtgaagacaaggtgaagcaatgtgtagatcccaggttgaagggagaatatcctccaaagggagtcgctaagcttgctgcagtggcagcactgtgtgtgcaatacgaagcagagttcaggcccaacatgagcattgttgtgaaggcgctttcgcctctccttcaacaaagacctgcaccaggcaccgcatagccagccccgcaacctgtgagctgaattcagtcacgtgtg

SEQ ID NO: 63212 - DNA, 406 bp, Zea mays
  Clone ID: LIB3075-011-Q1-K1-A3
tcggagcgacatttcgaataacacagttgatcgcgacgatgggatccctcgctaataacatcatggtcgtgggtgtcgtccttgcagcgctcgtcgccggcgggtcatgcgggcccccgaatgtgccgaccggtcccaacatcaccaccaactacaacggcaagtggctcaccgccagggccacctggtacggtcagcccaacagtgcctggactgctgacaacggcggtgcgtgcgggatcaagaacgtgaacctgccaccctacagcggcatgacggcgtgtggcaacgtccccatcttcaaggacggcaagggttgcggctcatgctatgaggtgagatgcatggaaaaacctgagtgctcgggcaatccagtcacggtgtacatcactgacatgaactacga

SEQ ID NO: 63213 - DNA, 287 bp, Zea mays
  Clone ID: LIB3075-010-Q1-K1-H11
tccagaaatcaaagtaaaaaaaagccctagtgtcttcgcatctcgctcccgcacacagaccgaccagtcgcagcccgtggcgcacctgcctgcgcccgacgcctacgtcatccactcaacctcgcccctcagccactgccgcgcggcgcccgtccatctgccgcacccgccgaattattctacggcccttaagctgaagcggtgtggcctaagtagcagcgcggcggtcgtcccatgtctcgttcactttggccccgacaggctgtccacggtagcgcgaactgccc

SEQ ID NO: 63214 - DNA, 402 bp, Zea mays
  unsure at all n locations
  Clone ID: LIB3075-010-Q1-K1-H12
gtggtctttaactgtggaggagagccaggtagtattaccttgtttgaagtcactgcagatagagtggtgtcctaaactgaaagctctaccagaaggcctgaagcatgtagcgctgtgtgaacttcatgtggagggtgcacatagcctaactgaaatcaaggacctgccaaaactatctgacgagctccatctcaaagataataaggtgctacagaggatctccaacctgcccatgcttcgttccctcattatcgatgactgctcaaagttgaagcatgtggcaggtcttgatgcgctgcagcacctcaaacttgtctttcctccgtncaccgagacattttatttcgaagagctagtaaattntctggagcgttgccctcccacggtggctgaagctactga

SEQ ID NO: 63215 - DNA, 452 bp, Zea mays
  Clone ID: LIB3075-010-Q1-K1-H2
tcggaaacagaccttgcaccccttccgtccgtgattttaatacatcctgtcagcccaacgaaaatgtggcgcgctacaaatagccgcactgtgtacatcctcaacgacgctgccctcaacacggccatggcaccggcagaatcaccgaatgcaggcagtcctgacaaggcaccgacctagtcaccaaaggcacgcagtcctgcagcatatgccaatgcacctgagtctgctgccacgagaactgcccccgctaatgcacctcaagccgcctacacctccggcgctgccgatgccccatcttcgtcaacaacctaggaagtctgagccagctgccgagccgaccaccgacgtctctacaccgtcttcttccacggacgaggagttgagcccttcgccgtcagcattcaccgtcgatgtggcgtcccctgccgctgatgggcctgctgatggac

SEQ ID NO: 63216 - DNA, 428 bp, Zea mays
  unsure at all n locations
  Clone ID: LIB3075-010-Q1-K1-H3
caacctgttccatttccagtaaggtctgtccaattgggtactntgttttctagtctgggttcagaaggatctgttctacatccgagagatgttgatatccatgtccgcacaagtgggtccgtgcctggagccagtactaacccaagtgattcagctggtgcgcaagcgcatcaaaatgtgaataggccaggagatgcttcgcatgcaaatattggtgaagcgttttcaggggttgcaggtggcactcctttttcagttgagtccggagttagactattgccacttagaacagtggttgccatgcctgctggcatcagtcgtgctccatcagggtcgtctagtggtgggcttggtattatctatccatttctcactagggttcgacaaagggcaaacactaatggtaatgatgaaaagaatggtcaatc

SEQ ID NO: 63217 - DNA, 472 bp, Zea mays
  unsure at all n locations
  Clone ID: LIB3075-010-Q1-K1-H4
gcgctagccggccgcgctcgcaccgtcgcgtgtcccattctcctcgtcgttcgaaactggcccctgcctcaccgtgtcgtgggcaccggcggctccacacgggatgtggccacgcctgacacctncacctccatggctgagtgacggatgagcggctgggaggtctcccgcggagcggctccactagccgcctcaacgtgcaggcgcaggagttcgtgccgcgcgctgccgcggtgcccctcccccttcgcaacagaagcggttgccattggtagggttggcaagttcggtccccaccgctgctgcagagcaggaggccgaaggtgagcatttttatgccttcttgtcaggggaaccttttgcaggtatcagatcttgggtattttctggtgattcagttgtgtattcttggagctgaaagactcggaagaagtaatatatcggcaatagctagttccattaatcaaatatc

SEQ ID NO: 63218 - DNA, 443 bp, Zea mays
  Clone ID: LIB3075-010-Q1-K1-H5
caacctcttctcccctgttttctctcgttcgttctccgcaggagcgaggagggctcgcggcaggggcagggtctccggtgtttgtgttccagaatctgtagcaaatggctgacggcgaggacatccagccccttgtttgtgacaatggaactggcatggtcaaggctggttttgctggtgacgatgcgccaagggctgttttcccaagcattgttggacgcccacgtcacactggcgtgatggttggcatggcgcagaacgatgcgtatgttggcgatgaggctcagtccaagaggggtatcctgactttgaagtacccgatcgaacatggcattgtcaacaactgggatgatatggagaacatctggcaccacaccttctataacgaactccgtgttgcgcctgaagagcaccctgtgctgctgaccgaatccccactcaac

SEQ ID NO: 63219 - DNA, 377 bp, Zea mays
  unsure at all n locations
  Clone ID: LIB3075-010-Q1-K1-H6
tcgcggacgcgtgggttctagatcgcgagcggccgtccggactagaactagttctctatttgctgaggagttgntnangcggaagaggacaggaaagcctaacgacaacctgcggaagccgatccaggacgtcaacggcaggacgaagaacttggacgacattggagccggccacgtgaacccgaagaaggccatggaccctggcctagcgtacaacatgactgacatgggctacgtgccgtacctgtgcgggctcaactacacggacgacaaggtgagcacgatcatctacctagagacggctgtgccgagcacgaagcaggcgatcattatcaggacgaccttaactacacgtccatcaccgtcatcctgaacca

SEQ ID NO: 63220 - DNA, 463 bp, Zea mays
  unsure at all n locations
  Clone ID: LIB3075-010-Q1-K1-H7
cggacgcgtgggtgatgtcaccgttgatagtgattctaaagtgtcaaccacagtcactgttgatgaagcactaactggtttgaagacttcattcgccttcaaggttcccgatcacaagtctgggaagcttgatctgcaatatgcgcacaatcgtttttcattgaactcgaccattggtttgacatcagcacctttggttgaactggctgcaactgtcggcacaagtgaacttagcattggtgctgaggttgggtttgacagtacttcagctgctgttactaagtacaactcangaattggatacaacaagtccgatttctcagcttccttactactggctgataaaggggagactttgaaggcatcttacgttcatttgttcaatccgaccaatggagctacagttgcagccgaggtaacacacaagctgaagaccagagagaactatttcacagttgggagc

SEQ ID NO: 63221 - DNA, 500 bp, Zea mays
  Clone ID: LIB3075-010-Q1-K1-H8
accggaattgaagggtccgacccacgccacgcgtgcgctagactgccggaggagggggagacggggaaaccgatctcaacgaggctcttacctcgcaggtgcgccgccttgccatggagatccggcaacttgctaattcacgaccaataactgttctcaatggaggttctggacaatcaggagtatcaggcctgatagtacctgcagcaactgttggagcactaggttatggttatatgtggtggaaagggatctcgttctcagacctaatgtatgtcaccaagcgcaacatggcaaatgctgtttcaagcatgactaaacatttggagcaagtgcaaagttctcttgctgctgctaaaaggcatttgacacagcgcattgaaaagttggacgataaattggatcagcagaaggctctatctggacaaataagagatgatgtcactgatgcacgtctgaagcttgagaatattggttcagaaatcaagaacatcaaaaga

SEQ ID NO: 63222 - DNA, 396 bp, Zea mays
  Clone ID: LIB3075-010-Q1-K1-H9
acgcctagatcgcagttcggacgctcgaatatctgatactaagtatttacaatatgccagtccgaacacaagcgctgctgggtctgtatatgttctcatgtaggatgatatattggacttttgatctgtgaacagagctgcgtgatacaaaccgtgaaatcagactatatgaggcacctggctgctcgagcctgctacgtgatccaatcaaactggtgcctgcgacaatggcatgcgacgttcgtgcagctgcctcacctggctaatcatccgactgtccttaaactgtagccttatgacctaattagcatcgctgcagtgtgtactctgatatcgtcactatatgcgggacaggctgtgcaacgagtctagatactgccgttagatggtccacac

SEQ ID NO: 63223 - DNA, 445 bp, Zea mays
  Clone ID: LIB3075-011-Q1-K1-A1
gccattaacgtcaacgattccgtcaccaagagcaagtttgacaacctgtatggttgccgccactcgctccctgatggtctgatgagggccactgacgttatgatcgccggtaaggttgctgtggtctgcggatacggtgatgtcggcaagggttgtgctgctgccctcaagcaggctggtgcccgtgtcattgtgaccgagatcgaccccatctgtgccctccaggctctgatggagggtcttcaggtccttcccttggaggacgttgtctctgaagctgacatcttcgtgaccaccactggcaacaaggatatcatcatggttgaccacatgaggaagatgaagaacaatgccattgtctgcaacattggccactttgacaatgaaattgatatgctcggccttgagacctaccctggcgtcaagcgcatcaccatcaagcccc

SEQ ID NO: 63224 - DNA, 470 bp, Zea mays
  unsure at all n locations
  Clone ID: LIB3075-011-Q1-K1-A10
acccggttcatcaaggagaagagcagcaccacggccgtgatccgctacaagggctccagcgccccgccgccggccaagctgccggagggccccagcgggtgggcgtggtccatcaaccagtgcaggtccttccgctggaacctgacggccagcgcggcgcggcccaacccgcaggggtcgtaccactacggccagatcaacatcacccgcaccatcaagctcgccatgggccgcggcaaggtcgacggcaaggagaggttcgccttcaacggcgtgtcgcacgtggacccggaaaccctcgtcaagctcgccgagtacttcaacgccagcgacggcgtgttcaagtacaacctcatcggggacgttgccgccttcaacacggnccccaccaagatggcacccaacgtcatcagcgccgagttccgcacgttcatcgaggtggtcttcgagaaccccgagaagagcatcga

SEQ ID NO: 63225 - DNA, 472 bp, Zea mays
  Clone ID: LIB3075-011-Q1-K1-A11
ctacgaggatatttgttgctcgaattccacagtcagtggacgagtcgatgtttcgtaggcattttgaagcttttggagaaattcttgatctttacatgccaaaggaacatggttcaaaggggcatcgtggaattgggtttatcacgtttcagagtgcagagtctgtggacagcatcatgcaagagtcacatgagcttgatggcacaacagtagttgttgatcgcgcgactccgaaggaggaagatgtaagataccccccgagtagaccatctcagggtggctatggtgcatataacgcatacatttcagctgctaccaggtatgcaactttgggtgcaccaacactgtatgatcatcctggatcagcctatggaagagggtactatggatcctctcaagcagtgggcaagaagatatttgttggtagacttccacaagaagcaaacacggatgacctaagacattactttgg

SEQ ID NO: 63226 - DNA, 296 bp, Zea mays
  Clone ID: LIB3075-011-Q1-K1-A12
cccccaaatcccgaatccctctcgaatttctatttaatgttcctgttcttcccctccgatccgatgtccccaactgcgctcccgtcggcgatcaaacaccggatcgcggcactcgccgccgttgagcgatggatcgctcctagactagatcaagcgccttgccgtcagcaccatgaggaagaagctggacacgccgtttcccgctcctcggattaaaaagatcatgcaaacagatgaagacgtcggctagattgctcaagctgtatctgtgctagcgtccaaagcattggagctat

SEQ ID NO: 63227 - DNA, 467 bp, Zea mays
  Clone ID: LIB3075-011-Q1-K1-A2
tcggtcgatgcggtcacaggttgcgatggctgtggcgttggtgatcttggtgagcggcgcatggtgcggtccttccaaagtccccccaggcaagatcatcacggacacctatggcaaggactggctggacgctaaagcgacatggtatggcaagccgacgggtgccggtcccgacgataacggtggcggctgctggtacaaggacgtgaacaagcccgccttcaatagcatgggctcatgcggcaacatccccatcttcaaggatggtctgggttgtgggtcctgcttcgagatcaagtgcgataagcctgtggagtgctccggcaagcccgtggtggtgcacatcacggacatgaactatgagcctatcgcggcgtaccacttcgatttagcaggcacggcgttcggcgccatggccaataacggcgaggaggagaagctgcgcatggcggtcatcatcgacatgc

SEQ ID NO: 63228 - DNA, 363 bp, Zea mays
  Clone ID: LIB3075-010-Q1-K1-H10
attcgaagggcaagtgcaccgagcataagggcatcttggcgccggccatgaaggtctgccaggaggagtgcgacaaggcgtacgtggtgaaggcggccgaggtcaccaaggcctgcatcgtcacctgcgccaaggagaagaacccgcgcctcagcgagaactgcaagaggtcctgcacccctcctccttcttgaagcgaagccccttgaaatgaatgaaccatgcatgcatgcatgtatgcatgcgccggggtgacgtggcgttcagctcatgcgctgagcgagtctatacgtacgtcgtcaccggctggccacgcatgcgataaccatctgatatggacggaactatatattggattcctat

SEQ ID NO: 63229 - DNA, 454 bp, Zea mays
  Clone ID: LIB3075-010-Q1-K1-F8
caatgttccagtgatgccgactccgctttttgccaatgctccagccgagaaaggtggcaaaaacttcatgattgatttcatgatgggccgtgtttcagctgctggttcgaagactgcagctgcttccattgaacgagtgaagctgcttattcagaatctcgatgagatgatctcatctcggatgggctctcagacccgcacaggggtattgctgatcgcttcaaacgtaccatcaaggatgagggtttctctcccttggggaggggtaacactgctaatgttattcgttacttccctactcaggctttgaactttgcgtttaaggactacttcaagaggctgttcaacttcaaagaaggacagggatggttactggaagtggtttgctggcaacctggcctctggtggtgctgctggtgcttcctctttgtttttgtgtactccctggattatg

SEQ ID NO: 63230 - DNA, 361 bp, Zea mays
  Clone ID: LIB3075-010-Q1-K1-F9
acgcgtccgccgaacggaggagagagggcctcgccggcgaccttcgctccggccttgatgtgggtgcccaggtgctgggtgtgcagtgccgagcgtacaccgagaaggtcgcgctctcggcgatcaagtctggaggacgagctgctcagaacgcgtcggctgcattgaaagacgtcatgggctcctacacaaatgcaatccggcgtcgtctacgtcttgaccaacgcgtgaggttacgagccacctgaagaacaggttggtagctggaatctcaagtgctacgcaagttgtgcccttgatcactattttttacccactcatgtgctaattaatcataatgatctgcatatgttaattttga

SEQ ID NO: 63231 - DNA, 434 bp, Zea mays
  Clone ID: LIB3075-010-Q1-K1-G1
cggacgcgtgggtgcggagtgtactcatgatggatccactaggaccttgtcataaccagatgtgcaagcttcaatatcaactgatggacaaaagacatcagatttacactgtccaactaatcctgaatgtttaccatagtatatcagttcaggttctgaagctgccagtaggtgctggtgaccatttgcatttgctttcctagtcttctgccgatccttccatgatctccttgaagtccattctgggaatatgcttccaatttcttcaacgccaattgacccttccattctttgcatcctggagttcacaggtaaaagggaaaacaaagttccatcagcaacaaagagccgagtacggtcaccaagagaatacttctgcaacattgtacgacaggccgcaaggcggtgctttgcaacatcaacaccagtcagag

SEQ ID NO: 63232 - DNA, 425 bp, Zea mays
  unsure at all n locations
  Clone ID: LIB3075-010-Q1-K1-G10
acgcgatgtcttatggtgccactctccataaatgagttgaaccagatgtgatgagtaggcctgccggtaaagtgaaggagaaagctctggagacagtcatgcaacatgttcactatgaggatgagaacactcggtacatttgcattggtcctgtaaacaaggtattaaatatgctagcttgctggattgaagatccaaactcagaggccttcaaactccacataccacgagtctatgactacttgtggcttgctgaagatggcatgaagatgcatggttataatggtggccaactttgggatacagatctcataggtcaagccattgtggctaccaaccttaccgaagagtttggtcccacccttaaactagcacacaactatatcaagaaatcacaggttcttgacgactgncctggtgatctg

SEQ ID NO: 63233 - DNA, 349 bp, Zea mays
  Clone ID: LIB3075-010-Q1-K1-G11
acgaaacactatccagaagacgttcaaggtctcatcaacccaactgctttaccagtcttgcccttaccaatcactgaccctggttctcattggccccttccttgatggctttttgactaaccaaaatgtctttgctattaattatacatctcaagttgtgtttttcatcgtcatgtcatgcttgatatctgattcagtgaacttcagcactttccttgtgatcggcaagacatctcctgttacttaccaagtgctgggccatcttaaaacatgccttgttcttgcttttggatatagcatgcttcacgatccgcttagctggagaaacatacttggaatactaattgct

SEQ ID NO: 63234 - DNA, 372 bp, Zea mays
  Clone ID: LIB3075-010-Q1-K1-G12
cggacgcgtgggttcgttatcctcctcgatcttaattacaggtcatagctaagcaggtctgagaggatgtcgtggcagacatacgtcgatgagcacctgatgtgcgagatcgagggccaccacctgacctccgctgccatagtcggccacgacggcgccgtttgggcccagagcaccgcattcccacagttcaagacagaggagatgaccaacatcatgaaggacttcgacgagcccgggttccttgccccgaccggcctcttcctcggccccaccaagtacatggtcatccaaggcgagcccggcgctgtcatccgcgggaagaagggatctggaggcataactgtgaagaagacagggcaagcgatggtg

SEQ ID NO: 63235 - DNA, 427 bp, Zea mays
  unsure at all n locations
  Clone ID: LIB3075-010-Q1-K1-G2
gattgcggcagcaccgtcgaccacgagcccgtcgaaaggctcctccgcctgccgttccaaggtgcactgccggcattgctcaatctcccgtggtgcggaagtccacccgtgcgccaattggtctnctctttcgttggcagactgagtggcatccaatcctgaatcaatgangggctggcgtttgctcgtgttatcgctacatgttctttcatgcctgggtagtggcgttgcttctggtcgaacaagctcttatgtgcgcacagagtttccatctacagatatacctctagaaagtgaatggtttgctattccaaagggatacaatgctccacagcaggttcatatcactcaaggtgattatgatggaaaggcagttatagtatcttgggtacctccagaaaaacctgggccaagtgaagtatttatg

SEQ ID NO: 63236 - DNA, 173 bp, Zea mays
  Clone ID: LIB3075-010-Q1-K1-G3
ctctgctgagggcaacgggttcatctgcaagtctatggggttcgtgaacaccgcggggccggaggggcgccaagcgggggcgatgcacctgcaaggcgacaagtcggtgttctacaacttgccgttcgaggggtaccaagacacgctggacgtgcacgccaaacggcagttct

SEQ ID NO: 63237 - DNA, 449 bp, Zea mays
  Clone ID: LIB3075-010-Q1-K1-G4
gattctgcccgtggaaacttcatttatttgagcttgaagaggagctgaagactgatcctctgaccaagtatgtgctgtatcaggatgagaggagcaagagttggcgagtccaagcagtcgcagttgctcctgacaggttcgagagccgaaaggctctgccagagaagtggaggggcatgagagacgacgaactttcagcagaaaccggcatccctggctgtgtgtttgtccacatgagtggcttcattgggggcaacaagacctacgagggagcattggaaatggcgagagctgctctgaaattctgattcaaccaaagcatatttattacccatgttaccattatatcagtaagcacattaagaacacaagatgcagttgcgctttcttcaatgttatcgtggactccagccgtgggtaactgggactgattcttgcactgatcttct

SEQ ID NO: 63238 - DNA, 465 bp, Zea mays
  Clone ID: LIB3075-010-Q1-K1-G5
cggacgcgtgggcggacgcgtgggcccgtgcgaagtggccatggttgccgcagttgaaacacttcctgatcgacgactttttcttttgtcgagccttccactcggcctccgtgagaaggagctggttgtcgcgccgttcgccgccagtacgagtgcgccgccgggaacgctcgtcgaacgccttcagtctgccgagcgcctcctcgaacgccatcgtctcgacatcgcagaactgctcgatgcccgcgacggcgggaagagccgatctggaacgatgtcgaggagcttcttcaccatggcagcgtcgtcgagcgtcacgccaagcccggcgtaacgcgccgtcataccgctgattttgtcggcgtagtcgtccaatgcctccccgtcctccatttacagcttgtagaactcccccttgagcgtggtgaggcgcgtcgtcttgacccgattcgccccgacaaaacg

SEQ ID NO: 63239 - DNA, 459 bp, Zea mays
  Clone ID: LIB3075-010-Q1-K1-G6
cgtacgcctggtcccacgcgtgcgccattgctttgctgccgctcattgcgtacaccgagcagggactggtcaaggactgcgacatgtgcagagcgtgacactctggctcatgcataatcacctacaactgcgccaatgtgtgcccaggacaaggcctcttggccggaacgctcagcaaacgactgcgtcgttgcatgcgcatcttgcaacgctaaacaatgaacatcgataactcgtatgcatccacaacctattcaagatcacatctattacgacgtccatatgcatgacgaccatcacatatgtactgatcactgcgatgtgtattctgatgactgccatcgttctggtgaatgtgtgctcaaggtccatcaatgccttcatgtactacatttacagctgaataacctactacttaagcttgcggacatgcatgaattataccctaatgagctcaac

SEQ ID NO: 63240 - DNA, 464 bp, Zea mays
  Clone ID: LIB3075-010-Q1-K1-G7
gcctaccataaaaagagaatctttcaaagatggcgtccaagaagatggtcctcgccgtggcggcgactgctgctagtcacgctcgcactgcaggtcgcccctcctgcgatcgccatggactgcaaggccgggtgtgccgagatcaagaactccccactcggcataagcatcgaggagtgtctgaagaggtgcgaggggatcgccactgagcagggacctagggacccttacaaggataacaaacttgatatcccataaacacttatgacttgctgatatatttgtgcctatccaatcatttgtgatagatcaatgcatctttgtgttaaaaatagatagatcaatacatctgtatatatgctcactccgttcttttttatttgtcggcgtttagttcagaaatgaactagcggacgacaaatattagagaacggaggtagtactatgcaagcctacccatgaaa

SEQ ID NO: 63241 - DNA, 467 bp, Zea mays
  Clone ID: LIB3075-010-Q1-K1-G8
gcgtttttaggggtggcctactacaatcatgtcaagctgcaggcgctcaaggctaaggaggcccagaagaaagccgcacaggctgatgaggaggttggatcgctcttgcaggagcgcgatggacacggtgatcataagagcgacaatcaggcttagactgtcagatctgatcctggccttcccatattggggatctgatgcaaggtgcaaagactagagtttggtctacggttgctttcaaggaggtggatgacggtttcttgcacttctttaactttgtgtctggagagaaaatcagaggtattaacgtttaggaaatatgcacctgcttggtggagagctttgctttgttattttagacactttgttctacagaaaggcagccatgccttactactatctcacttgcccattgcctagatttatttgtcctgctagtagattaggtactaaaaatgtactgctgc

SEQ ID NO: 63242 - DNA, 266 bp, Zea mays
  Clone ID: LIB3075-010-Q1-K1-G9
acgcccggatgtattctcagcctcgaacggtctatttgcagtatgcatacgagatatgtcatatgcggtagtatggttaccgagatctgtagggatgcatatgcatatgatctacgcctttgcacattatatgtgatgctgcgattatgagcactacaataatcacgacctcataattacatacgaaatgatccatgcactcaagtccaagcctgatctgcagacacaaaagttccttgtgtattcttttactagattattgaccg

SEQ ID NO: 63243 - DNA, 458 bp, Zea mays
  unsure at all n locations
  Clone ID: LIB3075-010-Q1-K1-H1
gcggtggagcccggcggcgtggtgcctgtgcaaccgaaagagctcctcccgaggctgttcgacgagtccttccgcagcaccgcaacttcctctttctccaagtactccgtcgcggacagctccatggacctgggcagctgcccgttctccgaggtcgaggtgggcggnggaagtctgcgagaaggtgacgagtcggagaaggagaggccactggttctgcgcaacaaggcgccgaggtggcacgagcagctgcagtgctggtgcctcaactttcgcgggcgcgtcaccgtggcctcggtcaagaacttncagctgatagctcctgcaaagacgcagccgcagccgcaggcctccggccccccgccggcgncgncgncgncgtcgtcgtcgtcgtaccatgacccggtgatcctgcagttcggcaaggtcgggagggacatgttcaccatggactaccg

SEQ ID NO: 63244 - DNA, 455 bp, Zea mays
  unsure at all n locations
  Clone ID: LIB3075-010-Q1-K1-F7
agcgaagccggagaagggaggaaggagatcgctaccagccggagccggaggccgagaggatgaagacgttcgacccgtggccggtcttcttccgccgggagtggaagcgcaactggcccttcctcacggggttcgccatcaccggcttcatcatcaccaagatgacggccaacttcaccgaggaggacctcaagaactccaagttcgtccaggaacacaagaagcgctgaccaaccgggtggagtcgtccgaatcgcctgcggatgaaaaattagccctctttttcttgtcttttttttttatctagatgcgtgcactctattgtaataatgtaataagaggcaattggattgatccaacagcaaccggcttctgattttgatccgcttcgctgacatatgcatgcagcaaacgaatatgtgccttnttttttcttgatgttggattgcatctaa

SEQ ID NO: 63245 - DNA, 373 bp, Zea mays
  Clone ID: LIB3075-046-Q1-K1-H5
acctgaccaaggccaagagcgaggggtacctgtgggggaacaggactgcagctgtggacgtgggacaagaagcagcagcttcttgccgtcattggagtttacactgggtttggctcccgtctcaagaggaacgtcttccgtggctcctggatgccaagaggtgatgctctgaagaagcttgaggaaaagggtgtagctattcgttttgttattggtcggagtgcaaatcgaggtgatagcttggaccgtaatattgatgatgaaaatcggcagacaaaggacttcttgattcttgaaagtcatgaagaggctgcagaagaattaccgagcaaagcacacatcttcttcagtgctgcagttgaagcctgggatg

SEQ ID NO: 63246 - DNA, 420 bp, Zea mays
  unsure at all n locations
  Clone ID: LIB3075-046-Q1-K1-H6
agtttttgaacggagaagttggacccaagaccattcatgttcctactggggagaagctgtgtgtttttgatgcggccatgagatacaaatctgagggccatgctactataatcctcgctggtgctgagtatggaagcggcagttctcgtgattgggctgctaagggtccgatgctcctgggagttaaagctgtaattgccaagagctttgagcgtatccacagaagcaacttggtggggatgggaatcattcctctgtgcttcaaagctggtgaggatgctgattcgcttggcctcactggacatgagcggtacagcatcgatctccctaccaacctcagtgagatccgtcccggccaggatgtgactgttactaccgacaatgggaaatctttcacttgcatcgntcgctttgacactg

SEQ ID NO: 63247 - DNA, 294 bp, Zea mays
  Clone ID: LIB3075-046-Q1-K1-H7
gcgatgaactctcctcggtgtttattctggtctgcaagcgttggtctgaaggcatacggggggggtggcactgattctcttggcaggatccttatctcaacacagctatacaactctgagacacatacttggacacctcttcctagcatgaataaggcacggaaaaattgctctggcttgttcatggatggcaaattttacgtaattgtcagagtgacaaacaacatcatggcattgacctgcggtgaagtgtacgatgcgcataacaagacttgtatggtgatcgataacatg

SEQ ID NO: 63248 - DNA, 480 bp, Zea mays
  unsure at all n locations
  Clone ID: LIB3075-046-Q1-K1-H8
gcgaaggcgaccctccctccttcgctcctttcgcgccgcctcccggccgtcgccgccatggggaagtactcgcaggagccgggcaaccctaccaagtcggctaaggccatgggcagggatctgagggtccacttcaagaacacaagggagacagcctttgcgcttcgcaagttgtctttgaccaaggctaagcgataccttgaggatgttattgctcacaagcaggcaattcccttccggagatactgtgggggcgttggtcgcaccgcgcaagctaagtcgcgccactccaatgggcagggccgctggcccgttaaatcagccaggttcatcctggatttgctgaagaatgctgagagtaacgctgatgtgaaaggctnggatgtggacaacctctatgtttcacacatccaggtgaatcaagcccagaagcagatgcgccgtacctaccgtgctcacgggcgcatcaatccctacatg

SEQ ID NO: 63249 - DNA, 226 bp, Zea mays
  Clone ID: LIB3075-047-Q1-K1-A10
aaaaaaccagcagctagcgatggctggagcccgggcactgctcatcgtcctcgcggctgccgtcgcggtcctggccgcgcggccggcgtctgcatgcgggggagccgcggcggtggcggagatctgcatgaaagactccgtccccgacctgtgcaccaggacggcggggaagcaccccaacaaagtacaaggtggtggacgcggtgacggtgctagagatgcaggt

SEQ ID NO: 63250 - DNA, 443 bp, Zea mays
  Clone ID: LIB3075-047-Q1-K1-A11
cagggcgcacgaggagaacggcggcgtctgagatcgcgaggccgaggcttgtcccgtccccgctcggctccgctcctctcacccacggtttctggaggacaattctttgctatctagccttcctcaaaagtaaaaagggtaaatgggatcagaaggaccttcagttgtcactgtccatgttactggatttaagaagttccatggggttgctgagaacccaactgagaaaattgtgaccaatcttaaatctttcttggaaaagcgagggttgccaaaaaatcttgtcctcggaagctgcacagttctcgaaacagcaggggaaggggcacttgccacattatataaggttttagagtctgctgttgcagacagaggaactgggtcctcggcacagggacaagtaacttggatccactttggggtcaacagtggcgcaataaggt

SEQ ID NO: 63251 - DNA, 301 bp, Zea mays
  Clone ID: LIB3075-047-Q1-K1-A12
agttaaccttgacaatcgccaaattactgatgttggcctggcagcacttataagtctcactaggctgactcatcttgacctttttggagcttgcataactgacaatggcacaaattgcttcagatattttaagaatcttgtttctcttgaagtctgtggtgggttcgttactgatgctggagtgaagaacatcaaggatctgaaggccctgacgttgctgaatctttctcaaaatgctaatctgacagacaaaaccttggagctgatctctggcctgactgctttgatcaacttgaacgtg

SEQ ID NO: 63252 - DNA, 402 bp, Zea mays
  Clone ID: LIB3075-047-Q1-K1-A2
aaaagatgttccgtttgaaagaattgataagagcttcagggggaaggatggagttactaaatgatacagacagaaaatgttgttaacgaaaactatgaaagtagttcgtcaggcgtgtatgtcaaaagcagggtacgataaggcgatggatgtgttggatgagctcgatgtcgttctaagccgattggagccagatattggatgtaatgagtcaacagatgttagtgataatgaggaagacaaggaagaagagttgaataaaattaatgctagcgatgggatggaagatgacaatacaattacatgtcataataaggattcgcataacaccaggactggatgtgaacatgcattaacaataataacaactggtaaccaagaagacaacatgggattttcaca

SEQ ID NO: 63253 - DNA, 251 bp, Zea mays
  Clone ID: LIB3075-047-Q1-K1-A3
cggacgcgtgggcggacgcgtgggttcgacgtgcacgaccaagagggaagccagcctggaggtgtccaccttgagatgaccggtcagaacgtgaccgaatgcacgggcgggtcaagcaacgtcaccttcgacaacctgagagaccgctaccacacgcatggcgaccccaggctgaacgcgtccaagtccctgaagctcgccttcatcctcgccgagaagctgaggaaccgaaggatccgccggtcgtcgtt

SEQ ID NO: 63254 - DNA, 441 bp, Zea mays
  Clone ID: LIB3075-047-Q1-K1-A4
agctcatccaacccagtcgcctgattgcattgggatcccatggccaagctcgccgtcctccgcctcctcgccgtggccgcgtccgccacagtgccggcgcacggccgcgataccccgactgagatcaagctcatcaaaggcacggacgccttcggcgtgggcgacgacagcatggagtgcgtgtacacggtgttcatccggacggggtcgatcttgaaggccgggacggacgcgaacgtcacgctggagctggccgccgcggacggcaacggcgtggggatctcgaacctgcccgcctggggcgggctcatggggcaaggctactcctacttcgagcgcagcaacctggacatcttcagcggccgcgggccctgcatggagaaggcgccatgctggatgcggctggccaccgacggcaccggcgaccaccacgggtggtac

SEQ ID NO: 63255 - DNA, 428 bp, Zea mays
  Clone ID: LIB3075-047-Q1-K1-A5
ggtcgacgacgcgtgcgccgacgcgtgtgccgacgcgtaggttcgactttcactttcaagacggaagccagcctggacgtgttcaccttgatatgaccggtcagaacgtgaccgaatgcaccggcgggtcaagcaacgtcaccttcgacaacctgagagaccgctaccacacgcattgcgaccccaggctgaacacgtaccactccctggagctctccttgatcctctcctagaagctgaagaagcggatgatgcggcggtcgtacttggcgcctgtgctcggcggcagcatcttgtccttgacgaactttgggtcttgatgtcttgcacgctatctgtgtgcatgcacagtgcactgcatgagtgtggtatgagaatcttacgttgctcattgccttgctatgtaatatgtaatgctttaatttact

SEQ ID NO: 63256 - DNA, 138 bp, Zea mays
  Clone ID: LIB3075-047-Q1-K1-A6
gtgttctcttactccatgtaaactactctagacagtgctcggtgagtacagctgctcggtgagtacggtgtcacagtcactccgtgtaggcagtgccatttcgaagacaatattgcaaaatttaactaacttggtttt

SEQ ID NO: 63257 - DNA, 442 bp, Zea mays
  Clone ID: LIB3075-047-Q1-K1-A7
atcaaattcaccatctgtgaaggagaagatggcactgaatcatcaaatggagatgtgttgatctttccagatatgatcagatacaaagggctgacccattttgacgtcgacaactttgttgaagaagtgtttgtgaaggatattgactggcttcctggatctcctgagcctataagcggttcctatgttttcgtttgctcccatcaaagaagggatataaggtgtggtattcgtggacctgctttgattaaaaggttcaaggaagagataaatggactgggacttgatggtcaggtggctgtcagtgcatgctcacacgtgggaggtcataagtatgcaggaaatgtcatcattttcagttctgatgccaagggagaagtgatgggtcattggtatggttatgttgtccccgacgatgtgcctgttttgctgcataaacata

SEQ ID NO: 63258 - DNA, 437 bp, Zea mays
  Clone ID: LIB3075-047-Q1-K1-A8
ctctctcgcgcgcgcattacttgcacgtacgagctcagaaggaaggcagaggcaaaagcagccatggcgaactcgtcgtccggccttgcggtgaacgacgagtgcaaggtgaagttccgggagctgaagtcgcggcggagcttccggttcatcgtgttcaggatcgacgacacggacatggagatcaaggtggaccgcctcggcggaccgaaccagggctacggcgacttcaccgacagcctccccgccaacgagtgccgctacgcgatctacgacctcgacttcaccaccatcgagaactgccagaagagcaagatcttcttcttctcctggtcccctgacactgcacgcaccaggagcaagatgctgtacgccagctccaaggacaggttcaggagggagctggacggcatccagtgcgagatccaggccaccga

SEQ ID NO: 63259 - DNA, 449 bp, Zea mays
  Clone ID: LIB3075-047-Q1-K1-A9
gccattcaagatgttgtttccttgctccggtgcacaaggcagagcctaggagtcatggcatcaagcagaggggcactcattgggcgccttgtgttgcatgaaccggacggggagcagattgactgctccattcttggagcttcaggacatgcaattacgggggacctgaacctgttgagcaaattaaatttgtcttcgggctctcggtacatcattgtggtggagaaggatgccgtatttcagaggctggctgaagaccgcctgtataatcagctcccttgtattctgatcactgcaaaaggatatcctgatattgccacaaggttcatcttgcatcgactgagccagacatttccgaatatgccgattttcgcattagtggattggaacccagcagggcttgctatactgtgcacttacaaatacggaagcatatcaatgggcctaga

SEQ ID NO: 63260 - DNA, 381 bp, Zea mays
  Clone ID: LIB3075-047-Q1-K1-B1
cttggtggtggcatgtccttgaagggcataccaaacaatgttgaagttggttttcttaccgtcctggaatcactaaatctctgcaaggttggtcagtacttgaagtgcccaaagtggccgatatgggttgtgggaagtgaaagtcactacacagtccttttttgccttgaaccccaacgttcaagaggagaatgagctggaagagcgcgaatcaaaaataaggagggcttttgatgcccaagatcaaagtggaggtggaggctttatcagcgttgagggcttccaacaagtcctcagggatactgacataaattttccttcggataaactcgaggacctatgtaatgctgggattatagtatggagtgaattctggcaggc

SEQ ID NO: 63261 - DNA, 395 bp, Zea mays
  Clone ID: LIB3075-047-Q1-K1-B10
caaccggttcatggactcgcgcactattttctctctgcattgtgccaagaaggtgtcagaatggtggggaagccgcagcagatctacgaggatgccgaacatctcatgcgcccgaccttatcaaatctcttggcttcgaagacggtaatgcaggaagatttgtgtgagacgaggtcgtctccgtgctcgagggccaacaaagcgagcgcctcggcggcagccttcctggcggcccaatcgtcggccgtgagcgcgtcgcggaggcaaggcacggcggcggaggcggcttcaccgccggatgctgccgaggcagcgccgatgatggaaatgagcgcgggcttggccttgaacgccgcgctgcggatgaccttgtataggctccggaagagcccccg

SEQ ID NO: 63262 - DNA, 418 bp, Zea mays
  unsure at all n locations
  Clone ID: LIB3075-046-Q1-K1-H4
agataccaaagggtagagaagcctcggaatgacacgccaatcagccagaatgagatcagaatcactactcaggggaggatgaggaactatatcagctatgggatgtcgctgcttgaggaaaatggacatgatgagattagtatcaaggccatgggacgggccataaataagacagttatggttgttgaattgatcaagagaagggttggaggtcttcatcagaacactgctactgaatctgttgatatcacagacacatgggaacctttggaagaaggccttctcccactagagacaactcgccatgtgtcgatgatcactgtgacactgtcaaagaaccctctggatacatcatctncaggataccagccacctatcccagctgaagaggtgaaacctgcttttgactatgatcatg

SEQ ID NO: 63263 - DNA, 297 bp, Zea mays
  Clone ID: LIB3075-046-Q1-K1-F7
ctcgacgggcaggggccagccgtgtggagcaagaactcctgcgtcaagaagtacgactgcgggatccttcccaactcgctggtgatggacttcgtgaacaacggggaggtgtccgggatcacgctgctcaactccaagttcttccacatgaacatgtacaagtgcaaggacatgctgatcaaggacgtcaatgtgacggcgcccggggacagccccaacacggacggcatccacatgggcgactcgttcggcgtcaccatcaccaacaccgtcatcggcgtcggcgacgactgcatc

SEQ ID NO: 63264 - DNA, 385 bp, Zea mays
  unsure at all n locations
  Clone ID: LIB3075-046-Q1-K1-F8
gtgagatggatcatctgattttagtgacgcatctgactgctattgcccaccacatcttggggacaataacactgttgtaataacagggattgcattatctgacctgagagagttgcatagatcttacaatgaagagaactacttacctatgactctaatgatggaggtctgtgacctgaccccaaaaaatctgataggatcgaatcaattgaagcgagcatatcaacaatgctagcatatggacatgatgtctgtcaacctgtacctcacacatacgtcggtcacgttaatcgtgaaacggtgaagcgagtgtctttcatcgatccaaatgacgaatatgttgtcagtgagtcagactgcagtctgatctntattaggatacagg

SEQ ID NO: 63265 - DNA, 355 bp, Zea mays
  Clone ID: LIB3075-046-Q1-K1-F9
ctcaggtttggggggaaaaggcctcgcgggtcgcaaaccgctctctgttgatttgggatttgggaggcgctcgagttttcaggtaaaccatagtttagtgaccaatggctcgtactaagcaaactgctcgcaagtccactggagggaaggctcctaggaagcaacttgccaccaaggctgctcgtaagtctgcacccacaactgggggagtaaagaagcctcatcgttaccgccctggaactgttgctcttcgtgaaatccgcaagtatcagaagagcactgacctgctcataaggaagcttccgttccaaaggcttgtcagggagattgcccaggatttcaagactgatcttcg

SEQ ID NO: 63266 - DNA, 263 bp, Zea mays
  Clone ID: LIB3075-046-Q1-K1-G1
cttctttcattttcacgtggtatgctatcttccgatcgcgaggcgtgtttgcaatataatcgtcgttagcctcggagaggaggattggagaggcaaccaaccatccacgacgggatcgcaggagctgatgccccggtcgcggaaagcaacggcgacgagatttcgtgcacgcgagacgcggcagagaaccgacgaggaggacgcgagccgcgtgacggatgatccgcggtcgccactcgctcctcgggcgggaaggcatcggt

SEQ ID NO: 63267 - DNA, 300 bp, Zea mays
  Clone ID: LIB3075-046-Q1-K1-G10
taattaccggaccgacccatgcgttcaaacaatacttgcacccattatctccattacttcaccacatctctctcaccctaacgaaggtcgcccgccccacataccacgctcctctcctacatccttataagatttaccatcaccacgggccaggcaccggcacatctaccaattgctctcacagctgctatatcacccgccgtggccaccgaatgcgctatcccttaccgtgacccacacccagtgcatcctcgagttcttaccctatgagagcgacaccctgttcaggaacttctttct

SEQ ID NO: 63268 - DNA, 200 bp, Zea mays
  unsure at all n locations
  Clone ID: LIB3075-046-Q1-K1-G11
tcgggcgcatccgatcgttccttggggacgatgcttcatcgcgatgtggtgngaggcggtgaggcgccggttggtcgcgacggcgcggcccgcgttcctccgggcggcgggggcggaaaaaaacttccgcgccgtggtggtgccgcgtttcggtgggccggaggtgctcgaggtcangcaaggcatgcctgtgccccatc

SEQ ID NO: 63269 - DNA, 362 bp, Zea mays
  Clone ID: LIB3075-046-Q1-K1-G2
gcttccacgaccagctcctcaaagtgcaggacatcatacccatctgcgcctccatcatcgggcagcgcctggcgctctactcgctggaggccggccccgagtggatcaaagaaagggtgagagacctggtgaaaaaccgcgcgctgctcgtggacgcgctgtccccgctcggtgacgacaacgtcaggggcgggcagggcgccatctacctctgggcgaagctgccggacacctgccccgacgatttcgaggtcgtcaggtggctcgcgaacaggcacggcgtcgccgagatccctggcagcgccagcggaggccccgggcacattcgcgtctccttcggagggctcaaggaggaagacacc

SEQ ID NO: 63270 - DNA, 329 bp, Zea mays
  Clone ID: LIB3075-046-Q1-K1-G3
cggacgcgtgggcaagcctatgggttggagccacttcactgccgaaggagatgttgagttcaaagctttgctctttattcccccgaaggctccacatgatctctatgagagttactacaacagtaacaagtcaaacctcaagttgtatgttaggagagttttcatctctgacgaatttgatgatcttcttcccaagtacctgagctttttgaagggtattgttgactcagacacgctgcccctgaacgtgtcacgagaaatgcttcaacaacatagcagtctcaagaccaatcaagaagaagctgatcccgaaaaccccttgacatgat

SEQ ID NO: 63271 - DNA, 451 bp, Zea mays
  unsure at all n locations
  Clone ID: LIB3075-046-Q1-K1-G4
ggcgacggcgacggcgtcgacgagagtacaagcgtctccggcgggcggaaacacgtgtcggtcggcgacctgagcctcgcggagtggacgtcgttcctggagaggttcgagcagctgctgccggcggcgctcgaggacaagaagtgcgctgtgctagggacgtcgacgtcgtcgtcgttctgaccgtgctacgtactggtcaatcactaccgtcaccatttgcatgcatacatgcgtgagtgcgtgcgtgcgtggatgcaaaataatacacgtgtgcatggcgctgtgctagggacctactagctccgtctggatgccttttgtgtgtctactacgtatggtcgtcgaccttgtacggtggcattggcatgcatgctgttgggatgggatcatgggagttgggagctgctgtggaacaccctttncaaagaagctgacgtgtgggggcaat

SEQ ID NO: 63272 - DNA, 393 bp, Zea mays
  Clone ID: LIB3075-046-Q1-K1-G6
cagaggtgggctggcttctgctcccgctcttaccaagtcctcttcgggttagggttacttagggttttgtggaggggcgatggcggcggctgatgtggagtaccgttgcttcgtcggcgggcttgcctgggccaccagcatcgagtcgctggagaatgccttcgccttctacggcgagatcctcgactccaaggtcatcaccgaccggtagacggggaggtctcgcggcttcggcttcgataccttctccttcgagaactccatgctcgacgctatcgagaacatgaacggcaaggagctcgacggccgtaacatcaccgttaaccagtcccagtcccgtgtcagtggcggtggcggcggttgctacggcagaggtcgcggcggcggctgcta

SEQ ID NO: 63273 - DNA, 336 bp, Zea mays
  Clone ID: LIB3075-046-Q1-K1-G7
gattctacgtgtggataacctggtcatcaccggcaagggaaacgctggacgggcagggcccagccgtgtggagcaagaactcctgcaccaagaagtacgactgcaagatccttcccaactcgctggtgatggacttcgtgaacaacggggaggcgtccggggtcacgctgctcaactccaagttcttccacatgaacatgtaccggtgcaaggacatgctgatcaaggacgtgaccgtgacggcgcccggcgacagccccaacacggatggcatccacatgggcgactcatccgggatcacgatcaccaacaccgtcattggcgtcggtgacgact

SEQ ID NO: 63274 - DNA, 451 bp, Zea mays
  Clone ID: LIB3075-046-Q1-K1-G8
gggctgcatccccaactacctggccgtgcttttgaagtatgtggcggacgacggcgacatcgtgctgatggaaatccaggacaagttgtcggctgagtggaagcccatgaagctctcttggggcgccatctggaggatggacactgccaaggcgctcaagggccccttctccatccgcctcaccagcgagtccgtcatgaaggtcatcgccaaagacgtcatcccggcgaactggagacccgatgccgtctacacttccaacgtccaattctactagactttgaattcccttcgattcatacggcacagcgggctatggaccttcagcagcaagctaattaagttggcagcatgcaccgctaaccttatatactactgagacttccaaattctagtatatgtaatccttttgttcgggttcatgatcgaattccatagagtggaaaacaag

SEQ ID NO: 63275 - DNA, 233 bp, Zea mays
  Clone ID: LIB3075-046-Q1-K1-G9
ggcaagatgacaaatattttgataatgtattttatcagcgagatcattctgataatggggagcagaaattaactaaagacacatgcatagctacatgccatacaggaattcatgtatcattgtacatgttgcctgagtatatcaccatgctaattgtagaagccattacacatcttttctaatcaataatgcatcttctaaaaccaacttctataactacattgcaggatcct

SEQ ID NO: 63276 - DNA, 362 bp, Zea mays
  unsure at all n locations
  Clone ID: LIB3075-046-Q1-K1-H1
tttctatggcaaaaaaatgcgagtacaatatgcaaaaacaaaatcagactgtattgcaaaagaagatggtacttatgcacctaaggagaaaaggaagaagcaagaggagaaagctgctgagaaaaaacgacgaacagaagaggcacaacaagctggcctcaatgctgctgctgcccaaagcaatggaactggctatcaagcgtctcgtctgggcaaggcctcacaggagccacctgcgccttcgaacaacatcctcttcatccagaatctgccagaccagaccacgagcatgatgctccagatcctgttccagcagtaccctggctcncgggaagtacggatgatcgaagcttaaccaggca

SEQ ID NO: 63277 - DNA, 342 bp, Zea mays
  Clone ID: LIB3075-046-Q1-K1-H12
atttcgagtaacacagttgagcacgacgatgggatccctcgctaataacatcatggtcgtgggcgccgtccttgcggcgcttgtcgtcggcgggtcgtgcgggcccccgaaggtgccgcccggccccaacatcaccaccaactacaacggcaagtggctcaccgccagggccacctggtacggtcagcccaacggtgccggcgctcctgacaacggcggtgcgtgcgggatcaagaacgtgaacctgccaccctacagcggcatgacggcgtgcggcaacgtccccatcttcaaagacggcaagggcttgggctcatgctacgaagtgagatgcaaggaaaa

SEQ ID NO: 63278 - DNA, 345 bp, Zea mays
  Clone ID: LIB3075-046-Q1-K1-F5
tcgacgagctgcaaggctcattgctaagtacaggcccagcatgcctgttctatctgttgtcatggctcgtctaaagacaaaccaactgaagtggagtttcacaggtgcttttgaggcaagacaatcactcatagttagaggcctcttccctatgcttgctgatccgcgacacccagctgaatctaccagtgctacaaatgagtctgtgttgaaggttgctcttgaccatggcaaagcctcgtgcgtgatcaagtcccacgaccgcgtcgtcgtttgccagatagtgggtgattcctctgaggtgaagatcattgagctggatgattagacactcaggctatgcta

SEQ ID NO: 63279 - DNA, 447 bp, Zea mays
  Clone ID: LIB3075-046-Q1-K1-H2
atttgaaataattgggaataaatagttcgtgaatccctgaagcgtgcatatatatattcctgccaagataaaggtaatggagtcgtcacgcaggttccagccggccgtcatcctgcttctcctgctcattgtgtccaccgatatggcacaggcaagggaatgcgagaagtacagtgagcgatttgttggggcatgcatgatcgcagacaactgcgccaatgtgtgccgcggtgagggcttcttggccggcaggtgcagcaccttccgccgtcgctgcatctgcactaggcagtgctaaacaagatcgctcgatcgctcgccatgcatcgacaacctattcttaataacgttcattatctccgtcttatttatgacgaatgtcatgtatgttctggtgactgtcatgtatattctgatgactgtcatgtatctcggtcatgtatgctc

SEQ ID NO: 63280 - DNA, 285 bp, Zea mays
  Clone ID: LIB3075-046-Q1-K1-H3
ctcgagatggacaccgtcagcgtccccgtggtggccgttgcgaatgggatcggggaggtggagcgcaaggtgcagaagagctactgggaggagcactccaagtgcctcactgtcgagtccatgatgctcgactcccgtgccgtcgacctcgacaaggaagagcgacccgagatcctgtctttgcttccctcttacaaagggaaatcagttctagaacttggtgctggaataggacgctttactggagatctggcaaaagaagctgggcacgttctggctctagac

SEQ ID NO: 63281 - DNA, 429 bp, Zea mays
  Clone ID: LIB3075-046-Q1-K1-E10
cccacgcgtccggtgcaagtatggatctaaggtcaccttccatttggagaagggatgcaaccgcaactacctggccctgttggtcaagtacgttgatggagatggtgacattgtggcggtggacatcaaggagaagggctctgacacctacgagcctctgaagcactcttggggcgccatctggaggaaggatagcgacaagccgatcaagggacccatcaccgtccgactcaccaccgagggaggcactaagactgtctacgacgacgtcatccccgccgaatggaagcccaacactgcctacaccacttgatagaccttttttatttttttattcaataaaaggatataaggtgtgtgacaacaacacaaatattggattatctatggatctcctatgccatcccaattttatcatggacacatttt

SEQ ID NO: 63282 - DNA, 381 bp, Zea mays
  Clone ID: LIB3075-046-Q1-K1-E11
agacactaaagtggggtctccaaaggttgaaagacttccctagaccattttggctagctctgtttgttgagggtactcgctttactccagcaaagcttctcgcagctcaggagtatgcggcttcccagggcttaccagctcctagaaatgtacttattccacgtaccaagggatttgtatctgccgtaagtattatgcgagattttgttccagccatttacgatacaactgtaatagttcctaaagattcccctcaaccaacaatgctgcggattttgaaagggcaatcatcagtgatacatgtccgcatgaaacgtcatgcaatgagtgagatgccaaaatcagatgatggacgttcaaaatggggtaaagacctttttg

SEQ ID NO: 63283 - DNA, 303 bp, Zea mays
  Clone ID: LIB3075-046-Q1-K1-E12
cagctcctcgttttttctctctcctctcttcgtccccgcgtggagaaggagagagagaaacgggggagcgccccccactcctcttcgctgccaagaaaccaccattcctaacggatttctacccagtcttctttaggatttccgattcggttctccggtgagagggtgggaattttattttcctccgctgcaaccggtgcaaacatttcgaattccttcattccattccttttcgtgcaatcgaacattcatatgtttcttggctggattgaggcatccgtacccgaattttgatgtgagctg

SEQ ID NO: 63284 - DNA, 309 bp, Zea mays
  Clone ID: LIB3075-046-Q1-K1-E2
atcgatcacgacaagatggcgtgcacagacaatgcgatgagagccttgttcctcctggtcctcttctgcatcgtgcatggtgagaaggaagagtcaaagggcatcgatgcgaaagcgtccggtcctggtgggttcttcgacatcaccaagttgggcgccttcggcaatggcaagacagacagcacgaaggctgtgcaggaggcatgggcatcggcgtgcggcggcactgggaagcagacaatcctcatacccaagggcgacttccttgtcggacaactcaaacttacaggccctttgaagggcgacgtg

SEQ ID NO: 63285 - DNA, 182 bp, Zea mays
  Clone ID: LIB3075-046-Q1-K1-E3
gtatatccctgctgccatgcatcacaatcggtacaactcatgtgttatctgtgtgtgcctagccgatggccgatgttcatgttcgtataaagtgaacgaaacactacccgtgtcacgggacctgctgatgaacaagaaggttacgctgttcacacactggtcagtctatgaggctaccttgt

SEQ ID NO: 63286 - DNA, 375 bp, Zea mays
  Clone ID: LIB3075-046-Q1-K1-E4
cagagggttggtgtcaggtggcgtcgccggccggccgtcgtggaacagggaaccgcgtgtggaggacgaggattccctctgtagcactgcactgcactgcactgcaagttgttgtacacaagtgcatgtgtatgtgtagtagtccggcctccgggcgggaggcgccgaccccatccgatggcgacggtggcgtccttttcggatgctgagctcgccgacgctgagcctgagcgtctacgccttcatgtgaatgaaggagagctgtggccaacgattagcccaccacacaatggagaccggagaggtgaccaaccgtgtccaatccgtgaacggccggcacgggattgaagtgaacgggcgggcgggcgaaaaagc

SEQ ID NO: 63287 - DNA, 325 bp, Zea mays
  Clone ID: LIB3075-046-Q1-K1-E5
gcgtcgccgcgccatgacgatgacgatagccgccgtgctctgcctgctcctcttctctggccgtctcgccgcggcggagaagactttccgcggaggtggaggcggaggctacggcgggttggaggccggtggcggaggcggcggcggctattccaccccgagcgaggcggcgccatccacgcctgccgctggggagacgactaccccttcgtcaggcggcggttactccactcctagcgtggcggcgccatccacgcctgccgctgaggagacgacgacgactccttcgtcaggcggcgggggttacggcggtgcaaccggcaag

SEQ ID NO: 63288 - DNA, 344 bp, Zea mays
  Clone ID: LIB3075-046-Q1-K1-E7
cccactcgtccgatcaaataaacaagcgcactcgaacaaatacctcgccgccaataatggcctccagatcctccattgtgctcgccacggcgatgctagctacactattcgcggttggtttgtgcaccaccccgctcaccttccaggtcggtaagggatccaagcctggccacctgatcctcaccccgaacgttgccaccatatccgacgtggagatcaaagagcatggtggcgatgacttctcctttacgctgaaggagggcccgaccggcacctggacactcgacaccaaggccccgctcaagtaccccctttgcatccgctttgctgtcaagtctggtggc

SEQ ID NO: 63289 - DNA, 320 bp, Zea mays
  Clone ID: LIB3075-046-Q1-K1-E9
cggacgcgtgggtacaaaaataaggaccctgatcatgtggagtgggcaaaagccctaaaagagctgtacattcccaatttacgtgactacgtgaagaggtattacccattgggtcctgtgtggcaaccgccaggaagcgcagccaacaaggcaccttcagctccgtctgttcctcctccatgtctttccatctcttcagcctcgtcgtcccaaccaaaatctggaatgtcagctgtctttgctgaaatcagctctgggaaaccagtgacacaaggcctcaagaaggtaactgatgacatgaagagcaaaaatagaacaga

SEQ ID NO: 63290 - DNA, 446 bp, Zea mays
  unsure at all n locations
  Clone ID: LIB3075-046-Q1-K1-F1
aaagccacaacacatacaggaaaagcaagcatgaatcatcggaataatggctcgtgcatgtgtgttcctcgtcgtgctcctcctggccgccatcgcggtggcaccgttcgcgggcgccgcacgcgtggacgtcgtggagggtaggtccatggcatccgccgatgcaccggaggcggcggccgatgctcccgctcctagccccgactccgcctcatccccagactcatcgtcagaggcgcccttcagcagcagctcctccgactagacgcaaaaacctcttcattctctggaataactaacagtatatacgttgcaccctgatgatatagaaacatgtacgtgcatcagtgtatggaatgcgagtggcaaacacatggaatgtgcttgcctaantattgttaaattcttaattaatatatgtctttttcggtggtttttaattttcc

SEQ ID NO: 63291 - DNA, 179 bp, Zea mays
  Clone ID: LIB3075-046-Q1-K1-F10
cggacgcttgggaactaaatccactcatgttctaggaaagagggacacaggagggatggagccccggtctccacgcctccacaaccatccttcccgatcccgaccagctttgaatatcctatggcggacggccgttgttgcaccttcgtggatacccttttccaaaatacccccccccc

SEQ ID NO: 63292 - DNA, 293 bp, Zea mays
  Clone ID: LIB3075-046-Q1-K1-F11
gggagtgaacatggaaacagctcaattcttctaacgtgattttgaagagaatggttccgtggggcgggtcaccctttttctgaatctggctaacgaccccaccattgaacgtattatcacccctcggattgctctaacaacagcggaatatttggcatatgaatgtgggaagcatgtactcgttatcttgacagatatgagctcttatgcagatgcacttcgtgaggtttctgcagcccgagaagaagcgccatgtacgcgtggctatcctggatatatgtatactgatttgg

SEQ ID NO: 63293 - DNA, 440 bp, Zea mays
  Clone ID: LIB3075-046-Q1-K1-F12
gatgtatttgtggttgctgaacccggagatcttgcagacagatttctgcaatctgtcagaagtagtttgtcaaccttgttgcgtgggcgtaatagaaagggtgcatattccttgtccaagatttcatgtttatctgagctggttgctgagtgtccatcttttgaaatcggtgggatacaccaccgctatataggtcgacaaacacaagtaggaattgctttttctggctccttgtttccaactaggtcattattttgcatacttaattatccttttttcgtaggtaatggaagataaccaagaaattggcgcatatatgtttaggaggacagtgcctgctgttcacatggcacctgaagatgttcgatggatggtaggtcaatttgcgcagcatgaatgcattggtcttcataattatgttaaagccataactgatcaca

SEQ ID NO: 63294 - DNA, 454 bp, Zea mays
  Clone ID: LIB3075-046-Q1-K1-F2
cggacgcgtgggcagctggtaaatcaacaaaatgcaccagtttcagtttctaatacaggtatagcaagagcaagtttctgctgcagcactcttaataagaatgcatcgttgtctgatggtgatagctcgcacaataggcgctgggacacaattcggtctggtcatattgtttcctctcattcttcagatagcactatgctatcaagaccagccagtgcagtatcatccactgatgtggcatctctgcatagaaaggaaaggagacaagcttgtcctcctggatttgagaagcctcatctgtactccggttcaggcaaagcttgctctggacattgctctgcacctgatgccctggtacaagattgtggtattccagatcaacaagaccttactagcttgactacagattgcctgaaagatgatggagatgtcacacaaaatctaagcatgaaca

SEQ ID NO: 63295 - DNA, 441 bp, Zea mays
  Clone ID: LIB3075-046-Q1-K1-F3
aggtctcaaattaaatggcctcctcgtcctcctccttgctgctggcgtcgatggcggtggcggcactctttgtcgtcggctcgtgtggcggcgcgctcaccttcacgatcggcaaggactccagctccaccaaactatccctcgtcactaacgttgccatctccgaggtgtcggtcaaggagaagggcgccctggactggtcggatgatctcaaggagtcgccagccaaaaccttcaccctcgatagcaaggagccgattaagggccccatctccgtccgcttcgctgtgaaaggtggtggctaccgcgtcgtcgatgacgtcatccctgccgacttcaagcctggctctgtttaccagacaggcgaacaaatctgagtaatggattctgctgcgtgcagattatattgatctctaaaataaatgttgacagagactaatt

SEQ ID NO: 63296 - DNA, 413 bp, Zea mays
  Clone ID: LIB3075-046-Q1-K1-F4
cacagccagtgagcccacagccgtcgccgcctccatcagtgaaatctccacccgcacccgggccagctccagcaccagcacctattagctcgcctgccccacttatcaaatctcctcctccaccggttccggttagctcaccaccaccactactaaaatcgcctccacctccagtatctatgagtttaccacctccatctgtgaaatctccaccgccgttgccaccaaggtcacctccagcgccagtgaaatcaccacctgctgcaccaccagtaagttcgccgccaccaccagtaccggtgaggtcaccaccaccgtcaccaccatcaccgattagttcaccaccgccatcgatgaaatctccacccccaccagcacctattagctcgcctaccccacctaccaaattccct

SEQ ID NO: 63297 - DNA, 388 bp, Zea mays
  Clone ID: LIB3075-046-Q1-K1-E1
actgcattgtggatttttggtgccgttgatcgagccacgcgtgcttgaggcttgagcagttgaacacgcggggacgcaggcggcaggctagcgcacacccgcgccgtcgcgacgtgacccggcgatggggtgcgcaacctccaccgaggcgcgccgcgacatggtgcggaccggcgccggcgcccccccgcgccggagcttctcgctaccctctgtcgaccgccagcggctgcggctgaagaccgtgtcgatgctcggcaacctcggcctcgccggcagcagcgcccgtcactccagctcgtgcaggcacgcgacgctgtcggtggaggatttgatgaagagcgacaacgaccatgccgcggacgcggtgctcctcggcgacgacgcg

SEQ ID NO: 63298 - DNA, 464 bp, Zea mays
  Clone ID: LIB3075-010-Q1-K1-E3
cggacgcgtgggtgaagcaaagctgaactgcatgtcatgacagacattagtggtgcaagagtctgctcatcttaaagctgtactggacaacccgcagttccagcttgacccattcgctgcgatccatcagcacctgctggcaacgcagccgcctgcagctgcaaagaagggacgacgcagcgggaagcaggggaaggtttccaaggacaagaaaagccaggaggaagaagggcacatcgtcaatctctcaggcaatggatatctgattgtgttccttcagtactagtaacttggtccgatgtcgactgcccgtgttccactagagggagctcatcgaagttcgatatcgatggttggcatagtttgagtaccagtagaggtagtactgtaccagccctcgcttttggcagcctgttgattgatgtttgcagaatcggtgccatcaacatttggtgctactttgg

SEQ ID NO: 63299 - DNA, 344 bp, Zea mays
  Clone ID: LIB3075-010-Q1-K1-E4
gtcgtggctctcctccacgctcggcggcaccttcacctgcgaggacgcctgcaaggacctgcccaagaccagcgacaaggacgacgtcgtcaacttcagcctcgacttcgagaagctgcagcgcgtcacgctcgacctcatcaccgaggcgtccggcaccatgtccgcaggcatcgccctgccaccctccaacgccggagcgccctcctacggcgcggcggcgccttccgggggctccgccgatgcccccgccggcgcctccgagggccctgcgagcgccagcggcccgtctggtgacgacgcgccggcgtccggtgctggtgccagcgcgtcggctgctgatg

SEQ ID NO: 63300 - DNA, 455 bp, Zea mays
  Clone ID: LIB3075-010-Q1-K1-E5
cgaataataacctagctctgcacaccgtccagccaccagtggcagcaggagcaggggtcggaacaagatggtggtgacggcggccggcagcgcggaggaggctgtgcggcggtgggtggacgccgccggaggacgcctcgtcctcgacggcgggctggccacggagctcgaggccaacggcgccgacctcaacgacccgctctggagcgctaagtgcctcctctcctccccgcacctcatccgcaaggtccacatggactatctggaagctggcgcaaacattataatcacagcatcgtatcaggccactattcaagggtttgaatcaaagggtttttcaaaagaacagagtgaaaacttactaacaaagagtgtcgagattgcactggaagctcgtgagatgttcttgaaggaacatctggagaagtccactcctatacagcacccggttctgg

SEQ ID NO: 63301 - DNA, 462 bp, Zea mays
  Clone ID: LIB3075-010-Q1-K1-E6
cccactcgtgcgcttacacagactgtgagtacatcacggagatcgcggttgcctgttgcaaggcatgatcataatcatgacatcatattgagatgcatcaaataaaatctaggatatatggatggcaaaccagctgcagcatgtatcatttacaaatgtctattgcactgacgtgcttttgaatcagagcgaactgctatttttgatcacgagattgatgccatacatgatgtcctaatgcagaacgaagctactgatatattacctgattgggcgtccaatacctctgcatcgctatgcctggtccatagaaatgtgagatcaaatggatcattcactaccgcgcttcgtcgttatgctggagctctagggaacatagcacaaacattgacgactacttcaaagttaataggccgcagtgatactataccacatgttgatgcacggtatccagtcatacta

SEQ ID NO: 63302 - DNA, 459 bp, Zea mays
  Clone ID: LIB3075-010-Q1-K1-E7
cccacgcgtccgcccacgcgtccgcccacgcgtccgggcggaccaggctaaccaacccactggccttcataagctcggtggccagttccacctgcgctcgatcatctctgaaggtgtacgggcccgtaacatatgcccatctgtctcatcttatgaaaggagatttgccacaaggaactacatgacccagagcctttggggcccttcaatgtctgttagcggtggcatcaatgtcccagtgatgcagaccccgctctgtgctaatgctcctgctgagaaaggaggcaagaacttcatgattgatttcatgatgggcggtgtttcagctgctgtttcaaagactgctgctgctcccatcgagcgtgtgaagctgcttattcagaaccaagatgagatgattaagtctggtaggctatcagagccgtacaagggtatggttgactgcttcaaacgtaccat

SEQ ID NO: 63303 - DNA, 295 bp, Zea mays
  Clone ID: LIB3075-010-Q1-K1-E9
cacaacgcgaatgtgcaaacctactactagcattaagatgagcagcaaactcacagtttaatggatcgagctattaaggagcatggtgtacaagctgcaccttaccaagcaggtgtccatttcaaccaacatctgcttgcattctcaggagctatagcccgacctcgtcttccacttctgccaacccctgacatgcctcatgggtttgctcaagcacctggcgcaccattgctgccaggaattaggcccccgattttaccagctccaggctatactgatgctccaccaaccatgc

SEQ ID NO: 63304 - DNA, 374 bp, Zea mays
  unsure at all n locations
  Clone ID: LIB3075-010-Q1-K1-F1
gtaagggtaaggtggccaaggataccgtgtccgagtcacctgctccaagccccgcccccgtctgcggcccttagttgcgtggtgggcgccgcttgccgccggcccccggccaccatgcgtcgtgtctgcgcgcgcacgcacgcattgaacgggagatagaatatggtatcgttcaatgcagattgccatgctatagctccagagtttatctacctggtagcaccatgacacgatggcccgttcgtattttctggcttgctcgtacttttcagttccatggttttacaacaccttttacttccagcagaaaatacataatatgcatgtactcctctttttttccgtatagtaatataaacaaattttcacannaa

SEQ ID NO: 63305 - DNA, 371 bp, Zea mays
  Clone ID: LIB3075-010-Q1-K1-F10
cacacacacgtacaaaccgagagcacacaccgtcccccgtccgcccgccgccgcgacacgcgcgccatggccatgctggctcgctccgccgcgcacctcttcttcttccttctcctcgtctccaccgcgcccgccgtgcggaccatccccgacgaagcccgcggccccggaaacaacatccacgaggcgtgcagcaagacgctgttccccaaggtgtgcctgcacgcgctcaaggacaaccccgagtgccaggcgggggcggtcacgccgcgccggctggccgagctgctcgtgtacgtgtcggccgacgtgggcatgaccgtggccgcgttcgcgcaccacgagctcaactccatcaaagacgacgtcct

SEQ ID NO: 63306 - DNA, 356 bp, Zea mays
  Clone ID: LIB3075-010-Q1-K1-F11
caacctcttctcccctgtttcctctcgtgcgttctccgcaggagcgaggagggctcgcggcagcggcagggtctccggtgtttttgttccagaatctgtagcacatggctgacggcgaggacatccagccccttgtttgtgacaatggaactggcatggtcaaggctggttttgctggtgacgatgcgccaagggctgttttcccaagcattgttggacgcccacgtcacactggcgtgatggttggcatggggcagaaggatgcgtatgttggcgatgaggctcagtccaagaggggtatcctgactttgaagtacccgatcgaacatggcattgtcaacaactgggatgatatg

SEQ ID NO: 63307 - DNA, 405 bp, Zea mays
  Clone ID: LIB3075-010-Q1-K1-F12
ccttcatcgtctccaacaacatcgtgtcaggcctcaagtacaccaacactgtctggaaaacgggagtcgaagtggagacccagaagatgatgctggggacgttcagcccccagctagagccctatgtctacgagggcgaagaagagaccacccctgctggcatttttgcgagaggttcttattctgccaaactaaagtttgttgatgatgatggcaagtgcttactggagatgagttactactttgagattagaaaggagtggccaggaactcaatgatgtgtggaccagcatggctgactcgtcggagtatgttagagctcatagctaagccaagcacaagatgtggactcatcttcaagaatgattttcattcgctacttcatctttaaatcgcatttaaatt

SEQ ID NO: 63308 - DNA, 462 bp, Zea mays
  unsure at all n locations
  Clone ID: LIB3075-010-Q1-K1-F2
cggacgcgtgggccctgaccgtgactcggtcatttcgcgctataaagcgaaaagggagacaagaagatttgcaggcaagtccggtatgagtcgcgcaaagttcgtgctgatggcaggctcaagatcaaggggcgttttgcaaaggcaaaccagacatgaacctaaatctgcagttctgcactatcctaagcatctttcctcaagaaatatgctaagtatcttccaacacgaagaagaaaactggtcaggggcgatgataatgcaaaaatgtgccagaattttgtttgccttcagttcaatagctgataaccatagctccatatacagntgaattgaatgacgtgtgtatatattgctgtcatgtgactagtagctacattgctttgagagatcaaaacctgtatatgcacctacacatgtgattttgccatgacggacataataatagaaccactgcgtttg

SEQ ID NO: 63309 - DNA, 153 bp, Zea mays
  Clone ID: LIB3075-010-Q1-K1-F3
aggtgaaccagcagcctacaataaaagccagcttatttgctttaaagcgagagacctcagacgtgaggcgagccgaccgccgacgtaccaccgcgccaacgtgcgagaaagatggagatgatcaagaggatcctcatcggcgtgctcctcgta

SEQ ID NO: 63310 - DNA, 472 bp, Zea mays
  unsure at all n locations
  Clone ID: LIB3075-010-Q1-K1-F4
gcgctatttgcttccttcactggtgcaacctgtgctagatgctcctcctagagatgaaatcaaaatatgtggtgaaggaaatactaaaggtgtttttgttaaagagaatgatgttgctaaatttacaatatgcaccatagaggatcccagaacattgaacaagacgttgtatctgagacctccaggaaatgtcttctcaatgaatgaattggctgacctctgggagtcaaaactcaagaaatccctgaaaaggttatatgcaacagaagagcaacttcttaaagaaatccatgatgctccattntccttgaagatggatttaatctttatatattcagcgtttgttaagggtgaccacacgtattttgaaattgacttgtcaatggaaggaactcaactgtattcccatgtaaattatacaacagtgaacgagtacttggatactctagtttaggatatttgntcgggttat

SEQ ID NO: 63311 - DNA, 372 bp, Zea mays
  Clone ID: LIB3075-010-Q1-K1-F5
gggagagatagtcctctcacaatttagccttgacaactcctggaacagagctatgattgttaatggacctcgctctgtagaatctctaaacgacaagtttgaagtattctatattgactatggcaaccaagaggtggttccctacagtcgtctacgacccgtggacccatctgtttcctcttctcctgctcttgctcagttatgcagccttgctttcataaaagtgcccagtcttgaggatgactttggtcaggaagcagcagagtatctaagtgaatgtttgctcagtagctcaaagcaatatcgggcaatgattgaagaacgtgatgcttctgggggaaaatcaaagggacaaggaacccggaatgttct

SEQ ID NO: 63312 - DNA, 459 bp, Zea mays
  Clone ID: LIB3075-010-Q1-K1-F6
aggaggcaaagccgccgatcttgtgctgtggaggaacaaacaggcatccgggagcatcttggcaggggtgactgtgatctggctgctgtttgagggcatcggctaccacctcctcaccttcctctgccacgcactgattgtgtttctcaccgtctggttcgtctggtctaatgttgcgtcctttgtcaacaggtctcctccaaagtttccagaggtgattctatctgaagcccaatgcctgaaggtagctcatattgcaaggaaagaaatcaacgaggctttctatacattgcgcaatgtcgcttctggaaaagatttgaaaacgtatctgatgtcaattgcagtgctttggttcatttcgataattggaagctgcttcagcttcttgactgtgtcttacactattattttgcagttttcctgatggcatacactctgccaatgttatatgaaaaatac

SEQ ID NO: 63313 - DNA, 360 bp, Zea mays
  unsure at all n locations
  Clone ID: LIB3075-010-Q1-K1-E2
gcagcgcggcactcgctcgtctgcccattgccttggcgtgtcgacccaaattggtcccggccggggcatcaccctggcgtaacccaagctcgccttgtcggcgtgggcgccttcatgggcggccgggctgaaccctggctctgtgaggatagcagtcgctcctgctgaattttgcacatcatcaccgtcagcatcggcatcgtcatcaccatcaccacagctctgcacttccccaaactggaccatcgatgtctcggacgtncgaactatcaaggtgaaccaacgtgcctctctcggcgaccgccggggaacatgaaggagttcttctccttctacggcgagatcgagtacgtcgagatg

SEQ ID NO: 63314 - DNA, 360 bp, Zea mays
  unsure at all n locations
  Clone ID: LIB3075-010-Q1-K1-D1
gcagattacagacttgccgttctctctctattcaacttttggtataaaagctcgaccttggtttaaccagccaactatattggtcctcaataaggatatgatcaaaggaatttactatccatgatattggggccaccaatcgtggctgctatcatctacatagtacagattggaggaccttaacctggctatatatctctggcgttntatgtttgtattagctctactgatgatgacaatataccccattgtgatagctcctctgttcaacaagttcactcctcttcctgaaggagtcctcanggaaaaaatagagaagctggcagcttccctcaagtttcctttgaaaaagcttttcgt

SEQ ID NO: 63315 - DNA, 418 bp, Zea mays
  Clone ID: LIB3075-010-Q1-K1-D10
ggcagtaccagcagcgcccggcctttagcttactacaccgaagccgctgatcctccgggggtgaccagagcagatcttgaacctgctccaagagacggtggcagggaaagccaggaaaggcgccgctccttctcgtttctgtggccgtttggcccgtcgagttccagatccacttcttaccagtacgaacagaatgttgatgagcctgcagtatacgatccaaaccatatagcatattctgagtggcactatgaccactgactgaaaccctgcagcaagtgcacgctatctgcaattcgtgccttcaaccctcagctttggagaggcattcatcatctgtcatggctgcttggcgcagtaaacaaggatggttcttgcctgtgatactgggcttactgcatatccgtgctccgtatgt

SEQ ID NO: 63316 - DNA, 344 bp, Zea mays
  Clone ID: LIB3075-010-Q1-K1-D11
gtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggtgacttccttgtcggacaactcaacttcacaggcccttgcaagggcgacgtgaccatccaggtggatggcaatctgctggcgaccacggacctaagccagtacaaggaccatggtaattggatcgagattctacgtgtggataacctgggcatcaccggcaagggaaaccttgacgggc

SEQ ID NO: 63317 - DNA, 427 bp, Zea mays
  Clone ID: LIB3075-010-Q1-K1-D12
acggcggtctactgataacacatgaatgaaatacctgtcactggtcagtcacttacattttgatgtgccagaaatattcaagtatctaaacaaggtggtcgtgttggatgacgatgtaagtgttcaacgtgatctgactttcttgtggaatattgatatgggagacaaggtaaatggcgctgtcgaactttgaggtctgaaactgggtgagatgaaaaatgtcttgggtaaaacagcatatgatccaaagtcgtgtgcgtggatgacgggggtgaatttgattaatctggattaatggagggagcataatgtcacagagaactatctgcggctcatgaaaaagttcgaagtcaaggatgagctgtgcctgctagcagcagcattttcctctaagcttgctatccttgcaacatttaatattccccct

SEQ ID NO: 63318 - DNA, 311 bp, Zea mays
  Clone ID: LIB3075-010-Q1-K1-D2
gcagatgtacagacttgccgttttctctctattctacttttcctatagaggctcgacatggtttgaacgagcaaactatatggctcttcattagggatatgatcaaaggaattttactatccatgatattggggccaccaatcgtggctgctatcatctacatagtacagattggaggaccttacctggctatatatctctgaggttttatgtttgtattatctctactgatgatgacaatataccccattgtgataactcctctgttcaacaagttcactcctctttctgaaagaatcctcagggaaaaa

SEQ ID NO: 63319 - DNA, 453 bp, Zea mays
  unsure at all n locations
  Clone ID: LIB3075-010-Q1-K1-D3
gtattcttatacctgcttctaacatctcatttcattccaggtattttctctgaccttgtctgaagctcacaggtggcaatagatatacatgtgggtttttcacaggcttgtaacaaatcggagtttgcattggctgtggagtgtaactgacaagatgcagagctcttcaaatatcttgttacttttttcagcanatagaaatttaacctttgtgttttatctgtttctgtttgcttacagagttcactgatgttgattaacattgctagcatgccttaagttttgaaattggttggttggtgtagtcttggtattagttggtggtagtaggttttgatacattttatttctttccactctttagagaaagttttgcatttgcaaaatcttctcattcagtggaagctccaagcaatatacatatacanattacacaaggtccttncatatgaa

SEQ ID NO: 63320 - DNA, 288 bp, Zea mays
  Clone ID: LIB3075-010-Q1-K1-D4
tttaaagaactcctttataaaaaccagatgcttcaagcccttagaatgcctaaaacgaggtaaaagaagagaaaaacacttggtcatcagaagaccacattgcgacatcagaggatattctcaataccaatttgccatgcacaactatgacagaatgtgggaaatatctttacatgagaggtcttccgtagtccatacagtacccgtgtatatggactggcatgcattacatgggacaagcgatacacacaagtgttatgtcacgatgctcgtggcctaagcaacctc

SEQ ID NO: 63321 - DNA, 247 bp, Zea mays
  Clone ID: LIB3075-010-Q1-K1-D5
ggcgatgctggttgcgctgtttgcggttggtttgtgcaccaccccgctcaccttccaggttggcaagggatccaagcctggccacctgatcctcacccccaatgttgcaaccatatctgacgtggagatcaaagagcacgggggcgatgacttctcctttacgctcaaggagggcccgaccggcacctggacgctcgacaccaaggccccgctcaagtaccccctttgcatccgctttgctgtcaag

SEQ ID NO: 63322 - DNA, 337 bp, Zea mays
  unsure at all n locations
  Clone ID: LIB3075-010-Q1-K1-D6
cgagaggagaaccagcagcctccaataagagccagccagagaaactaataaaactctcgccggcgccatccgagcgaacaagccaaccgaccccgtccccaaggcaatccgccgccgacgtaccaccaccaccgcaggagcgagatggagatgaagaggatcctcttcgccgtcctcgtcgtcatcgccgcctcggccaccgcagtgctggcctccaccgaggccgccgccgcgggcgccccaactgcctccgagtcgtccgccgaggctcccgctggcgctggcgctggcgctgccgctggcgccgncgcctcggggccctccgccagcagcggcg

SEQ ID NO: 63323 - DNA, 462 bp, Zea mays
  Clone ID: LIB3075-010-Q1-K1-D7
gaagaagatcgcctgcgccgtcctcatcgccgtctcggccaccgtggcgctggccgcggaggcgccggctccgtctcccaccagcggctcctccgcggtcgcacccgccatcgtcggggccgccgtggcctccttcttcgcgtactacattcactgagccgccggacgaggagccggagccggagggaagagaccaaggtggggggagagacttggctgcgctgcgctgctctgctgctcccgcgcattcccgatgcgtgggcgtgctctgattgggcacggcggtggcagtggcacaccttcgtcttccttttgtttgtttttttttccttcctctttctacttgattttcatttaacgaattggtatcgctgatgcaccagtttaatttggtgccctgttatttgttctttccctcgagtgagggatcgacacctgtaccattgcttgccatttgtctgg

SEQ ID NO: 63324 - DNA, 470 bp, Zea mays
  unsure at all n locations
  Clone ID: LIB3075-010-Q1-K1-D8
gctgccgcagagactgggcgacggaccggcagcgcctggcccgttgcgccagaggcttcgggcacgcgaccaccggcggcctcggcggcaagatctacgtggtgaccgaccccaccgacctcgacgtggtgaacccgcgccccggcacgctgcgctggggcgtcatccagcccggcccgctgtggatcatcttcgcgcggtccatgatcatccagctctcgcaggagctgctcatgagcagcgacaagaccatcgacgggcgcggcgcgcaggtgcacatcgccaacggcgccgggatcacggtgcagctggcgcaaaacgtcatcatccacaacctgcacgtgcacgacgtcaagcacaccatgggcggcctcatgcgcgactcccccacgcacatcggctcccgcaccagggccgacggcgacggcatctccctcttctccgncaccaacgtctggatcgaccacatc

SEQ ID NO: 63325 - DNA, 329 bp, Zea mays
  Clone ID: LIB3075-010-Q1-K1-D9
acgcaggcaagggcgcaaccaataatagcaagtgtgatcattcgttgatccatcttgctaataacgctgcgtgcccttcgttctcgtctcgagcccgacgacgctcccttcggcttcggcaaaccacatcaagtcgcgatggagatgaagaaggtcgcctgcgccgtgctcgtcgacgccgcctacgtcaccgtggtcctcgccgacgaggccccggcgcccgtgcccaccagcgccttctcggctgcgttcccggtcgtcggcgccgtgctgagcgcctacgtgctctccttcttaggctactacctgcagtaaaattcatggacgat

SEQ ID NO: 63326 - DNA, 414 bp, Zea mays
  unsure at all n locations
  Clone ID: LIB3075-010-Q1-K1-E1
cggacgcgtgggcacaaaagcaaaaagcatcatcacaataatggcccgcgcgtgtgtgttcctcgtggtgctcctcctggccgccgtcgccgtggcgccggttgcgggggcttcgcgtgtggatgtcgtggaaggcaagtccatggcgtccgccgacgcgcctgaggcgggggctgacgcgcccgctcccggtcccgactccgnctcatccncggactcgccgtcggaggcgccctccagcagcagctcatccgactagccgcgcacaacgcagttcttgtcatgatctatctagcacataaaaagatcatatgtctcgtttgattctctggaataactaatagtatatatgctgcgcccggatgatatataaatatgtgcatcaaatgcgtgcggcaaacgcatggaatgtgc

SEQ ID NO: 63327 - DNA, 424 bp, Zea mays
  Clone ID: LIB3075-010-Q1-K1-E10
ctggagacgcgcacggacggcttctttttcgttgtcaactccaacatgctcttcacgttcctgatcgcgcatgcgttcctgtccatgatgtgctccatgcgcaccttcatcttcttcttcttcgacgcctgcatcggggtcatggccatcttcgtactcacgctgctggcggagaccaaaggcgtgtccatcaactagatggtggaccgggtctggcgccgccattggttcttgaagacgtgcttcgccgacgactactacgcggccagggtctacgacaactgctagtgctaggcacgcgcgccgccggggattagtttttttgtcattggaaatagaaaatcggcctgatttattggattttcgtgctatgacctttaaattgatgtctgggcaattaacaggcaaaactattttgtatatg

SEQ ID NO: 63328 - DNA, 474 bp, Zea mays
  Clone ID: LIB3075-010-Q1-K1-E11
acgccacgcgtacgtacacgcgtccgatatacagtagctcgtcagacactccaaggctacaagcgacatgtgtgggcagcaaaggcccatgcgagaacgacgccaatcaaacgagacaagcatagacctactgtccaaagtgtgctaatgcgatcagggtcctgagcgacagacatgactagtaaacgcactgctagagtgaaacatcttttaatggatccagccaacagcgagtacatcttccccctgaaccttttcaggggagcacaaggctactttacacatgtcagaactcttcatctgggatatgactgtctggacacaacctagactgaattcatgaactatgcaaatcttaagaagctcactctgcacaagatttcctttttgggagacctacagtgcctgatgctgccagaatgcaattcatctgagtgtctgagcatcagcatctggtccttgcctggcttaagc

SEQ ID NO: 63329 - DNA, 379 bp, Zea mays
  Clone ID: LIB3075-010-Q1-K1-E12
gttcgagccacgacgtacgcgcttcgcatggagacacgcgatcccggataggttcactgctgctgctgaggcatgctccagaagaaatgcaggctctgggcgccctgcacatcattgcactcattccacgcacaaaagctttgcatattcctttctaacgcgcaacgatgcacatgccgactcatcagataaaacgcgcatctcgtgccggtgagggagctcgtcaaaaatgcccgcagctgcgtccacccgtgcgacctcttcaggggactgcagtgaccataacacgcggtgggtctccggcagaagtggcagcagtgggcgcccgttcctcgcgcagaggctccaccagtcgggaggcgccgagaacagcatgtcg

SEQ ID NO: 63330 - DNA, 390 bp, Zea mays
  Clone ID: LIB3075-010-Q1-K1-C9
tcgagcgacgcgtacgcacccagtaactagatccatcatctagagcgctaccgttcatggaccactatattccggagcgacgaagtgagacaaacagtagtacatggcatgaagaacgtccattgcgccgccctcgtcgccgacgtctgggccatcggctcactggactcagtggcttctgatgagccctgcaacgcactcgccggaccggccggcattcttcttggtcctagcgtaagcggctacaccgtaacgctgccgcccaatgacgactcgctctggcgctgttgttagagtacggacctcaatgatctatcaagctctcagctgtaatctattgaagtctctgatgtagctgaacctactaatgaatcctgacatcatgctaca

SEQ ID NO: 63331 - DNA, 345 bp, Zea mays
  Clone ID: LIB3075-010-Q1-K1-B6
cggacgcgtgggcggacgcgtgggtgcaaacaccagttttctaccctaaacacaagaacccagatgcataataaaaggtgaaagctagcagaagaggtacctaactctaccctactatagagaaaaagtcagcacattgcaagcaataataatggagacgacgacgaagctccggtggagccggcccggctccttcctcctcgtcgccgcggcgttcctggcgtccgccgccgcgtcgggcgtcaacgtcggccagttcgacgaccacttgcagaagcggaaggagctcgccgaggcgtcggcgagggaggcgtacaggcccgacccgtacaacgtcaccaacag

SEQ ID NO: 63332 - DNA, 459 bp, Zea mays
  unsure at all n locations
  Clone ID: LIB3075-010-Q1-K1-B7
cacaaaagcaaaaagcatcatcacaataatggcccgcgcgtgtgtgttcctcgtggtgctcctcctggccgccgtcgcggtggcgccgtttgcgggggctgcgcgtgtggatgtcgtggagggcaggtccatggcgtccgccgacgcgcctgaggcggcggctgacgcgcccgctcccggtcccgactccgcctcatccccggactcgccgtcggaggcgccctccagcagcagctcatccgactagccgcgcacaacgcagttcttgtcatgatctatctagcaaataaaaagatcatatgtctcgtttgattctctggaataactaatagtatatatgctgcgcccggatgatatataaatatgtgcatcaaatgcgtgcggcaaacgcatggaatgtgcttgcctagctagctaatnngttgtntttttttctttacttttcttcatacctgtctc

SEQ ID NO: 63333 - DNA, 461 bp, Zea mays
  Clone ID: LIB3075-010-Q1-K1-B8
agatggttggttggagccatgctgactctattgttactgggcaaagcaaagaagcactccagtacaatggcatgatcgatgcattcaggaagactgttcgtcatgaaggagttggtgctctgtacaagggtcttgtgccgaactcagtcaaggtggtgccctcaattgccattgcatttgtgacttacgaggttgtgaaggatgtgctaggagtagagatgaggatatcagactgaggatggtcgttttcaactgctatttttgtaggctttgggaagttgtgtttttttgtaggcagggcgggtagaaggatatgaccgcggctccattcagcatcagcccatgttggatatatcatatatcctgccactggcttcaggtcctagaattgtttgctgggtcgtgcaaaaagtaataagtcggctgtaaagcttattaagcatctgcctaactcatcaaaa

SEQ ID NO: 63334 - DNA, 468 bp, Zea mays
  Clone ID: LIB3075-010-Q1-K1-B9
cttcctcgctggcccataaatatatatctatctatcgccatcgagcaattataatctcacagagtaatgaacatcatggggcaagcctcacggctcgtcctactcgccgtcgtggcgctgctgtccgccggcctcctcccgcaggcgctgggtaagggtaggggaggcaggggacacggtggcgccgtcaacccgcaggtcgccggcatctgctctcgcaccccgttcccggaggtgtgcacgtccaccgtcgggcggcacgcgtccaagtacccggtcatcgacaacctggccgtgctgaacatgcatgtggacgcgttcgccaagcgcaccgcgcaggcgcgcaagcacgtcgcgaggtcggtccgcaccattccgacgcagcagacgcaggcgctcacgttctgcgacaccatgtacatgaacacgcaggacaccatcggggcggagcaacgggccatcacgttc

SEQ ID NO: 63335 - DNA, 422 bp, Zea mays
  Clone ID: LIB3075-010-Q1-K1-C1
ctctagggtttttgccaagccgccgtcgccgtcgctctgccctcgtatcccctcccacgacaccgagacaccaagatgacggcgcagaccgcggaggagctcgccacccagatcgagcagcagaagctcgaggagcagaagaccgaggcagaggaagttgtggtggaggatgaggaggaggaagatgaggacgatgacgatgatgacaaggatgatgatgaactcgatggggatgccagtggcaagtcaaagcaaagcaggagtgagaagaagagccgcaaggccatgctgaagcttggcatgaagcccatcactggtgtcagccgcgtcactgtaaagaaaagcaagaatatactctttggcatctccaaaccagatgtgttcaagagcccgaattccgacacgtatgtcatattcggcga

SEQ ID NO: 63336 - DNA, 319 bp, Zea mays
  Clone ID: LIB3075-010-Q1-K1-C10
acgctcggacgaggcagccatggccgcggggggcaccgccgacttcttctaccgcgagtcgcagcgtctgggctacgtcgcccgctctgcgtttaagctgatccagatgcagaagcagcacaagctcatcgcgccgggcgctgctgtgctcgacctcggctgcgcccccggcgcgtggcttcaggtggcttgtcagaacctgggtcccctcgagaagggtggcattgtcgtcggcgtcgatgttaagaaggtgaaagtgccctctgcgcactgtgactcacgggtcaagacggtctgtgcagatgtcatgacgctgatg

SEQ ID NO: 63337 - DNA, 152 bp, Zea mays
  Clone ID: LIB3075-010-Q1-K1-C11
ccgtgctctttgagctagccctcgcgctcgaggcgggcaacgccccacacgtagcggaggcaatgaatactagagcggcaggaagctgccaggcagctgcggcgaataagatccaggatgacttgtgatcgacgctgtacgaggacactaac

SEQ ID NO: 63338 - DNA, 376 bp, Zea mays
  Clone ID: LIB3075-010-Q1-K1-C12
acggttctgaccacctgaggcaagtttttggcaagcagatgggcttgagcgatcaggacattgttgccctctctggtggccacaccttgggaaggtgccacaaagagcggtctggtttcgagggggcctggactacaaaccctttggtctttgacaactcttacttcaaggaacttctgagtggtgataaggagggccttcttcagctcccaagtgacaaagccctgctgagtgaccctgttttccgacctcttgtcgagaaatatgctgcggatgagaaagctttctttgatgactacaaagaggcccaccttaagctctccgaactgggggttgctgatgcttacatagaccctatcctggagtgatacattct

SEQ ID NO: 63339 - DNA, 384 bp, Zea mays
  Clone ID: LIB3075-010-Q1-K1-C2
cgagctagtagaagcgcgaacgcgtgcatgcgcagacgttgaggtcgaaggacacgggatctctgagcttcatcagagagcggacccgcaccggcacgcttggccgaagccgagaagagtgccgggccgggagaccggacgataattgatccgtagcagattcgctatggcgagacggcggacatggagcggatcttcaagcggttcgacaccaacggcgacggtaagatctcgctgtcggagctgacggaggcgctacggacgctggggtccacctctgccgacgaggtgcagcgcatgatggccgagatcgacaccgacggcgacggctgcatcgacttcaacgagttcatcaccttctgcaacgccaacccggggctcatg

SEQ ID NO: 63340 - DNA, 458 bp, Zea mays
  Clone ID: LIB3075-010-Q1-K1-C3
ccgagtggaagaaggatgagaacatggctggtgaatggaaccacacttcgggaaaatggaatggagatgccgaggacaaaggtattcaaacctccgaggattacaggttctatgccatttcagccgaataccctgagttcagcaacaaggataagaccctggtgctgcagttctctgtgaagcacgagcagaagcttgactgcggtggtggctacgtcaagttgctgggtggtgatgtagaccagaagaaatttggtggagacacatcttacagcattatgtttggaccagatatctgtgggtacagcaccaagaaggttcacactatcctgaccaaggatggcaagaaccacttgatcaagaaggatgtgccttgtgagactgatcagttgactcatgtttacactttgatcatccgtcctgatgcaacatacagcattctcattgataatgaagag

SEQ ID NO: 63341 - DNA, 458 bp, Zea mays
  Clone ID: LIB3075-010-Q1-K1-C4
attcgatcaaaatcaggcaggggcacgggttgcttttatcccgaagcgtatcctgcgacttggactctgaaaggtgcaaagaggcgaacctttctgggatagcccttggggccgtggaagaccgggatggcatattgaatgcagcgcaatgagtgctcactatttaggacatctattcgatattcatggtggcgggaaagatttgatttttcctcatcatgagaatgagcttgcacaaagccgagctgcttatcctgagagtgaggtgaagtgctggatgcataatggctttgttaacaaggatgataaaaaaatggcaaaatcagataataactttttcacgattagagatatcactgctctttaccatccattggctttaagatttttcttgatgcgcactcattatagatcagatgtgaaccattctgatcaagcacttgagaatgcatctgatc

SEQ ID NO: 63342 - DNA, 460 bp, Zea mays
  Clone ID: LIB3075-010-Q1-K1-C5
ctccttctcgcccggcaccgtcgagctcggctgtggaaacagaacaaacccatcaaccatggcgaactcggcgtcggggatggccgtgagcgacgagtgcaagctcaagttccaggagctcaagtcgaagcgaagcttccggttcatcacgttcaagatcaacgagcagacgcagcaggtggtggtggacaggctggggcagccgggcgacacctacgacgacttcaccggctccatgcccgagagcgagtgccgctacgccgtcttcgacttcgacttcaccaccgacgagaactgccagaagagcaagatcttgttcatctcctggtccccggacacctcgagggtcaggagcaagatgctgtacgcgagctccaaggaccggttcaagagggagctggagggcatccagctggagctgcaggccaccgaccccagcgagatgagcatggacattgtc

SEQ ID NO: 63343 - DNA, 466 bp, Zea mays
  Clone ID: LIB3075-010-Q1-K1-C6
tcatgatccgcgccgcgctcaaagacaaggccacgggcaacaacgtccacaacaagtgatacgtttctctgggtgcttgtcgcggacggcgtttaggaacaaggactgcggcaagggccggcgatcgcgaggcacagtgggcggtagagcagagacactccacgggcctcaaccagctcgccaccacctcctcctccgaccttctaggcagcaaggactagcatgcagtccgagctcaccgagcaggcccgcaaaggtcgcaagatatacgtagctacagtcttctccggcgactagcccaccatctctagcgccgctgatgcggctgatctcgctggtctccagagaccgacggcgtccagcggtggccggaggagtcctgtgttcttcgtttccttaggtgtacttatgtgggttttggggtggcaagagagttttttttttgtgaactctggtgtatcggatc

SEQ ID NO: 63344 - DNA, 458 bp, Zea mays
  Clone ID: LIB3075-010-Q1-K1-C7
gaacgagcagcctccagtacgagccagccagtgaaactaataaagctctcgtcgtcgccatcggagctaacacgccaaccgaccccgtgcccaaggcaatccgccgacgacgtaccaccaccaccgcaggagcgagatggagatgaagaggatgctcttcgccgtcctcgtcgtcatcgacgcctcggtcaccgcagtgctgtcctccaccgaggtcgtcgccgcggacaccccaactgcctccgagtcgtccgacgaggctgccgctagcgctggcgctggcgctgccgctggcgccgccgtctcgatgccctccgtcagcagcggcacgaccgccctagacgccgagctcgacgcgctactcttatacctactcgcctactagctccactaagcgtgtgcgtgcgtacgtacgcacgcatggacgacgatggatccggacaacgttgacattgcag

SEQ ID NO: 63345 - DNA, 449 bp, Zea mays
  Clone ID: LIB3075-010-Q1-K1-C8
accagactgaagaagagctagagccagtttgttagccaataaaagatttccttgtcaaggaggctgatggaggcactccagatgagacagttttgcaggattatatggtcccagtaaacttgattgagcggtggggcaatgctatggatattgtataccctgaatttaagcggtgctgctgtttcactaaaagctactatcgttatgtgaaggggacaggctctttgttggctacatctaaaaacctcaatgttcctgaagagaagctccaaatttcttccctgaaggagttgggcctacgatttttcacccctcgtgaggttgccaatttccattccttcccttcaaatttctgcttcccggatcacataagccttaggcaacagtatgctatgctgggtaacagtctgagtatagcagttgtgggtcctttgctgcattatctcttt

SEQ ID NO: 63346 - DNA, 458 bp, Zea mays
  unsure at all n locations
  Clone ID: LIB3075-010-Q1-K1-B5
ctctgctttcaccccccgcatcgaacctcacccccgatctgatcgaatcgaaggctgcggcggcgatgggcggtgaccatggcggtgggcacgccggcggcgacttccgccagaaggtatggagcatgacgggcggcccctactgccgccccgtccactggcgccgtaacaccgccatcgccatgttcggcgtcttcctcatctgcatccccatcgctatgaagtccgcagagctcgagcaacgcccgcatcacccagtccggccaatcccatctcaactgtggtgcaaaaactttggtaagaaggaatactgaaggaccctccaactagcatgaagtgtgggcaccttgcttttgccttctttntgtggaaacctgtgcctagccataatgctgggttaagtgttaggagcatctctggaatgcttcgcgtagtatcttttgattcttctttccttc

SEQ ID NO: 63347 - DNA, 456 bp, Zea mays
  Clone ID: LIB3075-050-Q1-K1-A9
cggacgcgtgggcgctcctctccccatcctgcacgctcctccgcctgattcccagcgcgtcgcacatctgctgctcgtcgcacttcaagagattcgatcgggttcgccggttcgcgcccgccgccatggcgacttcctcaggaccaaaggaggcgccagcgaataaccctgggctccagaccgaggtcgaccccgccaccaaaggctacttcttgcaacaaacgatgttacgtgtgaaggacccaaaagtgagccttgacttctactcacgtgtgatgggcatgtcgttgctgaaaaggttggattttgaagagatgaaattcagtttgtattttctaggttacgaggatgtgaccttagcccctgatgatcatatcaagcggactgaatggacttttaggcaaaaagctactcttgagctcacccacaactggggcacgggaaatgaccctgaat

SEQ ID NO: 63348 - DNA, 448 bp, Zea mays
  unsure at all n locations
  Clone ID: LIB3075-050-Q1-K1-B1
aaaaataggagttgcaatgcctttgatgccccattcatctgtttttgcatgtccttgccttggatttgctgtgagaacttccatatatagcatcagatggcttaaatgccatagcagattaatatatgaaactttcctctcaagcagaagacatcaaagtaaacttcttagtacaacagttctagcaagaagcacaagaaaagtaagcagtcatttagcaatagtcatcattttgcatgggaaatcagttgaatcatcaattgaagtgtacatgcagtcagagtttgaacagcttaactcacttcattgctacaatgttgtggaagagttttctgtagtcaagactaaatggcctgcaactgtccttgttttttatattgaaactacaagcttctcacattgtgatgacagaattattgagttttcagttccgtgatcttatgaangg

SEQ ID NO: 63349 - DNA, 442 bp, Zea mays
  Clone ID: LIB3075-050-Q1-K1-B10
gttttacagcctaaatactggtgctctgctctacatgataccattggggcttacttactccataagcacacgcgtttccaacgagcttggcgctgggcagcctcaggccgcgaagatggcagcaaaggtagtcatgtacatggctttgtctgaaggactcgttatatccttgacgatgaccctgctacgcaacatttgggggtacgtgtacagcgacgaggaggagatcgtgacgtacatctctaagatgttgccgatcctcgggatatctttcttcatagatgggctccatagctctctttcaggggtgctcacaggctgcggaaagcagaagatcggcgcggccgttaatctcggaacgttctacttgctaagcatcccagtggctgtactggctgcattcgtcttccatctcaaccggaatgggccccttggcttggca

SEQ ID NO: 63350 - DNA, 408 bp, Zea mays
  Clone ID: LIB3075-050-Q1-K1-B12
cgctctctcggcggaagttggcgacgactgggcgaccgccgccgccgtacgccaggtgctcaggtctccgtcagacccttcgccaggtcttcttccgcggcgagcaccgccaggtgtgcatccaatcttcttcactgggtcctccgctgcttctagtcacgcatctaaatccggagttgccagcattcgcttgaggtgcctgacaaagcacaccatcatgcaggctagcgataggttcaacataaactctcagcttgagcatcttcaagccaaatatgttggtacagggcatgctgatttgtctagatttgaatgggctgtaaacatccagagagacagctatgcctcttatattgggcactatccaatgctagcatattttgccattgctgagaacgaatcgatcgg

SEQ ID NO: 63351 - DNA, 430 bp, Zea mays
  Clone ID: LIB3075-050-Q1-K1-B2
gctactatggaagttcaggaagcatttgtgaagatatgtgaacaagctaaggcttacttagaaatgaaaggagaactagtcagtggtcttaacttaatcaataataccaatttagaatttttccctgtgaagaacaaagcagaaatatttcgtctgagaggtgattttctgttaaaaatgaacgaatgcgagactgcaaatcagtcttattcaaatgccataactctttttaagcatttgcccaaaggatggattagctggggaaattactgtgatatggtttttaaagaaacaaaagatgaggtttggcttgagtatgcagtcagttgttttttccaaggcatcaaatatggagtttcaaactcaaggagccatctagctcgaattctctaccttcttagctgtgatggacaaaatgaacctgttggaa

SEQ ID NO: 63352 - DNA, 387 bp, Zea mays
  Clone ID: LIB3075-050-Q1-K1-B3
caactcaatatagcttggtcatgtattttgtcacaaataccttgaagaagggatcattactacaacgtttttttgatggcgatgatgaattctgcaatagcagactaaagcttataccatccgttcccaagggctcctggttagtgcgacagagtgttggaagcaccccttgtctgttgggaaaggctgttgattgtagttacgttcgaggtcctgcatacttggaggtggacgttgacattggatcttcggcggtagcaaatggagttttgggtcttgtttttggtgtggtgacaacattagtagttgatatggccttcctaatacaggccaacacatatgaggagctaccggagcaagtgataggcgcagctcgactggctcatg

SEQ ID NO: 63353 - DNA, 391 bp, Zea mays
  Clone ID: LIB3075-050-Q1-K1-B4
agcggccatggcctcgattccggcgacgaccttcgccgtcatcttatccgtcctcttctgtgccgcggctggcaccgccgtcgacaacgacctccccgactacgtcatccagggccgcgtctactgcgacacctgccgcgccgggttcgtgaccaatgtcaccgagtacatcgcgggcgccaaggtgaggctggagtgcaagcacttcggcaccggcaagctcgagcgctccatcgacggggtgaccgacgcgaacggcacgtacacgatcgagctcaaggacagccacgaggaggacatctgcgaggtggtcttggtggagagcccgcgcaaggactgcgaccaggtgcaagcggacagggaccgcgccggcgttctgctcaccaggaac

SEQ ID NO: 63354 - DNA, 460 bp, Zea mays
  Clone ID: LIB3075-050-Q1-K1-B5
cccacgcgtccgactgtggggaggctggtgatatcgatcaccttgctgcagcatttcttacttcacataacattgctcatggggtgaacctaaagaaatcccctgtacttcagtacctgtattatcttgctcagattggtctagcaatgtctcccttaagtaacaactcactgtttatcgactatcatcggaaccctttcccaacatttttcttaaggggtcttaacgtgtctctttcgactgacgaccctctacaaattcacctgacgaaggaacctttggttgaagaatacagtgttgctgcttcactttggaagctgagctcatgtgacttgtgtgaaatcgctagaaattctgtctaccagtccggattctctcacaagctcaagtctcactggatcgggagaaactactacaagaagggtccggagggcaatgacatccaacagacaaatgtttc

SEQ ID NO: 63355 - DNA, 441 bp, Zea mays
  Clone ID: LIB3075-050-Q1-K1-B6
cgctctctcggcggaagttggcgacgactgggcgaccgccgccgccgtacgccaggtgctgaggtctccgtcagaccctgcggcaggtcttcttccgcggcgagcaccgccaggtgtgcatccaatcttcttcactgggtcctccgctgcttctagtcacgcatctaaatccggagttgccagcattcgcttgaggtgcctgacaaagcacaccatcatgcaggctagcgataggttcaacataaactctcagcttgagcatcttcaagccaaatatgttggtacagggcatgctgatttgtctagatttgaatgggctgtaaacattcagagagacagctatgcctcttatattgggcactatccaatgctagcatattttgccattgctgagaacgaatcgatcggaagagaacgttacaatttcatgcagaaaatgct

SEQ ID NO: 63356 - DNA, 409 bp, Zea mays
  Clone ID: LIB3075-050-Q1-K1-B7
gcctggtgtggtcctcccaaggttcccccgggtaagaacatcacggccaaatatggtagtgattggctagatgccaaggcgacatggtatggcaagccgacaggtgctggccccgacgacaatggtggcggctgcgggtacaaggacgtgaataaggcccctttcaacagcatgggcgcgtgtggcaacgtccccatcttcaaggacggtctaggttgtggatcctgcttcgagatcaagtgcgacaagccagcaaagtgctctggcaagcccgtggtggtgtacattacggacatgaactacgagcccattgcggcgtaccacttcgacctagcgggcaccgcgttcggtgccatggccaagaagggtgaggaggagaagttgcgcaaggcgggcattattgacatgc

SEQ ID NO: 63357 - DNA, 331 bp, Zea mays
  Clone ID: LIB3075-050-Q1-K1-B8
cccacgcgtccgggaaatccactcgttgatgagcagctagtgctcctgatgtactgcctgggtacagtggctctgtacatgcggtttgctacatcacttattcatgagatcaccaatgcactcgggatccactgcttcaggatcactaggaaaaaggcatagttcctccgtccacgggcatcaacgttgccctggattgtgtaatcaatcacaactcacaaggtggagcctgacagacaagcaatttttcatatttaatggatgctgcttcctgaatactcacatggatgacgcccccccccccgtccctgtggggcgttataatttaaat

SEQ ID NO: 63358 - DNA, 386 bp, Zea mays
  Clone ID: LIB3075-050-Q1-K1-B9
atttattgtgaagtggaatgcacatgtggatgccagttttgttttaattgctccttacaaacacactcaccatgttcctgcatgatgtgggagctctggattaagaaatgccatgatgaatcagaaacagtgaattggataactgtaaatactaagccctgtcccaagtgtcacaaacctgtggagaagaatggtggctgcaacctggttgcatgtatatgtggacaagcattctgttggttatgtggtggtgctacgggtagagatcacacgtggtcaagtattagtggccacagttgtggccggttcactaatgatcagactaagaagaccggacaagcagggaagacctctatagatatatgcactaccacaacagatacaag

SEQ ID NO: 63359 - DNA, 396 bp, Zea mays
  Clone ID: LIB3075-050-Q1-K1-C1
tgaccatccaggtggatggcaatctgctggcgaccacggacctaagccagtacaaggaccatggtaattggatcgagattctacgcgtggataacctggtcatcaccggcaagggaaaccttgacgggcagggcccagctgtgtggagcaagaactcctgcaccaagaagtacgactgcaagatccttcccaactcgctggtgatggacttcgtgaacaacggggaggtgtccggggtcacgctgctcaactgcaagttcttgcacatgaacatgtaccggtgcaaggacatgctgatcaaggacgtgaccgtgacggcgcccggggacagccccaacacggatggcatccacatgggcgactcatgcgggatcaccatcaccaacaccggcattg

SEQ ID NO: 63360 - DNA, 398 bp, Zea mays
  unsure at all n locations
  Clone ID: LIB3075-050-Q1-K1-C10
cgcacgtgggcatgtacctggtgtcggtgcgcatcggcacgccggcgctgccgtacaacctggttttggacaccgccaccgacctgacgtggatcaactgtcgtctgcggcgccgcaagggcaagcactatgggcgacagtcgatggggcagacgatgtcggtgggcggggaaggcgcgacggcggcgaagaaggaggcgagcaagaactggtaccggccggccaagtcgtcgtcgtggcgcaagatccggtgctcgcagaaggagtgcgcggtgctgccctacaacacgtgccagagccccagcaaggcagagtcgtgcagctacttccagaagacgcangacggcacggtgacgatcggcatctatggcaaggagaaggcgactgtgacggtgtcg

SEQ ID NO: 63361 - DNA, 407 bp, Zea mays
  Clone ID: LIB3075-050-Q1-K1-C11
ctgaagattctcattcaggtccattttcattgttgggaagagtttcagagttgaaacctgacttttttatcagaatgggagatgtgaaaagagtttaccatggagtaagcagagtatctgtagtctgacgctccaaagttgatgccatcaaacacgaaggccagggaattgatggtctgcgtcccggcgacaaactgaaccgagataaaagatgtctaattcagtgtctgaatcttgtgaaatgcttgcgtatggagcggcgttgtttcgatagccaggccagggcacgtccttaccgggatgcctctgtgaatgacttggatcacgggcacgtcgcttgtgaaaatgccagccccgaacctcatagcaagtcccagcacgacggtgagacccatgcccaggacaat

SEQ ID NO: 63362 - DNA, 209 bp, Zea mays
  Clone ID: LIB3075-050-Q1-K1-A8
cttccagagccccccgccgccgctgcgccctcctctcggtcctgccgtccgtcgaggtagaaggacagcatggtgagggtgggcgtgctcaatgatgctctcaagtccatgtacaatgctgaaaagatagggaaacgtcaggtcatgatcaggccgtcatccaaggtgatcatcaagttcctgacggtcatgcagcgccatggctacat

SEQ ID NO: 63363 - DNA, 369 bp, Zea mays
  Clone ID: LIB3075-049-Q1-K1-H2
tcacaatgggtttaggaggagagggctatcttaatttcatgggaaatgagtttggacatgctgaatggatagattttgcaagaggtccgcaaagacttccaagtggtaagtttattccagggaataacaacagttatgacaaatgtcgtcaaaaattgaccttggggatgcagactatcttaagtatcatggtatgcaagagtttgatcaggcaatgcaacatcttgagcaaaaatatgaattcatgacatctgatcaccagtatatttcccggaaacattaggaggataaggtgattgtgttcgaaaagggagatttggtatttgtgttcaactttcactggcacaacagctattttgactaccggat

SEQ ID NO: 63364 - DNA, 457 bp, Zea mays
  Clone ID: LIB3075-049-Q1-K1-H3
cccacgcgtccggccaaacctgacatcagcctattacaagcgtcagtagagatcttccagggggccatggccaagcccccgggtcagacggccgccatcatcttcctcgtgctcctcgcgaccgcgtcgtgcctccacaccgtcgacgccgccgctttagggttttgctggggcaagtgcagcgctcggtgcgcgcgggcaagcgcgcggcgggcgtgggccgcgtgcatgagctcatgcggcctctgctgcgaggagtgcaactgcgtgccgcgcgacatccatgactgcccctgctacagcaacatgttcaccaccggccccaagaagatgcccaagtgcccctgagactgagactgtgaggccggctcacactgcggcatccatgggactgcgactgctgcctacaactacgatccgatccatgctgggccagacaaccagttatgcatgttat

SEQ ID NO: 63365 - DNA, 420 bp, Zea mays
  unsure at all n locations
  Clone ID: LIB3075-049-Q1-K1-H4
tgaagacaatgacccattggatgtgttggtcctgatgcaggagcctgttattcctggttcggtcctgcgagcaagagcaatcggccttatgcccatgattgaccagggtgaaaaggatgacaagataatagcagtctgtgctgatgatcctgaatatcgtcactacaacgacatcagtgagctgtctcctcatcgcctgcaagagatcaagcggttctttgaagattataagaagaatgagaataaagaggttgctgtcgatgcattcttgcctgcgaccacagctcgagaggccattcagtactccatggatctgtatgcgcagtatattttgcaaagcttgaggcagtagattggaagcaactatttatctgggcgtcttggaatgagtgtgattntaataagtcaaaacacttgata

SEQ ID NO: 63366 - DNA, 449 bp, Zea mays
  Clone ID: LIB3075-049-Q1-K1-H5
gtgcgcgccgcggccggattcccggtcggcgcacgcgtacgggccaaggagcatgctatgcggatccctttatttggaagcgctatgcttttatcactgttgcttctattcaagtttctctcaggagatgtggtcaacgctgagctcactgcctactttttcattctaggcattgttgctctctccgcaacactgcttccttctataaaacgttttcttccaaaagagtggaatgataatctcatcgtctggcgggctccattctttcactcactctcggtggagttcacaaagtcccagattgttgcctcaatacctggatttttcttttgcttgtggtatgcgtcaaagaagcattggcttgcaaacaatgtcctgggattggctttctgtattcaagggattgagatgctgtcattgggatcatttaaaactggagccattctctt

SEQ ID NO: 63367 - DNA, 338 bp, Zea mays
  Clone ID: LIB3075-049-Q1-K1-H6
acgcagaggtgggctggcttctcctccccctcttaccaagtcctcttcgggttagggttacttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcattaccgaccgggagacggggaggtctcgcggcttcggcttcgttaccttctcctccgagaactccatgctcgacgctatcgagaacatgaacggcaaggagctcgacggccgtaacatcaccgttaaccaggcccagt

SEQ ID NO: 63368 - DNA, 324 bp, Zea mays
  Clone ID: LIB3075-049-Q1-K1-H8
atcgtttaagaaattcgccgcttgatgtgtggatccgtcgcggctgccgtcaagcatagacaccaagaaccagacctcggggtggggcatcggggtcgcggaggtctactggatggggtcaagaagtatccgggcaagtcgtctctgggaaccctgcttattgctcgccggatgctagcgccgccgtggactgcgcggctccgagaagtcgaggtcgtcgcgacatatcccaggaaccttcggacttggaacgaagctgtccataatatggaaagcatgattgggacgaaggtcgaatcaattctgaagctatgcgcaaggaag

SEQ ID NO: 63369 - DNA, 451 bp, Zea mays
  Clone ID: LIB3075-049-Q1-K1-H9
ctcacgtcaagggatgatgatgattcccttgtaccaagtccccttatgctcaaaagtgaaaatgtgcaagaggatggggtctatttgttggaaaacggtgaggatggtctagtctacgtaggaaatatggtaaatccggctaccctggaacaaatattcggtgtctcttctttggctgcattaccagcccagttagcattggagcagtttgacaacgaactctctgaggaagattaacgaagttgtaaatgaaattaggcgccagaggtgctcatacttgaggataagactatgcacaaggggcgaaccatctggtgattttttccggtcatttctaatagaggacaaggcacctggcgtcttctcctacgacgagtttctcgtgcatgtgcacaggcagatccaaagcaagatgacctgagggccaggcgaatgcaaggcaacatgaact

SEQ ID NO: 63370 - DNA, 168 bp, Zea mays
  Clone ID: LIB3075-050-Q1-K1-A1
gtttgttttatctgtatattgaacatgctcattccctggttactagagatataaaatgtgccgatatcctatttgatgcaagcggactggtcaaattggcagattttggacttgcaaaggagatgtcaattttgagccaggcaaaatctagcaagggaactgtctact

SEQ ID NO: 63371 - DNA, 431 bp, Zea mays
  Clone ID: LIB3075-050-Q1-K1-A10
gaagagagcaacaaaaattattcatctcagctaaatggtttcatgaagtggttagaaagagaactgttgcagttcggcttccattctgagagtgccaatgattatgattacactcaatttcctgtctatatggatatgttggacaaaaaaataggatctctgatagccgaatcagatgatttaagggttacagttcaaagcaaagattctttactacaggttgagagggccaaaattgaggagttgatgcgtaaatcagatggtctagaagcttcattgagccaaaaggattcccagatagggttacttcgccgggacagagcatccaatcagcagagcagatctataaatttgcctggcacttcagagattgagcaaatgaatgacaaagtaagcccagctgcagttgtcactcagattcgaggcgcacg

SEQ ID NO: 63372 - DNA, 436 bp, Zea mays
  Clone ID: LIB3075-050-Q1-K1-A11
tttcctttaatacactggccttactttgccctttccttgacagaggtacaataagatacgctagtgtccatgcacatttaggacgtactggtagcagaagggatgatctggaatcattagcatatacattgatatttcttcttagaggaaggttgccgtggcaaggttatcagggcgagaacaagagttttcttgtttgcaagaagaaaatggctacctctccagatctattatgctgtttttgcccaactccattcaaacttttcctggagactgtgacaaacatgaaatttgatgaagaaccaaattactcaaagcttatttcccttttcgatgaattgattgagccccagcatttgaggcctattagaattgatggtgcattgaagtttttttttcactacaagaaatgacatttctattttgtatacaatta

SEQ ID NO: 63373 - DNA, 282 bp, Zea mays
  Clone ID: LIB3075-050-Q1-K1-A12
ccgagaggtgaaccagcagcctccaataaaagccagcacatccaaataaaaccgagagacctcagccctcatgcaagccgaccgccgacgtaccaccgcgccaacccgagagaaagatggagatgatcaagaggatcctcatcgccgcgctcctcgtagtcgccgtctcggccaccgcagtgctggcctccaccgaggccgccgccgccggcgccccagccgtctacgagtcgtatgcgtgcgccgaagccctcgatggcgccgtcggctccggagtcggac

SEQ ID NO: 63374 - DNA, 356 bp, Zea mays
  Clone ID: LIB3075-050-Q1-K1-A2
cggacgcgtgggctagatcgcgagcggccgctcgcgatctataactagtcctgaaaacagccgagcgatctcctctccctctgcctctccgatccattctccagcgcagcgaagtaaacatgtctgaccgggcaaagatgtcgtggcaggcgtacgtggacgagcacctgatgtgcgagatcgagggccaccacctcgcggcggcggccatcgtcggccacgacggtgccgcctgggcgcagagcacggcgttccccgagttcaagaccgaggacatggccaacatcatgaaggacttcgacgagccatggcacctcgcgccgacaggcctgttcctcggacctaccaagtacatg

SEQ ID NO: 63375 - DNA, 390 bp, Zea mays
  Clone ID: LIB3075-050-Q1-K1-A3
caataagatggcgtgtatagacaatgcaatgagagcctcgttccttttagcgctcttctgtgtcgtgcatggtgagaaggcaaagtcaaaggacaacgatgcaaaagcgtccgggcccggtgggtccttcgacatcaccaagttgggcgcctccggcaatggcaagacggatagcacgaatgctgtgcaggaggcgtgggcatcagcgtgcggcggcaccgggaagcagacgatcctcatccccaagggcgacttcctcgtcggaccactcaacttcacaggcccatgcaagggcgacgtgaccatccaggtgaatggcaatctgctggcgaccacggacctaagccagtacaaagatcatggtaattggatcgagattctacgcgtgga

SEQ ID NO: 63376 - DNA, 264 bp, Zea mays
  Clone ID: LIB3075-050-Q1-K1-A4
gcaagcagtgtgttccgttttgatgagccatcctatcctatcctatccagctaggaaaatttaagcagctcgatcaaaattcgcgtatgccttcactgtttagatcagggaataatcttgatctgtagttggagccaggatgtaagatctgtgcagtgatttatcatgacaataaaattaagtggaaaaaaaaaaaaaaaaaaaaaaaaataaaggaaaaaaaaaaaaaaatataaggaaaaaataaagaaaaatttataaatg

SEQ ID NO: 63377 - DNA, 397 bp, Zea mays
  Clone ID: LIB3075-050-Q1-K1-A5
aatggaggcagacatacatagtggtgatgcggtgaagaaggagcttcatcaagtgcatatggaggcaaagagacttattactgagaggcagatgctgacccttgagacagaggatgtgaataaagaattacagaaactctctgcctctggtgacagtaaaagccttcctgaattgctagctgagctagatgggctaaggaaagagcatcttaatttacgatctcaatttgaatttgagaaaaatacaaacatcaagcaagttgagcagatgcggacaatggaaatgaacttgatgaccatgactaaacaagctgagaagttacgaggtgatgtggcaaatgctgaaagacgggcacaggcagctgtggctaaagcaacagggcatgcagctggtgca

SEQ ID NO: 63378 - DNA, 359 bp, Zea mays
  Clone ID: LIB3075-050-Q1-K1-A6
gtcgccatctccccaccacctcgtcaccgcagaccatgcccccacggggcccccgcgcgggcgtggcctaccggtgaacgccgggcggacacacgggaccgcgcagccggcgagcacgggatcgcacatcacgggcgcggccaaaatgcgggagccgtgcgctgcgaagtgcggaagcgcctgttaattgctctccctccagtgccgcgcagtgcgcacagggttttaggaagggggcgacaccggtatcgccattcgccagccatggaatccgcaacggcggccgtccgcagcgcgtcgctagcccgggcccgggccgcgccgctcgttcacaggcgcgcgcgcggggcgggtcgcgt

SEQ ID NO: 63379 - DNA, 433 bp, Zea mays
  Clone ID: LIB3075-050-Q1-K1-A7
ggctgttccagcgtgatgatgaccctggccccgtgcatggacttcatctccagcaaggcggggggacccgggaatctctgggggttcgttcctgcccgaatccggccaaaccaaccccggttgctctgcatggtactggacggcactgccacgtgcttcggcattgccatcaaccaaaccagggcgctggagctccccggcgtctgcaaggtcaaggcgccgccgctcatccagtgcacaggcgtccctgcggcacctgcaccgacgcctccggacgagccagcagcggcagcggaagatgaagaagccgacgcagctgcagatgccccttcagcaaatggagcctcaagctccacaaactcaaagaatgcagcgagcttactgcttctcatctgcgcattgctgtatgccttctaataagtggtgatacaac

SEQ ID NO: 63380 - DNA, 387 bp, Zea mays
  Clone ID: LIB3075-049-Q1-K1-H11
gcctctcgagagtgtgagcgtcaactctattccaactagcaaggaggatatccgtgatcttggtcctccggataagggtgccgaggctcttattaaaaaagttttggcaccatcaacacaaaagacaaagttaattgaggcgaaagagaatgatgttgatgggagggcttactacacttttgagttcacagctcaggctccaaactacacaagacatgcacttggtgctattgtaattgcaaatggcaaattttacacattgaccactggagcaaacgagagaaggtgggaaaagatgaaggatacgctgcatactgttgtggattccttcaaaatcgaaaatagaatatgagtgcctgaattgctgtgctgtttttccttcggtga

SEQ ID NO: 63381 - DNA, 455 bp, Zea mays
  Clone ID: LIB3075-049-Q1-K1-F5
cgctgggctccggccgccgcccgtcgctgcggcagcgtcgctccgaggccgtcggtttgcgtcggtgccgccgctcgcggcttcccattcggtgcggtccgtgtcccgcgcggttaagaataaagcaagtgcaatctatgacctccaaaggaatagaagtaaccttgaatcgttattctgctacgacaaatctgtcccagaggagaatattggaaaaccgtccggtctagatctggaaaagaaggatgtcgggggcaaccctccctgctcaagctgtgaagctaaaggcgctgtgctgtgcgcaacatgcgctggttcaggcttgtacgtcgactcgatactagagagccaagggatcatcgtgaaagtcagatgcctaggctgtggaagaactgggaacatcatgtgctccaagtgtggaggcccggggcatacctgaatgataaaaagcttgg

SEQ ID NO: 63382 - DNA, 395 bp, Zea mays
  Clone ID: LIB3075-049-Q1-K1-F7
cgtctctgtatgccagtggtcgtaccacaggtatcgtgctcgactcgggagatggtgtcagccagactgtccccatctacgagggatacgccctcccccacgccatccttcgtctcgacctggctggccgcgacctcaccgactacctcatgaagatcctgactgaacgcggctactccttcaccaccactgctgagcgggaaattgtcagggacatgaaggagaagctcgcctacattgccctggactacgaccaggagatggagactgccaagaccagctcttctgttgagaagagctacgagctgcctgacggacaggtcatcaccattggtgctgagcgcttccgctgccctgaggtccttcttcagccatccttcattgggatggaagct

SEQ ID NO: 63383 - DNA, 367 bp, Zea mays
  Clone ID: LIB3075-049-Q1-K1-G1
gttgccataggcaatggcaacagctcgcccttgtcttccttgaaggagctgttttttgggaagtgatgaaccgtcggcaaccttgtttctcttgcactttaagcagctaactgttcccgggtaggacgctctcctgcaataaatcatggtagctgttaagaacggtggttcagttgctctcatatggtctgaagaaacggtgcttcagtctttagcattttgaggaggaaacgtgaaacttactggtcagctgaaagctataaacattgccatggccctggactggaagccccaactttcccaagcctgtagaaagcgccatgtgcctctacagaagccaccgcgtgatgaccagcttcatccggca

SEQ ID NO: 63384 - DNA, 374 bp, Zea mays
  Clone ID: LIB3075-049-Q1-K1-G10
ctatgagagatacccacaagtggaattgtatcttaaatccaaccaaatgaagggcttccacgatctacttaaagactgggatggtagctccaaggagttcaaagaactggacatcgaacagttcaaaagggcccttgctcaagtggactctcaagtcaagatgctcccagcaacagctcaggttgctgcacaagagggaagttacctagcggattgcttcaacagaatgaagacgtgtgaagaatatcctgagggtcctataaggatcagaggtgcagggcgccatctgttcaaacctttcaggtacaagcatcttgggcaattcgctccactggggggagagcaaactgcttaccaattggcacgggactggg

SEQ ID NO: 63385 - DNA, 337 bp, Zea mays
  Clone ID: LIB3075-049-Q1-K1-G11
atcgacgccatgcttcaccagaccggaggcagcgttcctagcaccacctaaaaacctcgttgtgctctccgtcctgcgtggtagtaaacaaaagggaaaaagtctttttaaggaacttgtgatgctctggctccttgtgccattgctgagggacatccttagcctttgtttagtagtatggtttggtactttgttctgtcatcactcgtttatctatccctaatacatgccgccatgattgtactcccaatgacgcgcagatcatttgctttgttttgtctgctcgaacctcgaagtcgtctatgcttttcagattattttgggcatgtttttaatt

SEQ ID NO: 63386 - DNA, 386 bp, Zea mays
  Clone ID: LIB3075-049-Q1-K1-G12
gatcaatgagattgtgaaccgcttgaataagacaaaggtggaacggaaacctgattgaaaggctgaaagagaggctatgagtgctgctgaaaaggcagaaagaaaggcacagcttagagacaagaaacgtagggaagagatggagaggcttgagaaagagaagcaggctgatatcaggagctacaagggtctaatggtccaagagaagatgacttccaacaagcaaatcgcttctggcagcaagaccctgcaggaacttgaagaagactttatgtgagaggcggacattataaatgccatgctgaagatttccttgaactgcttctgtcgaagacagaaggggtaccacaggcttgtgagatactggatctaaatgactcatgggc

SEQ ID NO: 63387 - DNA, 263 bp, Zea mays
  unsure at all n locations
  Clone ID: LIB3075-049-Q1-K1-G2
atgattcgtctggtctggcgtgcgtgagtccagctcgtgtcgtgtgtgtctctgtgtgaggtgtcagcgggcgtgtgtatgtatggagtcngccgcggcggcggaggaggtgtgcgcgtggtggtggtggtacgtgcttcgacgcgccactgtttgtcgcggcgatcatgtactaccctgctgcgttttctggttatcaatgagatgatttatttgattcttttcagcctgggcactaatataagcgcacacaattttacggt

SEQ ID NO: 63388 - DNA, 446 bp, Zea mays
  Clone ID: LIB3075-049-Q1-K1-G3
caaaaataggcgaacttttggatctggatgtgtgcatggaaattttggacattctgtatggaacggaagatacctgggactttttaattctccctgctcacttgctgcttccactcttgttgctgcatatgctatatcagttcctaagcaaacatgggagtttcccatccttccttgggtcaggtttgctacatcatacgatgaagaggaaatcatgaagattgttctgacaattctcctgcatgtgcttaaactggatggtatcgaagagaagggcaagggacgttttgatgccagatgtttgtcgtgagtatgtgatatgtagagcacgagattgtgccccaattttgccttttgagttctgaacgtataaccatctaactgaccgagggcagcagatacatgcttttagaagacactgtagctagttttttgacaggcgggtt

SEQ ID NO: 63389 - DNA, 261 bp, Zea mays
  Clone ID: LIB3075-049-Q1-K1-G4
aaagccgcacatccaaataaaccgaggtacttagtcctaggcaagccgaccgccgacgtacgaccgcgccaacccgagagagaggatggatatgatcaagaggatcctcatcgccgcgctccttgtagtcgccgtctcggccaccgcagtgctggcctccaccgaggtcgccgtcgtcggtgccccagtcgtcttcgagtcgttggtgttcgtcgaatccctctctggcgccgtcggtgccggcgccggtaccggtactcg

SEQ ID NO: 63390 - DNA, 404 bp, Zea mays
  Clone ID: LIB3075-049-Q1-K1-G5
cgctttcccgttccccaccccgaccgactgttttccctcccccgcaccagcctcaaagcatcgccggcgccgcaacatcgctgaggaagcccgcacccctgcccggatccgatggccaacagcaacctcccgcggcggatcatcaaggagactcagcggctgctcagcgagccagcaccggggatcagcgcgtcgccctcggaggagaacatgcgctacttcaacgttatggtccttgggccggcgcagtcgccctatgaaggtggagtttttaagcttgaactctttttacctgaggaatatccaatggctgccccaaaggttaggtttctgacaaagatctatcattccaacatcgacaagcttggtaggatatgcctcgacattctcaaagacaaatggag

SEQ ID NO: 63391 - DNA, 467 bp, Zea mays
  unsure at all n locations
  Clone ID: LIB3075-049-Q1-K1-G6
gagttgccagcgacgagcanaccaagggagggagagaggcggatggggcantgcccgtgttgggggtgcgtgaaggcggcggagcgggagcggcngnaggaggcggaccggcgcgagtcgcangatgctcgcgccaaggccgccgaggccgcgcagaggaggtaagacagcaggagtatgagaaatcggcagctggaagggcagccaaagcacagatgaaagcaatgaaggaatcaaagacatcaaaccaaggtggagagccggttcttaagtggcagatgggatcatgagtttcgtttctgtcgatttgcatccctccgcttgtaagtatgaacaatcatactcatctgcttcatttgcatgctgtctctggtagactggtatcttatgtgaacctgtctgaggcaaaattgtgtatctaagcatgtgttttcgntcttcttaatttacttgtattgggcatgctg

SEQ ID NO: 63392 - DNA, 365 bp, Zea mays
  unsure at all n locations
  Clone ID: LIB3075-049-Q1-K1-G7
gcagttgggacatctgtgaacccatcgtcagcaaatgtaagtcgctcaaagaagcgcaagggcagagttgaaggagcaggaggcaacgacacatgggttgccaagggtcattaacttctcagccatcaacatctaggatcctgtggtcaaccttttggcattcgattcgtcttggtacctctgcctgtcatgttgtttgctcaaaccactgcatatcgttgtaggttgcttttttaaccttaactttaattcgtaaccactgcattttgtaactgcataacaattcggctggatcagtttccaccaaagatataacgaacgaatggtaacagcctttatcttanaaaaaaaaaaaaaaataaaaa

SEQ ID NO: 63393 - DNA, 444 bp, Zea mays
  unsure at all n locations
  Clone ID: LIB3075-049-Q1-K1-G8
cttggttcctggatcaccaaattttggtacctacgtccacagcaagccaagccaccataatcgagagagaaactgagcgagagagacaagccccaacaatctggccacgactgagggtggcgatcatcgtcattaaatggcgaaattgctgctaccttcaatttgacgtaagagaccgcggtcagggagaattcctcatcggaaacttttcctcgctgccattctacatcccactgcagactgggcacgacgtgcatcgttgccggtcaagaacaggtaccgcaagatgaggcgcatggaggatgttgcgatgagttcgtgagaggtctaggccgtcgtctcccagtcaactttgggttgctggatcggttcctcatatgatgtaactnattaattattntgtatagaacntcctgtatatagtaaagatgtgatattcgatcc

SEQ ID NO: 63394 - DNA, 321 bp, Zea mays
  Clone ID: LIB3075-049-Q1-K1-G9
aaaaaaaaaaaaaaaaaaaaaaaaaaaaataatttattaataataaaaaaacaaaaaaaaaaagaaagaaaaaaaaaaaaaaggggagggaaaaaaaaaaaaaaaaataataatttaaataaaaaaaaaaaaaaaaaaaaatataaaaaaaggggggccccctttttaaatgcaaattttttttcccccctttttctacaaaatattttttttttttttccctcaaaaaaaaataatcgccccccgcttttaataccccctcctttgaaaaacccccctgtccccccaattatatcctttttaaaaaaaatccctttttta

SEQ ID NO: 63395 - DNA, 449 bp, Zea mays
  Clone ID: LIB3075-049-Q1-K1-H1
gtcggcgtttggggcggcggcgtgactggccgctggtcgcggcgcgcgtccggcctggtgggatcccttcggacttccgcagattcccgcgcgggggtgtttgatttggatgagaggagcgcggcggcgggatggggaccccttcgcagggctcggcgaccgtgacggcggcccgggtcgacctctgcgcgctcgacctcatgcccgtctttgccaaggagatgatcgccggcggcgtcgccggcgccttctccaaaaccgccatcgcgccgctcgagcgcgtcaagatattgctgcagaccagaacaaatgagtttgggtctcttggagttctcaaatcattgaagaaactgagacaacttgatggagtcatggggttttacaaaggaaatggtgccagtgtgatgagaattgtccttatgctgcattacatttcatggcatatgagc

SEQ ID NO: 63396 - DNA, 340 bp, Zea mays
  Clone ID: LIB3075-049-Q1-K1-H10
cccacgcgtccgtccaaacctgacattaatttattacaagcgtcagtatacatcttgcatgtggtcataggcaagggccggctggaaacttactaaatcatcttcctcgcgctcctcgcgaccgagtcatgccttcacaccgtcgacaccgccgctttatggttttgctggggcaagtgcagagctcagtgcgcacggtcaagctcacacaggacatgggccgcgtgcatgagctcatgcagcctctgctgctaagagtgcaactgcttgcccaacgacatccatgactgcccctgctacagaaacattttcaccacctgtcccaacaatatgcccaagt

SEQ ID NO: 63397 - DNA, 334 bp, Zea mays
  Clone ID: LIB3075-010-Q1-K1-A10
cggacgcgtgggtggtattgcatggagctcccatgatccatcattattcgcttctttgtcatatgatggaagggttgtcttggaatcagtcaagccctacttgcagagaaaatgaaccttgtctggttttctaaattgtaagctgagtagctttgccttgccattctgtagcctcttaacaagcatttatgtgatgattcggtttactgttgtagcaatggcagaaaaatggataacaagattgttacagaaatcaatttttaggatgttgtatatttgaagtgtccatgaaaaggtcttgctgtatatgatgaggtggggttgaactcaattt

SEQ ID NO: 63398 - DNA, 438 bp, Zea mays
  Clone ID: LIB3075-010-Q1-K1-A11
cgtatatagttcagttgtagccgttgagacttgggaggcaggcgacatgggtggcgggaaggacgacggccacgatccctcgaaggcggacaagggattccacggaggagggtacccggccgccgccggtggatactacggcggccagtaccccggcggcggctaccctgctccaccgggcggcggtgcgtaccctcccggccctgggtacccggtaccacctggtgggtacccgtctccgggtggctaccctcagcctggcggatacccgccgtcgcacggggcgtacccggcgccgggtgcatgcgcgtatcctgccagcgggtacccccatcaaccggtctacccacagcctggctatccatcgatgcccggtcatggtggcatgtacggaggacgccacggtgcaaggggctctgcaagccacggggcgatgct

SEQ ID NO: 63399 - DNA, 376 bp, Zea mays
  Clone ID: LIB3075-010-Q1-K1-A12
cagtttcattctttcctgagtcccacattacatagattgccaggccgttgaaatattttggcataaaagatataagcgtatgccagtatcacacggtccattgcgcataatgcaattatcttggtgtggccagccccttaaatccaagttgtctgctgcagaattttgtcttgtataagtgtccaagcaaaccatttaaatgtgcctttgaactgcacccggtacttatgcattgttaaatttgtagtttggtgacactctacttgttttgcttctgtagttggtggagcgggcacagttctgggtgaatgaattggagcttatgaacgtctattttatggttggcaatgccacgatgtcttttgagaaaatcata

SEQ ID NO: 63400 - DNA, 71 bp, Zea mays
  Clone ID: LIB3075-010-Q1-K1-A2
gctaccttactgtaagttgtgtaacaactgctgtattatattaacgcttttgagttctgccgggtgatatg

SEQ ID NO: 63401 - DNA, 422 bp, Zea mays
  Clone ID: LIB3075-010-Q1-K1-A3
caaacctgcagtcatgtcctgcaccatgaccgcatatggaggaatcattgatgtctgtagatgtgtttactcagaaggtggagtgcgggctctttaccgaggtgtaggtccaacactcatggggatacttccttatgctggtcttaagttctacatatatgaagggctgaaggtacatgtaccagaagattacagaagttctgtaacattgaagctgtcatgtggtgctgctgctggtttatttggacagactctgacatatgcattagatgttgtcaggaggcagatgcaggttcaaaaatcagcaacaacatgagcaatttggtgccccacgaataacgggcacattccagggtcttgtgtccattaaacaaacacagggttggaaacaattatttgctggcttgagcctcaattacatc

SEQ ID NO: 63402 - DNA, 346 bp, Zea mays
  Clone ID: LIB3075-010-Q1-K1-A4
acccaggcgtccggtcagctcacttttgaatagtagacttccacattctttttatggagctatcattgccgtctttagatgggtttactcagaatgtggacgcgctgctctttaccgaggtgtacgtacaacactcatgcggatacttacttatgctggtcttaagcactacatatatgaaaggctgaaggtacatgtaccacaagattacacatgctatgtaacatccaagctcacatacaacgctgactgtaggattatttgaacagactctgacatattcattatacgttgtcaggaggcaaatgcaagttcaaaatcagcaacaacatgagcaattaggtgc

SEQ ID NO: 63403 - DNA, 427 bp, Zea mays
  Clone ID: LIB3075-010-Q1-K1-A5
caaacctgcagtcatgtcctccaccaccaccaccaagctcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgctctctaccagcagtccaacctggtgctgtacggcaggatccagtgcaagggcaagtgcaccgagcagaagggcatcacggcgccggccatgaaggtctgccaggaggagtgcgacaaggcgtacgtggtgaaggcggccgaggtcacc

SEQ ID NO: 63404 - DNA, 389 bp, Zea mays
  Clone ID: LIB3075-010-Q1-K1-A6
cgcgctcgtctctccaagcctcgaaccgcatctccggcggcctagtggaacgcgaagatggcgacggcgctcggcctcggtgcgcgctccggcctccgactcctctccgcaggcgccgtggccgcctcagcaacggcttctcgtgcattccattctactggcgcaaggaggatgggggcgcacgctcatgatgagccatactacgtccacgccaagcacatgtacaacctgcacaggatgaagcaccagcagcttaaggtgtgcctcgccgtgctggctgcggtgggcactggcattggagtccctgtgtatgctgttgttttccagcagaagaagactgcatctgcataatctgaaacgccgaggtggctcgacatgaaaacatgcct

SEQ ID NO: 63405 - DNA, 407 bp, Zea mays
  Clone ID: LIB3075-010-Q1-K1-A7
cttctttgcgatcattgtgccgactgagtacgattgtttaatggccagcactagaaagaaggaaattgttgatgtcattgttaaggctattaagagcacatctgagtatgaacctgaggtggcttcctctaacaggtttgagtatcatgcagctgctgaagttattaaggtggttgagtttgaggaagtcgatggaggcacgaaaaccaggatcacgaacagggagaaatcatgattaaaactcaaggaatggttggtttcctgtaaactgtatagctctttcgtttttcatggatgggtggctttttatcttcacatgtcacgtgtagtgtgtaccgcaacctcaatgtcagttccttttgttttgctctgcattattttactagaaaactgcatggcgctggcgt

SEQ ID NO: 63406 - DNA, 420 bp, Zea mays
  Clone ID: LIB3075-010-Q1-K1-A8
ggactttctagcatgcatgggagcattttttggagtcatattttcatcggcggagtatggctggctcattgcggttgcaatatctgttgctaaaattcttctccaagtaacacggccaagaacagttttacttggaaaccttccacgaacaactatatacaggaatgtagaacagtatcctgatgctaccaaggttccaggggtgctgattgttagagtggactcagctatatacttcacaaactctaactatgttaaagagagaatcctgaggtggctaagagatgaggaggagcaacaacaggaccagaagttaacaaaaactgagtttctaatcggtgacctgtctcctgtaattgatatcgacacaagtggaatccatgctttggacgagttggcgaaagctctcgaaagcgcaat

SEQ ID NO: 63407 - DNA, 461 bp, Zea mays
  Clone ID: LIB3075-010-Q1-K1-A9
attcccggtcgacgacgcgtacgcgttgtgctcacgtcatccgaccgtaactcggagtactgggcggagcgcgcggaggcggagcacgcgtacaaccgcgcggcgtaccagaccgaccccgtggccgtcgtgcagcgcttcaacgacggcgtgcacagggcgacggcgacgcggtcgcggtccctggcgcacagggcgcggggcccctgcacggcgaccaaccccatcgaccagtgctggcggtgccgccgcgactgggcccgcgaccgcaagcgcctggccaggtgcgccatgggcttcggccacaggaccaccggcgggctggccggcaagttctacgtggtgattgaccccagcgacgacgccgtcgacctcgtcacccccaggaagggcacgctccggcacgccgtgacccgggcccgggcgctgtggatcaccttcgcgcgcgacatggtgatcga

SEQ ID NO: 63408 - DNA, 418 bp, Zea mays
  Clone ID: LIB3075-010-Q1-K1-B1
cacagtttcctctcacggatcgcactttcttcatgcgcagcgactgccgctagttgcggcccgtgagggcacaacgagcaccgtccgcttcgagcttggcgtgtgggcagaaaagcaacgccaccgctgacacttctatatgcgctgcttcttcaggaagccatgggtgatcgccgtgctttagtctctgcatctgatggcatgcgggcccgtcgagcgccgctacgagggtgagcaggcgtgccattgacactctgcgggcgagcctccactggcgggcgaactggctgccgccgctgcaccgatcgggcgagtggaagggagtgctagcgggagcagggccacatatttggtttcttcaggaaactgttcttattgtcgtatgacttacaccaacagtaaatcgcagattcacttg

SEQ ID NO: 63409 - DNA, 313 bp, Zea mays
  Clone ID: LIB3075-010-Q1-K1-B10
gaaggcatgaagacccgaaactgaaaccaaaaataaactgcaggcagagggggaaggagagcggcaggagggtcattaaataaatctacttttctgtttcagggtaggaaatgatgtccgagagtgaagagcatggctcgctcctagacaagatcaacgacaagatcaacgagaagatccatgagtataagcactcgtcgtcgtcctcctcctcttcggactcagacgatgacaagaagcccaagaagtctaagaagaagaagctttttggaagaaaacatccattgcatcatgtcctcggaagaagcaaaac

SEQ ID NO: 63410 - DNA, 416 bp, Zea mays
  unsure at all n locations
  Clone ID: LIB3075-010-Q1-K1-B11
gtcgatgagcttaatagggcaaaggaaattgtttcaaaactggaggagaggttcaagttaaagcctgngattccacgcaaggatgatggttcaatagcttttgaaaatgacttcttcaaacgtcaagcttttttgacagtgtctggacagcttcaggttgagacatatgcatgtgctcttagtagcgtttatacctttggaccaacattccgggcagagaactcacatacgtcacgacatttggcagagttttggatggttgaaccggaaatcgcatttgcaaacttgcaggatgacatgaactgtgcagaaaaatatgtacagtacctttgcaagtggctgcttgaccattgccaggaagatatggagtttatggtgaaaaattatgantagagtgcaattgaacgcctggagct

SEQ ID NO: 63411 - DNA, 249 bp, Zea mays
  unsure at all n locations
  Clone ID: LIB3075-010-Q1-K1-B12
cgggattgtgggcgagtgcgtgcgttcgtgcagtcacagacaggcgttcgggcaccatgtctgtcaccggcacgcaggacaagtgcacggcgtgcgacaagaccgtccacttcatcgacctcctcacggccgacggcgccatctaccataagacatgcttcaagtgcagccactgcaaaggggtcctctcgatgtgcagctactcctncatggacggtgtgctgtactgcaagacccacttcgagcagc

SEQ ID NO: 63412 - DNA, 172 bp, Zea mays
  Clone ID: LIB3075-010-Q1-K1-B2
gcaaggaggtggagcttgttcgaagaagaaaccttaagaaagggtgttgaaaaatatggggttggcaattggaaggatattctagataacaatgcttaagcttttaacggcaggacaacggtggacttgaaaggccagtggaagaacctgctttttccgtgattgtaccggg

SEQ ID NO: 63413 - DNA, 367 bp, Zea mays
  unsure at all n locations
  Clone ID: LIB3075-010-Q1-K1-A1
attggtttcgacaacagcagctcagcggcgctgaatagctttttcgctattgggtgcgccagtggatcatttctgggtggtgtgatagcagatgtcttatctagatactatccagattctgctcgcgtcatgtgcgctcagttcagcgccttcatgggcatccctttttcatggatcctcctcacagtcattccccagtctgttgattactggtctgcctatgccgtcacactctttttaatgggaattaccataagctggtgcgctacttgtgcaaacaaccccatgttcgcagaggtagtccctcccaagcaccgcacaatgatctancgccttgaccgcgcatttgaggggtcatttggctcgc

SEQ ID NO: 63414 - DNA, 75 bp, Zea mays
  Clone ID: LIB3075-010-Q1-K1-B3
ccaactggtgggcaatccccatttcgaaaggtaccctaattgtaaaaaggccttaaacgatggccctttccaaaa

SEQ ID NO: 63415 - DNA, 443 bp, Zea mays
  unsure at all n locations
  Clone ID: LIB3075-010-Q1-K1-B4
atcgacgtcgtgcagagctccacggggatcaccttcttcaactgccactttaacaaccacaacggcgtcatgctcttcggcgccagcgactcctggccgcatgaccagatcatgcagatcaccgtcgccttcaaccacttcggcaggggcctggtgcagcggatgccaaggtgccgctggggcttcttccacgttgtcaacaacgactacacgcactggctcatgtacgccattggcggcggcgacgcgccaaccatcatcagccagggcaaccgctacatagcaccaccaaacatcgccgncaaagtgatcaccaagcactacgcggaagaaggcgtgtggaagaactgggtgtggcacacggaggacgacctgttcatgaacggcgccatcttcaatccgtccggcggcgccccccagcaggtcgacaccaacgagtgggt

SEQ ID NO: 63416 - DNA, 466 bp, Zea mays
  Clone ID: LIB3075-009-Q1-K1-G6
gtttatccaaaacatgctgtcattgtcagaggatccatcattgatgatggcattttcaatggcacgtcttgcagctgcggtgccgcttctattagtcaatggcacctataagtcaactgttagcacataccttgattctgctattctccaacatcagctacagaagctaaatgagctcaattcactgaaaggaaggcattcacatcacaggtcaacattagaggtcccaatattctggttcatacataatgaacccatattattggacaaacattatcaagccaaggctctctcaaatatggtcgtagtagttcagtcagatgatgattcctgggaaagccatttgcagtgcaatggaagacccatcttatgggatttgaggaaaccggttaaagctgctattgctgcaactgctgagtatgtatctggtctacttcctccacatctggtttatagccatgctcat

SEQ ID NO: 63417 - DNA, 526 bp, Zea mays
  Clone ID: LIB3075-009-Q1-K1-G7
tcgtctcgtagatctgagcatgagagtcgacatagacgtagacaagtagaatgtctctgtgagcatggatcgccgtgggcgtctccgggctgagctgtcccactcccgacactcgtcaagggccgccgtggctcgagttcatctctcatgccttcatcttcgtacttcgtccggcatcagcgaatctggctatggcccttcatgtaagctcatcggactggtgtgctgccgtcatctcctgtccggctctcatcagccgcgtcttctggcgcatcgtccctatgccctcattcgtggctcgtcttccgtgggtgtccaacctatctccggtcggccatcgtgaactcctgctcgtgaatccttcggttgcctttgtgtggcggcattcatcatgcctccttcaagggccctggtctacttgggtggctccatgctcctggtgctccgtcgtcgcctggccttctcctcaagatcgccacgggcggcgcggccattggcgccttctcgctgtcggcgggcgtcggcg

SEQ ID NO: 63418 - DNA, 444 bp, Zea mays
  Clone ID: LIB3075-009-Q1-K1-G8
aaaacatggctgtgaatgtgagaaccatgtggtcgtcgatgcgggcacatgttgcgatggctgtggcgttggtgttcttggtgagcggcgcatggtgcggtcctcccaaagtccccccaggcaagaacatcacggccacctatggcaaggactggttggacgctaaagcgacatggtatggcaagccgacgggtgccggtcccgacgacaacggtggcggctgcgggtacaaggacgtgaacaagccccccttcaatagcatgggcgcatgcggcaacatccccatcttcaaggatggtctgggttgtgggtcctgcttcgagatcaagtgcgataagcctgtggagtgctccggcaagcccgtggtggtgcacatcacggacatgaactatgagcctatcgcggcgtaccacttcgatttagcaggcacggcgttcggcgcca

SEQ ID NO: 63419 - DNA, 409 bp, Zea mays
  Clone ID: LIB3075-009-Q1-K1-G9
catcaattgcaagaggagcaagataccaccaccgtagcaccacacgcaggtacgaagaatgcgacgaacatggcgaggctggccttggtagcggcggtggttctgtgcctcctgttagcgacagggccgcaaggggccatcagcgccgaagggatggtgtcatttgacaatttgatcaactgcaaagtactgggcaactgcgacaagaacctgggccccgaagcctcccgcccaaggaaacccgccaacgactacacccgcggcttgaacccgatcaccggctgtcgcggctgatcatatctctctggtcgatgggcgcgcaatgtcaatgtcgcacgcgcgtgcaagtaccaagccttaacgtgtggtgccgcgtgtgtgtatatattacacacatgcattatacatt

SEQ ID NO: 63420 - DNA, 447 bp, Zea mays
  Clone ID: LIB3075-009-Q1-K1-H1
tcgattgagaagaagattgtagcgaacgtgtcacctgacaactctgatgttcagtatcagtttatgcttgaacaacgtgttcttcggcggctttgtgttcagaagatagtggtgcctacaccgatgaaggacaggctagacaaggatacaaacttcacgatagcggaggatggatctcttcatgtccttccaaaaagcgtctaacagattcacatcaggggaaggaaatgacaatgtagggaaggaactcatttcatgcccgcgaaatgcatgagcaagcccatacacacgtctgagttcctctgtgctcatattctcatttaagggcacctcgctcgtttgtagtgtctgtttggaaatattaatctttccttcactcattagttctagtgttgattttcaccataatatcgcttcaatgtatgcgtgtggaaatttggatttctg

SEQ ID NO: 63421 - DNA, 205 bp, Zea mays
  Clone ID: LIB3075-009-Q1-K1-H10
cttgtgggaaaataacatatattcactgcatttctggaaggggccggagtacaacaatcgtcttgtgctatctggtcaaatacaagaatatgacacctgcagcagctttcgagcatgtacggtctaaaagggctcgagtgctgttgacacattcgcaatggaaggctgttcaagaattcagcaagaagaacacggaccttcctgc

SEQ ID NO: 63422 - DNA, 360 bp, Zea mays
  unsure at all n locations
  Clone ID: LIB3075-009-Q1-K1-H11
ggaagcgcgccccttggaggagggtctcgcttaggccatcgatgacggccgtattggcccacgtgatgatccgaaggtgcgctcccacatcctctctcaggagtttgggtgggacaaggacctggccaagaagatttggtgttttggacctgagaccactggcccgaacatggttgtagatatgtgcaagggagtgcagtatctcaatgaaatcaaggattctgttgtggctggtttccagtgggcatcaaaggagggtgcactggctgaagagaacatgcgtggaatttgctttgaagtctgtgatgtcgntcttcatgctgatgctatccacaagggtggtggtcaagtcattcccac

SEQ ID NO: 63423 - DNA, 136 bp, Zea mays
  unsure at all n locations
  Clone ID: LIB3075-009-Q1-K1-H12
ggcgaccacgcgtccgagctagcgatggctggagcccgggcactgtttatcgtcctcgcggctgccgtcgcggtcgtggccgcgcggccggcgtctgcangcggtggagccgcggcggtggcggagatctgcatga

SEQ ID NO: 63424 - DNA, 475 bp, Zea mays
  Clone ID: LIB3075-009-Q1-K1-H2
ctgctcttgaaatagcttacaaacaggcaaaaaagcgaggaataagagttcgtggggttctcatatctaacccttcgaacccaacgggaggcattgtgccaaaagaaatactgcatgaccttctacagtttgctgcagagaagaacatacacttaatttctgatgaaatatttgctggttcaacatatggaagtgacaagtttgtcagcgtggcagatgttgtggatgaactagaggactttgataaaggcagggttcatatcatatatgggctctcaaaagacctatctcttgccgggtttcgagttggagtgatatattcctacaatgaacacattgtatcggctgctgctaaaattgctcgattttcatctgtctcaagtccaacacaacgtttgcttgtttccatgctttcagatcaaaagtttatttcagaatacataaaggttaacagagagaggctccagaaaatgta

SEQ ID NO: 63425 - DNA, 465 bp, Zea mays
  Clone ID: LIB3075-009-Q1-K1-H3
gtggcaattgatgagattcaatatcctccagctgttaaacaaactgagattccactcccaagggtccgaaggaaaagaaatttctgatgccgatattctaaactgggccaactgcaaagtgaaggcatccggaagaacatctcgtatggaaagtttcaaggacaagagcttatcgaatggaatgttcttccttgatcttcttagcacagtacagccaagggttgtgaactggaaagttgttactaaaggggaaactgatgaggacaagaagctgaatgctacctacatcattagtgttgcaaggaagattggatgctctgtgtttctgttgccagaggacatcattgaggtgaatcagaagatgatcctaacacttactgctagcattatgtattggagcctacagaaacagccccagtcacaatctgaattgacagaacaatcagaaccatctagcatgacttc

SEQ ID NO: 63426 - DNA, 461 bp, Zea mays
  Clone ID: LIB3075-009-Q1-K1-H5
gttctagatcgcgagcgggcgcccttttttttttttttttttcatttaaaaggtcatagtttcatagaaattattgtaacatgtctactgtcgtacatacattgaaacagagagagttgctcacaagacataactgtgcactacttcagtccattgcccatttcccaactactctttctttcgcagacattccagccttttctttcacaggcactccagccacattgctaaggccaagggtacttgactttggtccagacctttcaaccaatgcgccctggaaaacacagtaagctatgaaggagagtatgcgccgaatctgccgcagcacaagcaacaacgaattgataacagaagccaccagtatattgaagtttgcaatcaggaaaaacgccgcgataatgccaaggattgtaagaacagtttgttttgctgcatcccagaaaccttcaccagtaagc

SEQ ID NO: 63427 - DNA, 468 bp, Zea mays
  Clone ID: LIB3075-009-Q1-K1-H6
tgatgcctggtatgaggcctggtggtccaatgccgaactttatgatgcctatggttcagcaaggacagcatccacagcgtcctgctggtagacgtgctggtggaatgcagcagcccatgccaatgggtggtcagcaacaggtgttccctagaggtggtcgtggctatcgctatcctactggacgtggaatgcctgatcctggcatgcacagtgttggtgctgtgatgccaccttcatatgagatgggagggatgccaatgagagaagctgccccccaacctgttccaattggggcgctagccactgcacttgctaacgccccaccagatcagcagagacttatgcttggtgagaacctgtatcctcttgttgaacagctggaacgtgagcaggctgccaaggtcactggcatgcttttggagatggatcagacggaggttcttcacctgctggagtcgccagatgctc

SEQ ID NO: 63428 - DNA, 394 bp, Zea mays
  Clone ID: LIB3075-009-Q1-K1-H7
cggtctcttgggcccgtgtctgggtcgctcgtttgctgaggatcagtccaacccccagggccggcaagcggaggagagggacgtgatggtggagcagcagcagccgacgagggccccgaagctgacgtacctggacttagtccaggtggcggctgtccaggccttggtgtgcctcgatgggctctacggactcgccaaggaccacgccggcccgctccgtcccagcgttgacgccgtcgagtctgtcgtctagggcgtcgatagccacgtctacgaccgcttcagcgagctgccgctcgacatcctcgacttcgtcgaccgcaaggcggacgacacggtgcacgacgtggacatgcaccatacgggctcgctgaaagcggcgtccgtgcatgtc

SEQ ID NO: 63429 - DNA, 436 bp, Zea mays
  Clone ID: LIB3075-009-Q1-K1-H8
cttgggagttgctgcagcttctgctaacccttctcacttcatccatttgtgctacaaacccactgatgggaacgtcaagagaaagctggctattgttgggaagggtttaacttttgacagtggtggctacaacattaagaccgggccaggctgcagcatcgagctgatgaaatttgacatgggaggctctgcagctgtatttggtgcagctaaagctttgggacaaatcaagcctcctggagtagaggttcactttatagtcgctgcctgtgaaaatatgatcagtggcacaggcatgaggcctggtgacattgtaactgcttccaatgggaagacaattgaggtaaataacactgacgcagaaggaaggctaacacttgctgatgctttggtctatgcttgcaaccaaggtgttgaaaagattattgatttggcg

SEQ ID NO: 63430 - DNA, 84 bp, Zea mays
  Clone ID: LIB3075-009-Q1-K1-H9
accggaaccggaagggccgggccagagcgacccgtacgatacatcctcatccgattacggacccggattgtatacatcgtgtac

SEQ ID NO: 63431 - DNA, 347 bp, Zea mays
  Clone ID: LIB3075-009-Q1-K1-G5
tcgctcaatgggaggataagcatggctggtgtaactacaggaaatgttggttacctagcaaatgcaattcatgaggttaccaaaccaaattgagttagggtgctaccttctttggtcgatggaagctgatggaatgagactgtgaagcggcgtttccccccctctgttcctgacagaaataagtttagcctgctgctaccatatacatggacacagactcacatgtagacactcaagttttgagagctgtgatcctgtttcatttaatcaaaaacaattttgtttttttccattttgtcatggcaaatgttacaccagctgcaaaataattacaataattgatcttg

SEQ ID NO: 63432 - DNA, 438 bp, Zea mays
  unsure at all n locations
  Clone ID: LIB3075-009-Q1-K1-F11
aagagctatccatacgcacagcgatgcaccagcacgagatactagccatcatgcgcctgtcgtccctcctcctcgtcgtggccgccctctcggcgcgcgccgcggcgcancaggtgccgccggtgggcggcagcgctctgaagccggactactacagccagtcgtgcccgcgcgcggagcggatcatcgcggaggtgatgcagacgaagcagatggcgaacccgacgacggccgcgggcatgctgcgcgtcttcttccacgactgcttcgtcaccgggtgcgacgcgtcggtgctgatcgcgtccacccaagtccaaaagtcggaacacgacgcggagatcaaccactcgcttcccggggacgccttcgaacgccgggggcgcgccaagctggccctggagctggagtgccccggggtggtgttctgcgccgacattc

SEQ ID NO: 63433 - DNA, 384 bp, Zea mays
  Clone ID: LIB3075-009-Q1-K1-F2
tttaaagtaaataaaaggtgcactaatgcagtgtgcataatgactaactcattgttattttagtattgtactatcaattagtaatttttaaaatcattgtttacctaaaaaaaaaaaaaaaaaaaaaaaaaaaaaaaaaaaaaaaaaaaaaaaaaaaaggggcggccgttttaaaggtccaaggtttacttacccttccttccaacttcttaccttttttatagggcaccttaatataatttaagtggcctggtttttacaactttgactctgaaaaaaccttggcttcacaaatctatatcgttttaaaacatatccctttttccaaatgtcgcattatagcaaagagccccacacatatcgcttttcaaaacatttgcacac

SEQ ID NO: 63434 - DNA, 463 bp, Zea mays
  Clone ID: LIB3075-009-Q1-K1-F3
accttcccaaatctcagttgtcgcctgtcgtcgtcttcgtctagcccggcccgttccaaaacctccgtagccgccgccgccaccccggcgaccgaagatgatctccccggacgcagcccgcaacgtagtcggcatcatcggcaatgtcatctccttcggcctcttcctgtccccagtgctgacgttctggcggatctacaaggccaaggacgtggaggagttcaagccggacccttacctggcgacgctgctcaactgcatgctctgggtgttctatggcatccccgtcgtccaccccaacagcattctcgtcgtcaccatcaacggcatcggcctcgtcatcgaggccgtctacctcactatcttcttcctctattccgacagccagaagcgcaagaaggcgttcgcgatcctggccgtggagattctgttcatggtcgccgtggtgctcggtgtgatcctc

SEQ ID NO: 63435 - DNA, 470 bp, Zea mays
  unsure at all n locations
  Clone ID: LIB3075-009-Q1-K1-F4
agcttacaggaacatttgagtggatcatggacggattggtaggcctcttgaaagtccgggtggtgaggggcatcaaccttgcctaccgcgacgcaagaggcagcgatccgtatgtcgtcctacgacttggcaagaagaaacttaagacgagcgtgaagaagagatctgtgaaccccatctggcacgaggagctaactctgaccgtcacagatcccagcctagctctgaagctggaggtgttcgacaaggacacgttcagcagggacgacccgatgggggacgcggagatcgacgtggcgccgctggtggaggcggcgaacgctagccctgaggcgagcctgaggaacggcgccatcatcctgtcggtgcggccgatcgccacgaactgcctcgccgacgagagccacgtgtgctggaggaacggcaagttcgcgcatgacatgatccttcgnctcaagaacgtggagagc

SEQ ID NO: 63436 - DNA, 314 bp, Zea mays
  Clone ID: LIB3075-009-Q1-K1-F5
actagttctagatggcttgaatttccgtccttttttgctttatactacgacattattgacttaacatgtttcattcacccgtctctgattgcgattgtgatcactaccgcctgcaataaaaaaggccatctttactatgatcaaaagccaacactcgcctacgcgccaaggacaagattgaagactgcaagatcatccgcgtcaaggcgcaccccatacacgagcaccccaggcctaaaaaggggctgccgctttaagacacccatgcttaattacccgtgcttgcgagaccaaacgcttcgtatagggcatct

SEQ ID NO: 63437 - DNA, 453 bp, Zea mays
  Clone ID: LIB3075-009-Q1-K1-F6
cggactcgtggggtcaaattgagagtaaaaaataaagagttttgtacatggtctaagatcttcatccgctagggaatttttggagatggtctaagatcttcatccgccagggaattgcccgctaattggagtctctcccgtagtcccgtgtttgagttgttctcctctcatctccatcttcgcaacgaccacgaattccacggccaaccaatctctggtctatcgctctcttctccttgtctttaaatctgagactttttttgttcgcgtcctccgccctcaaccgtagccacctcgctgcccctgccgtcgacacccctgctcgccgttgctgcagccgcacaggcgatggatcatgaagaagtgaccgaattcctgggccaagtgccccttctgcagtgccttccgggttcctctatccgcagaatcgcggaggccgtccaggtcaagaac

SEQ ID NO: 63438 - DNA, 456 bp, Zea mays
  Clone ID: LIB3075-009-Q1-K1-F7
cggactcgtgggcaatctctctggcctgctgcttcctgataatcgaccagttccccagtcttgctccttgcactcctccctccatctccagcattgtgttctgattcacctgctccaatggctgttctttctgctgctgatgcttccccggtctcagctatcgggtttgagggctatgagaagcgccttgagatcacattctctgaggcacctgtctttgtggaccctcatgggcgtggtttgcgtgccctctccagggcccagattgactctgttctggatcttgcacggtgcacaattgtgtccgagctctccaacaaggatttcgactcatatgtcctttctgagtcaagcttgtttatctatcctctgaagattgtcatcaagacctgtggcactaccaagctcctgctcaccattccaagaatccttgagcttgctgaagagctgtctatg

SEQ ID NO: 63439 - DNA, 420 bp, Zea mays
  Clone ID: LIB3075-009-Q1-K1-F9
caagggcgcaaccaataatagcaagtgtgatcatccgttgatccatcttgctaataaccctgcgtgcccttcgttctcgtctcgatcccgacgacgctcccttcggctccggcaaaccacatcaagtcgcgatggagatgaagaaggtcgcctgcgccgtcctcgccgccgccgccttcgccaccgtggtcctcgccgccgaggccccggcgcccgcgcccaccagcgcctcctcggctgcgttcccggccgtcggcgccgtgctgagcgcctccgtgctctccttcttcgcctactacctgcagtaaaattaaaagaggatcggaaggagaggctgctggctgccattgcctgtattcggttggatccccgttatatatatatatatatatttaaggactttaatttgggctgaacatg

SEQ ID NO: 63440 - DNA, 443 bp, Zea mays
  Clone ID: LIB3075-009-Q1-K1-G1
caccctccctccctcacacaaataataaggaaaggtcccgcccttttcctccgacatccacaaggggggaggggaaaacacgtacattcacccggcggcaataatggcctcggttccggctccggcgacgacgaccgccgccgtcatcctatgcctatgcgtcgtcctctcctgtgccgcggctgacgacccgaacctccccgactacgtcatccagggccgcgtgtactgcgacacctgccgcgccgggttcgtgaccaacgtcaccgagtacatcgcgggcgccaaggtgaggctggagtgcaagcacttcggcaccggcaagctcgagcgcgccatcgacggggtcaccgacgcgaccggcacctacacgatcgagctcaaggacagccacgaggaggacatctgccatgtggtgctggtggccagcccgcgcaaggact

SEQ ID NO: 63441 - DNA, 444 bp, Zea mays
  Clone ID: LIB3075-009-Q1-K1-G10
atcaattgcaagaggagcaagataccactatcgtagcaccacacgcaggtacgaagaaggggacgaacatggcgaggctggccttggtagcggcggtggttctgtgcctcctgttagcgacagggccgcagggggccatcagcgccgaggggatggtgtcatttgacaatttgatcagctgcaaggtactgggcaactgcgacaagaacctgggccccgaggcctcccgcccagggaaacccgccaacgactacacccgcggctgcaacccgatcaccggctgtcgcggctgatcatatctctctggtcgatgtgcgcgcaatgtcaatgtcgcacgcgcgtgcaagtaccaagcctcaacgtgtggtgccgcgtgtgtgtatatattacacacatgcattatacattggtcgtcgatcggtactgtatgcatggcaactgatg

SEQ ID NO: 63442 - DNA, 196 bp, Zea mays
  Clone ID: LIB3075-009-Q1-K1-G11
gatgaaccagcagagctacgcgctgtacgcgttgaagtccgtcggggacgggggcaaggagcgcctggacaagaagctgtcggaggcgaagaaaaagaaggtcacgtacgtggtggaccccagcggcaagggcgactacaccaacatcaccgcggcgctggaggatatcccggtgagcaacaccaagcgcgtgatc

SEQ ID NO: 63443 - DNA, 456 bp, Zea mays
  Clone ID: LIB3075-009-Q1-K1-G2
cggacgcgtgggtgttggagagattttttttacccgagaagctgcgccgcgccccaatctgatcatctccatgcgctgaagatcgttggtgcccgccatgcttcccgatgattgctgccacatcgtcgctgaggaaatttcaagccccatagctgcacatatactcgacttctactacggcgacgacggcctgggcgatgacctctttgccgcggtgactgccacctctggcccattccctgccactgacgatgatgtttcttcgtctaccgctaccacccctcctatctgcggctacagtgaagacaccgcagctgctggtggagccacagcctacaccccgttgacatccttcgacaccactctcacagccctcctggaggaagagcagcaccatggccttgacgccgggttcctcccgcagatcgatggcctatcagaggtagcagcatacta

SEQ ID NO: 63444 - DNA, 461 bp, Zea mays
  Clone ID: LIB3075-009-Q1-K1-G3
gggtgatggccagcccatcggtcgctacgacgacatgtgggcaggatggtgtgtgaaggtcatctgcgaccacctgagcctgggagtcaagactggcctgccatacatctggcacagcaaggctagcaaccccttcgttaacttgaagaaggaatacaagggcatcttctggcaggaggacatcatccccttcttccagaacgtgaccatccccaaggactgcgacaccgtccaaaagtgctacatctacctctctggacaagtgaaggagaagctgggcacgattgacccctactttgtcaagctcggtgacgccatggtcacctggatcgaggcctgggatgagctgaacccgtcgacccctgccgccgcaaatggcaaggccaagtagatgtgccatcacttcggcactggagtgaaaaagaaagtatgattgggtcctgcctaggccccataaatat

SEQ ID NO: 63445 - DNA, 470 bp, Zea mays
  unsure at all n locations
  Clone ID: LIB3075-009-Q1-K1-G4
tcgcggactcgtgggctcggatacctcgaggagcagaaagcctcgtcgcatgaaagagagagaaagttgtggccgccgccgatgtctgctgcccgtgctgccggtctgtggccggagtggggctatggtcgttcacggggctgtggtgatccttggcgcggagtcacaggagctagggatggacggaatcacccctaattcctcgttgttggtttgggcaccgccgctggccgttgtgccgcgcggtcagtgcatctgcaccacgaattcgtgaggtcacgaggatctgaagatcaccctggtaactggaatctcaagtgcatgagaagaacaggtggttcaagagggccactcatcgaggagttcgattcgatctaggtggcgtctccgaattgactttctggcgccaaagatggattttaaatcctgttatatttatattntattctgtaagactttcgctatgtaat

SEQ ID NO: 63446 - DNA, 445 bp, Zea mays
  unsure at all n locations
  Clone ID: LIB3075-009-Q1-K1-F10
caagggcgcaaccaataatagcaagtgtgattatccgttgatccatcttgctaataaccctgcgtgcccttcgttctcgtctcgatcccgacgacgctcccttcggctccggcaaaccacatcaagtcgcgatggagatgaagaaggtcgcctgcgccgtcctcgccgccgccgcctacgccaccgtggtcctcgccgccgaggccccggcgcccgcgcccaccagcgccttctaagctgcgttcccggccgtcggcgccgtgctgaacgcctncgggctctccttcttcgcctactacctgcagtaaaattaaaggaggatcggagggagaggctgctggctgccattgcctgtattcggttggatcccgcttatatatatatatatatatgtaaggactttaatttgggtctgaacatgtcgattgatccattcattttattt

SEQ ID NO: 63447 - DNA, 457 bp, Zea mays
  Clone ID: LIB3075-049-Q1-K1-E11
gaagaagtgaggagaaggttctacaagaactggtgcaagagcaagaagaaggcttgcacaaagtatgctctcaaatatgaaaatgatgctggcaagaaggaaattcagctgcagcttgagaagatgaagaaatatgcttctgttatccgtgtcattgctcatacccagattaggaagatgaagggtttgaaacagaagaaggctcacctgatggagattcaggtcaatggtggtaccattgctgacaaggtggactacggctacaaattttttgagaaagaggtccctgttgatgctgtcttccagaaggatgagatgattgacatcattggtgtgaccaaaggtaaaggttatgagggcgtggtcactcgttggggtgtcacccgccttccccgcaaaacccacaggggtctccgcaaggttgcttgtatccgtgcatggcatcctgctagggtct

SEQ ID NO: 63448 - DNA, 309 bp, Zea mays
  Clone ID: LIB3075-049-Q1-K1-E12
gcgacagagacaagagctacaacagcttgtccaagaacagcgctgaggcactgacgcaccggatcaagactaggacgaagaaggccacacgcgagttcctgtgcttgaaccccaggttctcctccaggctcagctggagctccacctggaagaacacaccctgaggccgtgccaagagcaactacttggacaacgtcacacacttcagcttggacaaactgaagctgcagagggtaacgctctagatcataacatacgcgtacctgaccaagtgcacatgcatcttcctgtcaccctccaacgtcacaa

SEQ ID NO: 63449 - DNA, 458 bp, Zea mays
  Clone ID: LIB3075-049-Q1-K1-E2
atcgactccatggttgaggttggtggaaactcatatgcaaattcaatttatgaggctttggttccaaaagatcacccaaaacccaaaccagattcaacgatggaatataggacaaaatttataagagctaagtatgagacacaagattttttgaagccaagtttgcgcatttcatcaagatcatcttttaaatctaccacttctgtgaagagtgtagatagcaatttctctagcacttcaaggaaggatgtctttgaagatacaagagaatttgttggagagttgaatatcacactggtcaaaggcaccaacttggccgttagagacatgctaacaagtgatccatatgttgttttaacgctcggagggcagaaagttcaatcaacggttaaaaaaagtgatctgaatccggtatggaatgaagtgctaaggatatctgttcctcgaaattatggacc

SEQ ID NO: 63450 - DNA, 458 bp, Zea mays
  Clone ID: LIB3075-049-Q1-K1-E4
tgaactatgagcctatcgcggcgtaccacttcgatttagcaggcacggcgttcggcgccatggccaataaaggcgaggaggagaaggtgctcaaggcgggcatcatcgacatgcagttccgaagggttaagtgcaagtacgactccaaggtcaccttccaccttgaaaaggggtgcggccccaactacctggcactgctggtcaagtacgtcgacggcgacggtgacattgtggcagtggacgtcaaggagaagggcttcgacacgtacgagcctctgaagcactcctggggcgccatctggaggaaggacagcgacaaaccgcttaagggacccctcaccgtccgcctcactaccgagggaggcaccaagttcgtctacgacgatgtcatccctgccaactggaaggccaacaccgtctacaccgtcaaataataactttagtgctgacaatacttt

SEQ ID NO: 63451 - DNA, 393 bp, Zea mays
  Clone ID: LIB3075-049-Q1-K1-E5
cccacgcgtccgtctcgatccacatcggccaagccggtatccaggtcggaaacgcgtgctgggagctttactgcctcgagcatggcattcaggctgatggtcagatgcccggtgacaagaccattgggggtggtgatgatgctttcaacaccttcttcagtgagactggtgctgggaagcacgtccctcgtgctgtttttgttgaccttgaaccaactgtcatcgatgaggtgaggactggcacctaccgccagctctttcaccctgagcagcttatcagtggcaaggaggatgcagccaacaacttcgcccgtggtcactacaccattggcaaggagattgttgacctgtgccttgatcgcatcaggaagcttgccgacaactgcactggtc

SEQ ID NO: 63452 - DNA, 405 bp, Zea mays
  unsure at all n locations
  Clone ID: LIB3075-049-Q1-K1-E6
agccacatgatgaagaagagcccgtcccaggatacgctgccggacatggcagccgacgagcaaccgccggaaccggcgccaccgcaagacggggaaggagaggacaactaggaggaagggaccgccaccaatatatatcacacacacacacactcacacattctcacactcaagtctgcgtttgccatttttcttttctttttctctacgacgcttcgttattccctcctttcatctatctctccgngaactcggtttgtcgtccagctggctgtaagtgtaccagatgccttcgttacgtctgatgaggctcatgacaatggcgattttggcatggagctgtgttagcctcgcggaaaaactgtaactgtgtaagcagaactgctatatattggtcctaacaat

SEQ ID NO: 63453 - DNA, 387 bp, Zea mays
  Clone ID: LIB3075-049-Q1-K1-E7
tgcttggtcgaacaaaggatcagattaggacgacagagcaggtcaatggtgctatggctagttgccaagctttgaagttggatgctctggttatcattggaggtgtcacttccaacactgatgctgctcaacttgccgagacatttgctgaggcaaagtgtgcaacaaaggttgtaggtgttcctgtaactttaaatggggaccttaagaaccagtttgttgagacaaccgttggctttgacaccatatgcaaggtgaacgcacaacttatcagcaatgtatgcactgatgctctatctgctgagaagtattactactttattcgcctgatgggacgcaaggcttctcatgtggcattggaatgtgctcttcaatcacatccaaaca

SEQ ID NO: 63454 - DNA, 57 bp, Zea mays
  Clone ID: LIB3075-049-Q1-K1-E8
ccaatttattaggcttttgttccaaaacatcacccaaaagccaaaccaaattcaacc

SEQ ID NO: 63455 - DNA, 462 bp, Zea mays
  unsure at all n locations
  Clone ID: LIB3075-049-Q1-K1-E9
acggtccgggatcacgctgctcaactccaagttcttgcacatgaacatgtaccagtgcaagaacatgctgatcaaggacgtgaccgtgacggcgcccggggacagccccaacacggatggcatccacatgggcgactcatccgggatcaccatcaccaacaccgtcattggcgtcggcgacgactgcatctccatcggccctgggacctccaaggtgaacatcactggcgtgacctgcggccccggccacggcatcagcatcggcagcctagggcggtacaaggacgagaaggacgtcacggacatcaacgtcaaggattgcactcttaagaagacaatgttcggcgtccgcatcaaagcgtacgaggacgccgcctncgtgctcaccgtctncaagatccactacgagaatatcaagatggaggactcagccaaccccatcttcatcgacatgaagtactg

SEQ ID NO: 63456 - DNA, 430 bp, Zea mays
  Clone ID: LIB3075-049-Q1-K1-F1
cgaataacacaggtgagcgcgacgatgggatccctcgctaataacatcatggtcgtgggcgccgtccttgcggcgctcgtcgccggcgggtcgtgcgggcccccgaaggtgccacccggccccaacatcaccaccaactacaacggcaagtggctcaccgctagggccacctggtacggtcagcccaacggtgccggcgctcctgacaacggcggtgcgtgcgggatcaagaacgtgaacctgccaccctacagcggcatgacggcgtgcggcaacgtccccatcttcaaggacggcaagggctgcggctcatgctacgaggtgagatgcaaggaaaaacctgagtgctcgggcaatccagtcacggtgtacatcactgacatgaactacgagcctatcgctccctaccacttcgacttgagcggcaagg

SEQ ID NO: 63457 - DNA, 439 bp, Zea mays
  unsure at all n locations
  Clone ID: LIB3075-049-Q1-K1-F10
gttgcatgtcatcgatgggtgtcctcagcttatctttgtcagatcaaattatacaattgagactgtagaggctgagaggatgtctgtggaccatgttgcccatctcaaaccatctgatggtggttcagcagcaactcagttggctgctcatcttacaggaatacacagtgccatcaagatgctcaatagcagggtccgtgttatccatcagtatcttgttgccatgcaaaaaggtgacattccaatggacaattcgctgcttaggcaagtctcaagccttgtaagaaggctaccggctacggaatcacagaaattccaagatgactttntaatggaatacaacgacactctcctcatgacttacctggcaatgttcactaactgttcaagcacaatgaatgagttggtcgagaaaatcaacacaagctatgagagaccg

SEQ ID NO: 63458 - DNA, 376 bp, Zea mays
  Clone ID: LIB3075-049-Q1-K1-F11
cccacgcgtccggacatgttcaagagcacatatgagtccatcacccaaggaaatcctatgtggaatgagctgccagtctcaacaagcactctctatccctgggatccatcatctacatacatccatgagcctccttacttcaaggatatgacaatgactcctcctggcccgcgaccggtgaaggatgcatattgccttctgaactttggtgacagtatcacaactgatcacatctcgcctgccggaaacattcacccagacagcgcagctgcaacatatctgaaggagcgtggtgttgaaaggaaggacttcaactcatatggtagccgaagaggaaatgatgagatcatggctaggggaacctttgccaacattc

SEQ ID NO: 63459 - DNA, 462 bp, Zea mays
  Clone ID: LIB3075-049-Q1-K1-F12
tccatcttgcttgccacggtggcgctagcaacgctattcgcggtcggttcgtgcaccacccggctcaccttccaggtcagcgagggctccaagcctggccacttggtcctcacccccaacgttgccaccatctctgacgtggagatcaaggagcacggtggcgacgacttctcctttacgctcaaggagggtccgactggcacctggacgcttgacaccaagaccccgctcaagtaccccctctgcatccgcttcgctgtcaagtccggtggctaccgcatcgccgacgacgtcatccccgccaatttcaaggccggcaccacctacaagaccaccctcaacatctaattagcctcttatgacacataatattttgagagagctcatctggaccaagtgccagcgagctaatatttaattttcttctttgggtatattgaggcaccacacgagccaagaaaa

SEQ ID NO: 63460 - DNA, 397 bp, Zea mays
  Clone ID: LIB3075-049-Q1-K1-F2
ggaagaccaacatgctgacagctctcttggttccttacattttcttcaccctgcctaatgtgctgttttctctgatcagaggagaggtggggaaatggattgcgattattgctgttattctgcgtctattctttccacgacacttcccagattggttagagcttcctggttccatcatcctgctcacagtggtcgcccctagcctgttcgcggacagcttcaggggagacctcgttggtgtcttcatatgccttgtgatcggatgctacctgctccaagaacacatcaaggcgtcaggtggattcaggaacgccttcaggaagggcaatggtgtgtccaactcccatcgcatccttctgctcttcatctaccctgtctgggccggtgtgctgcaagt

SEQ ID NO: 63461 - DNA, 397 bp, Zea mays
  unsure at all n locations
  Clone ID: LIB3075-049-Q1-K1-F3
gccaaattacacgattcttcttctggggcaatattttttgcagtttgccgtggcaaagttagtgagggtcttgattttgctgatcgtgctgggagggcagtaatagttactggaatgccctttgctactccaactgatgccaaggttcggctcaagcgcgagtatttggataagcaggggacaccatctaataaaaacacaaagatgttgacaggagaagaatggtatgtgcaacaagcagcacgggctgtcaatcaggctgttggacgtgttatcagacatcgccatgactatggagctattatttattgtgatgaaaaggttgngtggccaaattatcaatctcagatgtcatattggctccgacctcatataaagtgctactcaaagtatgggg

SEQ ID NO: 63462 - DNA, 459 bp, Zea mays
  unsure at all n locations
  Clone ID: LIB3075-049-Q1-K1-E10
cagttagctcacctcccccgccagttcccgtgagctcagcacccccatttgcaaaagtcccgaccgccacagttcaaaggacctgcaccaccaacttcgagaagatctccacctccactggtgaagcccccgccaccaccgccacttgtaagctctccaccactgccaccaatgacctccccacctccaccagccgtcccatcaccacctccacctgcaccatcatcacctccaccgtcggcacctgaggagttcatcttgccaccaatcatggcgcagcagtatgcgtcgccaccgccgcctctgttccaaggatactaagcggtgatcacagcgcgctctactgacgatgagagtaatcgcgacgagggaggccaggagaagcagtgacaagtcgatcgcaccatgcaatgctctagcgacctgaatngaatgctatcngataagcgcatgtacgtt

SEQ ID NO: 63463 - DNA, 222 bp, Zea mays
  Clone ID: LIB3075-049-Q1-K1-C6
gacgcgcccgctcccggtcccgacttcgcctcatactcggactcgtcgtcggaggcgcccttcagcagcagctcattcgactagccgcgcacaacgcagttcttgtcatgatctatctagcagataaaaagatcatatgtctcgttctattctctggtatactactactatctgttcgtcgcgctgattgctttttatacatcgatcgaggatcgacttatc

SEQ ID NO: 63464 - DNA, 332 bp, Zea mays
  Clone ID: LIB3075-049-Q1-K1-C7
gtgaaatcaagtataaaataccgcacgatcaacccagaatggaacgaggagctcaccctgtccatcacgaacatgatgaacccggtcaagattggactcttcgaccacgacacgttcaccaaggacgacagcatgggcaacgccgagttctgcatcctcaacttcgtggagatcgcgaagcaggacctgagcgacgtccccgacggcacggtgataaagacgatccgcccggagaagggcagctgcctcgccaccgagagccacatcacgtggaaggacggcaaggtctcccaggacatggtgctcaagctcagggacaccgagaccggaga

SEQ ID NO: 63465 - DNA, 230 bp, Zea mays
  Clone ID: LIB3075-049-Q1-K1-C8
acaacggggaggtgaccgtggtgacgctgctcaactccaagctctttcacatgaacatgtaccggggcaaggacatgctgatcaaggacgtgaccgtgacggcgcccggggacagacccaacacggatggctttacttgtgcgactcattcgggatcacgatcaccaacaccgtcattggaagcggcgacgaatgcatcttcatcggccccgggacctacaaggtgaaca

SEQ ID NO: 63466 - DNA, 90 bp, Zea mays
  Clone ID: LIB3075-049-Q1-K1-C9
acgcccacgcgttcgtccacgcgtacgactgatgatactatggaccttccagcttttgatgccagctgtggaggatattttttcttcttt

SEQ ID NO: 63467 - DNA, 363 bp, Zea mays
  Clone ID: LIB3075-049-Q1-K1-D1
gataacgcggattaccatttctcaaagatcagatcaaaacatggagcaagatccaacacgtccatgtgcaaaaactagccactacacatcacgcgaggtggctcccgattattcgacttgctgcacggctccaattcagttcatcaccatacacgcatgcatcgtggcgcacgccactcacgagcgcggcgcccatgcgcccacaacttattacgactcgtcaccaaccaaccaaaccaagccacccagcaggtccagtccaggcgtgtgtgctgtgctctcctctaccggccgccggccacatcacgccgccgaggcgcccttggcgtcgccgctgcagtagtcgcgaacggcctcgagctt

SEQ ID NO: 63468 - DNA, 98 bp, Zea mays
  Clone ID: LIB3075-049-Q1-K1-D10
cggacgcgtgggcttgttcatgtatgctcaaggttcattatcttgttcatgtattaagtatgttatgaataactcaatatttattattttgttcatgt

SEQ ID NO: 63469 - DNA, 360 bp, Zea mays
  Clone ID: LIB3075-049-Q1-K1-D11
ctgctgcgtcacctaaatcatccatcctatttgttgcatcacctgctaaagtataggggctgtcttttacacacatcgggtgtagtatattatgccacttaacataaaaacaatgtggccaatggatgtaacagctccaaactgacttgcctcctctttcaaacgactatcatggctatgatggcttctaaactgcacaacctggacctcttttataaaaaaaagattctgtcaaaaccctggcaagcaccacctctatctacatctcgaatcaaagacttatttaaagactcaccaattgcgccaatgtcctcagctacagctctttcccacgttaacgcttacaatgatatcattagt

SEQ ID NO: 63470 - DNA, 458 bp, Zea mays
  Clone ID: LIB3075-049-Q1-K1-D12
ctcctcagtcacagaaatcccccgccaaagttgatgcaacaccgcctaaagttgagaagccatcggttacaccacctcctaaagttgattatgccactgatctctttaacatgttgtcaatggatggaacaacagagaaagagtcagcttcatcttcaaacgacgataatggctgggatggcttccagtctgcacaaccagtacctagttcagagaaaaaagattctgccaaaccagcagaaagcaagacccagtctacatctggaatggaagacttatttaaagactcaccagctgtgccattatcctcagctccagctgtttcccaagtaaacgctaagaatgatatcatgagtttgtttgagaagtccaatatggtatcacctttcgctgcccatcaacagcagctggcgctcatgtctcagcagcaagctcttctaatggctgctctcaaagct

SEQ ID NO: 63471 - DNA, 435 bp, Zea mays
  Clone ID: LIB3075-049-Q1-K1-D2
ccaccaccagcgccaccgcggccagagctggcaccgccacagcggcggcggccgagatggccgccggtcgacccctctggcggggctgacgcagtgcgtgacaagctgcgggtctggggtcacctcctgcatgctggactgctaccagccgctggtcgacctggaccccgtggagctgcccgtctgcctcctcaagtgcaccaacgacgccatggtctgcgccaccggctgccccgtcaccgggaacgtctagcttgctatagctagcccatcattatatatatatatctatagtcatcttagttattaaccccgccatttatttatttaactagccaccgaaccaatccaacgtgttactcctatataataaggatatgcatgatgactaaaggatgttggtgaaatacgtagtatgtaagtcgcgtgttcaca

SEQ ID NO: 63472 - DNA, 441 bp, Zea mays
  unsure at all n locations
  Clone ID: LIB3075-049-Q1-K1-D3
gttcaatggcttgccaaacccttttactgccgcgaggtaccacagcttggtcattgagcaagaaaccttcccacatgatgctttggaggctactgcatggactgaagatggacttatcatggctgctcgccacaagaagtacaaacacatccagggtgtccaattccacccggagagcatcatcacccctgaaggcaagaaaatcatcctcaactttgtcagattcattgaggaactggagaagcagcgttcgtaggggaggtagacgcgacaggtggtttcatttcatagatcagacggaagcagagacaaggcgcttaaagctgcgccaggttccggggctggcagttgaagcatagctaggaaacagctntccctctcttaattcgttgggttcgtggtgacataatctgtgtgcggaccgaatttaagataaagtac

SEQ ID NO: 63473 - DNA, 422 bp, Zea mays
  Clone ID: LIB3075-049-Q1-K1-D4
attgtagtggcttatctcctccaaaacatgacaccaatggcacaattttttaaaaagatattttagatctaacaagaaccttgtatttgcagactattgaggctctcttcagtaaaaagattttcttgaacaaggaggggtacagtgagttctacagtggactggtagattccgtgagctctgaactgaagggatccaaggattttacaaagttatgtgcaggtctctcgatccttgggtacatttcttccgagtcagatggaacttgcaccaaggcattttcccaactcctcacattcctaggccacagataccccaagatccgaaaagctgcagccgaccaggtgtaccttgtgctgctgcaaaatgatgaccttattgtgtcggagaatatggataaagcccagggattacttgcggag

SEQ ID NO: 63474 - DNA, 399 bp, Zea mays
  Clone ID: LIB3075-049-Q1-K1-D5
cttctattctattctttcaccccagaccaccgctttcctctacgagtacgtcgctaaagggagcatcctcgacatcctgtgtggccaggaggatttcccgctggatctacgcatgaggatcgcgatcaagaccgcggaagcgttgcagtacctgcattcgtcggaaactggcgtcaccggacacggcagcgtctcggcgtccaccatactcctcgacaacaacctcgtaccgaagctcaccgagttctcgaggtcatgtacgctgttcaagaagagcgagactacttctgttgttggtgctggagtgatgatcactggcagccttctagagaaagctctgaacgacgacccgtcccgctacggctcggtgttgatgaacctggagagcgacgtgtacag

SEQ ID NO: 63475 - DNA, 369 bp, Zea mays
  Clone ID: LIB3075-049-Q1-K1-D6
aaataaactacaggaagagagagggaagggaccacacgagagtcattaagtaaatccactgtggtggctgattagggtaggaagggatgtctgaaagtgacgagcacggctcgctcctagacaagatcaacgagaagatccacgagtacaagcactcatcgtcgtcttcctcgtcagactcagatgatgacaagaagtccaaaaagtctaagaagaagaagaagctctttgggaggaaacatccattgcatcacgttcttggaggaggcaaagccgccgatcttgtgctgtggaggaacaaacaggcattcgggagcatcttggcaggggtgactgtgatctggctgctgtttgagggcatcggctacc

SEQ ID NO: 63476 - DNA, 411 bp, Zea mays
  Clone ID: LIB3075-049-Q1-K1-D7
ggcgcctgcgtcaccgagttcggccttgcccagctcatgtccacgccccacgtccacccgcggctcgtcgggtaccggtcgcccgaggtcctcgagaccaggaaaccgacgcagaaatctgacgtctacagcttcggcgtcctcctcctcgaaatgctcacaggtaaagcccctctcaggtcccccgggcgcgacgactccatcgagcacctcccgaggtgggtacagtccgtggtccgggaggagtggacgtctgaggtcttcgacgtcgacctgctgaggcacccgaacctcgaagacgagatggtccagatgctccacgtcgcgatggcatgcgtcgcggtcgtccccgacgagcggcctttgatggaggagggtgtcggcaggatcgaggagatccggagcttctac

SEQ ID NO: 63477 - DNA, 443 bp, Zea mays
  Clone ID: LIB3075-049-Q1-K1-D8
gcaacctaccatttacagatgctagacgcaatgggtaggtggcaaagctattacttcatcggctggttcccaatgcgcgatattcaatttggattgattggaaactcaagctagtgagggatccttatcaggtattacaaagggtcttgcgcaggcagagtgttagctttgcaatttccaggcattacagacgcttcgatgttttcgaggaagctgactccgacaaggcattgggaactgtgagaacacctttcgtaagggacgtagacgcgacaggtggtttcatttcatagatcagacggaagcagagacaaggcgcttaaagctgcgccaggttccggggctggcagttgaagcatagctaggaaacagctttccctctcttaattcgttgtgttcgtggtgacataatctgtgtgcggaccgaatttagaataaagtac

SEQ ID NO: 63478 - DNA, 453 bp, Zea mays
  Clone ID: LIB3075-049-Q1-K1-D9
gaagattgtccgcaacaagcgcaaatgtgttactgtggtgaagggacttgaattgtttggtgtaaagctgagtgatgcttcgaagaagcttgggaagaagtttgcaactggagcttctgttgtcaagggcccgaccgagaaggaacagattgacgtgcaaggggacatatcatatgatattgtggagttcattacagatacatggcctgatgtacctgagtcggccattttcttcattgaagatggaaggaaggttcctgccgcttgatgccactatgaggcgcaggaccaatggatttacaattataacacagagataaagcaaaggcgtggctgtcaaggcatgtagcggcccataccagtcgtctctttgtccgaagtcatggactggtcttccaagttttatcaggagtggcgttttgttaccaccgtcacctgcttcatgtatgagat

SEQ ID NO: 63479 - DNA, 370 bp, Zea mays
  Clone ID: LIB3075-049-Q1-K1-E1
gtctagaagcatgcaagctccttgaggcaacccttggtgctgcccttggcgttcgtgcatatagcccctccatcgactgacccatctctctagttataatttttctctcgtccttgcattgcccattagatgctatccattggtaacgcacaacagtaaaacgacagacatccgacagctatattatgttcgacggtgtaacaccctgaatttgagggtataaaatttcttctccaaataccaaccaaatttaggggtttaaaaaaaataaaaaaaatatataaaaaaaatatttttttttatttaatataaaattaaatttaatatatttaatttttaatttataataatattttataaaaaaaattat

SEQ ID NO: 63480 - DNA, 397 bp, Zea mays
  unsure at all n locations
  Clone ID: LIB3075-049-Q1-K1-C4
cccacgcgtccggaagctgctgcgcgtcacgctggacctcatcaccgaggcttccggctccatgtcggccgaggtcggactgccgccgtcggacgcgccggcgccgttcggagggtacggctcgtcggctggcgcccccgcctacggcgctccgtctcctgatgccccagcttatggcgccagcgtaccagcaccgacctcggagcagagtactgcttcgactgcatgagtgatatcgtggcggcacacacgcatcttggtcactcctatccatggttcgaattaccgaccgaaaagtctggttcctcggccaatttctcgttcccggtcagctaggggaagcatttctcggcccggtatcacattntaaaaatatgaaagtcaattttttttgttc

SEQ ID NO: 63481 - DNA, 336 bp, Zea mays
  Clone ID: LIB3075-049-Q1-K1-A9
cgaaaaggcgaaaactcatggtctcgagtttcctcggagcggaggcgatggctgggaagggagggaaaggcttgctcgccgcgaagactacggcggccaagtccgccgagaaggacaaggggaagaaggccccaatctcacgctcctcccgcgccggcctacagttccctgttgggcgtatccaccgtcagctgaagcaaaggactcaggcaaatggtcgcgttggtgccaccgcagcccgctactccgctgccatcctggagtacttgactgccgaggttctggagctggctgggaatgctagcaaggatctgaaggtgaagcgcatcacccctc

SEQ ID NO: 63482 - DNA, 442 bp, Zea mays
  Clone ID: LIB3075-049-Q1-K1-B11
gccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggcgactttcttgtcggacaactcaacttcacaggcccttgcaagggcgacgtgaccatccaggtggatggcaatctgctggcgaccacggacctaagccagtacaaggaccatggtaattggatcgagattctacgcgtggataacctggtcatcaccggcaagggaaaccttgacgggcagggcccagccgtgtggagcaagaactcctgcaccaagaagtacgact

SEQ ID NO: 63483 - DNA, 239 bp, Zea mays
  Clone ID: LIB3075-049-Q1-K1-B12
ctaactctaaccctatctgggcagaacactatgattaatcagggcctgggtcatggtgccgggcgcttaacatcgagtgtgggtagcatgtccagaggggcttccatgcacatcgtggacaaagggtcaagggctggttcgacttcaagggcatctatgaccttgaaaaggggagcgcgcccaactagctgatactgctggtccagtctatctaccgacaccgagcacctattatgggg

SEQ ID NO: 63484 - DNA, 438 bp, Zea mays
  unsure at all n locations
  Clone ID: LIB3075-049-Q1-K1-B2
gggacagctgcattgtttaattgtgttaactgggttgaaagcaagtcatgggatggtcgcgatggacttgttgtttgcacagacagtgcggtttacgctgaaggtccggctcgccctactggtggtgcggctgctattgcaatgctgattggaccaaatgctcctatttgttttgaaagtaaatatagaggatctcatatggcccatgtatacgacttttacaagcccgatcttgcgagtgaatatccggtggttgatgggaagctatcacaaacatgctacctcatggcattggactcctgctacaatgtattttgcaaaaagtatgaaaaacatgaggggaagcagttttcaatttctgatgcagattatgttgtgttccattctncatacaacaagcttgtacaagaaagcttcgggcgtttgtactacaatgat

SEQ ID NO: 63485 - DNA, 365 bp, Zea mays
  Clone ID: LIB3075-049-Q1-K1-B3
gtgagagccccctttacttcgcggagcgcctgacggagcactacaagcgcgctgatggcgcaggcccgctcatctacctcaagagggaggacctcaaccacacgggcgcccacaagatcaacaatgctgtggcgcaggccctgctcgccaagcgacttgggaagcagcgcatcattgccgagacaggggctggccagcacggtgtcgccaccgccaccgtgtgcgcccgtttcgggctgcagtgcatcatctacatgggcgcgcaagacatggagaggcaggcactcaatgttttccggatgaagcttcttggtgcaaaggtgaaggctgtacattctgggacagcaaccctgaaggatgctact

SEQ ID NO: 63486 - DNA, 365 bp, Zea mays
  Clone ID: LIB3075-049-Q1-K1-B4
ctgaggtcctggagcttgctgggaacgcagcgagggataacaagaagacccgcatcgtgccgcgtcacatccagctcgccgggcgcaacgacgaggagctgaccaagctgcttggtggtgccaccatcgcgagcggcggcgttatgcccaacatccaccagcacctcctccccaagaaggctggctcgtccaaggcttccaccgtcgatgacgatgacaactgaagctgcccactggagaagaggcattcgctaccgtcttgtttcctaggtttagcacgcagttagtcagcatgtctttgagagctcgatgtgtttgggaatgacaatagctcctttcttggttccctaagatcgttgattcag

SEQ ID NO: 63487 - DNA, 439 bp, Zea mays
  Clone ID: LIB3075-049-Q1-K1-B6
ggctccccaaagatagcatagcagcagcactcacaatagcaaaaaccaccatccgtcgtcgccaaccgtagcaagaacatcaccaccgcccaacggcaagaaagaccccgcctgcaccaagatgtgcaaccaggcgtgcggctccacggatcagggcgccggtgccgccggcgccgcgccggcttgatcgcccagcgcattcatcgcttcagctcgatataatcgctgctccgtcagcaacccacatatgattcgatcaattttcctgctctaatttctcgaccccgtcgaatttttttcctttctattcttctactatactactactatctgcttgtcgcgttgatttcttctcatacatcgatcgaggatcgactcatcgttttgtaattcctgcaatttgtaagtgtaatgacctatatgacttagtcttcctttt

SEQ ID NO: 63488 - DNA, 355 bp, Zea mays
  Clone ID: LIB3075-049-Q1-K1-B7
gcgggctgctctcttctggcctctccatcctgctctggctgcagttcgccgcctccatcttcggccaccaatccactagcagcttcatgtttgaggtctactttgggctgctcatcttcctgggctacatggtgtacgacacgcaggaggtcatttagagggcgcaccacggcgacatggactacatcaagcacgccctcaccctcttcaccgacttactggctgtacttgtccgcattcttgtcatcatgctcaagaacgcggctgacaagtccgaggacaagatgacgaataggatgaggttgtgaaaatctgtgttcgaacacagcacttcaaggaaaggaaggaaagcact

SEQ ID NO: 63489 - DNA, 329 bp, Zea mays
  Clone ID: LIB3075-049-Q1-K1-B8
cccgttccccagctgcaacatcctctgtgtgtctctctgtctctttctacctgccccgttcctcaccaaacttgtcgacttgtgagtctcttccgccgccgtcgacgagagctgcgctaggtgatctcggctgcttcctcgtcccccatggcgacggcgctcaaatcgttcctgaacagccccgtcggccccaagaccacccacttctggggccctgtcgccaactggggcttcgtcatcgcgggtttggttgacatgaacaagcctcctgaaatgatatctggcaatatgacagcagccatgtgtgtgtattctggactctttatgag

SEQ ID NO: 63490 - DNA, 368 bp, Zea mays
  unsure at all n locations
  Clone ID: LIB3075-049-Q1-K1-B9
ggcgagcggcagttcctccgccgcgcggcgtggctggtgatgaggacggacgggtacttcgtgccggcgctgttcctgaacccggcgtaccaggacgagctcgacgggatgttccctcggaaggactcggtgttctacctcctggcgcactacctgttccacccgacgaacgaggtttgggggctggtgacgaggttccacaggtcgtacctgaggggctcggacgaaaggctgggcatccaggtgagggtgttcgacggagacgccccgttccagcacatcctggaccagatcctcgcctgcacttcgcaggaacacctgctccccgacgtggcggtgacgcaagagccgtcngcgggccgcggcgc

SEQ ID NO: 63491 - DNA, 350 bp, Zea mays
  unsure at all n locations
  Clone ID: LIB3075-049-Q1-K1-C10
aacacacggaaccagaaagcaaacgcaaacaagaagcaaaccagcaatggcccgcgcctgcgtcttcctcgtcgtgctcctcctagccgccgtcgccatggcgccgttcgcgggcgcggcgcgcatcgacgtcgtcgagggcaggtccatggcgtccgcggacgcaccggaggccgccgncgacgctcccgctcctgctcctggccccgactccttctcgaccccgtcgccggcacccttcagcagcagctctttcgactagccgcccggcagagatatctacggcgtccgatcagtctttggcgccacctataacctatcggatcctgcaaagctatatatgattctat

SEQ ID NO: 63492 - DNA, 436 bp, Zea mays
  unsure at all n locations
  Clone ID: LIB3075-049-Q1-K1-C11
aagccaaaaggattattacaattatgggccgggccgggggggttcttcggggggttcttctgggccgccgtcgggggggggccgtttgcgggggctgcgcgtgtggatgtcgtggagggcaggtacatggcgtncgccgacgcgcctgaggcggcggctgacgcgcccgctcccggtcccgacttcgcctcatacccggactcgtcgtcggaggcgccctccagcagcagctcattcgactagccgcgcacaacgcagttcttgtcatgatctatctagcaaataaaaagatcatatgtctcgtttgattctctggaataactaatagtatatatgctgcgcccggatgatatataaatatgtgcatcaaatgcgtgcggcaaacgcatggaatgtgcttgcctagctagctaattggtggtttttttttctttac

SEQ ID NO: 63493 - DNA, 380 bp, Zea mays
  Clone ID: LIB3075-049-Q1-K1-C12
cggtcgcgtgggatagaataacagcagcactcacaatagcaaaaaaccaccatccgggggcggcaaccgtagcaagaacatgagcaccgcccaacggctggaaagaccccgcctgcaccaagatgtgcaaccaggcgtgcggctccacggatcatggcgccggtgccgccggcgccgcgccggcttgatcgcccagagcattcatcgcttcagctcgatataatcgctgctccgtcagcaacccacatatgattcgatcaattttcctcctgtaatttctcgaccccgtcgaatatttgtgctttctattcttgtactatactactactatctgtctgtcgcgatgatttcttgtgatacatcgatcgaggatcgactta

SEQ ID NO: 63494 - DNA, 328 bp, Zea mays
  Clone ID: LIB3075-049-Q1-K1-C2
ggaaggacggcgtacggcgctgccaacgctaccacaccggcccggtcgcgcgcccggatgcgacgcgcggtcctgtgctggcgggaccgagatgtgcggtgcatgtgggcgcgtacgtacgttggtcgttggtccctccgtccgccctccggcttcgtggtttcgtttagttaggatgcgtttggttggcgagccaccggatgtggagtggcttcattctagatttggagaatagagctgttctgttctatgttaggtaagcaggatggagctgctctattttttgcttggttggggagtgtattataacggagccattcactttttt

SEQ ID NO: 63495 - DNA, 310 bp, Zea mays
  Clone ID: LIB3075-049-Q1-K1-C3
ctttgagattagaaaagagtggccagggccagcaacctaatgatatatggagcggcggtggtggattcgttaaacacatacatgttagaactcttagttaagacaagcagaagatctattatattctactgcttctagctagaggatgattgcttcacatgcatatcgtcatgtttaaccaccgtacgtataatttgtttggagtccattattctacgctatttgggtattattattgttaattcacattatagaatcagtcgtgtatggagattcaaagatatatttatatacttatgaccttcttact

SEQ ID NO: 63496 - DNA, 75 bp, Zea mays
  Clone ID: LIB3075-049-Q1-K1-A8
acttcgagatcgaaccctgcgcgtactggatgaacggcatctacgatcccgctgtctgcaccgtccatgatgaca

SEQ ID NO: 63497 - DNA, 349 bp, Zea mays
  Clone ID: LIB3075-012-Q1-K1-B2
tcgacgaggctgcactgagagaagggctgccgctccgcaaggctgagcatgcattctacttggactgggctgtccactccttcagaattaccaactgcgagatccaggacaccacccagatccacacccacatgtgctactccaacttcaacgacatcatccactcgatcatcgacatggacgcggacgtgatcaccattgagaactcgcggtccgacgagaagctgctctccgtgttccgcgagggcgtcaagtacggcgcgggcatcggccccggtgtctacgacatccactcccccaggatcccgtcggctgaggagatcgccgaccgcatcgacaagatgctggc

SEQ ID NO: 63498 - DNA, 259 bp, Zea mays
  Clone ID: LIB3075-012-Q1-K1-B3
gctgctgagattgaggtagttgatggtcctaatgatgagggtgaaatgttcacctcgcctggtaaactgagcgatcgcttcccacagccttatgcaaacgagcaagcagcccggtttgctaatggtggtgcataccctccggaccttagtgtcatcacaaaagccaggcacaatggtcagaactatgttttcgctcgttttaactggatatcatgatccacctgctggtgatcagattcgtgagggtgtgcactacaat

SEQ ID NO: 63499 - DNA, 413 bp, Zea mays
  unsure at all n locations
  Clone ID: LIB3075-012-Q1-K1-B4
ctccccaatccgaccacccccatccattcaccaacccgaaatagaaggccgtccccagccacgagcctccggagttcctccggcgatccccgtccccttgtgtgcgcgctccaggagggccttctgcctccagcttgcagagcccacctaattgctgcgagatggatagagggcagaacgggagggatgacgtcttcggacgcagggatccattttctgggtttggcttcggcccccacaggagcttgttttctggtctccttggggggagggatccatttgacgatccgttctttacccatccgttcgggggtcggatgatgggtgaccatgacatgtttgtacctagtcctttttgggccgatgggagggccttttggngacatgaggaaacggtggtttatcgagcaagc

SEQ ID NO: 63500 - DNA, 200 bp, Zea mays
  unsure at all n locations
  Clone ID: LIB3075-012-Q1-K1-B5
ttcccggncgaccacgcgtccgcagctttaatagctgatgtaggangnnactttgcttgtcgtgggggtggcgaccttatcggggggggaggatgtgatgatttcgttagcgctnnactttacctcaccggcgcttgtggcggctgctaacttaacagtggtgaatgatgttgtgtatttcactgaccattgaggtgacc

SEQ ID NO: 63501 - DNA, 421 bp, Zea mays
  Clone ID: LIB3075-012-Q1-K1-B6
gcgggcaggaggtacaagggcctcaaaccagcgccgctcatctacgtccaaggcgtgttcgaagacggcgcgctcaacaccgtcgacgtccgcggaaagatcgtcttctgcgaccgctccgaaaccgccaccatgcgcggcgagatggtccgcgctgccggcggcgtgggcatcatcatgttcaacgacgcctccgagggcggtgtgacgaggttcctggggaacgtgtccatcgcggcggcgcgcgtcagcgaggccgacggcgccaagatcatgtcctacatcaactccacggcgaaccccaccgccaacctccacttcaccggcgttatgctggacccttcctaccagccggccatcgccgaatactcctcacgaggccccctgcacatgtcgaacctcggcgtgatcaagcccgaca

SEQ ID NO: 63502 - DNA, 445 bp, Zea mays
  unsure at all n locations
  Clone ID: LIB3075-012-Q1-K1-B7
catcgtgctgatggaaatccaggacaagttgtcggctgagtggaagcccatgaagctctctgggggcgccatctggaggatggacactgccaaggcgctcaagggccccttctccatccgcctcaccagcgagtccggcaagaaggtcatcgccaaagacgtcatcccggcgaactggagacccgatgccgtctacacttccaacgtccaattctactagactttgaattcccttcgattcatccggcacagcgggctatggaccttcagcagcaagctaattaagttggcagcatgcaccgctaaccctatatactactgagacttncaaattctagtatatgtaatccttttggtcgggttcatgatcgaanttcaaagagtggaaaacaagcaaaaggttaaatatacatgccatttttggagggcattttttcgaanaaaa

SEQ ID NO: 63503 - DNA, 435 bp, Zea mays
  Clone ID: LIB3075-012-Q1-K1-B9
cccacgcgtccgcttgttagcacaaacagatcgatcgattacagcaatggcggccaaggtgtgcctcctcctccgactcagcatggtcgccgtcgtcctggctgccatcgccacagtagcgctcgcggaggaagccgatccgcgggcactgccggcacagtggaccaccgcgaagaagtacaaggccacgatggacgccaagacgcggcaggctttcgacggcgtggtgggccgccgctacggcagagaagcggtcccaggcggtggaggccgtgctgcagcagcagctgaacatggacgtgtccctgtccaaggcgacgtcttccggggacgagaacaactacgtgagcgtggccgccgcctacgagaaggccgcgggcgccgtcatcgcggcgacgccggacaacaagctccgcgctatggcgttcgcgttcg

SEQ ID NO: 63504 - DNA, 331 bp, Zea mays
  Clone ID: LIB3075-012-Q1-K1-C1
cgagtaacacagttgagcacgacgatgggatccctcgctaataacatcatggtcgtgggcgccgtccgtgcggcgcttgtcgtcggcgggtcgtgcgggcccccgaaggtgccgcccggccccaacatcaccaccaactacaacggcaagtggctcaccgccagggccacctggtacggtcagcccaacggtgccggcgctcctgacaacggcggtgcgtgcgggatcaagaacgtgaacctgccaccctacagcggcatgacggggtgcggcaacgtccccatcttcaaggacgggaaagggcttgggctcatgctacgaggtgagatgc

SEQ ID NO: 63505 - DNA, 354 bp, Zea mays
  unsure at all n locations
  Clone ID: LIB3075-012-Q1-K1-C10
ccgggnccgacccacgccgtccgcaagccgtttaacctttatcntcatcacatgtacgaaaggtgtttggaaccttggatggagaggatgttgtcaggcactgtgagggtatctgtccaagccgtgctcgggggcctttgtcaacttctttggcttcgggnngccagagctgtagtaatgatacctcgtaaggttctctctttgcattggacgaaggggatgccaggagttcatactttttatctaagagaagacccttatttcgacatcgttgtacaactcttatttgtattttaagtggagaacctagaacacttttgttgatagatatanctgttaaatacttctgtcgat

SEQ ID NO: 63506 - DNA, 436 bp, Zea mays
  unsure at all n locations
  Clone ID: LIB3075-012-Q1-K1-C11
cccacgcgtccgcgacaagatggcgtgcacaaacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcatgcggcggcactgggaagcagacaatcctcatacccaaaggtgacttccttgtcggacaactcaacttcacaggcccttgcaagggcgacgtgaccatccaggtggatggcaatctgctggcgaccacggacctaagccagtacaaggaccatggtaanttggatcgagattctacgcgtggataaacctgtcatcaccggcaagggaaaccttga

SEQ ID NO: 63507 - DNA, 422 bp, Zea mays
  Clone ID: LIB3075-012-Q1-K1-C12
gaggggagggaaggggaggtgaacggagggagcggaggaagatctcgggctctcagagctgcatcctgaacccatcgcgtaggaaggggcaaaggagtcggagctgatccggcagtcgctctctctcggattgagtacgatttgacgcatttgcggccgagctttcttgcacccaagatgagtgggcatggtgacactgcgacctcagctaaagatggcgaaactgaaggagttgttgcaaaagagtgaaaaccacatttgtgctgactgtggtgcatctgatcccaaatgggcatcagctaatattggggtattcatttgcgtaaaatgttctggcgtccatagaagtctcggtacacatatttcaaaggttctgtcagtgacactggacaagtggtctgacagtgaagttgacttcatga

SEQ ID NO: 63508 - DNA, 205 bp, Zea mays
  Clone ID: LIB3075-012-Q1-K1-C2
caacgtcgaggaggtcaccgaagcggcgccctcgacccccgggaacaacaaggcctactgtgatgaccacggcacttgctaccggaaccataaccaagacgtcgaaccccaaaagccctgttgcggcggccaacccatacaccctctgctagaacaagatcacttgatgctgatgcttatcgatggcatgcaagcatatatatac

SEQ ID NO: 63509 - DNA, 247 bp, Zea mays
  Clone ID: LIB3075-012-Q1-K1-C3
gactacgtggagcgtccgtaaaagacgaccttgccaagagcgcctatggctacgattacgcggtggtagccgtgggcgaacccccatgcgccgagacggccggagacaacaagaacctgaccatgccggtggctgagccctaggtgatcaaggacctgtgcgggctcctgaggtgcgtcttgctactacggtgcggccggccgcttctgctgcaggcagacgtggacttcatggacgctgtcggcgt

SEQ ID NO: 63510 - DNA, 402 bp, Zea mays
  Clone ID: LIB3075-012-Q1-K1-C4
attcatcggtcaaagacaaaagatgattgctgtgagcatcatgtggtcattagtgcaggtgcaggtgctggcggcgatggcactagcatttctggtaggcggtgcctggtgtggtcctcccaaggttcccccgggtaagaacatcacagccaactatggtagtgattggctagatgccaaggcaacatggtatggcaagccaacaggtgccggcccggacgacaatggtggcggatgtgggtacaaggacgtgaacaaggcccctttcaacagcatgggcgcatgtggcaacgtccccatcttcaaggatggtctaggttgtggatcctgcttcgagatcaagtgcgacaagccagcggagtgctctggcagcccgtggtggtgtacattacagacatgaac

SEQ ID NO: 63511 - DNA, 400 bp, Zea mays
  Clone ID: LIB3075-012-Q1-K1-C6
ggagcaatcagcatataatcaagctatgcaacaaaatatttgtgatgggaaaattcaccctcttacagtccattcactgtacgtctacatacaactcctctctatgcaaactaatggagtattgtttgagtccagctgttattacgcttcaggaccgcctgaaggaaaatgaacttcggctatctatgttaaaagaggagtgtaagcaactggaggctgatacccaaggcattgagaaatggttctcctcgtcgcctcatgaatcacggagctggtggcagcggttcacctatggctcagagcaggcatcctttctccagccaaaggagccctagaagcccgagcggcggcagccggaggagggcttgatgatgatcttgctccgcctgatgcgttgatg

SEQ ID NO: 63512 - DNA, 290 bp, Zea mays
  Clone ID: LIB3075-012-Q1-K1-C7
caacaaaacaagtgcacacaaataaatacctggctcgctagattgccaagagcaatggcctgtaggtcatccatcctgctcgccatggtggcgctggctacgctattcgcggtcggttcatgcaccaccccgctcaccttccaggtcggcaagggctccaagcctggccacttggtcctcacccccaacgttgccaccatctctgacgtggagataaaaggagcacggtggtgacgacttctcctttacgctcaaggagggtccgactggcacttggacgcttgacacca

SEQ ID NO: 63513 - DNA, 480 bp, Zea mays
  unsure at all n locations
  Clone ID: LIB3075-012-Q1-K1-C8
gcacggtggactctctcctgatctagcacacttggatgagataaagaacttgcagcgtccaactgatgtaccagatcaaggtctactgtgtgacttgctttggtcagatccaggaaaagatgctcaagggtggggcatgaatgatagaggggtctcatatacctttggtgctgacaaggtttcagaattcttgcaaaagcatgatncttgatcttatctgtcgtgctcaccaggttgtcgaggatgggtatgaattttttgctgacagacagcttgtcaccatattctcggcccccaattattgtggtgaatttgataatgctggtgcaatgatgagtgtcgatgaaactttgatgtgctcattccaaattctgaaacctgctgagagaaaaaacaaatttatggggtccaacanaatgtgatagtgaaagccattttgctccagcagctctagcctgttaaggttctcctgtggatgca

SEQ ID NO: 63514 - DNA, 357 bp, Zea mays
  Clone ID: LIB3075-012-Q1-K1-B12
gcaaacctgcagtcatctcctccatcaccaccaaactcaacaacagccagctcgcgaaaataatgaagagccgcagcatggcatcatcggccgcgctcttggtgctagccctcgcgctagtggcggccaccgccccacaggtagcggaggcaaagaagaagagagcggcggaaagcggcgaggcggcggaggcgaagaagatccaagacgacttctgctcgacgctgtgcgagggcaaaaaaggggacggacctggtcgtgtgcaaggagtcctgcgcgctctcccagcagtccaacctggtgctgtacggcaggatccagtgcaagggcaagtgcaccgagcagaagggcatcacg

SEQ ID NO: 63515 - DNA, 462 bp, Zea mays
  Clone ID: LIB3075-011-Q1-K1-H6
catctgctgagtcggaggactcggtgtcaggtgttctatatgatatgttgcaaaaggaggtgatttctctaaggaaggcgtgccacgaaaaggatcagagcctgaaagacaaggacgacgcagttgagatgttggcaaagaaagtagatactttgacaaaagctatggagtcagatgccaagaaatcgaggcgcgagctagctgctatggagaaggagctggcagctgtgcgcttggagaaagagcaggataacagggcaagacgttttggtagttcaagcggttctgccagcagttcgcagctcccacctggcaggactttacctaggagcggctcggcgcgcaacatgtgaaggcatgtaggaattgaccgaatatggctttgatgatccttacttggattaggactggtgactgggaaggaacctctcattgtcctggagaagatggcatcagcggaag

SEQ ID NO: 63516 - DNA, 360 bp, Zea mays
  Clone ID: LIB3075-011-Q1-K1-H7
cggacgcgtgggcggacgcgtggggcgctgatcaagcacgcgcacccgacctggtcgcccgcggtcatcaaatcggccctgatgacgacggcggagcctaacgacaacctccggaagccgatccaggacgtcaacggcaggccggcgaacttggtcgccattggcgccggccacgtgaacccgaagaaggccatggaccctggcctcgtgtacaacatgacggccatgggctacgtgccgtacctgtgcgggctcaactacacggacgacaaggtgagcacgatcatctacccggagccgccggtgtcgtgcgccaagctgtcaaggctcgaacaggacgacctcaactacccgtccatc

SEQ ID NO: 63517 - DNA, 270 bp, Zea mays
  Clone ID: LIB3075-011-Q1-K1-H8
gactagttctagatcgtgtttggttcatccgattaattaattgttttttttatttacgtgggttgcgattggttaattgtttgttcgttcgttcgtttcgtggtcgtgtgaattgtcgaagggtttgttctgtaatcgtgactcgatgctaatattattatgatcccaattttattttattttaaaaaaacaagaaccctgaactaaaatacaacatatctgacatgaactacaagccataacatgagaaaactcaactacacggacgac

SEQ ID NO: 63518 - DNA, 412 bp, Zea mays
  Clone ID: LIB3075-011-Q1-K1-H9
gttccttgccatctccgaattcccatctgagattccaagggccgcgccgtgcaatcgaggctcgccccgctcaccatatatcggaggctccgcccccgcgcctcgaatccttcgcgagaggtgctgttgtttgccgtgatttgagccgggtggaggtgtctcgcttcttgatcttgagaggtgttcctagttgattgttgggagcgaagaaggcatgataccttctgtgaggatctctcctggctctgcagccttctctggctccagcctacgcttaaaattacattcaattccatccatctctagtctcaaaccctccaaatatgtggtctcctcgctgaaaccactctacctagcaccgctagatggtccacacacttctgagcttaagtcttggagacaaccacttgag

SEQ ID NO: 63519 - DNA, 285 bp, Zea mays
  unsure at all n locations
  Clone ID: LIB3075-012-Q1-K1-A1
tgagaatgaaatcgaccggaatctccttgagctgagagctcgagccaccgacacggttgtcctttattttcagaaggctgcttcggcaggacaaagtactttctttgacgttntaaaatatgttgctgcccagtcaccttctcagaaatcaacgcaacgccttcatcaggaatcacagcagccgccacaacaacagcaaccacaggtgcagcaggcgcaaccacaaaaacaagcagcatctgttatgcgcagagcatcatctattgctgctcggcaagcagcaat

SEQ ID NO: 63520 - DNA, 408 bp, Zea mays
  Clone ID: LIB3075-012-Q1-K1-A10
tgacactcaaggaactgttgaagcggcaaagtggttacacaaagtggtcaaccgccccaatgtctacataaagatcccagctactgcagaatgtgttccttccatccaggaagttatcgctaatggcattagcgtcaacgtcacgcttattttctcaattgcgagatatgaggctgtgattgatgcttacctcgatgggctagaggcttctggcttgagtgacttatcccgagttactagcgttgcatccttctttgtcagccgagtggacacccttattgacaaaatgcttgacaagattggaacacctgaggcccttgccttgagaggaaaggctgcagtagcgcaggccaaactagcaaatcggttctaccagaagacattctctggcccaaggtgggaggcgtt

SEQ ID NO: 63521 - DNA, 444 bp, Zea mays
  Clone ID: LIB3075-012-Q1-K1-A11
cctgcacttaagaagcagctcatcatctccaccgtcctgatgacttttggtattgctctaaggagctggttggcccttccagctaagttcaccatctacaacttcggtactcagaaggaggtttccaactggggtttgttcttctgtgtttcaattggtctgtgggctggtttgattattggttttgtcacagaatactacactagcaatgcatacagtcccgtgcaagatgttgcggattcgtgcagaactggtgctgccactaatgtcatttttggtcttgctcttggatacaagtcggttatcatcccgattttcgctattgctgttagcatctatgtcagtttctccattgctgcgatgtacggcattgcagttgccgctcttggtatgctgagcacaatcgcaactggtcttgctattgatgcttatggtcccatcagt

SEQ ID NO: 63522 - DNA, 188 bp, Zea mays
  Clone ID: LIB3075-012-Q1-K1-A12
tcatcattttcttcttcccgaaaacttttcacattccgcgaaggagctatattaaccttgcggctaaccacaccatctacaactttcctactcataaggaactttccaactagtgttccttctccctcttttacttgttttccgtactgcatttattattgggtttgacacacaatactcctctaaca

SEQ ID NO: 63523 - DNA, 274 bp, Zea mays
  unsure at all n locations
  Clone ID: LIB3075-012-Q1-K1-A2
gggaaaagaatcgtgggctgtgacctgtcgtcttcgtctccggcagagcaaagcggcggcgaggcgggagatatagaggagagacgagagcgggatggggtacctgtggagggtgcggctgtcttcatttgctgccggcgcggcgacngcttcggcggcggggttcttcctcctctacaaagaccacctgctcgcccgcgctgccatcatcagccaggtggaggacatcaaggaaacttctgaaaagcattatgcagccctaaataagaggata

SEQ ID NO: 63524 - DNA, 396 bp, Zea mays
  Clone ID: LIB3075-012-Q1-K1-A4
atcacgacaagatggcgtgcacaaaccatgcgatgagagccttgttcctcctgggcctcttctgcatcgtgcatggtgagaaagaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggtgacttccttgtcggacaactcaacttcacaggcccttgcaagggcgacgtgaccatccaggtggatggcaatctgctggcgaccacggacctaagccagtacaaggggaccatggtaatggatcgagattctacgtgtggat

SEQ ID NO: 63525 - DNA, 335 bp, Zea mays
  Clone ID: LIB3075-012-Q1-K1-A5
caccttcgacgacccccttcttcttctcccctccctcaatcacctgcagcgaaaaggaaaagggtgtgagaccgtaactaagagctatttagcaataatacatacatagctataccctctttaggtcaagagggtggagttctccttattcggaggaagagctccatcctcattctacaagaccaaaccaataaatggcctctagcccacagtcctcgccatcattctccaagaagtcgccgccaccacaagaagcatcagctttggcgccaaaatcatcttcaaagtcaccctcgccaccaaagggtgaatcaaattcatctcccagtccccca

SEQ ID NO: 63526 - DNA, 336 bp, Zea mays
  Clone ID: LIB3075-012-Q1-K1-A6
ctccacttggtgctgcgccttaggggaggcatgcagatctttgtcaagaccttgactggcaagacaatcacccttgaggtggagtcctcagacaccattgacaatgtcaaggcaaagatccaggacaaggagggcatcccacctgaccagcaacgtctcatctttgccggcaagcagttggaggatgggaggacccttgctgactacaacatccagaaggagagcaccctccacttggtgctgcgtcttaggggtggaatgcagatctttgtgaaaacccttactggcaagaccatcactcttgaggtggagtcttcagataccattgacaatgtc

SEQ ID NO: 63527 - DNA, 164 bp, Zea mays
  unsure at all n locations
  Clone ID: LIB3075-012-Q1-K1-A7
acgcgttcgcggacgcgtggngcagtcatctncttcaccaccaccaccaagctcaacaacagccagctcgcgaaaataatgaagagccgcagcatggcatcatcggccgcgctcttggtgctagccctcgcgctagtggcggccaccgccccacaggtagcgga

SEQ ID NO: 63528 - DNA, 336 bp, Zea mays
  Clone ID: LIB3075-012-Q1-K1-A8
ctcaagggaaaggagccgtgcagcttgggaagctattgatgagtatttgatgcccttcgtggaaaaagaaaaatatgaactcccaagcaaatgtagacttcgtcctgataatgacatgtttcgggagcaagagcaacataagattcattttgatattaatgagtggcactgtggcttttgcaagaaagctttccgagcagagaagttcattgatcagcattttgaaaatcgccacaagaatcttgtggataatagtgaaggaagatgcatggcagatctatgcggcgcactacattgtgatctgatgatgcagttcaaaaaaccaaaaagttaatg

SEQ ID NO: 63529 - DNA, 257 bp, Zea mays
  Clone ID: LIB3075-012-Q1-K1-A9
gtttcagatgcagttgttgaaaaggctgcagattatgctcttgtatggatcaataggctgctggctgtcggtcatgacatcgccatcaagagaaataggaaagtttttataaaggtgatattgattttgtggctggtttcatttgttggaatgctcttcaactttcttacactcatttacattggtgtaatgctttctctgttggttccaccactctatgagaagtatcaggatcaggttgatgaaaaggttggcgt

SEQ ID NO: 63530 - DNA, 305 bp, Zea mays
  Clone ID: LIB3075-012-Q1-K1-B1
aaccgcaacaatggcggccatggcgaacacctctcgtctccccaccccctgcagcctcccaaccatcagcatcggcgctaagagcaggaggctagctgtggcggccgtcagatgcggtcccggcggcagcaggagccaccggaggagccttggggtcttgctgtgtcgatcctcgtccacggccggagcccaagggagcacgaggatggaggactataacaccgccatgaagcggatgatgcgtaacccctacgagtaccatcacgatctcggcatgaactatgctgtcataagtgagagcttga

SEQ ID NO: 63531 - DNA, 360 bp, Zea mays
  Clone ID: LIB3075-012-Q1-K1-B10
cccacgcgtccggttggcaagagaggagggccggcgtcggcgtgcctagctcgatcttgaaccatagctagccagcatggcgcccagcagcagcatagcagtactgctgctcctcgtcgtcgccgtcgtcctctccaacgtcccctcctcgggcgccctggcctcctcgtcgtcgtctctgctgcaccagtcgtctccgtctgagagtgagactgagaccgacagtagcagcggagaatcttcgtcgtcgtcgtcgtcggaggaggaggaggcccggcgagaaggagaaggagaaggagcaagagatggagaaggccggtcgcggcggagaaggctgcccagcaggagctgctcaagtac

SEQ ID NO: 63532 - DNA, 461 bp, Zea mays
  unsure at all n locations
  Clone ID: LIB3075-012-Q1-K1-B11
cccacgcgtccgggaacttatacatgggatcaagaagaggatcatgatgaaggatgcgagagttcagtacctctcattggtcctgcttgagactattgttaagaactgtgagaaggccttctcagaagttgcggccgaacgggttcttgatgagatggtcaggttgattgatgatcctcagaccgtggtgaataacaggaacaaggcccttatgctgattaaagcatggggagagtccggtgatgaactccgctatctgccagtctatgagggaaaccgtacaagagcttgaaaatcaagagtgcggttttctggacgtgacaatgagagcttggctcccatatttactcccccacgatcagttgctgaagctgatgttgaaaccagcttgccccagcaggcgttcgaagacgtncatgttcatacatatactgctgaagaaacaaaagaaagcgttgatg

SEQ ID NO: 63533 - DNA, 421 bp, Zea mays
  Clone ID: LIB3075-011-Q1-K1-H5
gatgccaggtggtctctacatgccattaaagtttggggtgacttgctaaacaaaaatgcacttcgctgggtgttggctaaggagaattgtagcataataattgggactatgtttcgacgatttagaaggcaaggtgttcattccaataaacataaaaaattttcactggtacctggcgattgtcaatgctaaaaaaaatgaggtacatatactcgattctatgggaccacaaataacggatcgtcgagacctttatactacaggtttcttgcggtctatggatggtgaactatatggaatattggacagggtcttctttgtctaataacataactcagaatgatataacaaagtttagatttaagctacctgcaatattgtggaactcaagattaaacacaaagaaaggacatcaagagac

SEQ ID NO: 63534 - DNA, 466 bp, Zea mays
  unsure at all n locations
  Clone ID: LIB3075-011-Q1-K1-G2
aacagattatactatggagagggaaggttcgccaagagcgttctgtttcagcagagtgcagttccagcccacaatgatgcacgcatctgccggtgattcacaggagttattattgcgctgcgatattgatgatggttcgggcggattgctgtctgtggaccgtggtgggggcgaggggcgaagccggccaccagtgattcagtgaagaagaaaacaaaccaacacatttgtgtaatcaactttgatgaaacttcaattgaggcgcggcacaaaaatggtgaatatggcacttagatgcattgtttcgatgaatccagggtttgtgaatttagaccgtttgagaaagtttttgtagaataaagctcagcctgttcatttgcttttaatctttatcggctgtttttacgttgttttgcttctatcaattgtagcagctacaataattcgaacaattgactntaatatg

SEQ ID NO: 63535 - DNA, 432 bp, Zea mays
  Clone ID: LIB3075-011-Q1-K1-G3
gccaccatctatccatagaggtgcgaggccatggcggcccaggaggcggttccgatcgacgccatcggcagccagctggagataagtctcgtcgggctggagcacgcggtccttctcactaacaatctcgacctcgccggacagaccttcgtcgtcgaaaaagtccaggtgcgccaggcgccggccttgcttgaggtcatccagagggccgtctgccatcccaagaggaagtgggtggtccgcatacccaacaccttgaagttgcgccacatcgccaggatttcgaatgagatcgaggtggtcgttgccgtcgtgatccctcaactgctccgcgacaatgttgaccccaccggcgcgcgactcctacgccgctacgcttggtccatctgtcatgcggcgaggaaggtggatggcgcccccaggattcctggg

SEQ ID NO: 63536 - DNA, 465 bp, Zea mays
  Clone ID: LIB3075-011-Q1-K1-G4
tcgcagattactccataccatcatctgccagcgaaacttttgctgatgtccttaaacaagctggtggaaaagtagagttacaattgtataaagggaaaacacatactgatgtatttttacaggatccactaaggggcggcagggacaaactggttgaagatgttttatctgtcattcatgttgatgatgcaagtgcgcgtgagagggacgcttcggcacctacccctgagcgcctggtttatgaatggcaaattaaattggcccgccaaattagtcccttctaaacaggtctgtacacagaaaggatttgttccaagacttcaacaagcatgtgttgcaacgtgataaactacgtggggtacatgatatttcttgggattttcactgggtcaagcaaacgcagcttcaatctttgtttgcagggcgccagttgccaatgatggcagaagatttgccactgatgga

SEQ ID NO: 63537 - DNA, 405 bp, Zea mays
  Clone ID: LIB3075-011-Q1-K1-G5
tttactttgcccgctcgggttaccctgtggacccaacagatcctgaatatgagcagaaatctgcatttgggaggacgcaccctgttgtggcattcttgccaaaatcaaaagctggtaaaaagaagagcttgcttggggattcagaagagcctgaagagcaagcaccacctaaggggaataaagaatttgaggataaagatgagggtccgactgaatatttatcttattggaaaccaaatgtaacagtaaatcttgttgaagacttcacacggtataccaacaataatgtaccggccatcgttgctccatatctgaatgtggatccagctacaggcgattattatcctacagtattcttcaacgagttttggcttttgagggataaattaatagcgctcaatgaga

SEQ ID NO: 63538 - DNA, 393 bp, Zea mays
  Clone ID: LIB3075-011-Q1-K1-G6
cccacgcgtccgaaaagggacttccgttccgtgctagcgcgcgatcgcgtcggcctccactccaccttcccgaaaaagcttaccctttgtgtttgtgtgtctgtctggcaatcgatcgatctccatgacgacgtccccgccgcgcgcacgcctgctcgccatggcgctggcgctggcattcgcctgcgtgctgctcgtcaggtccgcggacgccgtcacgcccggcggctccgcgtacgggtgcaacccggccacggacaggacgtgcaggcccgagggcgtcggggtggtgctgcccgacggcggcattgacctcgacggcgacggcgacgaggacgagctgccgcagttcgacccacacttcacgatcctcggccatgcccagtgagtgtg

SEQ ID NO: 63539 - DNA, 487 bp, Zea mays
  unsure at all n locations
  Clone ID: LIB3075-011-Q1-K1-G7
tcgtctcggcgaaggagtcgtctctccgtgcccacatcatcgcgtcgtccgtcagctctctcgtcagtctcgcatcctggcctccagcgactctgtcagtgcctcgtgtcgctacgtcgtcctcgagccgcggctgcggagcatctgggacatcataatggcggcagtcggcggagatcggtaggtttcgcggcggcgagagtggcaggtgtgcgacgctcaggnccggctgcgcacccagccccggcggcggcggtggcaccgcagcctaggagggcggtggcggcgcagtcgctgcagacgaccgccaccgaggcgctgacggcggatctcgccggcacgaccaacggcgctgtgcatgctcggatgaatagtaaggctacacgtgaaatcacttcacaggcagttactgcaaattctaggagaaagacatagatagtctgcaccataggtccctgaaccaacactcgtgagatgatttggaagc

SEQ ID NO: 63540 - DNA, 467 bp, Zea mays
  unsure at all n locations
  Clone ID: LIB3075-011-Q1-K1-G8
gagcaacagcggtcttccggtcgctgggagcatgagcgtcgagcgccaactccactccaggccgccgtgtttggctcgacgatgggatgtccacctgctgccacaaggaacgtcgaaggcccttggaggcaccacgacgcaaacccagcacgggagggaggtttcgggtatcctcatacccataacttcctcccgaccaatggtatggctcctggatcgaacccattccttcagcaattccacatatggtgcatgatgcttttggaagtcatccacattctcaattcgaccgacctctgggtaacatacctaaggttccatttccggngttcgatggggaaaatcctaaactatggcagacacgatgtcaagattatttcaccatgtattctgttgacactagtgtgtggattaggattgctcgcatgcattttacggngtctgcagcacgatggctccaatcggta

SEQ ID NO: 63541 - DNA, 471 bp, Zea mays
  Clone ID: LIB3075-011-Q1-K1-G9
cggacgcgtggcgtgggatcgagttgtttcactgcacgagcacatcctccggcgaccaccggggtccctcttcgtcctctagcgaccgaccaacgcgccgagcgaagatgtcgtggcagacgtacgtggacgagcacctgatgtgcgacatcgagggccaccacctcacgtgggcggtcatcgttggacacgacggcgccacctgggctcagagcaccgggttccccgagtttaagcccgaggagatggctgccatcatgaatgatttcgacgagccgtggcacctcgccccgaccggcctgatcctgggaggcaccaaatacatggtcatacaaggcgaacctggagctgtcatccgtggcaagaagggatccgggggcattactgtgaagaatacagggcagtcactcatcattggcatctacgacgagcccatgactgccggcagtgcaacctggtgtggaaaggctg

SEQ ID NO: 63542 - DNA, 351 bp, Zea mays
  unsure at all n locations
  Clone ID: LIB3075-011-Q1-K1-H1
agggaacatcgtccatccgagctaagtaattaggtcgaaaatgacccgtgccagcagcagtagcagcagccggcgtgtgacgctggtactgctcggtctccgcctgctgcttctggttggtgttgcgcatgcggtagtggagttggtgcctgctgatgataatatcgccgtcgccgctgctggcacggcggtggacgatggcgagccgtctcagcagtgcgcgaccccggtgagcgtggangaagcgtgccgcggcgcgttcgagacgcacgccggcgtggcctacgaccactgcatggcgtcgcttggcgccgacccgcgcagcaaggatgccggcaacaagaacatgca

SEQ ID NO: 63543 - DNA, 372 bp, Zea mays
  Clone ID: LIB3075-011-Q1-K1-H10
atggtcgtgggcgccgtacttgcggtgctcgatgccggcggctcgtgcgggcccccgaaggtgtcacccgtccccaacatcaccaccaactacaacggcacgtggctcaccgctagggccacctggtacggtcagcccaacggagccggcgctcctgacaacggcggtgcgtgcgggatcaagaacgtgaacctgccaccctacagcggcatgactgcgtgcggcaacgtccccatcttcaaggacggcaagggctgcggctcatgctacgaggtgagatgcaaggaaaaacctgagtgctcgggcaattcagtcacggcgtacatcactgacatgaactacgagcctatcgcttcctaccacttcgacttg

SEQ ID NO: 63544 - DNA, 410 bp, Zea mays
  Clone ID: LIB3075-011-Q1-K1-H11
gccgaaggcctcgtgccttctcttcctccctggcatggaggaagtagctgtttcgccgatgatcgttgccgccgtagtgctggacaacaatggcgctgacgcggtctcctgcactgccatccctagcgtaacaataagcctagaggagaaagaaaatatcaatggggatgttcccacgatcacctcggccgcaagcaacgaggaggaggcgttgttcagtgtcggagaatccaccaaggacgatggccatcgcttgacgatggaatgctccactcccgtctccttcagtagcccttccactcgcaagaagcgcggggcgttcagcctcttcagggcgatgttcctgtccttcggtcggagcgacgacagcatgaagaagacagacgaagacaccacgagccccaagaaga

SEQ ID NO: 63545 - DNA, 251 bp, Zea mays
  Clone ID: LIB3075-011-Q1-K1-H12
tggatttttaggttgaaaggcaatgggctgttgatcagtgtggggagggagtggaaggaccgagggggcacggcaacggatgaaaagggggatggcgctccctggtatgaggaaaatatttcgcatagaatcacccgactgagtacaagacattttgagttttgacagagaaagctgcttacatcaaacatgttattagctgaattctgtagatgaactctttttttcgatggaaatagctacttcatgtt

SEQ ID NO: 63546 - DNA, 462 bp, Zea mays
  Clone ID: LIB3075-011-Q1-K1-H2
gcagatccacaacaggacgttcgcggcctacagctcgcggttcgcgttcccgtcggaggagagcgggtcctcctcgccgttctactactcgttcgacgccggcggcatccacttcgtcatgcttgcgtcctacgccgactacagcagatcaggtgcgcagtacaagtggctggaggcggacctggagaaggtggacaggtcggtgacgccatggctgatcgcgggctggcacgcgccctggtacaccacctacaaggctcactacagggaagccgagtgcatgagggtggagatggaggagctcctctacgcctacggtgtcgacgtcgtcttcaccggccacgtgcacgcgtacgagcggtcgaaccgggtgttcaactacacgctggacgcgtgcggccccgtgcacatctcggtgggcgacggcggcaaccgcgagaagatggcgacggcgcacgcgga

SEQ ID NO: 63547 - DNA, 407 bp, Zea mays
  Clone ID: LIB3075-011-Q1-K1-H3
caccgacacgctcaagaacaagttgaacttcatgggcttcgtgatcccggactggcaggccgtggaccgcatcacgaacccgtcgcaccagcactactaccactccatcaaggagacgatccacgccggcatcgacatggtgatgatcccctacgactacccggagttcgtcgccgacctggccaagcaggtgaagcaggggcagatcaagctggagcgcatcgacgacgccgtcagccggatcctccgggtcaagttcgccatgggcctcttcgaggacccgctcccggacccgcgcctcaccaaggagctcggcgcgcatgagcaccgggcgctggcgcgggaggccgttcgcaagtcgctcgtgctgctcaagaacagcaagaaggggcaggcgaagccgatgc

SEQ ID NO: 63548 - DNA, 463 bp, Zea mays
  Clone ID: LIB3075-011-Q1-K1-H4
cggacgcgtggggcggcgccggcgtgctcgtgatctcaacccaaggcgtgcctccgctccggtcacccgtcactccacgcaaccatgtcgaggaggaagaccagggagcccaaggaggagaacgtcacccttggacccactgtccgtgaaggagagtatgtctttggtgtcgctcacatctttgcatccttcaatgacaccttcattcatatcactgatttgtctgggagggaaactctggttcggatcaccggtggcatgaaggtgaaggctgaccgtgacgagtcgtcaccttacgctgctatgcttgctgctcaagacgtcgcacagcgctgcaaggagcttggcattactgcactgcacattaagcttcgcgccaccggaggcaacaagaccaagacccctggacctggtgcccagtctgccctcaaggcgctggctcgttccggaatgaaaatcggac

SEQ ID NO: 63549 - DNA, 361 bp, Zea mays
  Clone ID: LIB3075-011-Q1-K1-G12
gacccacgacgtacgcggacgcgtgggttcgttatcctcctcgatcttatattcaggtcatagctaagcaggtctgtgcaggaggtcgtggcagacatacgtcgatgagcacctgatgtgcgagatcgatggccaccacctgacctccgctgccatagtcggccacgacagcgccgtttgggcccagagcaccgcattcccacagttcaagacagaggagatgaccaacatcatgaacgacttcgactagcccgggttccttgccccgaccggcctctttcttggccccaccaagttcatggtcatccaatgcgagccccgctgctgtcattccgcgggaagaagggatctggatgcataa

SEQ ID NO: 63550 - DNA, 101 bp, Zea mays
  Clone ID: LIB3075-053-Q1-K1-E7
gagtttgcctgcttctggtgttctttatgggtatcgcattaatggtcctcaagggtggcaacaaggtcatagatttgatgacaccgtaatctttttgaacc

SEQ ID NO: 63551 - DNA, 291 bp, Zea mays
  Clone ID: LIB3075-053-Q1-K1-E8
aatttaaaacaggttgctgcctataaactgctggttctcactaacacatacatgtgcagttaaatcactccagtcgagcgacttattcagaagaatagactgctatggagctgtgagctatatacgagagagatcgccatttatatttgatcaagtatctggctttctctttgaaagggggctaaatgcagctgcaggatccaaggaagtagaaccaccatttggctggcctagactaccagctaccactgagtacgtcaccatgtcaaagtttaatcgactggttactct

SEQ ID NO: 63552 - DNA, 245 bp, Zea mays
  Clone ID: LIB3075-053-Q1-K1-E9
agcaaaccgagaggtgaaccagcagcctacaataaaagccagcacattcaaataaaaccgagagacctcagccctcagggaagccgaccgccgacgtaccaccgcgccaacccgagagaaagatggagatgatcaagaggatcctcatcgccgcgctcctcgtagtcgccgtctcggccaccgcagtgctggccttcaccgaggccgccgtcgccggcgccccagccgtctccgagtcgtcggcg

SEQ ID NO: 63553 - DNA, 386 bp, Zea mays
  Clone ID: LIB3075-053-Q1-K1-F1
tgcttgactcccacctagtgccttcttctactgctgctgaatcaaaagtcttctacctgagaataaagggtgcctatcaacgggtttcttgcggaattaaaaactggccctgaaaggaaggattctgttgaaagcacaataatggcctacaaggttgttcaggacattgccctggctgacctggcacctacccatccgataaggcttgggcttgctcttaacttctcagtgttctattatgagattctgaactccccagacaaagcttgcaaccttgcaaagcaggcgtttgatgaagctatctcccagttagacacccttggggaggagtcatacaaagatagcactctgatcatgcagctcctttaggacaacttgaccctttg

SEQ ID NO: 63554 - DNA, 266 bp, Zea mays
  Clone ID: LIB3075-053-Q1-K1-F10
tcgttttttatttctttttttaatcgagagagaatcttaaattaagattccagaaaagactgtctgatgaaaatgtagagagagagaaacaaatggagaggaaaaacacctaaaaaagatcgggtttttttggttttgcttgattattgctgggctattcatgtatcaaactctatagcgagcaaaataaaaaagaccagtcgactacacgacgtccctagatgagctgccgtaagttcggccctactatatggcttttaatcaag

SEQ ID NO: 63555 - DNA, 417 bp, Zea mays
  Clone ID: LIB3075-053-Q1-K1-F11
ctcgttgtcccatctagcccatctgctatcagcgaggacgaaggcacaaacccctcacgtgcctcaaaccctagccctcgctctcccgcttgttcccgtcaccgccatcatgggctcagatgcggacatggaggactacgggttcgagtactctgacgaagagccggaggagcaggatgtcgacattgagaaccagtattacaactccaaaggtttggtcgagacagacccagagggtgcacttgctggttttgatcaagtggtcagtatggagcctgaaaaggctgaatggggatttaaagctcttaaacaaactgtcaagctttactataagctggggaaatacaaagaaatgatggatgcatatagagagatgttaacatacataaaatctgcggtcacccggaactacagcga

SEQ ID NO: 63556 - DNA, 368 bp, Zea mays
  Clone ID: LIB3075-053-Q1-K1-F12
ctaccctcgtcgtcgtctcactcaccccgccttcacgcctccctcaccaaataaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctactgcgacacctgccgcgccgggttcgtgaccaatgtcaccgagtacatcgcgggcgccaaggtgaggctggagtgcaagcacttcggcaccggcaagctcgagcgctccatcgacggggtgaccgacgcgaacggcacgtacacgatcg

SEQ ID NO: 63557 - DNA, 248 bp, Zea mays
  Clone ID: LIB3075-053-Q1-K1-F3
cggacgcgtggggaaaattacttaagttatagtattaattgtcagtaaaaaaatatttattttcaaatagttaaaatggagatataaataaattgaacaattttgcatagataaaattttatgaagtgtttgttatttacgtgcatttggaatgttttttgatttctcattattgattttagatattgaaaattcacataactaatataataattattagtctaaaaataaatattttacttataaat

SEQ ID NO: 63558 - DNA, 416 bp, Zea mays
  Clone ID: LIB3075-053-Q1-K1-F4
ccgcagccgccctagcacccgcgacgagcaggatctgcccagttgctcttgcggtagttgccgcaactgtcaccatgcagaacgaggagggtaagactgtggacctctatgtccccaggaagtgctcggccacaaacaggatcatcactgccaaggaccatgcctctgtccagatcaacattggccacttggatgcgaatggcctgtatgatggtcacttcacaacgtttgctctctctgggtttgtccgtgctcagggtgacgcagacagcttcttggacaggcttgggcaaaagaagaaggctgatataaagcagtagattttacatctagtttaccaagatttggacaccgccttaactatgctttgaaatcatgtcactatatgcaatggtgtgatttcagctgggacctta

SEQ ID NO: 63559 - DNA, 256 bp, Zea mays
  Clone ID: LIB3075-053-Q1-K1-F5
gacaattcttgacttccaagcagtgcaaaagctgctgacctccccaaagtttacattcggttatgatgcactccatggtggtgcgggagcttattctaaacacatctttgtagaagagcttggtgctgatgaaagctcactgttgaattgtgtaccgaaagatgactttggacgtggtcatgcggatcctaaccttacctatgcacaagagttgcttgaacacatgggtcttggaaagtcatactcaaatgttgag

SEQ ID NO: 63560 - DNA, 212 bp, Zea mays
  Clone ID: LIB3075-053-Q1-K1-F6
cgagagagagagagagagagagaggtagacggagatggagtgcctgcttgggctgctcaaggtgctggtggtgcgaggagtgaacctggccatttggaaccggttaacccacagcagcgacccctacgtcttcttcggccacggaaagcataaagggaattcaagtttaaaataccgtacgatcaacccaaattggaacaaggagttaacct

SEQ ID NO: 63561 - DNA, 163 bp, Zea mays
  Clone ID: LIB3075-053-Q1-K1-F7
tcgcgacaagatggcgtgcacaaacaatgcgatgagagccttgttcctcctggtcctcttttgcatcgtgcatggtgagaaggaagagtcaaagggcatcgatgcgaaagcgtacgggcctggtgggtccttcgacatcaccaatttgggcgcctccggcaat

SEQ ID NO: 63562 - DNA, 230 bp, Zea mays
  Clone ID: LIB3075-053-Q1-K1-F8
aacgacagcaagctgtaggcgaagctgccgaccattgtcttcaggcacaatgacggagccttgactacatgctgggaccggggcaatttctccaattgagatgtttcagtccgtctttacacttgttgaagatgaaatgatgggtgatcctgcatatcttattgctgtcatcatagagtttctacggagtgtcttaaatgcttggcttaaggcttcttacaacctttatg

SEQ ID NO: 63563 - DNA, 173 bp, Zea mays
  Clone ID: LIB3075-053-Q1-K1-F9
gaaggcctcgtgccttatcttcctccctggcatggaggaagtagctgcttcgcctatgagcgttgccgccgtagtgctggacaacaaaggcgctgacgcggactcctgcactgccatccatagcgtaacactaagcctagacgagaaagacaatatcaatggggatgttcaca

SEQ ID NO: 63564 - DNA, 343 bp, Zea mays
  Clone ID: LIB3075-053-Q1-K1-G1
atttttctggccaattatcttatgcagtggccgaggccccgaaagaggctcttcctcataattgtcgacctgattttggtgctgcttggtcaacaacattaaagttcaaggtcaatgaatcgtacagctgcagatatatgctaggtagtaacaaggctgatattcactcgaacaagctattcaattgtactgctgaggaaccttcgactggggagcttttcaaaaggatacttatactggcactttcactgtgtatagtttaagtgacactacctgcagtcgataagttgtgacgttcagacatcccttgctggtctattggttttcagagatgtatgtgtca

SEQ ID NO: 63565 - DNA, 354 bp, Zea mays
  Clone ID: LIB3075-053-Q1-K1-G10
gtacaatggctggttgagccccatgatcctgggtgatttcacagctttcgccgacttctgcttcaagacgtacggcgaccgggtgaagaactggttcaccatcaacgagccgaggatgatggcccagcatggctacggcgacagcttcttgccctccgccagatgcaccggctgccagttcggcggcaactccgccaccgagccgtacatcgtcggccaccaccttcttctcgcgcacgctgccgctgtcaagctgtaccgcagcaagttcaagggtcgtcaggccggccagatcggcattctgctggactttgcgtggttcgagccgctgaccaagttcgtggatgacgagta

SEQ ID NO: 63566 - DNA, 296 bp, Zea mays
  Clone ID: LIB3075-053-Q1-K1-G11
caatgtgtgccgcggtgagggcttcttggccggcaggtgcagcaccttccgccgccggtgcatctgcactaggcagtgctaaacaagatcgctcgatcgctcgccatgcatcgacaacctattcttaataacgttcattatctcgttcttatttatgacgaatgtcatgtatgttctggtgactgtcatgtatattctgatgactgtcatgtatcttgttcatgtatgctcaaggttcattatcttgttcatgtattaagtatgttatgaataactcaatatttattatttcgttc

SEQ ID NO: 63567 - DNA, 325 bp, Zea mays
  Clone ID: LIB3075-053-Q1-K1-G12
gcgcgacaagccagcggagtgctctggcaagcccgtggtggtgtacattacagacatgaacgacgagcccattgcggcgtaccacttcgacctagcaggcacggcgttcggtgccatggccaagaatggcgaagaggagaagttgcgcaaggcgggcatcatcgacatgcaatttcgaatggtcaagtgcaagtatggatctaaggtcaccttccatttggagaaaggatgcaaccccaactacctggccctgttggtcaagtaccttgatggagatcgtgacattgttgcagtggacatcaaagagaatggctatgacacctac

SEQ ID NO: 63568 - DNA, 256 bp, Zea mays
  Clone ID: LIB3075-053-Q1-K1-G2
aaccctagccgccatatctcacgatccactcgagcaccaagccgagggaaggtgaggagcgatggcgcgcggcgtggtgtcggcgaagggcggcgcggtcgcgggcaagaagaaggggtcggtttccttcacgatcgactgcaccaagccagtggaggacaagatcatggaggtcgcctcgctcgagaagttcctgcaggagcgcatcaaggtcgccggcggcaaggctggcaacctcggcgactccgtcaccatc

SEQ ID NO: 63569 - DNA, 351 bp, Zea mays
  Clone ID: LIB3075-053-Q1-K1-G3
gcaaacctgcagtcatctcctccatcaccaccaaactcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggca

SEQ ID NO: 63570 - DNA, 332 bp, Zea mays
  Clone ID: LIB3075-053-Q1-K1-G4
gatccatcttgggcgggcgccgcgcgtcgagggccagccaaagcttgccatggcggccgtccggtccgacagggtccagcaccaccaccgccgctccgaggcgtcgtgtccggcaacctccgcggccgtggcggcggcgagggccgatgacgccctgcgccagcgcccgcgggggctcgtgcacgtccgggagcgggaccagggcccgctgtcgacggggcaccagcacctgcaccaccatcaccaccagctgcggcggtcggcggcgttcccaccccgtcgtccggggccggtgcgccggccttctcagcgctgcgaaagcgacctcaaca

SEQ ID NO: 63571 - DNA, 163 bp, Zea mays
  Clone ID: LIB3075-053-Q1-K1-E6
gcttgagctgaggggggagggaaggagctgattgcttttgctgaagaataatggtgtagtcagctggggtgaggcgatgtgcgttgtcagataaagcttagtcttgttgactctactaatctgatatcaattggtaaccaattggttaaaaaaaaaataaaaa

SEQ ID NO: 63572 - DNA, 282 bp, Zea mays
  Clone ID: LIB3075-053-Q1-K1-G5
gtccagatccgcggcatcacgctgctcaacagcaagttcttccacctcaacatctgcgagtgcaagaacgtgctgggcgacaaagtgacggtcaaggcccccggcgacagccccaacacggacggcatccacatcggcgacttcagcaacgtgaccatcagcagcaccaccatcggcgtcggcgacgactgcatctacatcggacccgggagcaagatgatccgcatccatggcgtcaagtgcggcccaggccacggcatcagcgtcggcagcctgcggcgc

SEQ ID NO: 63573 - DNA, 83 bp, Zea mays
  Clone ID: LIB3075-053-Q1-K1-C6
cttcccttggaatcaacaaccttcaacagaccatctattggtctaatatgttttggcacaatcgggttatttccaaaagtttt

SEQ ID NO: 63574 - DNA, 324 bp, Zea mays
  Clone ID: LIB3075-053-Q1-K1-C7
aagacaatggtggaagggcctccaaacccaaaccttgtgacatagttgttcaaaatgggtgcttcaaagcctgaaagggaaccaggcaattcgtcaaacaaaagagcaacggataaaatggacgactttggccacaaggatagtttctctgaagtgtcctatgaatactgtgtaagggtggtcacgtggctggagtgtgagggctatattgagacaaacttcacgatgaagtttcttacatggtttagcttacgtgccaccctgcaagagagaaagatagttagcgtatatgtggatactcttatcgaggaccctgtcagtctc

SEQ ID NO: 63575 - DNA, 211 bp, Zea mays
  Clone ID: LIB3075-053-Q1-K1-C8
ctctcggcctcatcaggcccgctgccctccaccttcgcctccgcctccgtctccggcgggcccctccgctggatcgagtagaagaatcgagcgccgctactggcgaggggctagcggtcggcgcacagcgcggtatggcgagcggcagcagcaacggggagccaagcacggcaccgcatgcgaaccggtggtacgacctccggctgggctc

SEQ ID NO: 63576 - DNA, 158 bp, Zea mays
  Clone ID: LIB3075-053-Q1-K1-C9
gagaggatcagaacgatctgcacggacatctgtcaagcccgagacactgacatcgatgagctctccaccgcgatgatcaggtacaactgccacttcattaagcacaactacgcaatgctcttaagcgccaggtacatccggcttcaacaccacaacat

SEQ ID NO: 63577 - DNA, 329 bp, Zea mays
  Clone ID: LIB3075-053-Q1-K1-D1
ggcgcccgttcaggatccacatcttcccgagcgagttcttggttgacctcttcctcttgggaccacctccaaggctcttggtgtagcttgccactctcaccaatcaagttttcatgtctgatctcgacattcagatcccaactgccttcgatcccttcgctgaggccaatgctggggactctggtgcggcagcagggtcaaaggactacgtacacgtgcgcattcagcagcgtaatggtcgcaagagcctgaccaccgtccagggattgaagaatgagttcagctacagcaagatcctcatagatctcaagaaagagttctgctgcaat

SEQ ID NO: 63578 - DNA, 316 bp, Zea mays
  Clone ID: LIB3075-053-Q1-K1-D10
cctgagtgagagagcttcctcagtccatggaggtgtcgtcgaggctccaaagcctcctcagacccttcctactctgccgctcccgcgccgcagggatgaccctccaaaccctagctctttgctccccgccgcctcctccgcgcatcccatcttccttcctcctccgaacgcgccgtctacctcctccctttccccatggcggcccatcccgtcttcttttccacagcaccttcgccttcgtcttcccggcccccgcccctgctccagggagggaccaccttaacttcaaggaacagggacccccgtccgcgccctt

SEQ ID NO: 63579 - DNA, 332 bp, Zea mays
  Clone ID: LIB3075-053-Q1-K1-D11
tttcgaattccctcctcctccgcctctcccgcagtccctctcctcctttccctcccccgtcgcgatcgctctgtgctccgcctccgtccgtcaaggcctgctcttgcgccgttcctcctcgcccaatccgccaggttctccgcggtgtgttcctgacgctgttgaggcccggcgtgtgcgttgcatgcaggggatggccacattcgagctctaccggaggtccaccattggcacctgcctcaccgagacgctggacgagctcgtctccagcggggccgtcagcccggagctcgccatccaggtccttgtgcagttcgacaagtccatgactg

SEQ ID NO: 63580 - DNA, 316 bp, Zea mays
  Clone ID: LIB3075-053-Q1-K1-D12
gatgttctgtccgggttgtcagaaattaaggtgggtgtttcttatacccagactgatggacagaagctgcaatccttccctggggatcttgatacccttgagcaagtacaggtcaactatgaggttctgcctgggtggcaaagtgacatttcttctgttcgaagatacgatgaacttccccaagctgcccgcctttatgtggagaggatagaagaacttgttggtgttcccgtgcactacattggtgttggacctggcaaagatgctctcatatacaagtaaaagcaactttatttggtccttggttgggcggaaa

SEQ ID NO: 63581 - DNA, 242 bp, Zea mays
  Clone ID: LIB3075-053-Q1-K1-D2
caaagtgcatgatgggaatgcgactggccgtggatccgtccgccgccggggcataaccgcggggccatagccaaggccgcgctcgctgatgccctggtcggggccacgcgaccaagcgctcgagttgcgccatggctgttgcgcgcccgcgcgttcgccggggtccacgccagggccaccgcgcctggatggacgggccaccgatgggaggtcgcgccgggatctgcgggctcgatcgcgcg

SEQ ID NO: 63582 - DNA, 371 bp, Zea mays
  Clone ID: LIB3075-053-Q1-K1-D3
aaagaagtcgcctaattctttcgatcgaattaggcgccttcttcgtcccacgctccgtctttatttgtaatctgaacttggcaggaccatttaatggattaatgaccggtttggtaggctttttgaaggtccggttgttaaggggcataaacctggcttaccgacacacagagaggcagagacccgtatgtcgctataacacttggcaagaagacacttaacacgagcgtgaaaaagatatctgtgaaccctatctggcacggggagctaactttgaccgtcacagatcccactctagctgtaaagctggaggtgttcaacgaggacacgttcagcggggaccacccgatgggcgacgcgaatatcgacgt

SEQ ID NO: 63583 - DNA, 230 bp, Zea mays
  Clone ID: LIB3075-053-Q1-K1-D4
cggacgcgtccgtccacgcgtccggcgagcggcagcggctgcggcgatcggagaagatggtgcgcaaggcgaaagttgagttcgacgagcagccgccggataacttcgacccgaagaacccgtatgccgacccggtggcgatgctcgagtaccgggaacacctggtgcgatagaagtggatccagatcgagaccgccaggatcatccgggagcgccttcgttggtgctac

SEQ ID NO: 63584 - DNA, 371 bp, Zea mays
  Clone ID: LIB3075-053-Q1-K1-D5
agcagcaatggcgctgcttgcctacgactttcctcgcgtcatctcgtgcttcccaatgggtataaatagaactgggttggtccccatggacccatgattctctcagacgccactgcgcctgttcgacgacgcgaagccagaaggcctcgtggtcggagaggctgacgcatagagggactatgggaacgggggtacccgcctacaacggcgctcggggcataatactgggacaggcgtgatcataggggctcactagaggcgcgtgcatcggtccgtggggccaaacacggtctgtgcggaagctattgctctctgggatcccaaagaaccggcgtccgatcattctgcgttggcagcacttttcctatcag

SEQ ID NO: 63585 - DNA, 102 bp, Zea mays
  Clone ID: LIB3075-053-Q1-K1-D6
ctcgttctgatcgcgacgagtcgggctatgatccttccgtcatcttggcataaccgggggggcattatcaaagtggggctcgcttattccctcctcggggcc

SEQ ID NO: 63586 - DNA, 421 bp, Zea mays
  Clone ID: LIB3075-053-Q1-K1-D7
cacgctatgactatgagaatgtcgatgctggggctgctaaggagctgatggcaaacctagtaagcatgcagtcatgactttctgatgttaacaagttgatcaaggagatccggtctgatgtttctgaagtagttgcagctgacgagtttgagtacaaggatccagttgatggctctgtgtccaagcaccagggcatccgatacctcttcggagatggttcacgactggtgttccgtctatccggaaccggttctgttggtgccaccatccgtgtctacatcgagcaatacgagaaggattccttcaagaccggcagggattcacaggaggcccttgctccactggttgatgttgcgctcaagctcttcaagatgcaagagtacactggccgctctgcccccacccgtatcacataaatttt

SEQ ID NO: 63587 - DNA, 302 bp, Zea mays
  Clone ID: LIB3075-053-Q1-K1-D9
cgaagttgcctttgccgtcccttgcggagttggcagcacagctactggtgtacttcctggttgaggactacctcaattactggatccacaggtttctccactgtgagtgggggtaccagaatatccaccgggttcaccatgagttcactgcgccaataggattcgcagctccatatgcacactgggcttaggtgctgatactctgcatcccctacttcggtgggccagtcattgttgcaggccacatgatcacattctggctctggattatacttcctcaagtggaggctatcgagacacat

SEQ ID NO: 63588 - DNA, 427 bp, Zea mays
  unsure at all n locations
  Clone ID: LIB3075-053-Q1-K1-E1
gaagatgcttaatgatggagctgttgagtatgaggatggtacacctgcaactgaagcccagatgggtaaggatgtcgtatcattcctttcgtgggcagctgagcctgagatggaagagagaaagctgatgggagtgaaatggatctttctactatcactagcgcttctccaagctgcctactaccgccgcatgaggtggtcagtcttgaagtcccgaaagctggtcctggatgtcgtcaactaaggactatcattaccctttttttattgaaatatgttgagccgttaaggagcattcaaaataatgagttggtggtgtacaattttgccactggggctaggttccatgcctagaaattattntgctntctttactctgctgagctgcaaaagcatttaccaagggagtacatttcacgggtttttt

SEQ ID NO: 63589 - DNA, 352 bp, Zea mays
  Clone ID: LIB3075-053-Q1-K1-E11
ctggcgaccacggacctaagccagtacaaggatcatggtaattggatcgagattctacgcgtggacaaccttgtcatcaccggcaagggaaagctcgacgggcaggggccagccgtgtggagcaagaactcctgcgtcaagaagtacgactgcaagatccttcccaactcgctggtgatggacttcgtgaacaacggggaggtgtccgggatcacgctgctcaactccaagttcttccacatgaacatgtacaagtgcaaggacatgctgatcaatgacgtcaatgtgacggcgcccggtgacagccccaacacggacggcattcacatgggcgactcgttcggggtcacca

SEQ ID NO: 63590 - DNA, 392 bp, Zea mays
  Clone ID: LIB3075-053-Q1-K1-E12
aaggaggcgggccccaacatctccgtcaagggctacgacgtgatcgaggagatcaagacggagctggagaaggagtgccccaacgtggtgtcgtgcgcggacatcatctcggtgagcgcccgcgactcggtgaagctgtcgggagggcccgaatacgcggtgctcctggggcggcgcgactcgctcgtgtccaaccgcgaggacgccgacaacctgccgggcccggacatcgcggtgcccaagctcatcgacgagttcgacaagcagggcttcaacacggaggagatgatcgcgatgctgggcggcggccacagcatcggcgtctgcaggtgcttcttcatcgagaccgacgccgcgcccatcgacgaggcgttcaagaagaagatcagcga

SEQ ID NO: 63591 - DNA, 382 bp, Zea mays
  Clone ID: LIB3075-053-Q1-K1-E2
gcagccgcccctgtccaaggagttcaccgacgagagtcagccggcggagctggtgcagctgaaccagcagagcgagtacgctccaggcctggaggacaccctcatcctgaccatgaagggcatcgccgccggcatgcagaacaccggctaggccaagatcttcggtgtgcaaataacctgtctcccatgagacggtggacgatatgtgtaggcctgtgagcagttagtacactcggcgccccagtgtgttctgggagggaatttttcaatgtgcagagccctttctctttgtgtgccttggctgtagatgcccagggggagcttaatggcttgtgaagccctgatgcaaaataaaagacgaaactatggtttttggttaact

SEQ ID NO: 63592 - DNA, 219 bp, Zea mays
  Clone ID: LIB3075-053-Q1-K1-E3
gcatccacacaggatgggtgctatcgtaaaaccacatgacagtgaaggcaaaccagagccgcaacatgccgggcaaggtcaggcatcaagcaacccatctcaagggggcggctatcctgcacaaccgcattactaccatggcaggattcaaccttactttcaaccccaacaaccatacgggggttcaatccttcaacgggccatgccttaccaacaaca

SEQ ID NO: 63593 - DNA, 319 bp, Zea mays
  Clone ID: LIB3075-053-Q1-K1-E4
cgccgagacccgggcccgggcgctgtggatcaccttcgcgcgcgacatggtgatcgagcgctgccaggagctcatcgtgagcagcgacaagaccatcgacgggcgcggagcgcacgtgcacatcgtgggcgcgcagatcacgctgcagaacgtgcgcaacgtgatccttcacaacctgcacgtgcacgacgccgctgcgcacggcggcggcgcgatccgggactcgcagcaccactggggcgtgcgcggcgagagcgacggcgacggcgtctacgtgatgggggccagcgatatctggatcgaccacctgtccatgagc

SEQ ID NO: 63594 - DNA, 105 bp, Zea mays
  Clone ID: LIB3075-053-Q1-K1-E5
attagggaaaagatcaattcaatgacagccggtgattactttgagaagtacccgggacttaagaagaactttgttgattaaatacgtaacgattactggggatat

SEQ ID NO: 63595 - DNA, 282 bp, Zea mays
  Clone ID: LIB3075-053-Q1-K1-C5
tcgcacgcacacagcaacaaatacctagctactaacaatggtctccaggtcctacatggtacttgcaacagttatgctggctgggctgaatgcggttggctcagtgcactatccagctcaccttccaggatggcaagggatccaagcctgtacacctgatactcacactcaatgttgcaaccatatgcgacgtggatatcaaagatcactgtggctatgacttatcctttacgctcaaagaaggcccaacctgcacctggacgctttacaccaatgcccggc

SEQ ID NO: 63596 - DNA, 116 bp, Zea mays
  Clone ID: LIB3075-053-Q1-K1-A4
acggcgcccatgatacccgtgcgcatggtggcgctccctcgcttttgtgttgtccgctggccacgagccatacttcgccggtgtgtcagacggcttttgccaccgattaaccctcc

SEQ ID NO: 63597 - DNA, 383 bp, Zea mays
  Clone ID: LIB3075-053-Q1-K1-A5
tcgagcttcacgacgacggtcacattgaccttactgtcattggcccacaccttgaggcaggtcagcgcccccagtatagggtgccaccgaacgtgtggtttgggtcgttccccacactagacgtcgagtcgttcgcatctgatggcagcgttcttgtcaagtctcggaagagggaccctgagctgcattactcccttgttggctgcacctgtgcccctggcttccagtacgaggattttgaaatggccaaatttgaggacgtgagatccatcgctcccaaggctgaacctttcctcaagtttcttattccctctaccgattaactccagagcagccttagatgattgtggatggggtctcagcgactttctatactgcatact

SEQ ID NO: 63598 - DNA, 230 bp, Zea mays
  unsure at all n locations
  Clone ID: LIB3075-053-Q1-K1-A8
ggaaactgcacttggtgtttttttctggatcgacttgtattatcaagcggtcttggaagaatgctactagttcatagtgggcacttncagtagctatgcatcctaagtttcaagtagattctgaagtagttgaatccgttggcccttttggtccaccatttcgaagcggatgattttggaatctggaacctttgaatgtttgccaaaattccgtttatgtccttaactta

SEQ ID NO: 63599 - DNA, 180 bp, Zea mays
  Clone ID: LIB3075-053-Q1-K1-A9
gaagtattgaaataaagctgtagctttctagtccagtactgcactttcttttataagctctagtcaaattttggagcgcctgaactgttttgctgttatataacttagtgtattgataaattcgactatcacatctggattattctgctggataatgtccgtgtctttgatgtttgtgtt

SEQ ID NO: 63600 - DNA, 366 bp, Zea mays
  Clone ID: LIB3075-053-Q1-K1-B10
ctcgcttcagccgcctccgccgcgcgtaccaagcaggtggagacaggatgccggctgggcacggcctgcgctcgcggacgcgcgacctcttcgcgcgccccttccgcaagaagggctacatcccgctcaccacctacctccgcacctacaagatcggcgattacgtcgatgtcaaggtgaacggcgccgtccacaaggggatgccgcacaagttctaccacggccgcaccggtcgcgtctggaacgtcaccaagcgcgccatcggcgtcgaggtcaacaagcaggtcaatgggcgcatcatcaggaagcgtatccatgtccgtgtggagcatgtgcagccgtcccgctgcacagaaaagttccgcc

SEQ ID NO: 63601 - DNA, 382 bp, Zea mays
  Clone ID: LIB3075-053-Q1-K1-B11
agaaaataggttattcattcgtccttctattatctttgcctttgtcttcttttctaagagttcactacttctgcggggtgtcacagtcttaagatcatggtgtttttatgtctcaaacatggtcgcaattgtgacattaggtagatgggagatttttgactgagttttcgtgttttgtgagcgaagtcagggtaggaaatgatgtccgagagtgaagagcatggctcgctcctagacaagatcaacgacaagatcaacgagaagatccatgagtataagcactcgtcgtcgtcctcctcctcttcggactcagacgatgacaagaagcccaagaagtctaagaagaagaagctttttggaagaaaacatccattgcatcatg

SEQ ID NO: 63602 - DNA, 423 bp, Zea mays
  Clone ID: LIB3075-053-Q1-K1-B12
actatatattgtattcctattaatctggttatcgcatgcgtggccagccggtgacgacgtacgtatagactcgctcagcgcctgagctgaacgccacgtcaccccggcgcatgcatacatgcatgcatgcatggttcattcatttcaaggggcttcgcttcaagaagtgtggagtgactacattatgccagagctcatatactctgaaaatactcgagcaggcaggcatgaaaggctgcaatgcttgcagtgtaccgatggagaacagactaaaattgagcaagaaagatgagtcaccgcctgttgacaagacaaaatacagaagcattattggaagcctgaggtatctagtgaacacaaggccggatatagcctttgctagtgggattgtagcaaattcatggaagatccaagagcaaaaca

SEQ ID NO: 63603 - DNA, 187 bp, Zea mays
  Clone ID: LIB3075-053-Q1-K1-B2
cggacgcgtggggaaccagcagcctccaataagagccagccagagaaactaataaaactgtcggcgtcgtcatccgagcgaacagagccaaccgaccccgttcccaaggcaatccgtcgtcgacgtaccaccaccaccgcaagagcgagatggatatgaaaaggatcctcttcggcgtactcgtcgt

SEQ ID NO: 63604 - DNA, 384 bp, Zea mays
  Clone ID: LIB3075-053-Q1-K1-B3
atcgatcacgacaagatggcgtgcacagacaatgcgatgagagccttgttcctcctggtcctcttctgcatcgtgcatggggagaaggaagagtcaaagggcatcgatgcgaaagcgtccgggcctggtgggtccttcgacatcaccaagttgggcgccttcggcaatggcaagacagacagcacgaaggctgtgcaggaggcatgggcatcggcgtgcggcggcactgggaagcagacaatcctcatacccaagggcgacttccttgtcggacaactcaacttcacaagcccttgcaagggcgacgtgaccattcaagtggatggcaatctgctggcgaccacggacctaagccagtacaaggaacatggtaattggatcgag

SEQ ID NO: 63605 - DNA, 127 bp, Zea mays
  Clone ID: LIB3075-053-Q1-K1-B4
tcagcagctagcgatggctggaaccccggccacctgctcatcgggcctgccggttgcctcgggggccttggcccgccggccggggtttcgagccggggaacccccgccgttgccgacaatttcatta

SEQ ID NO: 63606 - DNA, 250 bp, Zea mays
  Clone ID: LIB3075-053-Q1-K1-B5
tgtacacatgtgagaactgggtacagaatgtacggatctggcaggccatcgatcgcgaggtctggatagcactgagcgaggatgcaacttgataaggtaatgggctcaagtacgtcgtacttggtgattgagtcgatctcaatactcatcaccgttactctgatagcctttgccaatgcctacatagcagacttggacatggcaacgctgtacgctgacacacttgcacatactatgtgaccatagcctt

SEQ ID NO: 63607 - DNA, 295 bp, Zea mays
  Clone ID: LIB3075-053-Q1-K1-B6
tgatgcagctacttccaaagaagatgggccagtagcatcatcccttaatcgaaccgagcgttggcttctctctcactccgaacatctcaacttcttctctatcttgattcttgcttcggttccaaatccactctttgaccttgctggtattatgtgtgggcaatttggtgtgcctttctgggagttcttgtttgctactttgattgggaaagccatcatcaagactcatattcagacactatttatcgtgtccctgtgcaacaatcagctcttgtatcttattgaaaaggagtta

SEQ ID NO: 63608 - DNA, 324 bp, Zea mays
  Clone ID: LIB3075-053-Q1-K1-B7
gagaaattgacgctacatatacagattgctggaaaaatgaacaggtgtatcagggagtatgggctacgtgatattgggcgattggagcatgatttggcttttggagatgcgggagcgaacgaagtcatcactatgctcaggtcaaagcaggatatgagcccagaaaacaaaatgaggttgctaattatatatgcaatggattatccaaagaagtttgaaggtgacaaagggaaaaagtcgatgcacttagcgaagcttccacatgatgatatggatatattaaatggcttaggatacttgaatggttcaaatacaaaaaaatca

SEQ ID NO: 63609 - DNA, 390 bp, Zea mays
  Clone ID: LIB3075-053-Q1-K1-B9
tcggcatcgatcacgacaagatggcgtgcacaaacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaatgctgtgcaagaggcatgggcatcggcgtgcggcggcactgggaagcagacaatcctcatacccaagggtgacttccttgtcggacaactcaacttcacaggcccttgcaagggcgacgtgaccatccacgtggatggcaatctgatggcgaccacggacctaagccagtacaaggaccattgtaattggatcgaga

SEQ ID NO: 63610 - DNA, 299 bp, Zea mays
  Clone ID: LIB3075-053-Q1-K1-C1
gcggaccggcaggtgcacctggtccccagggcgtcgagggactatcgggcaatgaggacgacgacgatgactccaccaacgtaaggccaagcacgtcggtccgattgcatttggaacaagatatgaaagaaaagtgagagcaatgttgtttaaaaccaaaaatccataataatgtgtggtcatccgtgatatgttcttgctctccctctttttctttctgtttgatttcgatgtgttatcatgttcttagcctctaattggatcaattcttgatatcaaagactccaaaattatcggtt

SEQ ID NO: 63611 - DNA, 421 bp, Zea mays
  Clone ID: LIB3075-053-Q1-K1-C10
cgaccagcgacggcaagacggactgcacaaaggcagtccaggacgcgtggacgtcagcgtgcgaagcgaccggaagcgccacggtggtgatccccaagggcgactacctggtcggccctctcaacttcactgggccatgcaaggggagcaacatcgccatccagctggatggcaacctgctgggatcaaacgacctggacaagtacacggcgagctggatcgaattgtctcacgttaacaacatcgggatcaccggctcgggcacgctggacggccaggggaccgccgtttatagcaagagcaagaccgacaacgtgaaggcgatgcccaacacactggtgctgtttcacgtgatcaacgccactgtcgtcggaatcaaactacttaacttcaagttctttcacattaacattgacaactt

SEQ ID NO: 63612 - DNA, 428 bp, Zea mays
  Clone ID: LIB3075-053-Q1-K1-C11
tcgcggtgctgtcgagatctttgaggagttgatcgtgcaggtggagctacagcggcacatgcgtcccccagtcgatgggggcgtgccacgcttagttacctttgttgtcgagtactgcaaccgtctgcttggtgagcaatacaggcccatgcttgggcaggtgctaactatccatcgcagctggcgcaaagaggtgttcaatgacaggatgcttgttgatgtggtgctaaacattgtcaaggcccttgaagctaattttgatgtttggtccaaggcatatgacaatgctacgctctcgtatctcttcatgatgaatactcattggcatttctttaggcatttgaaggctactaagttaggagagatcttgggtgatgtgtggctgcgagagcatgaacaatacaaggactactatttgtcaatgttca

SEQ ID NO: 63613 - DNA, 112 bp, Zea mays
  Clone ID: LIB3075-053-Q1-K1-C12
ttttttttattatatatagataaggaaatattttccttaaaaatggagtacaagggattgttgagaactgcttttgttcatgatattaatatatatgatgaatatttcttgc

SEQ ID NO: 63614 - DNA, 179 bp, Zea mays
  Clone ID: LIB3075-053-Q1-K1-C2
acaacaagctcgtgcagaagagttttgctcgactttactacaatgacttcatgcgcaactgcagctatgttgatgatgatgctaaagagaagctccagtccttttcaaatttgactggtgaagagagctaccagagtcgcgacttggaaaaggcctcacaacaggtcgcaaagcacctg

SEQ ID NO: 63615 - DNA, 368 bp, Zea mays
  Clone ID: LIB3075-053-Q1-K1-A3
gcatgccttcatgaacacttcgcctgaggcactcaagaggaagaaggggatgggtctgactgatgagaaccaggaagccgtcgacctggcctggtctcgcttctcttcttggatgggccggttcctcggatctgcttgattatgtgccgcgtgatgatgtgtggagtcaggtcccatgaataaaatagaataaaataaaatgttcagattcaggaaccatgcaaatggactgggctgtacggttctctggatttgcttgtccttctggttatagttatctacctcagtgtggtttccttattttctgtggatggatgcatattgtggaatagccgtcaatggcttttgacagtaagcaacgacatggc

SEQ ID NO: 63616 - DNA, 427 bp, Zea mays
  Clone ID: LIB3075-053-Q1-K1-C3
cgtcgtcgtctcactcaccccgccttcacgcctccctcaccaaataaggtcccgccctgttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctactgcgacacctgccgcgccgggttcgtgaccaatgtcaccgagtacatcgcgggcgccaaggtgaggctggagtgcaagcacttcggcaccggcaagctcgagcgctccatcgacggggtgaccgacgcgaacggcacgtacacgatcgagctcaaggacagccacgaggaggacatctgcgaggtggtcttggtggagagcccgcgcaaggact

SEQ ID NO: 63617 - DNA, 390 bp, Zea mays
  Clone ID: LIB3075-014-Q1-K1-B12
cggacgcgtgggaaatcgtacagtgaatataatgtgcacaagagtgtcaaatatggtgtttgggctagcaccacaaatggaaacaagaaactggactcagcatatcgcgaagctaaggagaaagaagagcactgtcccattttcctgttattttcggtgaatgccagtgcacaattctgtggtgttgctgagatgactggaccagtggactttgagaaaagtgtggattactggcagcaagataagtggactggtcaattccctgtgaagtggcacatagtgaaggatgttcccaataatcttttccgacatataattcttgaaaacaacgacaataaacctgtaacatacagcatagatacacaggaggtgaaactagagcaaggaatg

SEQ ID NO: 63618 - DNA, 289 bp, Zea mays
  Clone ID: LIB3075-014-Q1-K1-B2
cccactcgttcggcgagcgccgtccttttttttttttttttttttttttttttttttttttttttgaacaaaggatgaggggttctagcgatcgttatactcacaattactcaaaatgtattctttaggtttagcaagggggtgttcatgttagtcgatgtgctggttatccttttgacgctgtgctggtttggttgtccatagattgttcgcttcaaaggggatgttcatgttagtcgatgacttttttgtgaaactgcagtttgatatatgaagtgcaagtatcgtg

SEQ ID NO: 63619 - DNA, 369 bp, Zea mays
  Clone ID: LIB3075-014-Q1-K1-B3
cggacgcgtgggcggacgcgtgggcggatgcgtggggggaaaacacgtacattcacccggcggcaataatggcctcggttccggctccggcgacgacgaccgccgtcgtcatcctatgcctatgcgtcgtcctctcctgtgccgcggctgacgacccgaacctccccgactacgtcatccagggccgcgtgtactgcgacacctgccgcgccgggttcgtgaccaacgtcaccgagtacatcgcgggcgccaaggtgaggctggagtgcaagcacttcggcaccggcaagctcgagcgcgccatcgacggggtcaccgacgcgaccggcacctacacgatcgagctcaaggacagccacgaggaggaca

SEQ ID NO: 63620 - DNA, 372 bp, Zea mays
  Clone ID: LIB3075-014-Q1-K1-B4
cggacgcgtgggcgagagaggaacgcgaacaaccaacgatcgcctcatcgccatggctcgctctgtccccatcgccgtcgccgtcgcgcctctgctcctgctcctcctcgtctccactgcgtccgctgcacggaccgtgggcgacaccgtgcaggacgcgtgcagcaagacacaattccccaagatctgcgtggacagcctcgccgcaaagccagagagccagaaggcgaccccgcgccggctggcggagctgttcgtgaacatcgcggccgagaagggatccgggatggccacgttcgtgcacgggaagtacaacaacgccaaggacagcaccgtgttcaagtgctacgacagctgctcggacgacgtcga

SEQ ID NO: 63621 - DNA, 415 bp, Zea mays
  Clone ID: LIB3075-014-Q1-K1-B5
tcggacaccatggcatacccgaggaaggccctgagggactgatgatggaagtggttggtcctgatgcaatggtgcagatactcattgataatcaaggaatggaggagggcaatgacgagggcccaggagaggcggccattgaagaaccagttggttctcttggctcaatgtcgcgtctgtcgcatctattcatgtataatccagaaatggaggatggcaatgacgaggactcaggagaggaggcggccattgaagaaccagttggttctcttggcgcaatggcgcctctattcatgtatgatcaagaaatggaggacaacgaggaggatcaggcacactagatgcagattgcaccagctgcagcgaagcctttgttttgtgttgctggggcggctctacttatgtaatgtggaat

SEQ ID NO: 63622 - DNA, 421 bp, Zea mays
  Clone ID: LIB3075-014-Q1-K1-B6
tcgtccgcaccacggcggcggaggcggctccccgcctgtgaggcatcagacgtacaggatctactgcaaggctggggaggaccagtacagcctagcctaccgcgacggcaaggtctgactcgtgcgcacggaccgtgatgacgactcgcagcactggatcaaggacatgaagtacagcaccagggtgaaggatgaggaaggctaccctgccatcgtgctcgtcaacaaagccactggaaaggctctcaagcattcccttggccagtcacaccctgttcttctgacccgccataatccagactccctggacgagtctgtcccgtggacagagagcatggacgttggcgatgggttccgctgcattaggatggtcaacaacatctacctgaaacttgatgctttacatggagacaaggaccat

SEQ ID NO: 63623 - DNA, 394 bp, Zea mays
  Clone ID: LIB3075-014-Q1-K1-B7
tcgctcgagtgaggggcagtaaagccggctttatgtgcctagaaactagtagctagtgtttgctgctgtcgaatgacactatgcaatgtgatctggaacctggtttcttgagtgcgacgcttgttatgactgtcgtcagtaaaatttgggggctccccgtatgagatgctgccgggaaaggcctcggtgtccaacctcgtttgtggcggggggcgctggatcccggtctggttgagttgggaagcctttaaacctgtggcaactgcattttaaccttttcaatcgttgttaatggtaagtggtcctatatcaatggctggtctcagtggtctatacgtatgctttttggttctctcttgattcctaacagggtgagtggggcatgagcatttct

SEQ ID NO: 63624 - DNA, 426 bp, Zea mays
  Clone ID: LIB3075-014-Q1-K1-B8
tcggcttctggaggacaattttattcatgcggatatgcaccctgtcaacattcttgttcgtttaaatgagaacaagcttgcaaggagacgttttttcagagctaagcctcatattgtgttccttgacgtgggcatgactgctgagctcacacgatctgaccgggataacttacaacagttcttcaaggcggtggctactagagatggccgtactgctgccaagtgtacccttcagttatcaaagaatcagagctgtccaaatccagtggccttcaccgaggagctagacaagacgtttacattttggggaacacctgaaggggatgtttttcatcctgttgaatgcatgcatgagttgcttgatacagttcggcgccacaaagtcaacattgatggcaacatatgtactgtaatggttaccatttt

SEQ ID NO: 63625 - DNA, 400 bp, Zea mays
  unsure at all n locations
  Clone ID: LIB3075-014-Q1-K1-B9
tgataatcctgaacccgaaagctgaacttccacacacaacaaataactgacgcaggcgatccatcactccacacaccggtcggaaccgaggccaaccaacgacgccgccgccaatgtcgtcccctgcagcgccggtgcagccgccgccgccgcgcgcggtgcgcttcggcgtcctgggatgcgctgacatcgcgcgtaaggtctcgcgcgcaatgctgatgctccctccgggcgccgccaccatcgccgccgtaggcagtcgctccgatgacaaggcccgccgcttcatctccgaaatcggcttccccgcggcgcgcgtccacgggtcctacgagtctctcctagaggacccgtacgtggaggccgtgtacctnccgctccccaccagtctccatgtgcc

SEQ ID NO: 63626 - DNA, 408 bp, Zea mays
  unsure at all n locations
  Clone ID: LIB3075-014-Q1-K1-C1
gctccctcgaaatggaggcgacgagcaaggcgatggcttcaggcctcctcgttctgctgcttctcatcaacacaggctttgtcctgcccgtccattccgaggactgctgggccgacacccgcgtcatctgcaccaagacgcacaactgccgggacgacacttgcgcggggcgcggcatgccggacggccgctgccactgggagttccccaacctggtgcccttctgccagtgcctgcgccccaactgccactagtccgggcgcctcggattggctcacttcgccggcgatgatggatggtgcccaactgcgactgcccagtctgctccattcgttgttgtttaaggcataatatataaactgccaaattcacatgtattttgggatattggntatcatactatgaaat

SEQ ID NO: 63627 - DNA, 423 bp, Zea mays
  Clone ID: LIB3075-014-Q1-K1-C10
cggacgcgtgggcaatgaacaagtatggtgctgtccttgatgattttggcctggaagctatgctgaaccagttcatggaacagttcatagctccaatttctaaagttctttatcctgaggttggtggaggaacattggactcccatcacgcttttattgttgaatatgggaaagacagggatgttgaactaggttttcatgttgatgattcagaagttacattaaatgtttgccttggaaaacaattctctggtggtgaattatactttcgaggtattcggtgtgagaatcatgtgaattcagagacacaacatgaggtgacttctcattttacttcaacaactttcttatctacccatgcatggaaatgtatgactacacacatattcctggttgggctgtactccaccatggtcgacacag

SEQ ID NO: 63628 - DNA, 300 bp, Zea mays
  Clone ID: LIB3075-014-Q1-K1-C11
aacactggttaacccgtgttgagatccgcactgcaccagagcttttggtgaccctacttgctacttccacttgcactcgccggattgatgaagctcctgcatgcattgcatgcggagtcttcaaggggatttcagctggcactcatgcattcaagtaaaggctccaattcgagataccggtgcgtttcaataagcaggttcaacagtatctttcgttaaaaaaaacagctctgcttttcgggcggctgctatgtcgcactgcacaatgtggcgtatcgcaacgatggcaaactaatgcct

SEQ ID NO: 63629 - DNA, 275 bp, Zea mays
  Clone ID: LIB3075-014-Q1-K1-C12
agcagcaccaccatcggcgtcggcgacgactgcatctccatcggccccgggagcaagatgatccgcatccatggcgtcaagtgcggcccatgccacggcttcagcggtcggaagcctgggcccctccaaggccaaaaaggacttggaaaacttccagttaacgggttgaacaaccgccggaacaacgaacggcctgcgcatcaagtcgtacgaggactccaagtcgtcgctcaaggccagcaagttcctgtacgagggcatcaccatggacaatg

SEQ ID NO: 63630 - DNA, 381 bp, Zea mays
  Clone ID: LIB3075-014-Q1-K1-C3
cgtcaaagaaacaagtgcacacaaataaatacatcgctcactagattgccaagagcaatggcctctaggtcatccatcctgctcgtcatggtggtgctagctacgctattcgtggttggttcgtgcaccaccccgctcaccttccaggtcggcaagggctccaagcccggccacttggtcctcacccccaacgttgccaccatctctgacgtggagatcaaggagcacggtggcgacgacttctcctttacgctcaaggagggtccgactggcacttggacgcttgacaccaagaccccgctcaagtaccccctctgcatccgcttcgctgtcaagtccggtggctaccgcatcgccgacgacgtcatccccgccaatttc

SEQ ID NO: 63631 - DNA, 423 bp, Zea mays
  Clone ID: LIB3075-014-Q1-K1-C4
tcgatgcgtgctgtttgtggtagatagatctgctctgcacgtctgcgttcgtcacgtataggttggattgttcgtgtggtagcctcggccgttggtgctcattcagatcggtgcttcctgcgtcggccaatagttttcaagtggcaatggcggaccaggctaaccaacccactgtccttcataagctcggtggccagttccacctgcgctcgatcatctctgaaggtgtacgggcccgtaacatatgcccatctgtctcatcttatgaaaggagatttgccacaaggaactacatgacccagagcctttggggcccttcaatgtctgttagcggtggcatcaatgtcccagtgatgcagaccccgctctgtgctaatgctcctgctgagaaaggaggcaagaacttcatgattgatttcatga

SEQ ID NO: 63632 - DNA, 429 bp, Zea mays
  Clone ID: LIB3075-014-Q1-K1-C5
cccgatcgccaccgtcgaccggactcccctcaaaggcggccacagcacagcgagcatgggagaccggcatcagcatgggcctggcagcggcgtggaggacccggcgacgctgctgcggcgggtgcagacccgcgcgcccaactcgacgcaggtggtggggttcctgacgctgctcgtctctggcgccgtgctgctgctgctgacgggggtgacgctgacgggcgccgtggtggcgctcgtcttcctgggccccatcgcgctgctcaccagccccatctgggtgcccgtcgccgtcgtgatctccgccatcgtcgccgtcgcgctctccgcctgcgccttcgccgtcgtcgcgctccccgtggccacctggatgtaccgctacttcacgggccgtcaccccgtgggcgccgaccgggtggactacgcgcg

SEQ ID NO: 63633 - DNA, 398 bp, Zea mays
  Clone ID: LIB3075-014-Q1-K1-B11
tgtatttctacgatttgaaatatagtttgtttgggacgggagcgagtaattctcagactcctgatgtgcacagtcactttttcctcataatacatccaggtggggttcctcccccagttcactctataaaaaaactatcacacctacggtcacaaggtttcgtagaaatacagttaggttgggacgggagcgagtaattctcagactcctcatgtgcacagtcactttttcctcataatacatccaggtggggttcctcccccagttcactctataaaaaaactatcacacctacggtcacaaggtttctaccccgtcgatatatatatacaaatggattgcataaaagaaattatagagggcgagaacactctgccgtatcagtcttgataactctg

SEQ ID NO: 63634 - DNA, 423 bp, Zea mays
  Clone ID: LIB3075-013-Q1-K1-H10
gaaggttgtgagctgattagcaaaacatgggaaagtttccatgatgtgaagctcagtgaccggagtctcatttggaactctgacctgatagagacccttgagctggaaaatcttttgataaatgcatgcataaccatgtattcggcagaagctcggaaggaaagcagaggagctcatgctcgtgaggatttcacgacaagagatgacgagaagtggatgaagcactcactggggtactgggaaaacgagaaagttcgattggcatacaggccagtgcacatgaacacattagacgatgaagtagagtccttcccgccgaaagctcgtgtctattgatcgattcaagcctcacacccttcgggaattccgtgtaaggtgttaataaagcagatgggcgttccttgctgagaacatgatctgaac

SEQ ID NO: 63635 - DNA, 329 bp, Zea mays
  Clone ID: LIB3075-013-Q1-K1-H3
ggaggatctggaggacaaagatgaaacataaaaagaagagaaggaaggacaggaaagaagcaatggccaatgcagaggagatgagtcaaccaaagctagtgaaaagatatggaatgagctcaccccaccccagagcatcaagaagctggtaatcaagaactacaaaggcgtaaagtttccaaaatggataaaaggtcccaagctaggagactccttccccagccttgtgtttttggatcttgaaaactgcatgtcatgtactaaactgccttcacttggcctcctgagtcaactccagtccctgcaaatctcaaatgcagactcagtca

SEQ ID NO: 63636 - DNA, 393 bp, Zea mays
  Clone ID: LIB3075-013-Q1-K1-H6
gcggcgcacgcgtcctgagagactagttaggtatacttcggttgatatctgaagaatgtaatgaactaaaggtgcaaaatgccatgttaacagacaaagtctcaatgatgcaggatacttcaaacaatatcattgaagaaaaacaaactaaaacatccatgcaaacaaagatgagtaccataaatgaggggaacaatgatctagctactgacaacagaggttgttgtctagttaatgaggaaccagacctgcaagtaaaggtccaatcattggaaagcggacttgtcgaagttctagagaaaaatagcatgtatatgacacaggtgaagagccccactacagagcagcaagcttggagtaggaatggagagggggataacgatgacaaaatag

SEQ ID NO: 63637 - DNA, 198 bp, Zea mays
  Clone ID: LIB3075-013-Q1-K1-H7
gtgatttgaaataattgggaataaatagttcgtgaatccctgaagcgtgcatatatatattcctgccaagataaaggtaatggagtcgtcacgcaagttccagccggccggcattctgcttcttctgctcattgtgtccaccgatatggcacaagcaagggaatgccaaaaggacaaggagcgatttgttggggcatg

SEQ ID NO: 63638 - DNA, 196 bp, Zea mays
  Clone ID: LIB3075-013-Q1-K1-H8
cggacgcgtggggcaagaaatggatcctaccatgccagtactagcaaaaccacaatccgaaaggattcaagccggggtcccattggtaataagccacctttcaaggattcgaatgatgcaactctgaggaagagcaggggtagcctcaaagcaccattccttaaagaatggcagaccaaaattcttgcaaaggcag

SEQ ID NO: 63639 - DNA, 263 bp, Zea mays
  Clone ID: LIB3075-013-Q1-K1-H9
gaaagattgtctggtttccttgagaaagattttcaactttttaccgatgatgaggtcatggagacaatgaagcatgtcatcaatctttccaatgtggttgataggctctgcaaacaaatgtatcagtgcattgagaatgatttgttatatcctctacgcacacctcacaatatcgctccatacaaatctaaaggccttgacagggcctcagagctcaatattaagctggatcctgctgaacaaagttcacagtcaacaaaaca

SEQ ID NO: 63640 - DNA, 397 bp, Zea mays
  unsure at all n locations
  Clone ID: LIB3075-014-Q1-K1-A1
tcgcggacgcgtggtcggagagccgaaaccttctccatgcagggatctggatgcctgctaggtttgcttcggagcattacgagcacgcgcataacttggctcgtactgtaaggtgtgcaaactgcacacagcggaggctgtgttatttgtattctgaagctttcttgtgtttcgtcaagaaagcttctctaacttttatcctgcactatcagataaacggtaaattgatagagaataagatgttttcgagctcatgtttagtggcaaacgctttatatttttggcaagctgtgaaggagctgaaccagtgacaactcgaagaattcattttgttgtattaagtcttcttgttagcccaaaaaaaaaaaatnnanctgatcaacttatcaataattat

SEQ ID NO: 63641 - DNA, 369 bp, Zea mays
  Clone ID: LIB3075-014-Q1-K1-A11
cggacgcgtgggcggacgcgtgggcggacgcgtgggctgccgtcttctgggcaagttcgacctcaatggcattccgtcagctccgaggggcacaccccagatcgaggtgaccttcgaggtggacgccaacggtatcctgaacgtgaaggcggaggacaagggcacgggcaagtcggagaagatcacgatcacgaacgagaaggggcggctgagccaggaggagatcgaccgcatggtgcgggaggcggaggagttcgcggaggaggacaagaaggtgaaggagcggatcgacgcccgcaaccagctggagacgtacgtgtacaacatgaagaacacggtgggcgacaaggacaagctcgcggacaagct

SEQ ID NO: 63642 - DNA, 282 bp, Zea mays
  Clone ID: LIB3075-014-Q1-K1-A12
gaccgccggggatgtcgaggtgctctggtcgagagaagggggggtcggagatgtgagcagagatccgcggcgcttaaccggtcacgccgtcgtaaaccctgggaattttccccggaatcaagccgccacgagtacccgcgtggcatggtcagaattagtgttgtgccgtagctgcgaggttacgagtcacttgaagaccaagttggtacctgggaatctcgagtctaaggtcaaggacaggtaccacaggatgaggcgcatgaaggatgatatgatgagttc

SEQ ID NO: 63643 - DNA, 357 bp, Zea mays
  Clone ID: LIB3075-014-Q1-K1-A2
atcgtgcgagcatatccacggcgatggaggcgagagcggccatgagctggtactgcggctcccttctggccgtggccatcgcgctgttcctgtccgtgtccctcggcgtgcgcgccgtcggcgccggcgccggcgtcgacatcaaggtgtcgtgtgcagcgacgccggacccggacgtgtgcctactcgcgctccaggcggacagcgactccaagaccccgcgggacctggcggaggcggcgctccgcgcggcgacgaccgcgggcggcgcggcgggcgactacgcgcggcacgagatggacgtggtgaaggacaacgacatgtggcagtgcctgaacgagtgcgccggggagatcg

SEQ ID NO: 63644 - DNA, 347 bp, Zea mays
  Clone ID: LIB3075-014-Q1-K1-A3
tccgggtcgaccacgcgttcgggcgatgcagcatctacaagactagagattttatcacgtccataaactggaactgcgggtgggttttcgcagaggacatggggctggacctatacgcgtccctcgacatgcgcgccggcagcgccggcgcctgcgtcgacatcaaggagtcttgtgcaaagacaccagaccctgacgtgtgcctactagcgctacatgcggacaacgactccaagacccatcgggacctgtcagatgcggcgctacgcgcagagacgaccgctgtcgaagcggaggtcgactacgctcggaacgagatggacgtggtgaaggacaacgacatgtga

SEQ ID NO: 63645 - DNA, 328 bp, Zea mays
  Clone ID: LIB3075-014-Q1-K1-A4
tcggacgcgcgcatggcattggcatgcatggactgttgaacatctatgcatgcatggacgacgtcacttgcaacgctgttcccatatagtactactggtctgctatgaatatctatgcatgcatggtaacggtttgtgttatttaattattattattacgtagacattactatttaaaattcatgtgttcgcgtcaagtcgttctgtaatcttgtgatggaatatatatgatatttccttttaaaatcattcgtttgaaatgcaatgtgtccagtcctcaaactgttactaccattatattgacggaatatatatgatttcctttttt

SEQ ID NO: 63646 - DNA, 265 bp, Zea mays
  Clone ID: LIB3075-014-Q1-K1-A6
gggtttcaacgctgtttccgtatcatgctaatggtccgctatgaatatctatgcatgcatgggtaccgtttgcggtatttaattattattacttcgtagaccttactatttaaaattcaagcgttctcgttaaagtcctctgtaatcttgcgatggaatatatttgatacattccttttaaaatcattccattgaaatgccattggtcctagcctcaaaccgtgactaccattgtattgaccgaatatatattgaatgcctcttt

SEQ ID NO: 63647 - DNA, 415 bp, Zea mays
  unsure at all n locations
  Clone ID: LIB3075-014-Q1-K1-A7
tcgagacaatggcgcgcaacctgtctgtcacattgttcattctgacggcctatgtcgccgcgacggcggcaccgaccgtctgtgcggtcaaatctccggcgagcacaacgaccacaaggaaacacgaagcagccaaagaagagacggatgcgcctgccaaggcaccagctgctgcagccaccgaggggcctgctgcgggagcgcccatgacatggccggatggcgggcctgagttcgtcaagatggtcatcaagaaccccttctttaaaagcgcacctncatctggtagcgaagacggcctacccattgaccccactccagaaggcagcatgaactaaattaaataccaattacgagaccgaccagatatgcatggagcatgcaagaatgttgtcgaacgaatatatgctatgaa

SEQ ID NO: 63648 - DNA, 348 bp, Zea mays
  Clone ID: LIB3075-014-Q1-K1-A8
tggatcgagattctacgtgtggataacctggtcatcaccggcaagggaaaccttgacgggcagggcccagccgtgtggagcaagaactcctgcaccaagaagtacgactgcaagatccttcccaactcgctggtgatggacttcgtgaacaacggggaggtgtccggggtcacgctgctcaactccaagttcttccacatgaacatgtaccggtgcaaggacatgctgatcaaggacgtgaccgtgacggcgcccggggacagccccaacacggatggcatccacatgggcgactcatccgggatcacgatcaccaacaccgtcattggcgtcggtgacgactgcatc

SEQ ID NO: 63649 - DNA, 376 bp, Zea mays
  Clone ID: LIB3075-014-Q1-K1-A9
atggcctcgattccggcgacgaccttcgtccgtcatcttatccgtcctcttctgtgccgcggctggcaccgccgtcgacaacgacctccccgactacgtcatccagggccgcgtctactgcgacacctgccgcgccgggttcgtgaccaatgtcaccgagtacatcgcgggcgccaaggtgaggctggagtgcaagcacttcggcaccggcaagctcgagcgctccatcgacggggtgaccgacgcgaacggcacgtacacgatcgagctcaaggacagccacgaggaggacatctgcgaggtggtcttggtggagagcccgcgcaaggactgcgaccaggtgcatgcggacagggaccgcgccggcgttctgctc

SEQ ID NO: 63650 - DNA, 416 bp, Zea mays
  Clone ID: LIB3075-014-Q1-K1-B1
tcgcaacctcagagtccatatcggtccctttctcctctagtactggacaagctgttcgtccttttagtgcctcagtttttttgggttttgatgcagatccatcattgaatatcacagctcgaatccgtggtccaaatgatcagtacataaatcatatcatgaaagaaacaggggttactgttgtactaagaggaaaagattcggagaatcttggcagttgtcatagtgaagcctcacaacaacctctacacctatacctcacaagtatgcatttaaagaacctagaagctgcaaaagttttggcagagaacctcctggatacagtagcagcagaattcggtgcttccagaatttcttcttcaaaagtatatggtgctgttccaccttctcagcagttgttagctggtgtcgacacc

SEQ ID NO: 63651 - DNA, 394 bp, Zea mays
  unsure at all n locations
  Clone ID: LIB3075-013-Q1-K1-H1
agggagtccattgagttaccacttatgaatcctgaactctttcttcgggtgggaattaagcctcctaagggtgttctactctacggtcctccaggaactgggaagaccctattggcaagggctatcgcaagtaacatcgatgccaactttttgaagattgtttcaagtgctattatcgacaaatacattggagaaagtgctcgtttgattagagaaatgtttggctatgcacgtgaccaccaaccatgcatcatcttcatggatgaaattgatgctattggtggtcgaagatttagtgagggaactagtgctgatcgtgagattcagcggacgttgatggagctncttaaccaattagatggatttgatgagctaagaaaggtaaaaatgatca

SEQ ID NO: 63652 - DNA, 249 bp, Zea mays
  Clone ID: LIB3075-014-Q1-K1-B10
gcgacatcaacaagctcctaccggcgcttatgatacccgtgcgcatggtggcgctcccccgcttgtgcgtcgtcccctttccaagagccaagattcggccgtgcattaaaaggcatgtgccacctttgaacccttcattttcaacaacgggttcgtcaaaatcattaacggcgaaatcaacaccgttgacttcacccgggacattaccaccggagttaacggcaacttcaccagcgggattaccaccag

SEQ ID NO: 63653 - DNA, 342 bp, Zea mays
  Clone ID: LIB3075-013-Q1-K1-F2
gcaaacctgcagtcatctcctccatcaccaccaaactcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagc

SEQ ID NO: 63654 - DNA, 444 bp, Zea mays
  Clone ID: LIB3075-013-Q1-K1-F3
gagtacagtacctttggcgacagcttccattatttcttctacactcttaagaagggcaggaggtcactggagtccagcagttaccaaaacacattaccatcacctgttgctccaagaataaatatggtccacgaagagctcgagagcgaggattttatattcctcacaaaccttgatgggttgtgagtggctgcttaaacaagcatctggctaacagcctaacacatcaaaagggtgaccaggccagcgttggtgaccctgcagtgatgtttttttcctgggcggcaaatgagaatgatgcctgtaaaatgtgtaatttaggatagatttaaattttgagctttgttgtctagtaatactataatactctatattactgcaagctagaggtctgtatgatcttgtaaaaattagtattactttccttttgaaatctaatgcttc

SEQ ID NO: 63655 - DNA, 408 bp, Zea mays
  Clone ID: LIB3075-013-Q1-K1-F4
gaatgtccttgccagaacaaagcgtgagtcagagaacaccaagaagtatgccatgcagagcttctccaagagcttgttagatgttgcagacaatttgtctcgggcatcatctgttgtcaaggcaagtttctcaaagatagattcatctaacgattctgatgaagctgtaacactactgaaaaccctactagagggtgttgagatgactgagaagcaacttggagaggtcttcaagaagtttggagttgaaaagtttgatcctttgaatgagaagtttgatccaaataggcactatgccattttccaaattcctgatccttcaaaaccatcaggaactgttgctgctgttgtgaaggttggctacatgttacatgatcgtgttcttcgccccgctgaagttggtgtcac

SEQ ID NO: 63656 - DNA, 261 bp, Zea mays
  Clone ID: LIB3075-013-Q1-K1-F5
actagttctagatcgcgagcggttttttgcgatctagaaccatccatctcccggcaggggctaggagagccggcggccacacgaaggagaaatggcttccgcacacaacgctctccgggtgtttttcatcctagccgtggtatgtgccgtatgcacagcgaaaaggacaggagccaacaaggaagaatcggcggcagccctcggtggcgctgctggaggcagcggcggtacgttcgacatttccaagctcggctcgaccag

SEQ ID NO: 63657 - DNA, 441 bp, Zea mays
  Clone ID: LIB3075-013-Q1-K1-F6
cttgaatggaactttcttgaactcccatgcagttcatcatccagatgctgagtgtaggcattggggtgaacctgctgaacttgcacatggtgatattataactctagggacttcatctaaactatctgttcaaattacactgcaaaatcaacgagttcctgctggtgttggtatggcatccgatccaatggtggcacgtagaagtggaaagaaacttccaatggaagacataagcttttgccagtgtcctctgcagggtgttgaacattttgggctctttggaatttttgatggacatggtggggatggagctgccaaagctgtcagcaagattcttccagaaaatctgggatacatgttatctcatcctgaaacaaaagaacgagtgcagtcatgttctgatgcttctgatgttcttagatatgcttttactttgacaga

SEQ ID NO: 63658 - DNA, 329 bp, Zea mays
  Clone ID: LIB3075-013-Q1-K1-F8
gagagagtctcgccatggtgatgggtcatctctgcagaaatctgcatctccccgaaggagatctacaccccctcgaagaagatctatatcccctcgaagatcctcacacaagaagagggaatcaccaagaaggggagactcacctaagaggaagcactcacctaagaagaaggagtcaccaaagaagagagactcaccaaggaagagagactcaccaaagaagagggattcaccaaagaggaggagggactccccaaggaaggggggataggtcaaaatcaaggtcaccttcaaagaaacatgacacttttagacataaaaaagaacat

SEQ ID NO: 63659 - DNA, 249 bp, Zea mays
  Clone ID: LIB3075-013-Q1-K1-F9
ctcctattgtggcccggtgccttactcttggctcctcccttggactgagtagtagtgggatggacatcaaccttggatggagctccccactggcacttcacgaagtccagcaaccttgcactgaccttggtctgaattgaaggagagtatatgttacactatcaacatatggatttttaacctttttgtttcttctcgatgacttggctactgtctttactcacaattcaaacttgtgattttattttt

SEQ ID NO: 63660 - DNA, 401 bp, Zea mays
  Clone ID: LIB3075-013-Q1-K1-G1
aaagaaggcagagagtgcaaatgttagtagagatgtatctggagaaggtgttcaacaagcattgttgaaaatcctagaaggaactgttgtcagtattcctgagaaaggatcacgcaagaattctcgcaatgacagtatacagatagacacgacagatattctttttatatgtggtggtgcttttgtggacttggaaaagactatttctgaaaggcgccaagattcatccataggatttggggcacccattcgtacgaacatgagaagttctggagctagctgtccaatggttacctcatctttattagaatctgttgaaagtggtgatcttgtaagatatggtctaattccggagttcattggtcgtttgcccattctagtaagtttggcagctctgaatg

SEQ ID NO: 63661 - DNA, 390 bp, Zea mays
  Clone ID: LIB3075-013-Q1-K1-G10
aaaaaaaggtcaatatcggttactgtcatggagagaagtgcatactgcagttccctattgattgtatggtacattttctgtaagaccacagagaattgcaggagaatcatggcctcactacagtcctacagtggtgtggcaataataatacatctgggaagtccatgcccagccacaactttcccatattatccaaagaataaacagagctttacggagaaataagaaaaaccaaacaactagaacctcctaatctgcctttgtcaactgcaaaacatgaaaggcgggaactggtctgcagcactagagagtaacaagggtaaagatgacttgcattatataaagtatgaactcttcgacaggggtataaatttcaatggatcttgtgca

SEQ ID NO: 63662 - DNA, 442 bp, Zea mays
  Clone ID: LIB3075-013-Q1-K1-G2
gcgcaccgcctccccgtgtcccctccttctcgcccggcaccgtcgagctcggctgtggagacagaacaaacccatcaaccatggcgaactcggcgtcggggatggccgtgagcgacgagtgcaagctcaagttccaggagctcaagtcgaagcgaagcttccggttcatcacgttcaagatcaacgagcagacgcagcaggtggtggtggacaggctggggcagccgggcgacacctacgacgacttcaccggctccatgcccgagagcgagtgccgctacgccgtcttcgacttcgacttcaccaccgacgagaactgccagaagagcaagatcttgttcatctcctggtccccggacacctcgagggtcaggagcaagatgctgtacgcgagctccaaggaccggttcaagagggagctggagggcattcagctggagct

SEQ ID NO: 63663 - DNA, 388 bp, Zea mays
  unsure at all n locations
  Clone ID: LIB3075-013-Q1-K1-G3
cacaaggaactacatgacccagagcctttggggcccttcaatgtctgttagcggtggcgtcaatgtcccagtgatgcagaccccgctctgtgctaatgctcctgctgagaaaggaggcaagaacttcatgattgatttcatgatgggcggtgtttcagctgctgtttcaaagactgctgctgctcccatcgagcgtgtgaagctgcttattcagaaccaagatgagatgattaagtctggtaggctatcagagccgtacaagggtattgttgactgcttcaaacgtaccattaaggatgaaggtttctcttccttgtggaggggtaacactgctaatgttattncgtacttccctactcaggctttgaactttgcatttaaggactac

SEQ ID NO: 63664 - DNA, 414 bp, Zea mays
  Clone ID: LIB3075-013-Q1-K1-G4
gaagagccggattgcccagaagtgttccgttcccgaccgcggaggagagcggcggacggcttccctgccgctgccggccgccttcctcgagttcctcagcgagaacggcctggaccctgcggtgtactcaatggcagccaccatcccgcgctacataaggctaaaaccaggcatggagtccaagatcgcagagattgaagccgagttgaagtgtgcccttgacaaggttttatggctgcctgggttctatgcgattccgccggaaattcagattgctggctccaaggcttatcagcaagggaagatctatggaattgatgccgcttctggagctgctatattagcacttgatgttcgaccaggaaatcatgttcttgacctctgtgctgccccaggtgcaaagctttgcatgct

SEQ ID NO: 63665 - DNA, 427 bp, Zea mays
  Clone ID: LIB3075-013-Q1-K1-G5
gctgcctggaggcgggctcctcgtgttccagagcttctgtgctgctgaagacgctgttgctacctcgcccaaatctgttttccactgctttgacggcgagaacgtggagagtgctcctcctcctatgaagaaggactacaaactggctaatcttctatgctgggaggaggaagcggatgccatggaggagaaggcgggagtgcttgatgagtaagacgggcttctggggtcgatttgcttctgagttgtttattttatatcgtcgcaatttcgtggttgtcgtttggttattctgtgaagcagccaagccaagctattgttatgaaaatttgtcgtctgtaagcatgtgaacttccgacgttgccacatgctggatcagtctgaataagtaagtatgcagctctaggtggtcagctgcgtctaccac

SEQ ID NO: 63666 - DNA, 438 bp, Zea mays
  Clone ID: LIB3075-013-Q1-K1-G6
gcgtgcggcaacgtccccatcttcaaggacggcaagggctgcggctcatgctacgaggtgagatgcaaggaaaaacctgagtgctcgggcaatccagtcacggtgtacatcactgacatgaactacgagcctatcgctccctaccacttcgacttgagcggcaaggccttcggctccctggcaaagcccgggctcaacgacaagattcgccactgcggcatcatggacgtcgagttcagaagggtgcgatgcaagtaccccgccgggcagaagatcgtgttccacatcgagaagggctgcaaccccaactacctggccgtgctggtgaagtatgtggcggacgacggcgacatcgtgctgatggaaatccaggacaagttgtcggctgagtggaagcccatgaagctctcttggggcgccaatctgaggatggacact

SEQ ID NO: 63667 - DNA, 167 bp, Zea mays
  Clone ID: LIB3075-013-Q1-K1-G7
ctctgctgaagatgtttggtgacttccataatgatacagctgaagagcgcaatgtccgctttggagtcagagagcacggaatgggcgccatttgcaacggcattgctctgcacagaccaagggttgttccgtactgtgctacattctttgtcttcactgattacatg

SEQ ID NO: 63668 - DNA, 367 bp, Zea mays
  unsure at all n locations
  Clone ID: LIB3075-013-Q1-K1-F12
cacgcgtgcgcttgaatggaactttcttgaattccatgcagntcatcatccaaatgctgagtggaggggttggggtgaacctgctgaacttgcacatggtgatattataactctagggacttcatctaaactatctgttcaaattacactgcaaaatcaacgagttcctgctggtgttggtatggcatccgatccaatggtggcacgtagaagtggaaagaaacttccaatggaagacataagcttttgccagtgtcctctgcagggtgttgaacattttgggctctttggaatttttgatggacatggtggggatggagctgccaaagctgtcagcaagattctttcaaaaaatctgggatacatg

SEQ ID NO: 63669 - DNA, 156 bp, Zea mays
  Clone ID: LIB3075-013-Q1-K1-G8
aaacccatcaaccatcccaaactctgcttcgtttattgcctttaacgacgactgcaatctcaacttccattacctcaagtccaagctaatctttcctttcatcaccttcaacatcaacgtacatactctatcatttattttttatttattaccaac

SEQ ID NO: 63670 - DNA, 175 bp, Zea mays
  Clone ID: LIB3075-013-Q1-K1-G9
cgccagttcagccacgtggagagggcagatcctagaagagccggcgccatgagctcggcggcggggtccaccatctcggccggcgaaaacgtcgcttattccatcgacgcgctctaccgcaaggaccaagccctggctgaactcaagtctgaagtgatggaagcccttcaaaagg

SEQ ID NO: 63671 - DNA, 399 bp, Zea mays
  unsure at all n locations
  Clone ID: LIB3075-052-Q1-K1-F7
gggcgcgtcgtggtcctcaacacccagaacctgccgctcgtcaaggaggtcgggctcggtgctgaccttgtcaggatcgacgcccactccatgtgctcgcccggcttctcctgcgactccgcctaccaggtcacctacatcgtgcgcggcagtggccgcgtccaggttgttgggatcgacggcacgcgagtgctcgagacccgcgccgagggaggctgcctcttcatcgtgccaaggttcttcgttgtctccaagatcgccgacgaaaccggcatggagtggttctccatcatcaccacccccaacccaatctttagccacttggcgggccggacatcggtgtggaggcaatatctncgcggtctntgcagtcgtcgtaacaccacgccggagatggag

SEQ ID NO: 63672 - DNA, 455 bp, Zea mays
  unsure at all n locations
  Clone ID: LIB3075-052-Q1-K1-F8
cgcgcgaatcgccgcggacctcgccggaggcggcgacgagctcggatcccggcgatctagtcgccggaggcggtcccgatggctcggcggtcgtcttcctcgtcgtcggggacctggcggtacctgaacccggcgtactacctcaagcggcccaagcgcctggcgctcctcttcttcgtcttcgtcgcggccaccttcgccttctgggaccgccagtcgctcgtcagcgagtacgagtctgagatttcccgattagaagatgatataaatcggttgcatgaccagctaagaaaggctggagttaatctggatgaaaatccagtagtaagcaataagaattccagaaaagatcttgtagtagaaattgatcctgtcaataatgaaagacgggaaaaagttaaagaggcaatgctccatgctnggaattcttatgttaagtatgccttgggaatgga

SEQ ID NO: 63673 - DNA, 455 bp, Zea mays
  Clone ID: LIB3075-052-Q1-K1-F9
cgcgcgaatcgccgcggacctcgccggaggcggcgacgagctcggatcccggcgatctagtcgccggaggcggtcccgatggctcggcggtcgtcttcctcgtcgtcggggacctggcggtacctgaacccggcgtactacctcaagcggcccaagcgcctggcgctcctcttcttcgtcttcgtcgcggccaccttcgccttctgggaccgccagtcgctcgtcagcgagtacgagtctgagatttcccgattagaagatgatataaatcggttgcatgaccagctaagaaaggctggagttaatctggatgaaaatcccagtagtagcaataagaattccagaaaagatcttggagtagaaattgatcctgtcaataattgaaagacgggaaaaagttaaagaagcaatgcttcatgcttggaattcttatgttaagtatggctgggggaatg

SEQ ID NO: 63674 - DNA, 456 bp, Zea mays
  Clone ID: LIB3075-052-Q1-K1-G11
cggacgcgtgggcgcgaaggcacctagcagccgccactcgccgaactgaggaacacgcctggcgacgggatacagcagcagcgcgcccctctatccccgacgcgacggcgccctgcagctgcagataaacctgttccaatgggcaaacaaaaagagggtgtggacaaaagaactgctaggaagatgatccgatctacggaaggctgtgcaaagagcattactttcgagaggaacaacaaatcagacgatgtgcagcttcacgatctgccgaatgacatcctaggtagcatactatcacggttgacattcagagaatcctcacagatgggccttgtttctcatacctggcggcggctgtggagaagctgttgccggaaactggtcttcaccagtgccaccatgttccaacccggaaataggagcatcaaacatacaagggaccaacttgccatgaga

SEQ ID NO: 63675 - DNA, 377 bp, Zea mays
  Clone ID: LIB3075-052-Q1-K1-G12
cggacgcgtgggcgctaaggcacctatcattcgacactcgccgaactgaggaacacgcgctggcgacgggatacagcagcatctctcccctctatccccgacgcgacggcgccctgcagctgcagataaacctgttccaatgggcaaacaaaaagagggtgtggacaaaagaactgctaggaagatgatccgatctacggaaggctgtgcaaagagcattactttcgagaggaacaacaaatcagacgatgtgcagcttcacgatctgccgaatgacatcctaggtagcatactatcacggttgacattcagagaattctcacagatcggccttgtttctcatacctggcggcggctggggagaagctgttgcctga

SEQ ID NO: 63676 - DNA, 407 bp, Zea mays
  Clone ID: LIB3075-052-Q1-K1-G5
ctgcagttcccggcgctgatgcggcagtggctatcgccgccgctgatcccggcgtacacactgctccgggtgccggccacctcccaggaggacgagcttctcctctccatggccgagtccgacctcgaggataagctgaacgagatccgaaagaccaacagccacctggtaatcatcgggaagcccacgggcgacaccaaggaggagtacgacgctgaggtggaggacgacgatgcagacaacgtcgaggagtctgacggcgacgacttctaccaggagaccggttgacccacgtggctcccccgtgcttcgtcggcgtccttgagcgtcgtcatccccgctgtccagtctgtatttcgcaatccctgagttgttccttctatctagatacgctgttaccctattct

SEQ ID NO: 63677 - DNA, 453 bp, Zea mays
  Clone ID: LIB3075-052-Q1-K1-G6
gtcgttctctcttcctggtccaagtgatcttgccaagttacgagcagcgagcagagatcagagcatccatcggcaatgtcgaacatcgggcagtccttccaggccggcaaggctgaggcccagggcgagtaccaggcggagcacgcggcgcagtgcgtcaaggacaccgccgcagccgcggccgacagtgcgcagctgcagcagcaccgccccaccggcaccgttgagcaggtggcgcagacgggccagggcgtggcggcaggcgtcaaggacaccgtggcgggcgcggcggttggcgtcacaaacaccgtggcgggcgtggcggcgggcgtcacgaacacggtcacgggcgccgtggcgggcgtcacgaacacagtgaccggcgcggcggcgggtgtcaaggacaccgtgaccggcggccactgatcgacgacccaagaatgcttcatgcat

SEQ ID NO: 63678 - DNA, 390 bp, Zea mays
  Clone ID: LIB3075-052-Q1-K1-H1
aactcgtcgcttccgctccacaggatcctctgcgccacccacaaccgtgtgaccgtccgtgctgccggcgacccctatccgccgacccgtccgtcccaccacaccccaccgccgctcgcagctatgtcgccgtcggagccgacgcgggaggagagcgtgtacatggccaagctggcagagcaggcggagcggtacgaggagatggtcgagttcatggagcgcgtcgcgcgctccgccggcggcgccggcggaggggaggagctctccgtggaggagcgcaacctgctgtccgtcgcctacaagaacgtcatcggcgcccgcagggcctcgtggcggatcatctcctccatcgagcagaaggaggagggccgcgggaacgaggcgcacgcc

SEQ ID NO: 63679 - DNA, 278 bp, Zea mays
  Clone ID: LIB3075-052-Q1-K1-H2
cccacgcgtccggtgaagtggagttgaagcgtgactatgcattcattgaattcagtgacccccgtgatgctgatgatgcgcagtacaacctagatggcagggaagtcgatggaagccgtattattgttgaatttgctaaaggagttcctcgtggttctggtggttcacgtgagtacatgggaagaggacctccaccaggaacaggtcgttgttttaactgtggaatggatggtcactgggcaagggactgcaaggctggtgactggaagaacaaatgc

SEQ ID NO: 63680 - DNA, 437 bp, Zea mays
  unsure at all n locations
  Clone ID: LIB3075-052-Q1-K1-H3
acgcagagcagcatttcgagtaacacagttgagcacgacgatgggatccctcgctaataacatcatggtcgtgggcgccgtccttgcggcgcttgtcgtcggcgggtcgtgcgggcccccgaaggtgccgtccggccccaacataaccaccaactacaacgggaagtggctcaccgccagggccacctggtacggtcagcccaacggtgccggcgctcctgacaacggcggtgcgtgcgggatcaagaacgtgaacctgccaccctacagcggcatgacggcgtgcggcaacgtccccatcttcaaagacggcaagggctgtggctcatgctacgaggtgagatgcaaggaaaaacctgagtgctcgggcaatcctgtcacggcggtcatcacagacatgaactacgagcctatcgctcctaccacntcgacttgag

SEQ ID NO: 63681 - DNA, 354 bp, Zea mays
  Clone ID: LIB3075-052-Q1-K1-H4
ccggaacgaacgacgcagcccaacccgttcccaccaaaccagcggcaccacccatggcttcggcggcggcgagatccggtctccggtcgctggcggtgcgcgccgccccgttgaggcgccgcatgtcctcctccgtccacgacgacgcctatgagacggccaagtgggagaagatcacctacgccgggatcgtgacctgcaccctcctggcggcgtacaacctgtccaagggccacccccacttcgatgagccggcggcgtacccctatcttcacatccgcaacaaggagttcccatggggccctgatggcttggttgagacgaaggaccaccactgagccctgattagcacac

SEQ ID NO: 63682 - DNA, 460 bp, Zea mays
  Clone ID: LIB3075-052-Q1-K1-H8
tgggtgttaagggagctgctctaccacccacagggaaatctcaagttgaaactcggaaatgctttgctaatgctacagcagaagtgatttctgctagtacaaacgagatcagtgagccagataatgcagctgccccattgcttgcacagcagttgccaccagacactgcaaagaactccactgtcatcatgcatacccatgaaacaagtaaagtcaatcagttggctgctacatggccaagggcgaactttcaaactgattacaacaagaagccttccaatgtacccataatggctaaccagcccagtgggttcgctggtgcgactgctcccttggtgacaccaaagatggaaatcggaaacatgaaggacagttccaatcctctctcaaattctgcttacgcaagggcgcttgtaataaagcagcaagagcagctccttcagcaatataaattgggcag

SEQ ID NO: 63683 - DNA, 201 bp, Zea mays
  Clone ID: LIB3075-053-Q1-K1-A10
ctacaacggcaagtggctcaccgctagggccacctggtacggtcagcccaaacgggccggggctcctgacaacggccgtgcgggcgggatcaagaacgtgaacctgtgcacctacaagggcattactgcgtgcgggaacgttcccatttttaaagaccggaagggcttctggctaagcctcgaagtgagaatccagggaaa

SEQ ID NO: 63684 - DNA, 378 bp, Zea mays
  Clone ID: LIB3075-053-Q1-K1-A11
ggcatgaagacccgaaactgaaaccaaaaataaactgcaggcagagggggaaggagagcggcaggagggtcattaaatagatgtgcttttctgtttcagggtaggaaatgatgtccgagagtgaagagcatggctcgctcctagacaagatcaacgacaagatcaacgagaagatccatgagtataagcactcgtcgtcgtcctcctcctcttcggactcagacgatgacaagaagcccaagaagtctaagaagaagaagctttttggaagaaaacatccattgcatcatgtcctcggaggaggcaaagccggcgaccttgtgctgtggaggaacaaacaggcatctgggagcatcttggtaggggtgatcgtgatct

SEQ ID NO: 63685 - DNA, 382 bp, Zea mays
  Clone ID: LIB3075-053-Q1-K1-A12
gtgatgcagacgaagcagatggcgaacccgacgacggccgcgggcctgctccgcgtcttcttccacgactgcttcgtcagcgggtgcgacgcgtcggtgctgatcgcgtccacccagttccagaagtcggagcacgacgcggagatcaaccactccctccccggggacgccttcgacgccgtggtgcgcgccaagctggccctggagctggagtgccccggggtggtgtcctgcgccgacatcctcgcactggcgtcgggcgtgctgattaccatgaccggcgggccccggtacccggttccgctggggcgcatggactcgctgtcgtcgtcgcccacggcgcccgacgtggagcttgcgcacgccaacttcaccgtggacc

SEQ ID NO: 63686 - DNA, 273 bp, Zea mays
  Clone ID: LIB3075-053-Q1-K1-A2
atttcgaataacacagttgagcgcgacgatgggatccctcgctaataacatcatggtcgtgggtgtcgtccttgcagcgctcgtcgccggcgggtcatgcgggcccccgaaggtgccgcccggtcccaacatcaccaccaactacaacggcaagtggctcaccgccagggccacctggtacggtcagcccaacggtgccggcgctcctgacaacggcggtgcgtgcgggatcaagaacgtgaacctgccaccctacagcggcatgacggcgtg

SEQ ID NO: 63687 - DNA, 301 bp, Zea mays
  Clone ID: LIB3075-052-Q1-K1-F6
ggcctcaagtacaccaacactgtctggaaaactggagtcaaaggtgtggaccgcacaactccttagttacatcatcttttcagtccacacgctgtcatcgagaattcacaaatcgacatatagatttgtgatccaatcacaaagaataacaaggccgggagctagctagtaaaggagcagggatttggtcctttaatttgtccaaatgacgatgctgttgatattttcaccgcttcattgcagtggagacccaaaagatgatgctggggacgttcagcccccagctagagccctatgtcta

SEQ ID NO: 63688 - DNA, 438 bp, Zea mays
  Clone ID: LIB3075-052-Q1-K1-D8
ccacctcgtacctcgaaacaagttacgcgagatggcaccctcctaataagtcatggtcgtgggtgtcgtccttgcaacactcgtcgtcggcgggtcatgcgggcccccgaaggtgccgtccggtcccaacatcaccaccaactacaacggcaagtggctcaccgccagtgccacctggtacggtcagtccaacggtgccggcgctcctgacaacagttgtgcgtgcggcatcaagaacgtgaacctgccaccctacagcggcatgacggtgtgtggcaacttccccatcttcatagacggcaagggttgcggctcatgctatgaagtgagatgcaaggaaatacctgatttcttcggcaattcattcacggtgtacatcacttacatgaactacgaacctatcgctccctaacactttgacttgagccgcaaggcctt

SEQ ID NO: 63689 - DNA, 459 bp, Zea mays
  Clone ID: LIB3075-052-Q1-K1-D9
cgaagatgttgaatgttagtatttcacttctggttgattatgttttttcttatgcgcttgacaaatctagatatgcaaccagacatgctttattcttgttcctattttgttttccttatgtattaattccttaacttgtaatgcacatgatattttccttatgtattaattccttaacttgtaatgcacatgatgttttccttatgtattaattcctttacttttaaagcacatgatgaaggctggttgttaggtaagttctcttaaactttagtaagcttgcgtacttttgctatggatcttttgaatcaattacaaggtaattcatttaaaaagcgtagtaacacgtgtacctaaatatcatatataaaagtctgtatggtactgatggttgcaatgtagtggtgaaacaactagattaaaataacaaaatttatgtatggataggatcacatatgt

SEQ ID NO: 63690 - DNA, 397 bp, Zea mays
  Clone ID: LIB3075-052-Q1-K1-E1
caaaaatgtacctgaacaccaatagtacgttggagaacgttgcttcgaccaggattactatcttcgatctgaaactctgataagcagaattgaagacaaacgatcgggtacttggggaatatggaatttatttactgttggtttacctagtacttgcctaccagccaggcgccccaggggacgacggcaaagatacagtctcgggtattaggatggcaaaggcagcgatagataaattctactccaagtatatgttgggatcacgtaagctggtgcttgacccacattcaacgatctttggcaaaaggatgcttgtcaaaagtgcgatcatgtgctattccaataacacaagatagatcagtcctcgaggaaggtctacaggggccctggctttttg

SEQ ID NO: 63691 - DNA, 464 bp, Zea mays
  Clone ID: LIB3075-052-Q1-K1-E10
ctctctctcttcattcgttcccggcctcaccccgagccagtcgtctcgctagggtttcgccgccgccgccatgcctcgccgcagctcaggaaggtctgccccacgcccagctccccgtgctgcttcactgaggaacccgccacagccagcacgccaggctcctcctccagctcctgttcgagatggtggtggctccatgtttggaggaattgggtccaccattgctcaaggtatggcgtttggcacgggtagtgccatggcacacagggctgttgactctgtattaggtccccggaccatccagcatgagactcttgccacagaagctcctgctgctgcccctgctgctccagcgatgaatgctgatgcttgcagcttccattctaaggctttccaagattgtctcaacaactatggcagcgagatcagcaagtgccagttctacctagacatgctgaacgagt

SEQ ID NO: 63692 - DNA, 331 bp, Zea mays
  unsure at all n locations
  Clone ID: LIB3075-052-Q1-K1-E11
aaaaaaaaaaaaaaaaaaaaagaaaaaaaaaaaaaaaagaagaaaaaaaaaaaaaacaagggggggggggggggggggtagaggaatttgaggggggggggggggggcaaaaagaaatagggggggagagcgggggtataccacccttnnnccggggggggggctaagggggaaaaaaaaaatgggggggggggggaaaaaggatttgttttggggaagggggggggaaaaaaaaaaatgggggcggggggaaaaaaacccggggggggggaaaaagggggggggaaaaaaataagggggggggaacaagcccggtggtgagggggggaga

SEQ ID NO: 63693 - DNA, 375 bp, Zea mays
  Clone ID: LIB3075-052-Q1-K1-E3
gcaaatcatgatgaccatagtcgacgatcttgtctctgtcgacactctcattgaggactatctgtgcgctgagccagttaacgagtacgtccagagctgcgacatcgttgccttcaacaagatctaggcgtgactttcgatcagtccttcccctggggtgctggcgatggtggtggctgggcaatgcaccagcctaatttttccatagctatatgtctgctttgtgtggccagtgatattgccgtgagtatttttggatcctattcgagtcgaatgtaccagtaccagagttaatttgctttaattcgaaacaccgttccggttggaattctgttacccgtgttctttgcttgcagttcctctatttcttttttg

SEQ ID NO: 63694 - DNA, 419 bp, Zea mays
  Clone ID: LIB3075-052-Q1-K1-E4
gcacactgatgttgctgtcctgctcgacaatgaggccatctatgacatctgccgccgctcccttgacattgagcgcccaacctacaccaacctcaacaggcttgtgtcccaggtcatctcatccctgactgcttccctgaggttcgatggtgctctgaacgttgatgtgaacgagttccagaccaacctggtgccctaccctaggatccacttcatgctttcgtcctacgctccagtcatttctgctgagaaggcctaccacgagcagctgtccgtggccgaaatcaccaacagcgccttcgagccatcctccatgatggccaagtgcgacccccgccatggcaagtacatggcatgctgcctcatgtaccgtggtgatgtggttcccaaggacgtgaacgctgctgtggccacaatca

SEQ ID NO: 63695 - DNA, 431 bp, Zea mays
  unsure at all n locations
  Clone ID: LIB3075-052-Q1-K1-E5
ggacgaacttacactgaagggaattacacagttctatgcttttgtggaagaaagacagaaagttcactgtctcaacactctcttttccaagcttcaaatcaaccagtcaataatattttgtaactctgtaaatcgtgttgaactattggcgaaaaagatcacagagcttggctattcttgcttctatattcatgcaaagatgctacaggaccaccgtaatagagttttccatgatttccgtaatggagcatgcaggaaccttgtttgcactgatctttttacaaggggaatagatattcaagctgtgaatgttgttatcaattttgatttccccaagaactctgaaacatatctccacagggttggtagatctgggagatttggtcaccttggtctggccgttaattngatcacctatgaggatcggttta

SEQ ID NO: 63696 - DNA, 58 bp, Zea mays
  Clone ID: LIB3075-052-Q1-K1-E6
gattttgtttgtttagatcggacttgatggctgcacgtaaaggcactattgaggggat

SEQ ID NO: 63697 - DNA, 463 bp, Zea mays
  Clone ID: LIB3075-052-Q1-K1-E7
atccatcaacgaaacaagcgcacaagaaaaaatacctcgccgccaacaatggcctccatgtcctccatcctgctcgcaacggcgatgctggctgcgctgtttgcggttggtttgtgcaccaccccgctcaccttccaggttggcaagggatccaagcctggccacctgatcctcacccccaatgttgcaaccatatccgatgtggaaatcaaagagcacggtggcgatgacttctcctttacgctcaaggagggaccgaccggcacctggacgctcgacaccaaggcctcgctcaagtaccccctttgcatccgctttgctgtcaagtctggtggctaccgcatcgccgacgacgtcatccccgccgatttcaaggccggcaccacctacaagaccacactcagcatctaattagcctctcatgatgaattagatttcaaaagagctcatctggcgcacatgt

SEQ ID NO: 63698 - DNA, 321 bp, Zea mays
  Clone ID: LIB3075-052-Q1-K1-E9
gttttctatcaacatggacatgaactctgtcactatgtaaattctggacacccatcgagggctcgctgtttactgttaagtgctggatgatcttgagatgtgactcataatgttgtaggcctgcggaaagatagaatcatggaaagagaatgtgcgcatgcatgggagagatcgtgaacagggtcatttatgtgggacgatggaagcgcttggtggttcatttgcacacacacctgacgcgactttttgggagggggagatagactgtgctgaagacatcactgatttcactggagagcgggaggcatggcctgatgatca

SEQ ID NO: 63699 - DNA, 465 bp, Zea mays
  Clone ID: LIB3075-052-Q1-K1-F1
gatgaagaagatcgcctgcgccgtcctcatcgccgcctcggccaccgtggcgctggccgcggaggcgccggctccgtctcccaccagcggctcctccgcggtcgcacccgccatcgtcggggccgccgtggcctccttcttcgcgtactacattcactgagccgccggacgaggagccggagccggagggaagagaccaaggtggggggagagacttggctgcgctgcgctgctctgctgctcccgcgcattcccgatgcgtgggcgtgctctgattgggcacggcggtggcagtggcacaccttcgtcttccttttgtttgtttttttttccttcctctttctacttgattttcatttaacgaattggtatcgctgatgcaccagtttaatttggtgccctgttatttgttctttccctcgagtgagggatcgacacctgtaccattgcttgccatttgtctgg

SEQ ID NO: 63700 - DNA, 250 bp, Zea mays
  Clone ID: LIB3075-052-Q1-K1-F11
catcgatcacgacaagatggcgtgcacaaacaatgcgatgagagccttgttcctcctggtcctcttctgcatcgcgcatggtgagaaggaagagtcaaagggcatcgatgcgaaagcgtccgggcctggtgggtccttcgacatcaccaagttgggcgcctccggcaatggcaagacagacagcacgaaagctgtgcaggaggcatgggcatcagcgtgcggcggcactgggaagcaaacaattcttata

SEQ ID NO: 63701 - DNA, 465 bp, Zea mays
  unsure at all n locations
  Clone ID: LIB3075-052-Q1-K1-F4
cttatcacaacacacctgagcacagcggttatggggataatatggcagcttcattctgacgatgctgggtcattctatgtcatctacgctgccatctaaggccttatgaccatctcactactgtataacattgcacagggtggcttgcttccattcccaataactgcattcttccttataaacacactctcttggacctaccgtcgacgcacgacgccagactacgaggtgagcaacctgatcgatagcgcacgacttcatcaagacagtgaacactagcaacagagtacctgcaatatgcatcttctgcacggacttgatgaactgcatcccgccgattgtgcgccactacgtcgagcacatgggctgcctncgcgagctgatggtgttcgtcactgtgaggcatctgcctgcgacgtctgtgctgcctgaggagcgcttcctcttcgacaggctggaaccttt

SEQ ID NO: 63702 - DNA, 421 bp, Zea mays
  Clone ID: LIB3075-052-Q1-K1-F5
aacaaagcaggagagatgatctggagtctgttggctatcttctgctatattttttaagaggaagcctcccatggcagggccttaaagctggcactaagaaacaaaagtatgataaaattagtgaaaagaaaatgcttacctcggcagagattctgtgcaaatcttacccgccggagttcgtctcatatttccactattgtcgctccctgcgatttgaagacaggccagattactcttcaatgaagaagctctttcgtgatgtatttatacgggaaggataccaatttgattacgtatttgactggactgcactcaagtaccctcaaatgggctccaacgacaagcttgttcaacaaccaagtgcaagaatggctggggttggaccattaattgacagaacagacaaagcttccatggggcc

SEQ ID NO: 63703 - DNA, 446 bp, Zea mays
  Clone ID: LIB3075-052-Q1-K1-D6
atttgaacaaaaacaggttaaagcatgtgaaatatccatctaatctttcaccagatggacctattgatgatgcagctgctgtgccatttgaaaatttgcaagttcttttgttaggatctaatgacatagatgacttttcttcagtggattcacttaacctgttcccaagtttaagggatgtcaggctttctgacaatcctgtagctgatcctgccaagggtggtgctcctcgttttgtgcttgttgctcgacttggaaaagttggaatactaaatggcagtgagataagtccacgtgaacggagggaatctgaaatacgatatgtccgccttgttatgggaaaaatagaatcaaatgaccaagaagagatcagacggcttcaccctagattcgctgaactgaagtcctttcatggtattgaagatgagaagccaacttcaagcata

SEQ ID NO: 63704 - DNA, 355 bp, Zea mays
  Clone ID: LIB3075-052-Q1-K1-B9
cgagggctataattgttatgatcttatttcagatctgtttattatgcctgttcagggggatggtgagcctcgtacaaactgtaacaacggtcattacactgatttagagacattcgaacaatcaaaatgatctgcattgtatttacacaaccaccttcggatggagaaacgcgggctctcatcactatgcataccgaacatccaaaggctgatccacacttaatcaactccataactggcagaaagaggtggactggttgcacttcgaacaccaaatgatgctcaaatgcatgtactagctaatatcggagacggagaactacctgcagctcataactaaaatgattgaatggga

SEQ ID NO: 63705 - DNA, 383 bp, Zea mays
  Clone ID: LIB3075-052-Q1-K1-C1
gcgaactatctcgaccagcttggctttcatattgttggctatggttgcacaacctgcattggaaattctggagagcttgatgaatctgtgtctgctgcacttactgagaatgatcttgttgctgctgctgtgttgtctggaaacagaaattttgaaggacgtgtgcatcctttaaccagagcaaattaccttgcttgccctcctttaatcgaggcttattgcttggctggcacagttaatattgattttgagaaagaacctattggcatctccaacgacggtaaatatgtttacttccgggatgtttggccatccacagaagagatagccgaggttgtcaagtcaagtgtgctacctgacatgttccagagctcatatgactc

SEQ ID NO: 63706 - DNA, 465 bp, Zea mays
  Clone ID: LIB3075-052-Q1-K1-C12
ccgactccggcttgtagcaggcgaagtcggagcgcaagtgcacgcgcgagaccttggtgcactgctccaagctcaccggatccttcacggacgagaacctcgagttccagcgcaagatcctcgagcgctccggcctcggcgaggacacgtaccttccccccgccgtgctccgggtgccccctaacccgtgcatggacgaggcgcgtaaggaggcgcgcgccgtcatgttcggcgccatcgaccagctgctcgagaagaccggtgtcaggcccaaggacattggcgtcctagtggtcaattgcagcctgttcaacccgacgccgtcgctgtcagccatggtggtgaaccattacaagctgagggggaatattgtcagctacaacctcggcgggatgggctgcagcgccgggcttctgtccatcgacctcgccaaggatctgctgcaagtgcaccccaactcttacg

SEQ ID NO: 63707 - DNA, 459 bp, Zea mays
  unsure at all n locations
  Clone ID: LIB3075-052-Q1-K1-C3
caaaagacttgagtaataatatcaaaaagggtggtaagccaagcacatcatttggtattcagcaaagagctgagaagtccgcaaggactaaacgatctacgaagtcaatactgcacgggctgtctgatagtgataatagtgattctgagtttatgggcaccctgtcgaggtcaagatcgcacaccctgaagacaaaccgaaaattgtttcaaaatggcagtactggtttgataacacctcaatccagtggactgatagaaagagagagggtcagaactaaatcccagccattggacccaaaagcaacaagcaacggagatctacatactatggatgagtatcagtctgttatcatgcagttaagggatgaaaattcatcactaaaggaaagattatcaaagatggaagaatcgatgtcgcaagagctagtggntgagtgtgacaagaacagtctttgac

SEQ ID NO: 63708 - DNA, 461 bp, Zea mays
  Clone ID: LIB3075-052-Q1-K1-C4
tgcgcgtcgagcgctttaccccgccgtacctcgccccggagcgcgcggccaaccggcccgcgatcgacgtggccaccgtccccggggacggcatggcgtacggggccaagttcacgttccagttctcgacgcccgtgcaggccgtggccgagcccgacctaaaggtgaccatgtacgcgccaccgttcacgacgcacggctactccatgaaccagcggctgctggtgctgtccgtcaccgcgttcgcggccaacgggcagaggtacacgataacggtcgacgctccgggaaagcctgagctcgcgccgcccggatactatctgttgtacgtcatagcgaaaggcgtgccgagcaaggccgcgtgggtgaaggtacacaaatgagaacgaaggcggctcggagacgaatgccagtcgcgtttggcacgacaatacacaagtgttcaccggagtagctggacc

SEQ ID NO: 63709 - DNA, 385 bp, Zea mays
  Clone ID: LIB3075-052-Q1-K1-C5
tcgtgcgcgtcaagcgcttcaccccgcctgacctcttcccggagcgcgcggccaaccggtccgcgatcgacggggccaccgttcccggggacggcatggcgtacggtgccaagttcacgttccagttctcgacgcccgtgcaggccgtggtcgagcccgacctaaaggtgaccatgtacgcgccaccgttcacgacgcacgggtactccatgaaccagcggctggtcgtgctcttcgtcaccgcggttcgtggtcaacgggcagaggtacacgataacggtcgacgcttcgggaaagcctgagctcgcgccgccccggtattttgaggggtacggcatatgcaaatggcgttctgagcaaggcctcgtgggttaacgtacacaaa

SEQ ID NO: 63710 - DNA, 462 bp, Zea mays
  Clone ID: LIB3075-052-Q1-K1-C6
agctgctggagaggctcaaggaggagacggggctgcacgacttcatcatgtgctcgcgcaggcccatcaacgggaagctcctgccgctccgtctgcagctgccgcccaacaacgccgtcgtgcatatcgtgcttgtgcaggagtcatcaaatgtggcaaaaacttttgcttgaccagttgaccatcccgttcacaaaatcatctgattgaagatggtggaagcaacagcttgtgtatcaaatgcagaattgttcaacaattgtgtatgtattaactttttgatcaaaccgggtccagtgtggcggctaacacaagcagggtccttctgcctctagttgttctcattcatcatctcgtacttgctttgtctgtagatatgtgccatctaattctcaagattcatagggatctgtatagataataaggaacctttgaatattctgggttggtgatcttttttca

SEQ ID NO: 63711 - DNA, 449 bp, Zea mays
  unsure at all n locations
  Clone ID: LIB3075-052-Q1-K1-C7
gtgatttgaaataattgggaataaatagttcgtgaatccctgaagcgtgcatatatatattcctgccaagataaaggtaatggagtcgtcacgcaggttccagccggccgtcatcctgcttctcctgctcattgtgtccaccgatatggcacaggcaagggaatgcgagaagtacagtgagcgatttgttggggcatgcatgatcgcagacaactgcgccaatgtgtgccgcggtgagggcttcttggccggcaggtgcagcaccttccgccgccgctgcatctgcactaggcagtgctaaacaagatcgctcgatcgctcgccatgcatcgacaacctattcttaataacgttcattatctcgttcttatttatgacgaatgtcatgtatgttctggtgactgtcatgtatattctgatgactgtcatgtatctcgntcatgtatgct

SEQ ID NO: 63712 - DNA, 98 bp, Zea mays
  Clone ID: LIB3075-052-Q1-K1-D1
cccacgcgtccgaatttttcttatctgattgtctaaaacctataacgggtgtatcgtagtgggtgttatcgttaaacttttaacggtcattctatttc

SEQ ID NO: 63713 - DNA, 443 bp, Zea mays
  Clone ID: LIB3075-052-Q1-K1-D10
cccacgcgtccgcaaagatttcgtatgagcgagatggtgtgcccattggcaaaagggcgtactcggactggctttacgtcgttccatgggggctctacaaggctctgatttggaccaaggagaagttcaacagccctgtgatgctcatcggagagaacggaattgaccagcctggaaatgagaccttgccgttcgctctgtacgacaagttcaggatagactacttcgagaagtacctgtacgagctccagtgcgccatacgcgacggtgcaaacgtcttcggctacttcgcgtggtcgctgctggacaacttcgagtggcggctcggcttcacctccaagtttgggatcgtgtacgtggaccggaacacgttcgtccggtaccccaaggactcagctcgctggttcaggaaggtcatcaagaacgagaactgaatgatcgat

SEQ ID NO: 63714 - DNA, 444 bp, Zea mays
  Clone ID: LIB3075-052-Q1-K1-D11
gatcataacaattaattaattaattaaggcgaagacacgaagcgtggaggatcgatgcgtccccgccgccgcagtatgttttaagctgacttgcggtagatgtgttgtggcctgccggcggcggcgtccttctgggtgtctatgacagtctcgaaggcgccgacgagcgccttgaccctgctgcactggcgcttctgcatcagcttggtgcgtgccgcctcgatcacgtcgttgctccgcgccacctcccggcgccgcggctgctccgcctctgaccgcggctccatcgctgtcttcacccggctgcccaggaatctccgcatcgccacctccttctcgtccatctccggcttcttgatcgcctccttcaccaccgccacgaacttgtccgccaccacgtcctccactgcggcgacaacgacgatgggctctggcaccggcgcc

SEQ ID NO: 63715 - DNA, 123 bp, Zea mays
  unsure at all n locations
  Clone ID: LIB3075-052-Q1-K1-D12
gacccacgcatacttttttttttttccttcttgacaattaagccatctatgacatctgnnacncnacccggccgcgtttatatcataacctacaccaaccttaacaggcttgtgtcccacgtc

SEQ ID NO: 63716 - DNA, 328 bp, Zea mays
  Clone ID: LIB3075-052-Q1-K1-D2
tttctcccttcccccggctcccggcgtctctgcgctgcggccgtacggcgatgcggtggctatcgaggctgctctctcaagccgtcgccgccaggagggcctccgcggcggcgaggtccaacactagtctcgtcaagggaggatcccacgggttcgctagtggcggcagggatgggtctccggaggtgcctcgggagtggttgcggaagctgtgggtagacgagctgaagaagcagaaggaagccgcgaggagatggggcgtcggctcatcattagaggttgcaggagcgaccgaggaggcaccgtcaaggagctatcagtacgaata

SEQ ID NO: 63717 - DNA, 434 bp, Zea mays
  Clone ID: LIB3075-052-Q1-K1-D3
agttaccttgacagccggggggaaccctccatcagtgacagtaataatggtgagcataatcatccagaggcaggtctgcaaactatcctggagaattcagaagatttaccgtcaccatcagggagaacacaacctgccgttttcccacgtggccaaagctttggacaaagaattatgggcaatatgatggataatattttggtcagaagtcttacgtccaaatcaaaaggtcgaacagatgatattgctccaccctcacctgtgaaggcccctgatgatgaggctgacaaggctgaagaggaagaaagccctatgatggaaactgtcaggagcaaatgtattacacagttactgctgcttggggcaattgagagcatacagaagaagtattggagcaggctaaaagctacacagcagatagcaataatggatat

SEQ ID NO: 63718 - DNA, 466 bp, Zea mays
  Clone ID: LIB3075-052-Q1-K1-D4
ccgtcggcaaccttgtttctcttgcactttaagcagctaactgttcccgggtaggacgctctcctgcaataaatcatggtagctgttaagaacggtggttcacttgctctcatatggtctgaagaaacggtgcttcagtctttagcattttgaggaggaaacgtgaaacttactggtcagctgaaagctataaacattgccatggccctggactggaagccccaactttcccaagcctgtagaaagcgccatgtgcctctacagaagccaccgcgtgatgaccagcttcatccggcagggtgggtacagtagctagctatagccctagtctgatgtaagaacaaatttatattatccatcccatattgtctttaattagattcttttttgaaaccaatgcaatttcagctcttgctgtcgtgcaaatttgtaccattgtccatggatgagtagatgacctgggaga

SEQ ID NO: 63719 - DNA, 463 bp, Zea mays
  unsure at all n locations
  Clone ID: LIB3075-052-Q1-K1-D5
acaagcaaccaanattgccgctcgtcaagccaataggatattggggccaataattacgtgcggctgggacttcttcgaagcaatgtactctggcggaagcatgatggaaggttttcttcggggcactggcaccttgtttggaacttatgtgggtggtttccatggtgaggagcggtttgggaagctagggtatcttgcaggaagccatgtcggaagctggggtggaggaagaattggattgatgatttatgatgtcataagcggactgaaatatatgttcatgtctgtccaacctaagtatgaatcatcgtcatatgcatcagaagatggtccagaatacgcaaaaagatatacaaaccaagaggagccaacatactatgaaccatcaaaggaaaagcaagaagaatcaaaatggtttcggttgttctaaatatatgaaccgaagtgtcccgcttaaactcaa

SEQ ID NO: 63720 - DNA, 285 bp, Zea mays
  Clone ID: LIB3075-052-Q1-K1-B8
agcgcgacgaacgtaaaatgtttctgcggagcatcctgaccgttgccgtcattctatcttcccgaagggcgtgtcacgcctgtaataagactacagctatcctggatcttgacgtggatcataacgcgcgatatgtttttaacaggctctacaaactctcgctcaaagagatcaaggccgtcccctaatacgagggtttctcgatggcctgcttatcacttcaccctttacacgtttccacatctgccttgatgaggaggactggaatcgcatccttgacctaat

SEQ ID NO: 63721 - DNA, 403 bp, Zea mays
  Clone ID: LIB3075-013-Q1-K1-D3
gtatatattgcaaaggtacactgtcttatcaagaaaagatgttccgtttgaaagaattgataagagcttcagggggaagattggagttactaaatcatacagacagaaaatgttgttaacgaaaacaatgaaagtagttcgccaggcgtgtatgtcaaaagcagggtacgataaggcgatggatgtgttggatgagctcgatgtcgttctaagccgattggagccagatattggatgtaatgagtcaacagatgttagtgataatgaggaagacaaggaagaagagttgaataaaaataatgctggcaatgggatggaagatgacaatacaattacatgtcataataaggattcgcataacaccaggtctggatgtgaacatgcgttaacaataataacaact

SEQ ID NO: 63722 - DNA, 448 bp, Zea mays
  Clone ID: LIB3075-013-Q1-K1-D4
ccaggccacctgccgggagatctattttcaggtgttggtgctccaggaagtggcgggtgatcaggtatatttgggccaggatttccagagttagagcaagttgagcagcatttaagccagaatcccaacttgatgagggagataatgaatatgccagcgatgcaaaatctcatgaataaccctgatttaatacgcaatatgattatgagcaacccacaaatgcgcgagatcatggatcggaatcctgatcttgcccatgtgctcaatgacccaagtgtcctccgccaaaccctcgaagctgctaggaacccttgaatcatgagagagatgatgcggaacacagacagagctatgagcaacattgagtcctctcctgaaggttttaatatgctccgtcgcatgtatgaaactgtccaggagccatttctaaatgcaacaacaatgagcg

SEQ ID NO: 63723 - DNA, 126 bp, Zea mays
  unsure at all n locations
  Clone ID: LIB3075-013-Q1-K1-D5
ggactgccttgatattggtggcttgaattttgaacataanaaagctactttgcccaggttcacttttcccctctcaacacgcctcataacatcactttccaataattttatactaccaataaacat

SEQ ID NO: 63724 - DNA, 402 bp, Zea mays
  Clone ID: LIB3075-013-Q1-K1-D6
cgcaccggcaccaccaccaaccgagcggctccaggctcctgctcaggaaggggagaagaggcgagccttccttgggaagtcgcaggaggagagaaggggaacaaagatggggcgcggcaagatcgagatcaagcggatcgagaactccaccaaccgccaggtgaccttctccaagcgccgcaacgggatcctcaagaaggcgcgggagatcagcgtgctctgcgacgccgaggtcggcgtcgtcgtcttctccagcgccggcaagctttacgactactgctccccgaagacatcgctatcaaaaatcctggagaagtaccaaaccaactcttgaaagatacttgggggtgagaagcacaagagccttaatgcagagattgaccgtattaagaaagagaacga

SEQ ID NO: 63725 - DNA, 141 bp, Zea mays
  unsure at all n locations
  Clone ID: LIB3075-013-Q1-K1-D7
acgaaaaccctcgcggcgaggagcgctcttcgttccacacacgcgcgccggagncttcggagggcgcacctgccttcacgacttgtcgggctcgtgcgctactcttcttgagcgcggggcggagcacggggacatcaaatg

SEQ ID NO: 63726 - DNA, 288 bp, Zea mays
  Clone ID: LIB3075-013-Q1-K1-D8
cgcagagataggcgtcttcgtactcgcctacctccgggggtcaaacctttcccccttcggccggttcccgccgccgctccatcccgtaacgcgacaccatgagggagtgcatttcgatccacatcggccaggccggtatccaggtcggaaacgcgtgctgggagctgtactgccttgagcatggcattcaggctgacggtcagatgcccggtgacaagaccattgggggaggtgatgatgctttcaacaccttcttcagtgagactggtgcttggaagcacgtgcccc

SEQ ID NO: 63727 - DNA, 325 bp, Zea mays
  Clone ID: LIB3075-013-Q1-K1-D9
ctgcttcttctagctcatggcctggccattccatgtcgcgctggctgcgtttcatttcatgggagaaagcaagggtggatcacagggtggccgtctgctaaataaactacatacctttggctttaaagactgggttgggggattggtacacatcacaagacacattgggcaaatttttttttcacagaaggagtaggggatgggttaaacattgggttaattccccaccccggggttttccgtttcccgttgtgttaacatgaccaacttttgttggcaatggggctaaaaataaatttattcctcttttattgaatggttttgc

SEQ ID NO: 63728 - DNA, 360 bp, Zea mays
  Clone ID: LIB3075-013-Q1-K1-E1
gcatcgttcgttcatccatcaactactgtaaattagagagccggatctcttggtcggagaacctgcgaggaaggactaaggagtcgaagatgactgcggcggtgctgtccgtgcgcacgacgacgacgtcgctgctagcagcagtcatcctgtgcctctgcatcgtctccctctccccccgcggcgccgctgccgcgcgggtctcccccggcgccagcccgatcgtggccacctgcatgacgggcccgtacccggagctgtgcgtgggggagctgggacagcggctgctggacgtgcagacgtcgatcgcgtccgcggcgcccgaccagcgcgcgggcaggatcgcgggcgccccggggc

SEQ ID NO: 63729 - DNA, 247 bp, Zea mays
  unsure at all n locations
  Clone ID: LIB3075-013-Q1-K1-E10
cccacgcgtncgagacaaatatacttcatagggaccaaaatacttaacgcgatgaagcaggtgagtggttgtgacattgcttcaccaggcgtaccttctatggcttcgcagtgtatcccttccacaagtcgttcgacatctccatcaagtgcaatttcggttgatagatccatgttggaagctgcacatgaaaaggagaaagagctgctgaatgaagtcttggagctgcaatggcggttactatgca

SEQ ID NO: 63730 - DNA, 445 bp, Zea mays
  Clone ID: LIB3075-013-Q1-K1-E12
acagcataggggtggttcttttgtcatgtcaccatctttgttgcaccaacatgctccaggcagatcaatcagggagcaggaagtttcatccggagtgccaccaactaaagcttcacaagctatgatggatgaaccgcttgaaaatgtcaatggacaaactgaagagttgccatcagagctaccctgctcgatcaagagaccaaaattttcagttgcagaacttctagaagacctacagggtagaagtggttcttatgttgagacatcatctttgtcacaccaacacaccagagctaaacattggaagccaaagttcctttctttcgagaagaaaacaatagctattctaggagacaggagtattgacagtgaagaccccttggagcatgtcattgacggaacatctagcgaggaggaagattcttcttaaaaccacttgagtttg

SEQ ID NO: 63731 - DNA, 359 bp, Zea mays
  Clone ID: LIB3075-013-Q1-K1-E2
gctcgcgtaacctcctgcccatggctggaggcggcggcgcaggcgcgggctcgtcgtgcggcggcggcggagggggcggcagggagggcgactgggactgcggcagctgcggcaaccgcaactacgccttccgctcgctctgcaaccgctgcaagcagccgcgcctcctcgtcgaccccaacaccccgcgcgactccaagtggctaccccgcgccggggactggatctgcaccggttgcagtaacaataattatgcatccagaaagaactgcaaaaagtgtggcttgcccaaggaggaagcagcaatgccagcattgcaaatggcagggatgactatgccaacttatgcaacttatatt

SEQ ID NO: 63732 - DNA, 306 bp, Zea mays
  Clone ID: LIB3075-013-Q1-K1-E3
cggacgcgtgggcggacgcgtgggggaacttcatggaatcgcaatttttgtagggtgtggggggagattccacgactgtaaatatgatgagatatgaaacagaaaagggggtggcagatcaacatcgaccttctgtaattagccagaataaaagaactagatgctttatattgagcagagctctcgtctttttgatcctccccacggtgtagtatcaagaatgaataaatcttctgtttcttgtctggttgtagcatgccagcatctgtaagttgtaacaattcagtgaatttatttaccttcagc

SEQ ID NO: 63733 - DNA, 438 bp, Zea mays
  Clone ID: LIB3075-013-Q1-K1-E4
gcatcgatcacgacaagatggcgtgcacaaacaatgcgatgagagccttgttccgcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcatgcggcggcactgggaagcagacaatcctcatacccaagggtgacttccttgtcggacaactcaacttcacaggcccttgcaagggcgacgtgaccatccaggtggatggcaatctgctggcgaccacggacctaagccagtacaaggaccatggtaattggatcgagattctacgcgtggataaccttgtcatcaccggcaagggaaaccttgacgggc

SEQ ID NO: 63734 - DNA, 265 bp, Zea mays
  Clone ID: LIB3075-013-Q1-K1-E7
agacaaaacatggctgtgaatgtgagcaccatttggtccgtgatgcaagcccaagttgggatggttgtggccgtgtccttcttggtgagccgcgcatggtgccgtccttccaaagtcccccctggcaagaacatcacggccacctatggcaaggactggttagacgcctaagcaacatggtatggcaagccgacgggtgccggtcccgacgacaatggtggcggctgcgggtacaaagacgtgaacaagcccccctttcatagca

SEQ ID NO: 63735 - DNA, 373 bp, Zea mays
  Clone ID: LIB3075-013-Q1-K1-E8
cggacgcgtgggttctggtgagactagatctcgtcacatccaaccacgatggaaacaagtcctactagccgtaatggggcccgaacaacaccagcggccggtggatgggatcgctgcccgctcctgtcgtcgttgccccattggtggaggcccgaacagcacctgcaaccggtggatgggatcaccgcaccgcccctcgccgttgttgccccatctgtggagcacctcgtggccggggatgccgcccatggcgaccaaccagctcaccctctctttccatggcgagtttcattccaggcagatggactcgcacagtgtccaagacgtgcttttactgcttggagggagggagctgagtagtctgggtggagca

SEQ ID NO: 63736 - DNA, 196 bp, Zea mays
  unsure at all n locations
  Clone ID: LIB3075-013-Q1-K1-E9
acgggatccaaaatccaccacgatgagcatctttggccggccgaaagccgcgggccccggcgggcaagaagccgaagtggaagcccttatcccggccgggccagaagccgtgctccttaagctcaaagggaactcccacctcgtcttctcgggctncagcccttctttcgctcgacgcggcggaactcgatcccct

SEQ ID NO: 63737 - DNA, 446 bp, Zea mays
  Clone ID: LIB3075-013-Q1-K1-F1
tgctgttctggttgttttggggattgtttagcggagccacttccttgcgcttgtgcgagagaaactggcggagactttgcttatacgagagatggcctgcttaaagaaggatttctagatgcgtgtgtctcaatgctccgggaaccacttaaacaaccgcacttctactgtaagggtgtctgtcctattgagcaaataatgaagggagtcagctcagcgaaacctgatgcttgtaaagggcaccttattaagaagtttatcaaggaatgctggataaaatgcggctgcaccagaaattgtggaaaccgtgtggttcagcgaggcattactcgcaaactgcaagtgtttttagcttctcggaaaaagggatggggcttgcgttctgctgaaaatcttcctcgtggtgcttttgtatgcgagtatgttggtgaaatattaacaaacac

SEQ ID NO: 63738 - DNA, 298 bp, Zea mays
  unsure at all n locations
  Clone ID: LIB3075-013-Q1-K1-F10
cggacgcgtgggcggtaggtcacatgcggtcggatggtgagagcctgagagggggtggcagcacagcaccatggcgcgcgcttcaccgtccgtcccgacgcgtcggtcgagtactcgagtcgtcagcggtcggtcggcactcggcacccgattcttccaaagccgccacttatgtcctcgcgagcttggttaataacgccgcgtgagctgggtgggtggggagtttgtcagctgggtggcgcgagcgtcangcgatggcggaggcgggggaaaaggcgagggtcgtggtggttggcgg

SEQ ID NO: 63739 - DNA, 359 bp, Zea mays
  Clone ID: LIB3075-013-Q1-K1-F11
gtgccggactgggagaaattgggagggtttgagtaggccgccaagtgctccttgccacgcagagagagagggcatgtaccactactgttaatcccgccctacaccatctcttggggttcaagcaggggggccacggagcacgaatgaagctcatcaggtctcctctgtgggtccgtacgccgggcggttggccggaatctcatgggatttcttgccggagtatggcggtcgttgtgggattacggtgccatggcggtttgggtctcagaaaacggcttgggatgatcttcggaccctattgatgaggtgcgtgcgcttgattcgaactaaggtcaaccggggatcttggcaattggtcg

SEQ ID NO: 63740 - DNA, 414 bp, Zea mays
  Clone ID: LIB3075-013-Q1-K1-D2
ggcggtggacgtcaaggaaaagggctcttacacgtacgagcccctcaagcactcgtggggcgccatctggaggaaggacagcgacaaaccgcttaagggacccctcaccgtccgcctcactaccgagggaggcaccaagaccgtctacgacgatgtcatccctgccaactggaaggccaacaccgcctacaccgccaaataattaactttagtgctgacaatactttaagtcggcctatgctagctatactagattgggttggatcccaagcaatgcattacacatgcatgcattggaccgtgatatctatttgctaccactaccctattacgacagtgatgctggcgccaacaataatggcgtcatcctccttctccatcttctccatcttcatatatagctagagtgagact

SEQ ID NO: 63741 - DNA, 318 bp, Zea mays
  Clone ID: LIB3075-013-Q1-K1-B6
cgccgatctgcccatgctcggcgttgcctccattggtgccgccaagctctgcctcaccgccggaggtcttgccctacccagctactccgactctgccaagatcgcctacgtcctccaaggcaagaattcgtttttttaatcctataaaaaaaagcatctccgtgtcacatgcatgcgtgcgtcttgatgtatgcacaggcaaaggtatcttcggcgtggttctcccggaggcgaccaaggagaaggtcatctccgtcaaagaaggcgacgcgatggcgctccccttcggcgtcgtcacctggtggcacaacaacgccg

SEQ ID NO: 63742 - DNA, 391 bp, Zea mays
  Clone ID: LIB3075-013-Q1-K1-B7
gaagtggtgggggtatttctggtgatgtaattagttggggaagccttacttctgctcatgggatgggcaacatttcaagccttggatcaggaaaccttggccgtggaaccggagataacaactttggcttgccttctggaaactatgttaggagcaactcaactggtacaattggtgagccattttctgcatcagccaatgcatatgaatcgaacaatccaggtgcatatggcagcagctctatttatggtgactcaacctggaggttcaactcatctgaggttgatatgcctccttttggtcatgatcttggaaatgatgatccagatatcaaatcagaaatatcagcaagctatatgggcaactatactgttaataacaatcagacaag

SEQ ID NO: 63743 - DNA, 332 bp, Zea mays
  unsure at all n locations
  Clone ID: LIB3075-013-Q1-K1-B9
attcgcgagttcttcctcctctgccgccatggcgctctctggggagaaaacctcgtctggacgggagtacaaagtcaaggatctctcgcaagcggacttccgtcgcctcgagattgagctggccgaagtcgaaatgcccggcctcatggcgtgccgcgccgagttcggcccgtccaagcccttcgccggcgctaggatctcggggtctcttcacatgaccatccagaccgccgtcctcatcgagaccctcaccgcgctcggcgccgaagtccgctggtgctcctgcaacatcttcttcacgcaggaccacgccgccgncgncatcgcgcgcg

SEQ ID NO: 63744 - DNA, 403 bp, Zea mays
  Clone ID: LIB3075-013-Q1-K1-C1
gatcgaactcccgtccccgcgtggaggagagcagggccccacgagggccctctcgcgcggcgaccccgtggcgttcctgcgcggctgcttctcgttcgggtcggcggggcggaggcggcccaaggcctcgcccttgccctccccgccgcgcctgaccgcggctgcggcggcagcggacgacggggccaagatgaagggcctcttcaagtccaagccgcggacgcccgtggacatcgtgcggcagacgcgcgagtgcctcgtctacctcgacctccactcggactccaggagcggcgatgccaagcgcgaggagaagatgacagagctaagtaaaaatatcagggatatgaagtctatcctttacggcaatggtgaatcagagcctgtaactgaagcatgtgta

SEQ ID NO: 63745 - DNA, 263 bp, Zea mays
  Clone ID: LIB3075-013-Q1-K1-C10
ggcagcacctccgtccatgccggcgccgtcggcggcggagccaagcggaggcatcgtagcccccgtggccgtggtggcctcgcatttctgccccccctacgtggtgcaacttgcggtgaaagagaagaaggtgagccttcgggaaggcgactttaccattaccgacaccaacggggccgtcgtggtcaccgtcaaaggtgccttgatcagcattcacaaacggcggcggcttcttgacggcggccggaacccccttcttttgc

SEQ ID NO: 63746 - DNA, 380 bp, Zea mays
  Clone ID: LIB3075-013-Q1-K1-C11
cggcatctcccacaggacaccgagacttcttctcagctcgccgagtacttcaacgtgaccgacggggtggttcagctacaaccagatgggcgacgtgccccccgccgttaacgggccactccatgtcatccccaacgtcatcaccgccgagttccggaccttcatcgagatcgtcttcgagaaccccgagaagagcatagactccctccacctcgacggctacgccttcttcggcgtcgggatggggcctgggacgtggtcgccggagatgaggaagacgtacaacctactggacacggtgagccggcacacgatccaggtgtacccgcggtcatggacggcgatcatgctgacattcgacaacgcgggcatgtggagcg

SEQ ID NO: 63747 - DNA, 288 bp, Zea mays
  Clone ID: LIB3075-013-Q1-K1-C12
aatttgaggagagaaagaaagaaagagttatcgtcatggagagcaggaggaagaatcagcagaagacgagctacattgtaatttccatccagctcctagcggccctcctactcttggagcttgtgtcgctagtgccgggggcgtcatgcgaggagttgcccttggatttttgggtgagtgcactacggggggtcggggcaaaagacgtttcaacagccgatggatgcaccaagaagaataaagacaccgtgctctgctctgcccaggctaacacggtaaccaatttca

SEQ ID NO: 63748 - DNA, 405 bp, Zea mays
  Clone ID: LIB3075-013-Q1-K1-C2
ccagttctgggaagagaaagcctgtcctagttatcatattcagggacggtgttagcgagagtcagtttaatcaggtgctgaacattgagttgcaacaaatcatcgaggcttgcaaatttcttgatgagaaatggaatcccaagttcacgttgattattgcccagaagaatcatcacactaaatttttcattcctggaaagccagataatgtcccaccaggaactgtggtggacaacaaagtctgccatccaaagaacttcgatttctacatgtgtgcgcatgctggaatgatcgggactacgaggccaactcactaccacatcctgcatgatgagataggcttcagtcctgatgatctgcaagagctggtgcattcgctctcttatgtgtaccaaagagcacaac

SEQ ID NO: 63749 - DNA, 449 bp, Zea mays
  Clone ID: LIB3075-013-Q1-K1-C3
gaatttcccacaagacaaatcaaagatacctgcagcaagttatctaatggagcttgcagccattgactggtttaaggacaccaaacgtatggataacgttgctaggcagaagggttgtgttgctcaggttgctgctgagaaagggatgcatacatttattgtcaacatacagattcctggatcaactcagtatagcttggtcatgtattttgtcacaaataccttgaagaagggatcattactacaacgtttttttgatggcgatgatgaattctgcaatagcagactaaagcttataccatccgttcccaagggctcctggttagtgcgacagagtgttggaagcaccccttgtctgttgggaaaggctgttgattgtagttacgttcgaggtcctgcatacttggaggtggacgttgacattggatcttcggcggtagcaaatggag

SEQ ID NO: 63750 - DNA, 410 bp, Zea mays
  Clone ID: LIB3075-013-Q1-K1-C4
cggacgcgtgggccaaaccacaggaagaagcgagcagggcaccgtgttttctcgagcgagggcatcggcgcctgccgattcctacgggtgcgcggcgtgcggcgcgctcctggacctgtcggcggcgcacctgtacccggcggacttctacttcgaggccgggaacaagggcacgctgtccttctcgtgggtggacgagtcgcgcctgcggttcgcgcccgaggaccgcatccgccccttcttcgagaccctcaactactggggcatccagcggaagcgcacgcgcatcagctgcgacgcctgcggccacctgcttggccacgtctacgacgacggtccgccggccatgcagggcaccggccagttcgggatggggcccagccaggtcaattccgcgccgcccaggtacc

SEQ ID NO: 63751 - DNA, 346 bp, Zea mays
  Clone ID: LIB3075-013-Q1-K1-C5
gccaaaatcaacctacattggtgttgattacagaagaagtgcagattcatcgaacagatacttttcattggcattcgaggtcccaaattgttggctcaaataaaaagattgtttcactttatcaattattctatcacttttttttttttttattaaaattcatttatatatatattattttttttattttctattttttttatttatttactttttataaatttttatatatttttttttcttttttatatattatttttttttttttttttttctatattttttatcttaatttaatttttgttgtgttaatttttttctattatctatttttttacttatattt

SEQ ID NO: 63752 - DNA, 299 bp, Zea mays
  Clone ID: LIB3075-013-Q1-K1-C6
catccaccgaagggagcctagcgtgaagttgtataattatgccgcggcatctaaaggggctaaggttctggatttcaataaggaggctaagggtgcttccaacatcttagataaagacaaagacaagtacctccgcaatgcttgctcagcagaggggaagtttgtcatcatagagctttctgaagaaactttagtagatacaattgcaatcgcaaattttgagcattattcgtctaatccaaaagaatttgaactgctgagcagtctgacatatcccacagaaaactgggaaactcttg

SEQ ID NO: 63753 - DNA, 448 bp, Zea mays
  Clone ID: LIB3075-013-Q1-K1-C7
ctatgttttcacagacaaccaattcactgtgactgcttacacctgggcagtggcctacctagcaagcatgtccattgatttcgtgtacatcaagcatgttgtaatgaccattgggctgaacacatggggccttgtgctatacaacaaccttgaggccttgatgctattcccactcgagcttctcgtaatgggagaatttgatcagatgaaggtcgacagctccaaagtgtcaaactggctttcatttgatgtggtcctccctgttgctctctcatgcctgtttggactatcaatatccttcttcggattctcctgcagacgagctatttctgctactgggttcacagtgcttggcatagtgaacaagctcctaactgttgtgattaatttgcttatctgggacaagcatgcctcttttgtggggtaccattgggctcttgatatgcat

SEQ ID NO: 63754 - DNA, 327 bp, Zea mays
  Clone ID: LIB3075-013-Q1-K1-C8
gccttaccctcgaagccgaaggcctcgtgccttctcttcctccctggcatggaggaagtagctgtttcgcctatgatcgttgccgccgtagtgctggacaacaatggcgctgacgcggtctcctgcactgccatccctagcgtaacaataagcctagaggagaaagaaaatatcaatggggatgttcccacgatcacctcggccgcaagcaacgaggaggaggcgttgttcagtgtcggagaatccaccaaggacgatggccatcgcttgacgatggaatgctccactcccgtctcctccagtagcccttccactcgcaagaagcgc

SEQ ID NO: 63755 - DNA, 316 bp, Zea mays
  unsure at all n locations
  Clone ID: LIB3075-013-Q1-K1-C9
ggaatcccggtcgaccagcgtccgtaacaaagcttagagactgagtctgagcctttgaggaaggggaggagaaggcaagctacaaaggtgctacgcctgggttccggccgctccctgtcatgaactggcttcacgtctcctcgcgtctcttctcgttcctgctgcgcctctctcatactcgcnccgacatatccagatcgcgcagccgtaccgcgacctctctcgtgctcgcggcccgcgcgcccggcgcgggaccagcggcggaggcctcgcggctccacgcctgcctccggttcctcgccccggccaaccccac

SEQ ID NO: 63756 - DNA, 354 bp, Zea mays
  unsure at all n locations
  Clone ID: LIB3075-013-Q1-K1-D1
agaggatcaaggagatgttcttccccttctcctcttgaagatttcttggggaaaccctaggtggctacactccagatcatgtctagtacatttcttcttcttcgatgaaggtgcttgttgctcatcaaggggagtgggaagtagcagcacatccaccttcattctcataataatgctgcccagacgcagccatgatttaattagaaacttcttgtcaaaggatgtttgtttttaactagtcgtgcgcactgattaattcagttcatgttgttatggttgtcttcccattgctagcagattattaatgtcttatatgttttcttatcatgatatctatttatactttgntgcttc

SEQ ID NO: 63757 - DNA, 347 bp, Zea mays
  Clone ID: LIB3075-013-Q1-K1-D12
cacacttttctctctctgtatgttgtgtaattcaatgtgttttcatgaacacacatgtggaatggagtagtttgaatttaaattacatttgacttgcttgtaacatgatttcatgggtaccttatttgcagttgaggggtcctattttgagaagttctataagcaaacggctgatatggatccagctcagcgtgctgcctttctcgaggaagatgatgagatggaagatgcacattctgttgctgcatctgctggtgacactgatgctaatgttgatgttaatgaacattttgtatgtttctcctgtgttgatggtgaactttatgagcttgatggacgaaaatcac

SEQ ID NO: 63758 - DNA, 386 bp, Zea mays
  Clone ID: LIB3075-013-Q1-K1-A1
aaagtgggttgggtgtgaaaactgttgcttggtcaccatgtggacagtttttagcagggggaagctatgatcaagcagtacggactttgaatcacttgacgtggaaaacttttgcggagttctcacatgcagggtatattcgtagtccttgcaatgctgctatttataaggaagtggatgacccatggcagcttgatatgtcggaattatgtctaagtgaaggcctctctcgtaacatgccagacaatggtgcagaaaatggcaccgagggaggaggctctagagttaaatatgctgtgatggatgttcccatcaccttaccttcgttgaaaccagcttttgacaagcctaaccccaaacaaggcattggtatgctgtcatggagc

SEQ ID NO: 63759 - DNA, 217 bp, Zea mays
  Clone ID: LIB3075-013-Q1-K1-A10
ggtggtggccccgcctgagaggaaatacagtgtctggataggaagatccatccttgcctgcctgagcaccttccaacagatgtggatctcaaaggctgagtatgacgagtcaagacctgggattgttcatcggaagtgcttctaagctctgggtcccccttcggcttcattttatttattccttgagtggttttcatataaactactaatgttggga

SEQ ID NO: 63760 - DNA, 205 bp, Zea mays
  Clone ID: LIB3075-013-Q1-K1-A11
tcgtcacgcgttcgctcagaaactgccacagccatggcgaccgtgacgcggaggctgctcacgacgctacttaaaaccctagctcgcggcctctcgcgcgggctttctaccgagaaagccgttggtgcaggcagccacatcggtaagcacacccctgacacgatgcaagacacgagcaaggagctgcccatggaactgatcaacg

SEQ ID NO: 63761 - DNA, 175 bp, Zea mays
  unsure at all n locations
  Clone ID: LIB3075-013-Q1-K1-A12
cccacgcgtccgcccacgcgtccgggccaagnacgtaagaagtcntntaattnnattgggatcgaataaactccttattggggcctctcttcattagcacgctcaccagcttgtaatctgccgcatctaagcaaagacttcattcacttattgactgatttgtacgcctcttgaa

SEQ ID NO: 63762 - DNA, 373 bp, Zea mays
  Clone ID: LIB3075-013-Q1-K1-A2
gaagagtcaaagggcatcgatgctaaagcgtccgggcctggtgggtccttcgacatcagcaagttgggcgcctccggcaatggcaagacagacagcacgaaggctgtgcaggaggcatgggcatcggcgtgcggcggcactgggaagcagacaatcctcatacccaagggcgacttccttgtcggacaactcaacttcacaggcccttgcaagggcgacgtgaccatccaggtggatggcaatctgctggcgaccacggacctaagccagtacaaggaccatggtaattggatcgagattctacgcgtggataacctggtcatcaccggcaagggaaaccttgacgggcagggcccagccgtgtggagcaaga

SEQ ID NO: 63763 - DNA, 368 bp, Zea mays
  Clone ID: LIB3075-013-Q1-K1-A3
gaagaaggctactactgctactggctctgatgaggaccactcatcctctccaactcgcagccatgatggtgacaaagcagctgcagatgatgatgacgatgatgtccagtggcagactgacacttcaattgaggctgcgaagcagcgcatgcaagagcagctgagtgcagcaactgctgaaatggtgatgctgtcgactgaggagactgagaagaagatgaaacaggcaacccacaaagatggaagcactaatggttcagcaaaagaaatccctaatgacaagcctgccgtcactaagcctagtccctatgaagaactgattggagacatcaaggctagcctaggaagtgctccgacccctacccagc

SEQ ID NO: 63764 - DNA, 453 bp, Zea mays
  Clone ID: LIB3075-013-Q1-K1-A4
catgattgtgtgttcgatactacgattacgaacttcgttttcccttcttttttgttaaaaaaaaaaaaaaagaaagaaaaaaaaaaaaaaaaaaaaaaaaaaaaaaaaaaaaaaaaaaaaaaaaaaaaaaaaaaaaaaaaaaaacccaaaaaaaaaaaaaagggccgccctttttaaagaatcaaactttacttccccttccttgcaacttaatactttttttttagggcccccaaaattaaattcattgcccgccttttaaaaacgtcgtaattggaaaaaccctgccttaaccaaatttaatcgctttgaaaaaaatccccttttccccagttggctaaataacaaaaaggcccgaaccaatcccctttccaaacatttgcccaccctaaatggcaaatggaacccccctttaaacggcccataaaccccggcggttttggggtttacccc

SEQ ID NO: 63765 - DNA, 297 bp, Zea mays
  Clone ID: LIB3075-013-Q1-K1-A5
ctcctcgtccccgatctcctcccacccgcatccaagggtttccttctcgaccgtgcggaacgagccagagaacaggtatggcggcggcgcggcacctcagatccggcctccccctcctccgcgcccacctcgcatcctccgaatccgcggccgtcgctcaggtttcgaggggcttcgcgtcgcaggccgctaagcccaccgggaaggagatcaaggttccaaaagctctgtttggcggcacaggcaactatgccagtgcactgttcctcacagcagctaaatctaatgcattggaca

SEQ ID NO: 63766 - DNA, 204 bp, Zea mays
  Clone ID: LIB3075-013-Q1-K1-A6
gtatgacagagaggcctttggtagagagtaggctgctgaccgcgtgtacatgcacgatataatggatgacggtataaacatgagcatcaacagtatagtccctgacctccttgatgattccattgaaggggtgtaccgttttaagaaggatcctcgggcagatatgaaggcagcatctgcaagactcagagaagacgatgggtc

SEQ ID NO: 63767 - DNA, 285 bp, Zea mays
  Clone ID: LIB3075-013-Q1-K1-A7
ttactatgtcatttgccccaggagacgagcatgaggctcagatacaattgccctagagcgtggaattgcagcatatgtagcagtaattggaacacaaaagcttccgtttactgataatgtgttcgatgttgtacactgtgcaaggtgcagggtccattggtatgcaaatggtggaaaaccattcgtggagcttaatagagtactgatgcctggaggatatttcatttggtctgcaacccctgtctaccgtcaagagcaaagagactcagatgacttgaatgcaat

SEQ ID NO: 63768 - DNA, 359 bp, Zea mays
  Clone ID: LIB3075-013-Q1-K1-A8
gagcgatgtgctgtttcgatctcagccttggcggagatcgagagagcgatgtgctgtggcggcggcggtggagcagccccaggacgcggtgaaactcttcaaccgctggaccttcgacgacgtccaggtgaacgatatctcgctgaacgactacctggctgtgactgcggcgaagcacgcgacattcctgccgcactccgcggggcgctactccaagaagcggttccgcaaggcgcagtgcgccatcgtcgagcgcctcaccaactcgctcatgatgcacgggcgcaacaacggcaagaaggtcatggccgttcgcatcatgaagcacaccctggagatcatccaactgctcactgacg

SEQ ID NO: 63769 - DNA, 396 bp, Zea mays
  Clone ID: LIB3075-013-Q1-K1-B1
atcgcatctgcttccagagcccctcgccgccgctgcgccctcctctcggtcctgccgtgcgtcgaggtaaaaggacagcatggtgagggtcagcgtgctcaatgatgctctcaagtccatgtacaatgctgaaaagatagggaaacgtcaggtcatgatcaggccgtcatccaaggtgatcatcaagttcctgacggtcatgcagcgccatggctacattggtgagttcgagtacgtggatgaccacagagctgggaagatcgtggtggagctgaatggaagactgaataaatgtggtgttattagcccacgttttgatgtaggtgttaaggagatcgagggatggacggcgaggcttcttccatctcgccagtttggctacatcgtcctaacaac

SEQ ID NO: 63770 - DNA, 389 bp, Zea mays
  Clone ID: LIB3075-013-Q1-K1-B10
gtcgacggctccagcgacggcagcagcctcgagtccgaaagccgcgtcgtctacgcgggcatgaagctggctgatacgggaatccgatgcgcccggcgccggcgccggcgccggggccgtcgtccggttgaactgagaagcgtgcgtccagccaagcaaggtggtcaaaaccgaaaactaattaagggctcgattgtgtgtccggctactactgttcttgccataattatatatagatacgcaaagtgtggccaagcctacccacatgcatgctattgcatgcctccgaatatatattatccgactcgatcctgccaaattggttcgtcgacttcattatatatatcccatccctttaatttaatggagaagtgtgactgctgttcgtg

SEQ ID NO: 63771 - DNA, 352 bp, Zea mays
  unsure at all n locations
  Clone ID: LIB3075-013-Q1-K1-B11
tcgggtccatgctcaaatttatttatagggatttaaagccacaaaacctgctggtggacaaggagaaaggtatactggagattgctgatctgggactcggtagggctttcactgtgcccatgaaaagctacacccatgagattgtgaccctttggtacagagctcctgaagttttgcttggagcaacacattactcaactggcgttgatatgtggtctgttggatgcatctttggtaagtctgttcttttttagccttgagatgccaaatactttgtcttgtactggaaactngacgaattatatgtatataatgtacggagtaaaatgcaataactgatgcatgatcttgt

SEQ ID NO: 63772 - DNA, 409 bp, Zea mays
  Clone ID: LIB3075-013-Q1-K1-B12
cggacgcgtgggttttgtttgagcatgtataacctctcctataaaagaccagtatgatgtttgtgtatgagttcaatgttatgtcgactaaggtagactgttgtgttcgaggtcctcttttattactgttttcatagtttgtgagatgatcatgatttcatattttggtttttaaatttgtacagtcacagcaattgtccttttgcctacctgtatcattctgtcatactatctgcaattcagctatgcacagaactatcaaaagcaagcaaagatgctctagagtacctgaggaaggtaagggcatctatttcttaccacaaggcccaaaccaatataagtataatgttttcatcaattggtctatgtaaacctgtgtatgtgtattttttaatgcaatctaattcat

SEQ ID NO: 63773 - DNA, 396 bp, Zea mays
  Clone ID: LIB3075-013-Q1-K1-B2
ccttcaccaccatcacctccaccgttgtttaaatcaccgccaccaccggtgccggtgaggtcacctccatcgtcagtgaaatcaccacctccttcaccactgttaagttcgccgccgccaccagcgccggtgaggtcacctccaccgctaacgaaatcatcacctcctccaccaccgataaggtcgccacccccaccacaagcaaactcacctcctccatcagctctaataagctcacctcctcctccgatgcaatcccctccaccgcctgctccagtcagctcaccaccaccacctataaaatcaccaccaccggctccagtaagctcaccacctcctctggcgcaatcccctccaccacctgctccagtcagctcactaccaccacctgtaaaa

SEQ ID NO: 63774 - DNA, 480 bp, Zea mays
  unsure at all n locations
  Clone ID: LIB3075-012-Q1-K1-H9
atctgtttctcagcacaaggctgaacaagatagatttgtcgctcagttggcatctcttgagtgtaggcatagctctgcagaaggaaagttgggagcagctcgggaacatgcagcatctgctcaagatgaggctgcagaatggaagaagaaatatgaaatggctgccgtgcaggctaaaactgcattggagagactagcatcagtgcaagaacaaattaacaaaattgcacaagaaagggaaagttctataagggcagaatttgcctcacatttggagggaaaggaagaggaaataaggaaattagttgctaagattagagaagcggagagtgaagaaagtgtattgactgaacgctngctggttgtggaatcaaaaacacaaggccacaacaaggaaactaccagcttggagggatgaaatcaaagaactaaccangcagttagagtatctaagagatagagcagtatcatatgaaaagc

SEQ ID NO: 63775 - DNA, 414 bp, Zea mays
  unsure at all n locations
  Clone ID: LIB3075-013-Q1-K1-B4
aggccatcccgccacactgcttctagcgctcggtgctcaagtccttctcgtacgtggggcacgacctggtgatcgccgcggcgctcctctacttcgcgctggccatcataccggcgctcccaagcccgctccgctacgccgcctggccgctgtactggatcgcgcaggggtgcgtgtgcaccggcgtgtgggtcatcgcgcacgagtgcggccaccacgccttctcggactactcgctcctggacgacgtggtcggcctggtgctgcactcgtcgctcatggtgccctacttctcgtggaagtacagncaccggcgccaccacttcaacacggggtccctggagcgcgacgaggtgttcgtgcccaagaagaaggaggcgctgccgtggtacaccccgtacgtgtacaacaacc

SEQ ID NO: 63776 - DNA, 253 bp, Zea mays
  Clone ID: LIB3075-051-Q1-K1-H3
gcgtaagggaaatcaaagcctgtcgcgtaggacagttcggctaagccatagacctgccagtttaacgaagagttgatgcagatctgatcacgcagcaacgtctatgtagagcgtgctgataacgtgttgagaactacgtcaccacggatcaccagatccgttcctttccctgccgtcagcagattatgcgcgagaagatttggatgacccgtatccctttccataagcacgacagattgcacatgagacacat

SEQ ID NO: 63777 - DNA, 73 bp, Zea mays
  Clone ID: LIB3075-051-Q1-K1-H4
ctgggtatcattttagtgcatgatgttttagtatagaaaccatgatagtgagattgacaagaggtatctgctt

SEQ ID NO: 63778 - DNA, 388 bp, Zea mays
  Clone ID: LIB3075-052-Q1-K1-A1
caacatcaacaacaagacggccttcaccaaccgcaccgactacggcaagggcgagcgagaggcgcagtgggccacggcacagaggacgctgcacggcctcaaccaggccaccgccacctccgacctcttcggcgacaaccagggctaccgcgagctgtcggagctcgccgagcaggcggccaagcgcgccgaggtggccaggctcagggagctgcacacgctcaagggacacgtcgagtccgtcgtcaagctcaagggcctcgacattgacaccattcagcagagctacaccgtgtaaactcgactcacgttttttatttggttttttttgcggacaaatacaaaccacacacatatatatatttggaaaagagtcggtcggattttt

SEQ ID NO: 63779 - DNA, 436 bp, Zea mays
  Clone ID: LIB3075-052-Q1-K1-A10
gcaggtgcttcttcatcgagaccgacgcggcgcccatcgaccccaagtacaagaagacgatcagcgacgcgtgcgacggcaaggactcgggctccgtccccatggactccacctcgcccaacgacctggacgggagctacttcggcctggtgctggagaagaagatgccgctcaccatcgaccgcctgatggggatggacaagaagacggagcccatagtgaaggccatgtccgacaagaccaccgacttcgtcccgctcttcgccaaagccatggagaagctcagcgtgctcaaggtgctcacggggaaggaaggcgagatcaggaagacgtgctccgagttcaacaacccgcagaacagcagcggcagcacgtcggtgatacggatcagctccatcgaccccgaccaggtggccgggctgtcgcagccagggtc

SEQ ID NO: 63780 - DNA, 407 bp, Zea mays
  Clone ID: LIB3075-052-Q1-K1-A11
ggccgccaagaagttcgagcccaagtaccgcctcatcaggaacggccttgctaccaaggtagagaagtcacgaaagcagatgaaggaacgtaagaacagggcgaagaaaatccgtggtgtgaagaagacaaaagcgggagatgccaagaagaagtaagggaggaagttacttgccttgccatttctcatcttagtctttggtttgtttagggtgggctccttccggcaatgctgaatgtttagttagaagtagagaagattttgccaattacccatcacgttgagtttctcgttgcaccttctgttcagttttgaggcaccttctgttcagttttgaggcactttgtcagacacaagaatatatatacttggtcatcacggcttttgtcctgctatcatcattttga

SEQ ID NO: 63781 - DNA, 458 bp, Zea mays
  unsure at all n locations
  Clone ID: LIB3075-052-Q1-K1-A12
gcgacggcaaggtgagcgagttcatcggcgggaggcacagcctgccgctgcacgagctgcccacccacgccacccgcggctactacctgggcatgttcctcgggggcgcctaccaagaggccctcggcgggctgcacaacctcttcggcgggccgagcgtggtgcgcgtgtcccagtgcgacgggccccactgcttcgccgtgacgcgcgccgccgcgggcccgtcctgcgccgacgtgctccgcgcgatgcagcacgagcccgaagtgatgtacgaggtgctgaagcagaggaccgacggcgccacggncgntcgcctcgcccgggccttcggcgcaatgccgtacctggtgttcgaccccgaggccgccgtgatgtccggcggcgagagcagcgactcggagcggtcggccgccggcgccgccgaggaggaagacgatgaggagtgggagttcatg

SEQ ID NO: 63782 - DNA, 383 bp, Zea mays
  Clone ID: LIB3075-052-Q1-K1-A2
caccatcgacagcaagacggacttcaccaaccgcaccgactacggcagggaccagcgagacgcggagtgggccacggcacataggacgctgcacggcctaaaccaggccaccggcacctccgacctgttaggggacaaccagggctaccgacagctgtcacagctagacgagcaggcggccaagcgcgccaaggaggccaggctcagagtgctgcacacgctcaagggacacgtcgagtccggcgtaaagctcaagggcatggacattgacaccattcaacagagctacaccgtgtaaactcgactcaggttttttatgtcgttttttgtgcggacacattcaaaccacacacatatctatatccgtaaagattcgatcgtat

SEQ ID NO: 63783 - DNA, 128 bp, Zea mays
  Clone ID: LIB3075-052-Q1-K1-A5
actacgagttgatctaggtggcgtctcccagtgagcttgatggcgctaaggaataatattagttcgttttgttgttatcatttatttatgtaagacttccgctttgtataatgatacttgtgatattt

SEQ ID NO: 63784 - DNA, 483 bp, Zea mays
  unsure at all n locations
  Clone ID: LIB3075-052-Q1-K1-A6
cgcggcgacgggttcggggttcgagggacgcgtcacgcgaaacgcacgacctgagatggggcacattcttcgctgctagggcgccgccgccgtcaccggggcgggggcgctgcgcgcgtcgtcttcggcgccatggcggcggacggcctccgcgtcgtaccaccacacgatccaggctggaccgcgggagacagtcgggccgcgcgccgcggcgcgcgagcgccgtcacggacgcgttccggcggtcctgctcacgctcgcgggcgccgcgccagggaacggaattgaccaccggaacctccttaccgtcgacaggaggcagctcgcggagatgctcaagcagtcgccctacttactcttcacccccgtccgccttcaggtccgcgcgggcgagcgatccaacgccattcttcacgccggcaccgtncttcccataaggtgcatagagatgaaaattctgggaatatactgaatttggtaatg

SEQ ID NO: 63785 - DNA, 388 bp, Zea mays
  Clone ID: LIB3075-052-Q1-K1-A7
caacatcaacaacaagacggccttcaccaaccgcaccgactacggcaagggcgagcgagaggcgcagtgggccacggcacagaggacgctgcacggcctcaaccaggccaccgccacctccgacctcttcggcgacaaccagggctaccgcgagctgtcggagctcgccgagcaggcggccaagcgcgccgaggtggccaggctcagggagctgcacacgctcaagggacacgtcgagtccgtcgtcaagctcaagggcctcgacattgacaccattcagcagagctacaccgtgtaaactcgactcagtttttttatttgtttttttttgcagacaaatacaaaccacacacatatatatatttgtaaagattcgttcgtattttca

SEQ ID NO: 63786 - DNA, 359 bp, Zea mays
  unsure at all n locations
  Clone ID: LIB3075-052-Q1-K1-A8
gttaagtgcgtgaagaggtaataatggtggcagtggaggttgtgccggcgtccgcggagtccgcgattccgatcgaggctaaggccgcggtgacgtcggaggcggaggcggaggccgagggcgaagtggaggcggagatgaagggtgatgcggcagccacggcggaagaaacggaggaggaggaggaggaggagaaggtgtccaaaagcgacctgaagaagctggagaacctcatgtccaagcttaacccctccgcgcaggagttcgtgccgtcgtcgcgccgcacggncccagccgccgtgtcggcggcgaanccggcgggaggaaggtgctcttagccgacgcgcccgtgttcgtgt

SEQ ID NO: 63787 - DNA, 124 bp, Zea mays
  Clone ID: LIB3075-052-Q1-K1-A9
gcagaagatgacagcttcttctttgggctagcgaccgcgccggcacatgtggaggacaggttggaagacgcttggcttcagtttgcggtggagcactcctgcgacgacaaggaggccatgcgcg

SEQ ID NO: 63788 - DNA, 460 bp, Zea mays
  Clone ID: LIB3075-052-Q1-K1-B10
cggacgcgtgggctctttgggcgaccgtgactcgagccgttggagatccacactttcctccctgcatcgtttctcgatctctcgaccgggcgagggcgacgccgcccgcgcgcgcgccatggatgtggattacgacgtgatcgtgctgggcaccgggctcaaggagtgcattctcagcggcctcctctctgtggaccgcctcaaggtgttgcacatggacaggaatgactactacggcggagactccacatcgctcaatctcaatcagctctggaaacggttcaagggtgaagaaacaccgcctgcgcacataggagctagcagagactacaacgttgatatggttccaaagtttatgatggcaaatggtaccttggttcgtgtgctcattcatactggtgtcaccaagtacatgtccttcaaagctgtggatggaagctatgttttcaacaagggaaag

SEQ ID NO: 63789 - DNA, 366 bp, Zea mays
  Clone ID: LIB3075-052-Q1-K1-B2
gccagagcagacttcgatcttcttaatctacctgacagtttcttgccatcatttgattttattgatggacatgttaagcctgttctagggagaaagcttaactggatgaaggcagggatcattgagagtgatctggttctaacagtcagtccacattatgtcaaggaactcacttctggcccagataagggtgttgagttggatggtgtccttcgcacaaagcctctagaaattggaatcgtaaatggcatggatgtttatgaatgggatccttcaacagataagtacatcagcgtgaaatatgatgcaacaacggtaactgaagcaagggctctcaataaagagaggttgcaagccgaagtcgga

SEQ ID NO: 63790 - DNA, 428 bp, Zea mays
  Clone ID: LIB3075-052-Q1-K1-B3
agcgcgacgaaggtaagatgttcctgcggaggatcctgaccggcgggggcggcctggcggccctgagggcggcgcgcgccgtgaaggagacgacggggatcgtgggccttgaggtggtgcctaacgcgcgagaggttctggtagggctctacgagcgcacgctcaaagagatcaaggccgtccccgaagacgagggttaccgcaaggccgttgaatccttcaccggtcaccgcctccagatctgccaggaggaggaggactggaagcgcatcgaggaccgaatcggatgcgggcaggtcgaggagctcatcgaggaggccgaggacgagctcaagctcatcgctaaaatgattgaatgggatccatggggtgttcccgatgactacgaatgtgaggtgattgaagacgacaccccaattcctaagcat

SEQ ID NO: 63791 - DNA, 459 bp, Zea mays
  Clone ID: LIB3075-052-Q1-K1-B4
gcgctcaaggagccagagagggaccgcaagaaggtcaagaacatcaagcacagcggcaacatggggctcgacgacgtcatcgagatcgccaggaccatgaggcacaggtccatggccaaggaattggccggcaccgtcaaggagatcctcggtacctgcgtcagcgtcgggtgcaccgtcgacggcaaggaccccaaggacctgcagcaggagattgacgacggcgaggtggagatcccgtccgcttaagaaggattggtgtccaggactgtgttatctttgctgctgaagccattttctctgcctagattttctcatatttatttgaggtgggggtggacgtggacgtggaactatggaagttatcacagcggagttttgcttagaaactttgtcatgctttaagtctgagacaattttatgaacattcctaagtacaatcgaagttaccagtgcctg

SEQ ID NO: 63792 - DNA, 363 bp, Zea mays
  Clone ID: LIB3075-052-Q1-K1-B5
atctctcgaacgggcgagggcgacgccgtccgcgcgcgcgccatggatgtggattacgacgtgatcgtgctgggcaccgggctcaaggagtgcattctcagcggcctcctctctgtggaccgcctcaaggtgttgcacatggacaggaatgactactacggcggagactccacatcgctcaatctcaatcagctctggaaacggttcaagggtgaagaaacaccgcctgcgcacataggagctagcagagactacaacgttgatatggttccaaagtttatgatggcaaatggtaccttggttcgtgtgctcattcatactggtgtcaccaagtacatgtccttcaaagctgtggatggaagc

SEQ ID NO: 63793 - DNA, 397 bp, Zea mays
  Clone ID: LIB3075-052-Q1-K1-B6
cggacgcgtgggcgacaagatggcgtgcacaaacaatgcgatgagagccttgttcctcctgggcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggtgactttcttgtcggacaactcaacttcacaggcccttgcaagggcgacgtgaccatccacgtggatggcaatctgctggcgaccacggacctaagccagtacaaggaccatggtaattggatcgagattctacgt

SEQ ID NO: 63794 - DNA, 144 bp, Zea mays
  Clone ID: LIB3075-052-Q1-K1-B7
atggaagcagacatagcagatgatatgtctatagagcttcacatatatacagatttcttaagaattgttctggagataattattgccatccttacatatgcattgcccagaaatcctgaggttgtgtatgctgtattgcatcga

SEQ ID NO: 63795 - DNA, 151 bp, Zea mays
  unsure at all n locations
  Clone ID: LIB3075-051-Q1-K1-H1
gcgtaagggaaaacaaagcctgacgcggaggacagcacggctaagccatagaccagccgggggaacgaagagnagaagcagatcggagcacgcagcaacggcgatgtatagcgtgctgataagctggtgagaactacggtaccacggatca

SEQ ID NO: 63796 - DNA, 270 bp, Zea mays
  Clone ID: LIB3075-051-Q1-K1-C8
cctcctcttcggactcagacgatgacaagaagcccaagaagtctaagaagaagaagctggttggaagaaaacatccattgcatcatgtcctcggaggaggcaaagccgccgaccttgtgctgtggaggaacaaacaggcatctgggagcatcttggtaggggtgaccgtgatctggttactgttcgagggcatcggctaccacctgcttaccttcctttgccacgcactaattgtgtttctgaccatctggttcatgtgggccaatgctg

SEQ ID NO: 63797 - DNA, 283 bp, Zea mays
  Clone ID: LIB3075-051-Q1-K1-D2
ggaggagaagaaaagggagcttgaactattggataacaaggtgcaaacattagagaaagagtggtctgtggttgaagaagaatctttaaagaaacccactcctgcacaaagggagaaggtcctggagaggcaactgcatagcctcatcgagcagttgacagctaagcaagctcaagctgaaattctggccactgatgtgcattccaaagaaaaggagctggaacggctgaaccatctgcatagaaacctctacggcggtgccaacgaaactggcgcaccccgg

SEQ ID NO: 63798 - DNA, 254 bp, Zea mays
  Clone ID: LIB3075-051-Q1-K1-D4
gctgttctctacattgagtcattgcgtttagatgtcgacaaggcctggtggaaggattttggcggtgtgatcctgttggcagtgcttatctttatcctgatattcctactactattgtggttgtttcattcgtacattgctgtaacaaatcaatcaacctacgaagttgccagaaggaagcgaatattctacctaaggggagttcctgaaagagtccacccattcagtagaggcatatgcagaaatctctatga

SEQ ID NO: 63799 - DNA, 248 bp, Zea mays
  Clone ID: LIB3075-051-Q1-K1-D6
ggatgctgcggagagcaccatgaatgcctacaaagctgctcaggatattgctcttggggatctggctccaacccaccccatcatgctcgggcttgctctcaacttctcagtgttctactacgagatcctcaactgccctgaccgtgcttgcaaccttgctgagcatgcctttgatgaggcaatctccgagctagactgcctgggagaggagtcctacaaggacagcactctgatcatgcgtgttctgc

SEQ ID NO: 63800 - DNA, 436 bp, Zea mays
  Clone ID: LIB3075-051-Q1-K1-D8
aaagaaacaggcacacaagaacaaatacctcgccaccaacaatggcctccaggtcctccatcctacttgcaacggcgatgctggttgcgctgtttgcggttggtttgtgcaccaccccgctcaccttccaggttggcaagggatccaagcctggccacctgatcctcacccccaatgttgcaaccatatctgacgtggagatcaaagagcacgggggcgatgacttctcctttacgctcaaggagggcccgaccggcacctggacgctcgacaccaaggccccgctcaagtaccccctttgcatccgctttgctgtcaaagtccgtggctaccgcattcgccacgacgtcaatccccgccgatttcaaggccgcaccacctataagaccacactcagcatctaatcagcctctgatgatgaaatatatttcaaaag

SEQ ID NO: 63801 - DNA, 58 bp, Zea mays
  Clone ID: LIB3075-051-Q1-K1-E1
tgaaaagacagttagccatcaagcaggtggtagtggtcaccgaggtagatggtccaaa

SEQ ID NO: 63802 - DNA, 273 bp, Zea mays
  Clone ID: LIB3075-051-Q1-K1-E2
gctatccagctccaactgcacggtggccatcgtaggcaggaaggaggactgcaccatcggagccgttcgagatgattggcgccacaaggatacaggaacttatcgactccatggaggtcgccgaggaggcgccctgggaggaggccagcttcgtgcaggatgaggagaggggcccagaagatgctgctgctgctgcacctgcacccatggacatctataagccccatatgaacccaccaagtttacgctgcattctgtggtccctaaagacta

SEQ ID NO: 63803 - DNA, 255 bp, Zea mays
  Clone ID: LIB3075-051-Q1-K1-E3
tgaaaagacagttggccatcaagcaggtggtagttttcacctaggtattttgtccaaacaagggctgtttgagatttgacccatgcgtttctttaagagcatcgtcgaataaaagatgactgcagtcagattgctttcttttgatacctcatattggcccattgggtgtgatggacatgtaatattcagttatggaacatgctcatttctatgcttagcgtgctgggaattttgcaaaaggtctcatatatcatt

SEQ ID NO: 63804 - DNA, 409 bp, Zea mays
  unsure at all n locations
  Clone ID: LIB3075-051-Q1-K1-E4
atcaccggccgtcgagcgagcagtctcccaattccacccaataactaataacatctcctcgaacgccaggttccttggaccactatatccaggagcgacgaagtgatccacccgccagccatggagatgaagaaggtcctctgcgccgccctcgtcgccgccgcctcggccaccgccgtgctggcctcggtcgcctccgaggcgccctccgaggcgcccgccggcgcggccggtggtgcggctggccctagcgcaagcggcgccgccgccgtcgtcgtgcccgccgtcggggcgctcgtcgcctccttcctcgcctactacctncactgagcgacgacgcgcggggcggcaacgttgggatgcatcgtgtttgttcattcgataaataattggtttttttatttacgtg

SEQ ID NO: 63805 - DNA, 238 bp, Zea mays
  Clone ID: LIB3075-051-Q1-K1-E5
gcctcgttttctactcgtggtctgaccatccaatccaaactcaaaagaacaaatacgaaagaagcgtagtgaaggggaacaaatgaatggatatatgtaatcttgagatgcatgccctctcaaatcactgtactggggttctcaaaaaaattattcgcatgggagttatatatataactgtatctcaccatttatttacaccaacaagtcattgggtatgcatgttctatcgttacat

SEQ ID NO: 63806 - DNA, 253 bp, Zea mays
  Clone ID: LIB3075-051-Q1-K1-E6
cggacgcgtgggtagttcgtgaatccctgaagcgtgcatatatatattcctgccaagataaaggtaatggagtcgtcacgcaggttccagccggccgtcatcctgcttctcctgctcattgtgtccaccgatatggcacaggcaagggaatgcgagaagtacagtgagcgatttgttggggcatgcatgatcgcagacaactgcgccaatgtgtgccgcggtgagggcttcttggccggcaagtgcagcacct

SEQ ID NO: 63807 - DNA, 343 bp, Zea mays
  Clone ID: LIB3075-051-Q1-K1-E7
ctcctccaccaccaccaccaagctcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctgttcgtgtgcaaggagtcctgcgctctctcccagcagtccaacctggtgctgtacggcaggatccagtgcaagggcaagtgcaccgagcagaaaggcatcacg

SEQ ID NO: 63808 - DNA, 392 bp, Zea mays
  unsure at all n locations
  Clone ID: LIB3075-051-Q1-K1-E8
gggtctgctcgtctagagaattttgcttctgcactcgaactgattggacaaaagctccaaatggatacactgcaaagtcgacttgatgcagagttccttctagctcatatgtgttcagtcaagtttaaggaatggatcgtggtgctagctactttattgcggcgtgcagaggttttggtggatctctttaggcatgatttgcgattgtggaaagcatatagcattactctacagtcacatgatgtattcacagaatatcttgaccttcttaatatcttggaggaggagctntcatctgtctctgatcttacattgcaaaatggaccattgtcatgaatgctggacaatgccactgattgaaagattgcggtgtttaaaccttgagttaatta

SEQ ID NO: 63809 - DNA, 59 bp, Zea mays
  Clone ID: LIB3075-051-Q1-K1-F1
cggactcgtgtgacgtcaccgtctacatcgcgggctccaaagtgaggttggagtgctag

SEQ ID NO: 63810 - DNA, 379 bp, Zea mays
  Clone ID: LIB3075-051-Q1-K1-F2
attcacctccaatctgcccctcgggccgtcggcgccgatggagaaggtgaagaacatgctcaagccgcggccgacgccgcagcagcagctgcgcgagtggcagcgccgcctccgcaacgagtgccgcgtcctcgaccgtcagatccgagatgtgcagagggaggagaagaacgtggagaaagccatcagggaggctgccaagcgcaatgacatgggatctgcaaaggctcttgctaaggagcttgtaagatcaagacgtgctgttaatcggctttatgagaacatggctcaactaaattcaggtatcaatgcaccttggagacatttgtcgcactgcatgaacaggtgggtcatcggtccaaaagcacttgaagtgatg

SEQ ID NO: 63811 - DNA, 233 bp, Zea mays
  Clone ID: LIB3075-051-Q1-K1-F3
cggacgcgtgggacgtcaccgagtacatcgcgggcgccaaggtgaggctggagtgcaagcacttcggcaccggcaagctcgagcgcgccatcgacggggtcaccgacgcgaccggcacctacacgatcgagctcaaggacagccacgaggaggacatctgccaggtggtgctggtggccagtccgcgcaaggactgcgactgaggtcaggcgctcagggaccgcgccggcgtt

SEQ ID NO: 63812 - DNA, 331 bp, Zea mays
  Clone ID: LIB3075-051-Q1-K1-F5
ccgatctcgatggcgaaccctcgcgtcttcttcgacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggctacggcaccggcggcgagtccatctacggcgagaagttccccgactgagaagttcgtgcgcaagcacaccgtccccggtgtgctctgcatg

SEQ ID NO: 63813 - DNA, 265 bp, Zea mays
  Clone ID: LIB3075-051-Q1-K1-C6
agcgacggtgttttctacgccgagctcaacgagatgctgacgcgggagctggcggaggacggctactctggcgtggaggtgcgcgtcacgccgatgcgcacggagatcatcatccgcgccacgcgcacgcagaacgtgctcggcgagaagggccgtaggatcagggagctcacctccgtcgtccagaagaggttcaacttccctgagaatggcgtagagctttacgccgagaaggtcgtctaccgtggcctctgtgccatcgcgc

SEQ ID NO: 63814 - DNA, 343 bp, Zea mays
  Clone ID: LIB3075-051-Q1-K1-F6
ggcaaagaagttgttcaataagctatcaactgaccctacaacaacaaacatgttggtcgctaagcaaccagcctctttcacgggttctgaggttcgaatcattgacgatgacatgccccttgctcaatttgctgttgctttcaatggagcatcatgggtagatcctgattctgttgcactgatggttatgcaatcaatgcttggttcatggaacaagagtgctggtggaggaaagcatatgggttcggagcttgtacagaaagcagcaatcaatgacattgctgagagtgtaatgtcattcaacatgaattacaaggacactgggctttttggggtctatgct

SEQ ID NO: 63815 - DNA, 239 bp, Zea mays
  Clone ID: LIB3075-051-Q1-K1-G1
atcccgcagccgccgtccaacgccaactcggatgccatggcgtcgttcaagcaggcccaggctctagctgctggacccttggtgcaagcccgaaactttgcagtcatgactggcgcaaatgcaggcatatcttgtgtcatgagaaggctacgatggcaagaggacattcagggcagcatgacagctgcttttggtgctggtgctcttttctccatagtgagcggaatgggaactcctaa

SEQ ID NO: 63816 - DNA, 136 bp, Zea mays
  Clone ID: LIB3075-051-Q1-K1-G2
aagagtgccagttctactaccacggtggcgccgtaaccatccgatgaggcacgtgggggtgcaagtacatgctcgggggcatggaccggcaccggcacggcctgttcgacgacgatgggaagtagatgcacggaga

SEQ ID NO: 63817 - DNA, 255 bp, Zea mays
  Clone ID: LIB3075-051-Q1-K1-G3
cggacgcgtggggcctcggctacggcggcaacaagaagctcgacggacgtcactcccagggccagcttatgcagatgaccatgatggttccaccttcgttaccgtgagaacactctctgaacaaggaggacagactggttcgctattgctggctggttgtgaagcacagagacgcggtgtatggactggagttctgctatgaggatggcggtaggaacgagctgagcggttttagccttgcttgtagaaaggatg

SEQ ID NO: 63818 - DNA, 369 bp, Zea mays
  Clone ID: LIB3075-051-Q1-K1-G5
gtggaggcccggggtgttcgacgtcgtgggccacagccaccacatcttccacgtgctcgtgctcgtcggcgccgtcacgcactatgtcgccgtcgccgcgctcatccactggcgggagaaggtggctgccgcctgtggcgcggcgtcgtatgcggggcttgctgctcctggcttctgcagcaacccagctgaggtgtttgatcatccagagcttcaatgtgccactgcgatggattcaacatgcgttcgaatcggttaacgaagtacttgcagttgcagcatagatcggctctagaggtcgtcgattcgtaatttaattgatgggatgatcgagtatgggggctcattaacttatgatgagatttatct

SEQ ID NO: 63819 - DNA, 149 bp, Zea mays
  Clone ID: LIB3075-051-Q1-K1-G6
cccacgcgtgcgcgaagctccagtggagccggcccgggtcctgccttctcgtcgcctgggggttcctggcgttcgtcgtcgtgattgtcgtttgacgtctacagttcgacgaccacttgcacaagcggaaggagctcgtcgaggcgtct

SEQ ID NO: 63820 - DNA, 310 bp, Zea mays
  Clone ID: LIB3075-050-Q1-K1-H1
gcctatcgctccctaccacttcgacttgagcggcaaggccttcggctccctggcaaagcccgggctcaacgacaagattcgccactgcggcatcatggacgtcgagttcagaagggtgcgatgcaagtaccccgccgggcagaagatcgtgttccacatcgagaagggctgcaaccccaactacctggccgtgctggtgaagtatgtggcggacgacggcgacatcgtgctgatggaaatccaagacaagttgtcggctgagtggaagcccatgaagctctcttggggcgccatctggaggatggacact

SEQ ID NO: 63821 - DNA, 408 bp, Zea mays
  Clone ID: LIB3075-050-Q1-K1-H10
cccgatcgccaccgccgaccggactcccctcaaaggcggccacagcacagcgagcatgggggaccggcatcagcatgggcggggcagcggcgtggaggacccggcgacgctgctgcggcgggtgcagacccgcgcgcccaactcgacgcaggtggtggggttcctgacgctgctcgtctatggcaccgtgctgacactgttgacgggattgactctgacgggcgccgtgttggaactcgtcttcctggggggcatcgcgctgttcaccagacccatgtgggtgcccgtcgacggcgtgatctccgacatcgttggcgacgcgctctacgactgagcctttcacgacggcaagctccccgtggccacctggatgtcccgctacttcacgggccggcaccccgggggcgc

SEQ ID NO: 63822 - DNA, 398 bp, Zea mays
  Clone ID: LIB3075-050-Q1-K1-H11
gaataacacaggtgagcgcgacgatgggatccctcgctaataacatcatggtcgtgggcgccgtccttgcggcgctcgtcgccggcgggtcgtgcgggcccccgaaggtgccacccggccccaacatcaccaccaactacaacggcaagtggctcaccgctagggccacctggtacggtcagcccaacggtgccggcgctcctgacaacggcggtgcgtgcgggatcaagaacgtgaacctgccaccctacagcggcatgacggcgtgcggcaacgtccccatcttcaaggacggcaagggctgcggctcatgctacgaggtgagatgcaaggaaaaacctgagtgctcgggcaatccagtcacggtgtacatcactgacatgaactacgagcctatc

SEQ ID NO: 63823 - DNA, 268 bp, Zea mays
  unsure at all n locations
  Clone ID: LIB3075-050-Q1-K1-H12
cgttcggagctaacgtccctaaactaaaaaatgaagtcttgctagctatggcctccgaacaacctgacgacacaaggagacaacaggtcgacgatgacgctcctggacaacgngattgaaactatagcatctgcattggcgacgctggtgccattcccttactattgagtgttctggagacatataatctgcatacccaggaacatgctgtgactgcacttgtgaacctctgtatacacgaagataactagacgagcattatatcatc

SEQ ID NO: 63824 - DNA, 309 bp, Zea mays
  Clone ID: LIB3075-050-Q1-K1-H2
cgcacgccctcgcccgagccatcttcgaaggcggaccacatgacggaccagctcatcgacgagctcaacgaggacttcaaggtggtctataacgatggcgacagcggtgtcaatacctacgagcttgcaactgagatgcgctctgttgggcacaaccttactgaaaaacagcttgaagacatgatcaacgacatggatgctgatggcgatgctaccattgacttgaccaatgacctgaacctgatggcgaagctgatgaaagacaccaactacgacgacgaccttaaggaggaccttaacgaggtctac

SEQ ID NO: 63825 - DNA, 419 bp, Zea mays
  Clone ID: LIB3075-050-Q1-K1-H5
cccacgcgtccggtgcatgatacctgcatcatgtcttctggaggttgtctttgatcatgtgcattattcccgggacacaaagctgagcataatggtcgtgcttataggagttgcagtctgcacagttactgatgtcagtgtgaatgcaagaggtctaatcgcggctgttatagctgtttggagcacagctttgcaacaatattatgtccattttctccaacgcaagtactctctgaactcattcaacctgctgggccacactgctccagcccaagctgggtcactcctgctagtgggaccatttgcagattacttgttgacaggcaaaagggtggatcacttcagtttctcatcgcttgctctgtttttcctggcactctcatgcttcatcgccattggggttaatctgagccaattca

SEQ ID NO: 63826 - DNA, 272 bp, Zea mays
  unsure at all n locations
  Clone ID: LIB3075-050-Q1-K1-H6
tcggtattcgtcccgccagcacaaaaaagggatttgctagctatgcgtanaacgaatgacgacgcagggcggcaacaggtcgacgacgacgctggtcgccgccgtggacgtagttctggccgtggcggcggcgtcgtccctggccggcgtggcgtccgcggagaatgcgggcgggttcgtggtgacggggcgcgagtactgtgacccctgccgcgccgggttcgagactaacgtgttcaggaacgtggcctgcgcgacagtggaagtggtgt

SEQ ID NO: 63827 - DNA, 317 bp, Zea mays
  Clone ID: LIB3075-050-Q1-K1-H8
cagaaagagaagagcggaatttgattatttttatgatgaggaagatgacaatattgtaggggttgcatctactgagctgccggggcagcataccccagaccctgttgttggaattgctgaagacgctgaagtaaatcaaaagagcttggaaaatgaacacgatgtaccaaacaatgggaaaggttcctcaacggtggtggattctgacttcacatctgaatgtaaaatcaaaacaatcgatcctatgaacgattctgggattactttaaaagaaaagagcattgatccttctatcaatgacatgaagcaagattctg

SEQ ID NO: 63828 - DNA, 389 bp, Zea mays
  Clone ID: LIB3075-050-Q1-K1-H9
caaaaatgtacctgaacaccaatagtacgttggagaacgttgcttcgaccaggattactatcttcgatctgaaactctgataagcagaattgaagacaaacgatcgggtacttggggaatatggaatttatttactgttggtttacctagtacttgcctaccagccaggcgccccaggggacgacggcaaagatacagtctcgggtattaggatggcaaaggcagcgatagataaattctactccaagtatatgttgggatcacgtaagctggtgcttgacccacattcaacgatctttggcaaaaggatgcttgtcaaaagtgcgatcatgtgctattccaataacacaagatagatcagtcctcgaggaaggtctacaggggccctg

SEQ ID NO: 63829 - DNA, 273 bp, Zea mays
  Clone ID: LIB3075-051-Q1-K1-A7
cttctccattcgtttacctgaagcacaagaataaacgcagccgggcatgggcgaagctgagctcaacaacgtgaccgtcctgctggtggccctcctcctcctgagcagtggcgttcaggacgctgccgccatgccaggcacgttgaactactgtcgcgatggtggccgacgagccagactgatagaacaaggacctgtacgggcccgtcgccaacgccaataaatacacccgcgggtgcgagtgcatagaacgctgttggggcgcgcgctgat

SEQ ID NO: 63830 - DNA, 118 bp, Zea mays
  Clone ID: LIB3075-051-Q1-K1-B1
catatcctatcctctacctctgcatcatctaccggctccgacgtctcgtatccggtccggaccttggcaggcatgggcaacatcaacatcgtatttgacactttagaaaggatcgaca

SEQ ID NO: 63831 - DNA, 253 bp, Zea mays
  Clone ID: LIB3075-051-Q1-K1-B3
gtcaggtcagcctccctctccggatcccccacctgctccgccgtcgtccaacgcgtcggtccccttggcagccaggatgacagaagcaccatttctgccacgtgagaggctcttcaagctgcaacatcatttccagaacatgaccaagcacacgtgcctgaaagggcgctacgatgtgatcacctacgttgccatgcctattgcacttgctgccttcagcatgttcatgattgggcgtggagtgtacaacatg

SEQ ID NO: 63832 - DNA, 254 bp, Zea mays
  Clone ID: LIB3075-051-Q1-K1-B4
cggcggcctcctcctcctccctctcttcagcgtcccccctcgctcgcctaatctctcggggcggccttgccggtgccgcagacggccatgggtctgcgaaggtgcccttgtggaaagatccgttgagcccgagcaagtggaaggaagagcactttgttctagcaagcctctcaatgtggggggttattttttatggtggttacaagctttttagtggaaagaaggaagccaagactgaggcgggatcaccacag

SEQ ID NO: 63833 - DNA, 143 bp, Zea mays
  Clone ID: LIB3075-051-Q1-K1-B6
gcgcctctacatttcttctctctctgctccttcgcctacggctgatgcattcatgagagggatcgtcgtgtcggactcggaggagcaccactttcgaatcgattgccgacgctgaggcgtgcaagacctacccgtagtaggct

SEQ ID NO: 63834 - DNA, 279 bp, Zea mays
  Clone ID: LIB3075-051-Q1-K1-B8
cggacgcgtgggcgacgatgtcatccctgccaactggaaggccaacaccgcctacgccggcaaataattaactttagtgctgacaatactttaagccggcctatgctagctatactagaattggttggatcccaagcaatgcattacacatgcatgcataggaccgtgatatctatttgctaccactaccctattacgacagtgatgctggcgccaacaatgatggtgtcatcctccttgtgcatcttcttcatcggcatatatagctagagtgagact

SEQ ID NO: 63835 - DNA, 432 bp, Zea mays
  Clone ID: LIB3075-050-Q1-K1-G9
ctttgttcccatttctggttttgagggcgacaacatgattgagaggtccaccaaccttgggtggtacaaaggcccaaccctgcttgaggctcttgaccagatcaccgagcccaagaggccttcagacaagcccctgcgtctgcccctccaggatgtgtacaagattggtggtattggaactgtaccggttggtcgtgtggagactggtgtcatcaagcctggtatggttgtcacctttggtccaactggcctgactaccgaggtgaagtctgttgaaatgcaccacgaggcgcttcaggaagctcttccgggtgacaatgttggcttcaacgtgaagaacgttgctgtcaaaggatctaagcgtgggttttggggctccaacttcaaggttgacccttgcaaggaggctgccagcttttacttcccaaggca

SEQ ID NO: 63836 - DNA, 230 bp, Zea mays
  Clone ID: LIB3075-051-Q1-K1-C1
gcaaattaaagagggatcggattggaactcgatcggaaggaaggtcctgcaggccggctgggcggtcgtggatcgaggaaccaagctgctgctgctgctaccggacgacaccaaccatgatacggaggacgacggtgtgcctaggcctgctggttctactactggcggcgtcgactgctacggcacatttctagatcgtggacgtggacgagtacttgaacaggcgcacg

SEQ ID NO: 63837 - DNA, 253 bp, Zea mays
  Clone ID: LIB3075-051-Q1-K1-C4
tgacgacgttggcaagagaggagggccggcgtcggcgtgcctagctcgatcttgaaccgtgggtagccagcatggcgcccagcagcagcatagcagtactgctgctcctcgtcgtcgccgtcgtcctctccaacgtgccctcctcgggcgccctggcctgctcggcgtcgtctctgctgcaccagtcgtctccggctgagagtgagactgataccgacagtagcagcggagaatctttgtcggcgtcgtcgtc

SEQ ID NO: 63838 - DNA, 251 bp, Zea mays
  Clone ID: LIB3075-051-Q1-K1-C5
atcgccagcaaagggagagcgccgaggtgatagagataatgcggtggtggtgctcatgggtggatgaatgggggtgtcgggctatgcgcggttgacgtcctcatcggagcaaaccccttcaccgttggttgcctcgtgccgtggcctggtaagtcgattactgctcatcatggtaggaggccccgaccgaccgtgcaaccgtgtgccgacgctgtggctgtgcgccaatgaaatcacgtgtaagaacaggt

SEQ ID NO: 63839 - DNA, 221 bp, Zea mays
  Clone ID: LIB3075-012-Q1-K1-G10
taccatttctcttctccaccccatagcacctttactctaaaactcttgttgtagcaactctgctccatactttatattgtttcttataaccattcgcaattgccctataataactcaaaacttcattactaactttcttttttttatttttcacagtatcataaaatttactacaacaaattattctgcatctccaaaaactctataaatcttacacccct

SEQ ID NO: 63840 - DNA, 438 bp, Zea mays
  Clone ID: LIB3075-012-Q1-K1-G11
ggttttgttaagaaattggctagtgtatgtcaagtgattgaactagggtagaaagaagtcgagttgcaggtaattttacttaacttgacaaataaaactggatttttaaggatccactttagtaagcatttctgcaaaacagagtctttgattattgagaagccttaccttgactcccttataaccagcatacccttgagagtctttcctttagtcgggtaagacttgctgagtaattccatactcagggttttattccccgttgtttttaggtgaggaagcgacaaatttttgttgcttctgctctaaggtggtgccaaaagaagaacgcaaggaatgaagtgcgtgaggaaaggatcctccatttaggacttttgtgtaaaaacttatcgggaggagtttttgcctcccttggtatgtgtaataaatatactctgc

SEQ ID NO: 63841 - DNA, 465 bp, Zea mays
  unsure at all n locations
  Clone ID: LIB3075-012-Q1-K1-G12
cgcatgaagnttcatgacacttacccactctaccttttgctgaaagggagcgtgatgcttattaaggggttctgtaaacaccttgtggtcggagggaaattctagatattgctgaaatcttccgagcaaaacctattgacgtttctgaccatacagtaacccttcagcttactggagatcttgacaagatggttgcactacaaaggttattagagccatatggcatctgcgaggtcgccagaactggacgagtggcactggtccgtgaatcgaaggtcgactccaagtacctccgcggttactctcttccattgtagcctggcatttgtgattggtggtggacccgataaagagcttggtttgttgttatagatcagaccatctcgcgctgggatgtgttgtgcaattacaggacctgtttctttcatgttgtgaactccctggcctgcgagttcaataatgccc

SEQ ID NO: 63842 - DNA, 380 bp, Zea mays
  Clone ID: LIB3075-012-Q1-K1-G2
gcagcagcaagcccacccgttcgacgacatggtccgtctcggcgccggcgccgtgttggcgctcctagtggcggtcgcggcggtggccgcgttcctcgcggtgccggcctcggcgaagtccggggagctgagcgcgatggggttgctggcggcgaagggcggcagcggcgcgggcccgcagaagtgctcgggcgcggtgggcgagtgcgacgtggacgaggcggaggagctcgggctgagcggcggcggcctcggctccgacgacgcggtgcggcggacgctggcgcagcggaagccgaccaaccggtacatcagctacgcggcgctgcgcgcggaccacgtgccgtgcaacaagcgcggccggtcctactacagcaact

SEQ ID NO: 63843 - DNA, 363 bp, Zea mays
  unsure at all n locations
  Clone ID: LIB3075-012-Q1-K1-G3
agagcggcacgcaccttgcagaggaggagctggtcccttccgcgctcctcaagttcattcccagggagactgattccgtggtcttcaccggtttgcttgatgagcttctggaggccagtgagccgcttcctgctgcatcacaatgaagtgtgtgtatatagcagttcgttctgttgctgtttctgcttgctgcatcacaggattacttggataacggtacgtatttgtattggctgacatatcttgtggaaaggctgacatactcgagaaattcgttaggcccatgctgaactggatatgggctggactgggctggactggactgtaaaactcaatacatggcaagattgcttgaaaanaaaa

SEQ ID NO: 63844 - DNA, 288 bp, Zea mays
  Clone ID: LIB3075-012-Q1-K1-G4
gtcactcaattgagaggtgagcagaatggacagtgaaaagtttgtagtcacaaatcttagtgcatgtcatcttttggtatacaaaagcctggacaactattgcaagggctactaggattcatcaatggatctgtgggagaggtgtttgcagcttgcacgatgtaataggttgaattgctttattcacatgtggcgttgctatagttgtttagattaccattactatatctcaatatgtatgctaagtaccatatctgcttgaatttatgtttattgacattttccccg

SEQ ID NO: 63845 - DNA, 368 bp, Zea mays
  unsure at all n locations
  Clone ID: LIB3075-012-Q1-K1-G5
atctgcgtcaagtccggcgcctccaaggtggtcgtcaacgacgtcgtcttcaagaacatccgcgggacctccaacacgccggaggccatcacgctcaactgcgccaacaacctgccatgccagggcgtgcagctcgtcaacgtcgacatcaagtacaatggatccggcaacaagaccatggccgtctgcaagaacgccatcggcaagtccatcggcttggcaaaggagctcgcctgcatctgaaccaattgactaacatgcatatattatatatataatcactcttcgtaacctctctctttctcacgtactctcaagtctccaccgaatatataatccgcttgtttgtnnaaaaaaaaaaaaannna

SEQ ID NO: 63846 - DNA, 479 bp, Zea mays
  Clone ID: LIB3075-012-Q1-K1-G6
gcgacaagatatattttagacattttaagtttgataatggatccaagatatgttactttattgatcttcttagtacttgccttacatggagatactactttggcagaaacttgcaggcagttcgttaaagtgcatccattctgctttaaagcaatgtgcaaggcaaattgtgctatagagggaaaattctctgatggttcctatgtaaaggattacagatgtgaatcaggtggatttcactcagtgtgcgtttgcattttttgcaaacattagttatctaaagacaagcggagatatcttcttgtattcctatatgttatttaggagtattgccaaataattatacggtagcttagttaactagctagtttgtttatttatagacatatgtagcactagttaactagttggtatttcttaaattatcagctatgtaccaagaaacatgttttcagcgcttcaataatatatctttggtc

SEQ ID NO: 63847 - DNA, 269 bp, Zea mays
  Clone ID: LIB3075-012-Q1-K1-G7
gtcagcctgctctgctccgagacgcagccgtgcagcggcgtctcgctcatcgatgtcgacggggagtacgccggcaagaacaacaagaccatggctgtgtgcagcaacgccaagggaaccgccaagggaagcctccaggccctggattgcctcgtctgatcgatgaccttgcatttgcatgcattcttcttccgtttcacttttccatattctattgcgttccagctaagcatcttgtttcttgcagaatatatatatatatctctact

SEQ ID NO: 63848 - DNA, 427 bp, Zea mays
  Clone ID: LIB3075-012-Q1-K1-G9
gacgaattgcagaatgatgatgccgaagcacgcatcaaactctggatccggcatatcctgaagtgcaaaactggggtactaggggtgtgtttggcatggctctgctccaccccagagcagctctactctaaaactctgggtggagcagctctgctccagagtttagattgtttctcataaccagtggcaatggcggttaaataactcaaaactccatgactaggttgcttttttggagttttcagagcagcaaaagaggtactccaaaaaattgtactgcagctccaaaaactctatagagtttacaactctggagttagggtgtttggcatgctctggccagctcctccttggagttttgctctggagccatgccaaacaggccctaagagtccgatttccattcagctgcatatacgaaatgaca

SEQ ID NO: 63849 - DNA, 440 bp, Zea mays
  unsure at all n locations
  Clone ID: LIB3075-012-Q1-K1-H1
cgacaacaacggacacacacatcgtctatcagtgctcatccaacaatccgtgcgcgaccaaggcgaaggatggtgtcgtcctcccgtgctgtcgtcgtcgtcgtcggcctcctcgtcgccgcgtcctccctcgccgtcgctgcctccgatggcggtgggccgacgtacgggtacacggcggggagccccgacgggccggagaactggggcaagctgagccccgcgtacaagctgtgcgggcaggggaagcagcagtccccgatcgacatcgtcaccaagcagggccgtccccaacgccaacctcgacaccctcaaccgcacctacgccgncaccgncgncacgctcattaacgaacggccacgacatcacgatgacgttcgagggcaaggtcgggacggtaatggtgaacggcaaggcgtacagcttcgagaagatgcac

SEQ ID NO: 63850 - DNA, 373 bp, Zea mays
  Clone ID: LIB3075-012-Q1-K1-H10
cccacgcgtccgcccacgcgtccgctgacgcgtgggcgaatgcatctacaagttctttaacgaaaggttcaatctgaggtcagtgaaaaatgaagaacaagctggatctgaaaatgatgatgaagggaacagcagaccttcctttttgtccgtggaaaagggcgctggttccttggacaaggaactagctgccagtggatttaccaggaaagagcaagtggatatggataagtacatcgaggaggttgttgaagggcacggttccagctcagatgatgacaatgatgaggttggtgatgctgtgcctttggtttctttcaagatagaccaagacagttccgatgagcctgattgtgatcttaccccaagtgat

SEQ ID NO: 63851 - DNA, 158 bp, Zea mays
  Clone ID: LIB3075-012-Q1-K1-H11
ctcaggagcgaggaaagagggacagaggaggtatagatccccgggctccacgcctgcgaaggcatccgtcccgatcccgaccagctttgagatcgcgatggcggacggccgctgctgcaccttcctggagatcctcttcggcatcatcctcccggccc

SEQ ID NO: 63852 - DNA, 290 bp, Zea mays
  Clone ID: LIB3075-012-Q1-K1-H12
gatcacgacaagatggcgtgcacaaacaatgcgatgagagccttgttcctcctggtgctctggtgcatcgtgcatggtgagaaggaagagtcaaagggcatcgatgcgaaagcgtccgggcctggtgggtccttcgacatcaccaagttgggcgccttcggcaatggcaagacagacagcacgaaggctgtgcaggaggcatgggcatcggcgtgcggcggcactgggaagcagacaatcctcatacccaagggtgactttcttgtcggacaactcaacttcacaggccc

SEQ ID NO: 63853 - DNA, 192 bp, Zea mays
  Clone ID: LIB3075-012-Q1-K1-H3
acgcccagccatggatcgatcccacaggcacgccggtgaagtacgacctgttcacatgaggacacagctggaccggggatcggatcggagggttcggttcacggtggccggtgggggatcggaggccagcgcggcagcatgcatgcccttggttcgttgaatcgttcggtttcggtcctccctagatcggga

SEQ ID NO: 63854 - DNA, 175 bp, Zea mays
  Clone ID: LIB3075-012-Q1-K1-H4
gcagaggtcgacaagacgagacaagagaatgcctgtgagcaggatcgccgtgggcgctccgggcgagctgtcccaccccgacaccgccaaggccgccgtggccgagttcatctccatgctcatcttcgtcttcgccggctcaggatcgggcatggccttcagtaagctcacggac

SEQ ID NO: 63855 - DNA, 281 bp, Zea mays
  Clone ID: LIB3075-012-Q1-K1-H5
gaggtcgccaaggagaacgcggacgtgatcatcatggacgacaacttctcgaccatcatcagcgtcgccaaatggggccggtcggtctacatcaacatccagaagttcgtgcagttccagctcacggtgaacgtcgttgccctcatggtgaacttcgtctccgcgtctttcacagggagcgcccctctgaccatcgtgcaactgcttggggtgaacctgatcatggacaccctgggcgccctggcgctggcgacggagccccccaacgacgcgatgatgcg

SEQ ID NO: 63856 - DNA, 357 bp, Zea mays
  unsure at all n locations
  Clone ID: LIB3075-012-Q1-K1-G1
gtccttctcagttacttcgaccccatcaagctggacgagatgaagacacgcaccgncatcctgcccgcgctgctctccgtcaccgacaagaaactcggcgtcctcaactacaccagggccgacgacgggcagatgtacttcggcgctcccggcgccccctgcgtggccaagctcgtgaaggtcgtcgcagcgcggccgtactctgtgtccatcatggagatcagcgagcccattttgccggccgcgttgccctcccccgtcgcggcgcccggccgccgcggcaagggtggtaagcgcaagatcaagccatcagcggcaacccatgaggattccaacatgatcccgcgcaagcccgtc

SEQ ID NO: 63857 - DNA, 169 bp, Zea mays
  Clone ID: LIB3075-012-Q1-K1-H6
tttggagaggaaggatgttaacttgtatctaattaaagtagaaggcaaggttggtgggaagcgggaggacactgaacttgtatatggaattattgttgacaaagatatgagccatccacaaatgccaaagagaattgaggatgctaagattgccatcttgacatgccca

SEQ ID NO: 63858 - DNA, 458 bp, Zea mays
  Clone ID: LIB3075-012-Q1-K1-H7
gttctagatcgctagcgatctagaactagtgtcggacttaaatgcactttcatcttatggaggttctttgctcccattgtggttgcatgctgaggtgcacctgaagcaactagactcttctatttccaagctggaaatgaactatcatgcagattcagaacctaggaattcaaagacagaggttgctgaacacagggcacctgatgatgctgacttgataaacaccctccaatggcgagcctttggaatatgaagtttgtgctgggattactatcgatgcaaatatgaagattggtaagccagcttcaacgtctcagaattcacaaagatagggataatgcagctgttcctccaaaacatgaatctgacaatgatgaagatatggatgtggaaatggaagttgatgaagataatgtcgaagagcaggcacagtgcagttctgtacctgaaaaggagca

SEQ ID NO: 63859 - DNA, 356 bp, Zea mays
  Clone ID: LIB3075-012-Q1-K1-E5
gcgcaaagtgagcccattaaagctggcagctagttatttttaaccctaaccggtcacatcccgggggcgagggcctaggtgctggccccggcctatgcacacctgaacggggcacccccgaggcacaagcgctcggcccctggctgcacccagcagcgcgcgggcgaagccccccagcggctcgacacgggcgcgcccccctgcggcgactcagcggtcatggcccccggctgcacagcgcaccgcgggcgttgctcctcggtcagcgagcgcaagcaggccccccatcggtcagagcgcgacccccggccttagtctcgggggtggcgccgcccccgcaaggcgcgagcgctgac

SEQ ID NO: 63860 - DNA, 412 bp, Zea mays
  Clone ID: LIB3075-012-Q1-K1-E6
ctgggttgtgggtcctgcttcgagatcaagtgcgataagcctgtggagtgctccggcaagcccgtggtggtgcacatcacggacatgaactatgagcctatcgcggcgtaccacttcgatttagcaggcacggcgttcggcgccatggccaagaagggcgaggaggagaagctgcgcaaggcgggcatcatcgacatgcagttccgaagggttaagtgcaagtacgactccaaggtcaccttccaccttgaaaaggggtgcggccccaactacctggcgctgctggtcaagtacgtcgatggcgacggtgacattgtggcagtggacgtcaaggagaagggctctgacacgtacgagcccctaaagcactcctggggcgccatctggaggaaggacagcgacaaaccgctta

SEQ ID NO: 63861 - DNA, 426 bp, Zea mays
  Clone ID: LIB3075-012-Q1-K1-E7
cggacgcgtgggcggacgcgtgggcggtggtcaggacaagatcagacctctctggaggcattacttccagaacacacagggtcttatctttgttgtggatagcaatgaccgtgaccgtgttgttgaagccagagatgagctgcacaggatgctgaacgaggatgagctacgtgatgctgtgctgcttgttttcgccaacaagcaagatcttcctaatgccatgaatgctgctgagatcactgacaagcttggattacactccctgcggcagcgacactggtacatccagagcacttgtgccacaactggcgagggtctgtacgagggcctggactggctgtccagcaacattgcgagcaaggcttgaatatcaaatgcgaactgactaagagctccggatgtatcatggaaacttaggacagaatc

SEQ ID NO: 63862 - DNA, 417 bp, Zea mays
  Clone ID: LIB3075-012-Q1-K1-E8
cgtgtatagacaatgcaatgagagccttgtttcttttagcgctcttctgtgtcgtgcatggtgagaaggcaaagtcaaaggacaacgatgcaaaagcgtccgggcccggtgggtccttcgacatcaccaagttgggcgcctccggcaatggcaagacggatagcacgaaggctgtgcaggaggcgtgggcatcagcgtgcggcggcaccgggaagcagacgatcctcatccccaagggcgacttcctcgtcggaccactcaacttcacaggcccatgcaagggcgacgtgaccatccaggtgaatggcaatctgctggcgaccacggacctaagccagtacaaggatcatggtaattggatcgagattctacgcgtggacaaccttgtcatcaccggcaagggaaagctcgacgggc

SEQ ID NO: 63863 - DNA, 82 bp, Zea mays
  unsure at all n locations
  Clone ID: LIB3075-012-Q1-K1-E9
cgnntccgcagctagggcgatnnggctggagnncccgggctacttggcttctatcgtcnccctcgcggcttggccccgtcgc

SEQ ID NO: 63864 - DNA, 425 bp, Zea mays
  unsure at all n locations
  Clone ID: LIB3075-012-Q1-K1-F1
cccacgcgtncgcccacgcgtncgcggacgcgtggggctccgacacatacgagcccctgaagcactggtggggcgccatctggaggaaggacagcgacaaaccgcttaagggacccctcaccgtccgcctcactaccgagggaggcaccaagtccgtctacgacgatgtcatccctgccaactggaaggccaacaccgcctacaccgccaaataattaactttagtgctgacaatactttaagccgacctatgctagctatactagattgggttggatcccaagcaatgcattacacatgcatgcattggaccgtgatatctatttgctaccactaccctattacgacagtgatgctggcgccaacaatgatggtgtcatcctccttctncatcttcttcatctncatatatagctagagtgaga

SEQ ID NO: 63865 - DNA, 465 bp, Zea mays
  unsure at all n locations
  Clone ID: LIB3075-012-Q1-K1-F10
cggaaatcagagacgcgaatccctcgccccaggccccgaaacctccgagttctctcgccaattcgatccgcctcaccgccgccgcccgtccgccggtcggccttgactgctccgtcgcacgtggcggttcgcagcgcggaatctaccttgtgttgagagatccggggaaacccttgttcccggtcgttccggctcgaatcttctgcggactggcaatgtaagcgttctccatcggagggcgacgatctacggggcggttgttggcggggtcgcgggaatggagcacgtgttcggagggaagtttaagcttgggaagaagatcgggagcggatctttcggcgagctctatctcggcgtcaacatacagagcggcgaggaggtggctatcaagttggaatcttgtaaatcaaggcatcctcagcttcattatgagtcgaaactatacatgcttctncaaggggaact

SEQ ID NO: 63866 - DNA, 465 bp, Zea mays
  unsure at all n locations
  Clone ID: LIB3075-012-Q1-K1-F11
cggacgcgtgggcacgcccacgcacctcgctatcgtcatggagtacgccgccggcggcgagcttttcgacaggatctgcagcgccgggaggttcagcgaggacgaggcgaggtatttcttccagcagcttatctgcggtgtcagctactgccacttcatgcaaatttgtcaccgggacttgaagctggagaacacgctgttggatggcagcccggcgccgcgcctaaagatctgcgactttggctactctaagtcatcgctgctgcactcaaagcctaaatccacggttggaactccggcgtacattgctccggaggtactctctcgccgggaatacgacggcaagatggcagacgtttggtcttgtggagtgactctttacgtgatgctggntggtgcataccctnttgaggaccccgatgatcccaagaacttcagaaaaacgatggggagaatagtgtcaat

SEQ ID NO: 63867 - DNA, 433 bp, Zea mays
  Clone ID: LIB3075-012-Q1-K1-F12
gtactacgccagcaacttcgtcaacgccacagagaccaactaccgcaacgattggaatgcagagatttcgtatgagcgagatggtgtgcccattggcaaaagggcgtactcggactggctttacgtcgttccatgggggctctacaaggctctgatttggaccaaggagaagttcaacagccctgtgatgctcatcggagagaacggaattgaccagcctggaaatgagaccttgccgttcgctctgtacgacaagttcaggatagactacttcgagaagtacctgtacgagctccagtgcgccatacgcgacggtgcaaacgtcttcggctacttcgcgtggtcgctgctggacaacttcgagtggcggcttcgcttcacctttcaagtttgggatcgtgtacgtggaccggaacacgttcgtccggtaccc

SEQ ID NO: 63868 - DNA, 337 bp, Zea mays
  unsure at all n locations
  Clone ID: LIB3075-012-Q1-K1-F2
gccgatgctcccgctcctagccccgactccgtctcatccccagactcatcgtcagaggcgccgtccagcagcagctcctccgactagacgcaaaaacctcttcattctctggaataactaacagtatatacgttgcaccctgatgatatagaaacatgtacgtgcatcagtgtatggaatgcgagtggcaaacacatggaatgtgcttgcctaattattgtttatttctttatttattatatgtctcttctcggttgttttttatttttcttaatgcatgtaatataatttgttatacccaatatagacaatgtgtgctatgcgctttaattcnnaa

SEQ ID NO: 63869 - DNA, 283 bp, Zea mays
  Clone ID: LIB3075-012-Q1-K1-F3
accggtcgttggaccatgcttgagtttggaaaggcgaccttgacgatgcggaagtgcctctttgtccgtgcgatttttgacagaccctgtgtgcttcgttggatctaagtttttgtcaggtttttggagcacagggctgttagatcacaggagacgtatgctgatgtgtataaacagactcgtttttttcagttggggttttctcctatctgtggagaatgtaattaatgtccaacgcatgatgtcgctcgccacataatattttattgtatcttacttgcat

SEQ ID NO: 63870 - DNA, 372 bp, Zea mays
  unsure at all n locations
  Clone ID: LIB3075-012-Q1-K1-F4
cccacgcgtncgcggacgcgtgggctgcagtcatcttctccaccaccaccaccaagctcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgctctctcccagcagtccaacctggtgctgtacggcaggatccagtgcaagggcaagtgcaccgagcagaaaggca

SEQ ID NO: 63871 - DNA, 481 bp, Zea mays
  Clone ID: LIB3075-012-Q1-K1-F5
cgggtggaacccgatccctgacgtgagcgactcgcacatccaggagctaggcgggtgggcgctggggcaggcgaagcaccagaagctggccgccgacgggctgcggttccgccgcgtggtgcgcggcgagcagcaggtcgtgtccgggatgaactaccgcctctacgtcgacgccgccgaccccgccggccgcaccgtgccctacgtcgccgtcgtgtacgagcaggtctggacccgcacccgccagctcgcctccttcaacccggtgccccgcgccccctgaaaccatacggacacgggtgggccgaagcgaccacgacgatgttctccgtcaattacgtgtcgagctaatcttattattggttctattattataataatgcttctccctgttcctatggacctatagtagtatactagtatgttgcgagggagcgagtagaccgtgtgtttcgctatcgtgggactagaataagccatg

SEQ ID NO: 63872 - DNA, 385 bp, Zea mays
  Clone ID: LIB3075-012-Q1-K1-F7
cgcgcggccggcggggcgcagatcggctcctgcacgtgcagcgcagccgcacgatagtgaagcagggaggctgcgataggaggcgcagggagggtgcgacggaggcaaagagcaagcacctggggacttcaggtaagtagaaaaccaacactgaatttgtcggttctctattttgtgattgaccgattggtttgttgatctcagaaaccaaaaattgtttcaccgtcaagcaccaatttttgggtaggtaagtgttttgggatgattctcctatgcatcaatagcaaccttgtgcttggcaaagttatttgccctgataatgttgtaggtttagtgaaaagaaatatactgacatatccaccgatccatcgatgcccaatggaga

SEQ ID NO: 63873 - DNA, 398 bp, Zea mays
  Clone ID: LIB3075-012-Q1-K1-F9
cggacgcgtggggaacgtcgtacgagaacctttctccctcctccacctttctccttttcttggcacggcaaaacaccttcgccggcgagagcatggcgatggcgtaccgtgtcctggaggtcaccctggtgtcggcaaatgacctcaagaaagtgtcgctcttctcccggactcgcatctacgccgtggcttccatctccggattcgacctccgcatcccttcccacagcacccaagcagaccacagcaacggctgcaacccctgctggaacgccgtggtacacttccccatcccggctgccgctgacacccgcggcctcgcactccacgtgaggctccgcgcccagcgtctatacctgggcgatcgcgacatcggcgaggtgtttgtgcccatcgac

SEQ ID NO: 63874 - DNA, 445 bp, Zea mays
  Clone ID: LIB3075-012-Q1-K1-E4
gaagtatttggatctgatgcttaaatcgggctacacgccatcactaactgttttcactgattatatgcaagcatgtgtcagatctgggaggttggacacgttgacatcaattatacagaaatgcaagacagctgataagatcaaagttttgtgtccacaatgggcctggtgcattgacatatcagaagctgcatttgaagctaacaatagcaaattagctctttttgctctggaatttcttgcaagatggattgttcgtggtgagaatgttaaacctcctgttcagctgtcagttaatgaaggtcttgtaatatcagctctgagtgctgctggcagaacttttagtactgacctcttgaatgctgcttggtcgctactacggaagtccctgcgccagaaaagggcacccaccccagagacatatcttgccaagatctatgctcat

SEQ ID NO: 63875 - DNA, 351 bp, Zea mays
  unsure at all n locations
  Clone ID: LIB3075-012-Q1-K1-D1
gcgtcggcaactccgcttcgccggccgggccgtctatcgtctaaaaacctttcagggcacggggctagctgaaggagagggaacggagggggatggcgtcccggcgacgagataagccggctcttcgatccgccgcacgggatgagatgctgccnaccgcggatacggtgccgcgacgaacaaataagctcgaaaggccaagttcatgacgctcggaaccccgccgccggacgagctcaccttaacgccacaaagtgacggccatcggacagatctacggtctttctaatgaggcaaagccgggggaagacaacaggaactacgtcgagaagatgaagaacgagaacgtct

SEQ ID NO: 63876 - DNA, 140 bp, Zea mays
  Clone ID: LIB3075-012-Q1-K1-D10
ggagaagctactttgaagctaccactgcatcatggcatgtgacttgttgaataattggttgcaggagtagagtgcgccggttataacttataaagcagagcatgccgtgttgatactgagttttttgttggcttgaccta

SEQ ID NO: 63877 - DNA, 310 bp, Zea mays
  Clone ID: LIB3075-012-Q1-K1-D11
atcacgacaagatggcatgcacaaacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaagctgtgcaggaagcatgggcatcggcgtgcggcggcactgggaagcaaacaatcctcatacccaagggcgacttccttgtcggacaactcaacttcacaggcccttgcaaggggcgacgtgacca

SEQ ID NO: 63878 - DNA, 375 bp, Zea mays
  Clone ID: LIB3075-012-Q1-K1-D12
tgacgagatcgcatttatcacggaatcagcttccaactattccaatctgtccaaggtgcatgctgccgagaatgccaagcctcttgaaaagattgagtttgagaaggtgttacgcaagaagtttgctcaccaggatgaggagtatgattcctccatcggcatcactcgaggggccccaccggagctgacatccccaaatccagcccaataaacctctgtttttgtttctgttttctctttgacgccttaatcattttgtattggacagcgctggattttgaaccgggccatagttccatgacttaagtggcttatgtttacttttcctccccaataatcttgggtcgagcgatgttataaagctggccatgcact

SEQ ID NO: 63879 - DNA, 341 bp, Zea mays
  unsure at all n locations
  Clone ID: LIB3075-012-Q1-K1-D2
ggaggagttcgccgcgtactgccggaggggtttatgttaangagaagggtggaaatggaggacgggcgtgtggccaacgtcgctctcggcggggacccccaagtggcactgtttggtgtgttcgatggccacggcgggaaaaacgcggcagagttcgccgcggagaacatgcccaagtttatggccgaggagttgacgaaggtaaacggcggagagatcgaaggagcggtgaagaggggttacctcaagacggacgaggagttcctcaagagggacgagagcgggggcgcgtgctgcgtcacagacgtcctccaaaagggtggactggtcgtctccaacgc

SEQ ID NO: 63880 - DNA, 356 bp, Zea mays
  Clone ID: LIB3075-012-Q1-K1-D3
atcgagcggactgatgaatggtgggagaacagagaaactccaccgccatggcccggcgccgcgcctcctctggtgcactggtaccgctgccatgtgccgtgcagtgcgttggtgggatcctgtcgtcgtggtgggaatccagcggccctgggtaattcgggtgtgcgcccacatttggcctcggtgaccagctacaggattccgccggacatctccagtgcaaatcatgtggtcattccgggtggattgatgccgggggaccctgggattgttcaccggaaaatctacacagcggcaaagcgactctgagcggtgaccggagtgattacgccatcccatttggtaagaagcttacc

SEQ ID NO: 63881 - DNA, 400 bp, Zea mays
  Clone ID: LIB3075-012-Q1-K1-D4
gcacagagtgttttgatggagagagaattgatgagcactccactaccacctcaccagacaactgttgctcctatccgtggtctgtttcactccaatactggatctgttggtcctttgtgctcacctccgtctgtaaggttctcttcgcattcaaatcctgagcaataccccaaccacaattcatacaattctcaagtaccaagcactgcaagttcctcaacgctgaattatgggtcacaatatggaggctttgaaccatccattaaccgatttcccaagagacattgaaccaacttggtgccccgatccagttgagagcattcttggatactctggtgatgtccctgctgggaataatttgactgggaccacttctattggagcttcagatgatcttact

SEQ ID NO: 63882 - DNA, 357 bp, Zea mays
  unsure at all n locations
  Clone ID: LIB3075-012-Q1-K1-D5
cccacgcgtncggtgcagtgcaggtcgtcgcagcgccgctacgagggggaggggatcgaactcgaaggagaatttccattcgaccccatccacttctcacctcaatctcgcgagaagcgaagccggaggaggagggtgcgaggagatcgcgagcagccggagccggagccggagccggaggcctagtagatgaagacgttcgatccgtggccggtcttcttccgccgggagtggaagcgcaattggcccttcctcacggggttcgccatcaccggcttcatcatcactaagatgacggccaacttcaccgaggaggacctcaagaactccaagttcgtccaggagcacaagaagcgc

SEQ ID NO: 63883 - DNA, 393 bp, Zea mays
  Clone ID: LIB3075-012-Q1-K1-D6
ctcttctcaccgcatcacctctccctccggcgcgcgcgtccgggtacagcgctagagtcactgaccagcatgcatgcggcggcggcggcgaatggcgcgggcgacgtgcagaagcctcagcagcagccgctggtggcgggggcgccgcccccaccgccggcggcggccgtggtgccgccccattgggtcgccatgccgttcgcgccgccttccggggccacggccatggtgatgcagccgcaccatatggcgcctccgccgccgcagttcgcgccgactcacttcgtgccgttccacgccgtcgcgccggcaccgtcggtgccagcagcggtcgcactgggtttcccagcgccgcatcagccccggcaggaggaagacaagagcgtgtgggtc

SEQ ID NO: 63884 - DNA, 335 bp, Zea mays
  Clone ID: LIB3075-012-Q1-K1-D7
atttggaggaaagattatccgtgctccttctggagtgatgcatgggaaaagctctccagttgattacgacgaggaattaggaaaggccttattcaatggcttgccaaacccttttacagcggcgaggtaccacagcttagtcattgagaaagaaaccttcccacatgatgctttggaggctaccgcatggactgaagatggactcatcatggctgctcgccacaagaagtacaaacacatccagggtgtccagttccatccggagagcatcatcacccctgaaggcaagaaaatcatcctcaactttgtcagattcattgaagagctggagaagc

SEQ ID NO: 63885 - DNA, 287 bp, Zea mays
  Clone ID: LIB3075-012-Q1-K1-D8
gtgaaccagcagcctccaataaaagctctcatatccaaataaaaccgagagacctcaggcctgaggcaagccgaccgccgacgtaccaccgcgccaacccgagagaaagatggagatgatcaagaggatcctcatcgccgcgctcctcgtagtcgccgtctcggccaccgcagtgctggcctccaccgaggccgccgccgccgggtgccccagccgccttcgagtcgtcggcgttcgccgaagcccccgctggcgccgtcggcgccggcgccggcaccggcaccgtc

SEQ ID NO: 63886 - DNA, 465 bp, Zea mays
  Clone ID: LIB3075-012-Q1-K1-D9
cccacgcgtccgcccacgcgtccgcccgcgagcgctctctttctctatcgactggcgacgactgcgccaccgccgccgctctacgcgagacgcccaggtcttcgccaacgacgagcatccgggttagagaggaagaaattgcaaccgaaacaatggcggcagattccggcgctcgcagacaaccaagcttcaccaaggtcgaccagctgcgccctggaacccacggccacaacctcatcctcaaggttgttgactccaagatggtcgtccagagaggccgcgagggagggccccagggaagacagatgaggattgcggagtgcttggttggtgatgaaaccggcatcattgtcttcactgcaagaaacgatcaagtggatgtaattaggcctggaacaactgttgaactgaggaacgcaaagatcgacatgttcaagggttcgatgcggcttgcagtggacaagt

SEQ ID NO: 63887 - DNA, 369 bp, Zea mays
  Clone ID: LIB3075-012-Q1-K1-E1
accctcgtcgtcgtctcactcaccccgcctttacgccttcctcaccaaataaggtcccgcccttttgcgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctactgcgacacctgccgcgccgggttcgtgaccaatgtcaccgagtacatcgcgggcgccaaggtgaggctggagtgcaagcacttcggcaccggcaagctcgagcgctccatcgacggggtgaccgacgcgaacggcacgtacacgatcgagc

SEQ ID NO: 63888 - DNA, 456 bp, Zea mays
  unsure at all n locations
  Clone ID: LIB3075-012-Q1-K1-E10
cgnntccgccctcnngtcgtcgtctcacctctaccccgctcttcactgccnntccctcaccaaataaggggtcccgcgccttttctcgacacttcacnnaggggggaccaggnnaaatcagcggcccatggcccctcgattctcgggcgacgaacctnntcgccgtcatcttatcccgtnncctcttctgtnngccgcggcttggcaccgccccgtcgacaaccgaacctccctcgactaccgtcatctcaggggccgcgtctactggcgacactctgctncgcgccgggttctgtgaaccaatgtcactcgagtaccatcgcgggcgccaaaggtgaaggctggagtgcaaagcacttcggcaccggcaaagctcgagcgctccatcgacggggtgaccgacgcgaacggcacgtacacgatcgagctcaaggacagccacgaggaggacatctg

SEQ ID NO: 63889 - DNA, 363 bp, Zea mays
  Clone ID: LIB3075-012-Q1-K1-E11
tgaagattccactgaggtgcaaaaatatgagtccagcattcgacgggaaaatgaagcatttgaatccttgatcagacagaagtccctgatgatgatacctgttgatcaggatggccgttgcattggaccaactgttgcaaatgaaccagagcctcctttatgtcagaactcaattacaagaaaggcaggtggtaaaaaggcgcccgagaaggagatgcaggttattgtagacatgagagagttcatgagcagccttccgaatgtattacatcaaaaaggtatccgaatcgtaccggtcacccttgaagttggtgactatgtgctctctcctttgatctgtgttgaacggaaaagtatcgcgga

SEQ ID NO: 63890 - DNA, 409 bp, Zea mays
  Clone ID: LIB3075-012-Q1-K1-E2
atcaatatttggatatagattaaatatctcaaacgaaaaagtcaagaattcaaaatctgttgtggtgagcagagaaatgcacaaccgggggaccactaacatatttacatttgctgctgatcgtaattacgagtaccaaacaaaactgagaacaccaggaacacagaacaacagactgaaaccagcaaatcagcgcggcaagcgaccgcaccgcaccgcacgcacgttcgatcgatcagccaacaacaacaacgccacctaaatcgaggaacgcacgttcgatcgatcagactcaccccgcgatcggcttcacctcacgctgtcccgccaatcgccgccggggcggggcttccggctccgcagcgccttgatctttcctgcgatgagcctcccccatcgaggccggcgc

SEQ ID NO: 63891 - DNA, 439 bp, Zea mays
  unsure at all n locations
  Clone ID: LIB3075-012-Q1-K1-E3
agcacanccgacgggagtgcaagacgccactcgggttggatgacgttgctccaccttctcaccgtcgacagggcggcacccagagacgttcgaccagtccgtggcggcgatgatcaagctgatgaccgacggcagtgccagcatcacacggttcaactacgccgccgtcatagaggccgccttcgggttcgcggcgctcaagatcagcccgctggacgtcagcacaaagatcctggagctcatggccgagtccgtgaactggctgatccagtggcacaagtccggctactccgaccctggaaacagcggcggcttcagcggcagctcttcgtcccagacgtcggtggaagatgcgtcgcggatgggcaacctggcagtcaacatgttcatcaagctcgcggaggcgctgcgcaagacgagcctagtccggcgcgaggag

SEQ ID NO: 63892 - DNA, 417 bp, Zea mays
  unsure at all n locations
  Clone ID: LIB3075-012-Q1-K1-C9
aattaagcgaacctcgccgcgatcgtatcagtcatggcgaccgccgcgcacgagggcgtgacgcagcgcgtcgctgccagtggcagcagggacgacggcgccagcggcggcatcgcggcggtctcgggtcccaacaagaagccgggcggcggcaggaggcggcgcggcctccgttcggtcgccgccgcggtgtccatccccgcggcgctcgtggctctgtccttcttcgccgcgggccactccacgccgccgccgagttccgtcacggtggcggtggtgcgggccgggtcggtggcgtcagaggcggtgctggcgcttgcggcgtggatggcgtgggcagagggcgggctgcacgcgcgtncggncgacacgctgttgccctacgccgcgcgggttcgcgccgggctcgcgtgggcg

SEQ ID NO: 63893 - DNA, 417 bp, Zea mays
  unsure at all n locations
  Clone ID: LIB3075-050-Q1-K1-F5
gcgtcgctcaacttccgcatccagggccacgacatgaagctcgtggagctggagggctcacataccctgcaggacgtgtacgactcgctggacgtgcacgtcggccactgcctctccgtgctggtcgacgccgaccaggcgcccggcgactactacatggtggcctccacgcggttcatccacgacgccaagtccgcctccgccgtcatccgctacgccggctccagcggcgccccgccggcgcccaacatgaccgagccaccggccggctgggcctggtccatcaaccaggccaggtcgttccgctggaacctgacggccagcgccgcgcgccccaacccgcanggctcctaccactacggccagatcaacatcacccgcaccatcaaggtcatggtcttccgcggccacatcgac

SEQ ID NO: 63894 - DNA, 413 bp, Zea mays
  unsure at all n locations
  Clone ID: LIB3075-050-Q1-K1-F6
gcgagacttcccatccattccactccgcantggcggcggcggcggcggcgaggtctctacgactgtcacatctctccgaagagggcggaggggagggagatgtcgtaatgctgccggagggctgctgacgaagatgcggaagctggtgaagggcctcgccaggcccgagcccacgtggctcatggccatggaagaggcagcaccagtgacatttcctcgcatgatgggaagattaaggggtgtttgtttgggattataatctgtccagattatataggccaacaacttgaacaccccctaagaagatcgagtttctgatgatgtgtatgttaggaagctaaacaaaaagaacatccggattcgctatgccatgatgcaatcaatggatttgatccaccaccagcacgagcttt

SEQ ID NO: 63895 - DNA, 348 bp, Zea mays
  Clone ID: LIB3075-050-Q1-K1-F7
ggagttggtgatgttatttctcttttgtggttcaagcgcagccttcctcgctattgcactcggtttattgagatatgcgtgatgctttgtgctgatcatggtccctgtgtatctggtgctcataactctatagttactgctagggccggaaaggaccttgtttccagcttggtgtctggattattgacgattggtccccgtttcggtggagcaattgatgatgcagcccgatacttcaaagatgcatgtgataggagcctcacgccatacgagtttgttgaaggcatgaaaaagaagggaatccgggtgcctgggattggtcacaggattaagagcaaagacaacagg

SEQ ID NO: 63896 - DNA, 434 bp, Zea mays
  unsure at all n locations
  Clone ID: LIB3075-050-Q1-K1-F8
agctgaccccggcaccgccgccggcctcctccgcctcgtcttccacgactgcttcgcaaacggctgcgacgcgtccatcctgatcgacccgatgtcgaaccaggcctccgagaaggaggccggccccaacgtctccgtgaagggctacgacgtgatcgaggagatcaagacggagctggagaagaagtgcccgaacgtggtgtcgtgcgcggacatcatctcggtgagcgcccgcgactcggtgaagctgacgggcgggcccgagtacgcggtgcccctgggacggcgcgactcgctcgtgtccaaccgcgaggacgccgacaacctgccgggcccggacatcgcggtgcccaagctcatcgacgagttcgacaagcanggcttcaacgtcgaggagatggtcgcgatgcttggcggcggccacagcatcggcg

SEQ ID NO: 63897 - DNA, 443 bp, Zea mays
  Clone ID: LIB3075-050-Q1-K1-F9
tgagcatgtcttctggacagttttcaagtgctcgttcgatggacgtgaagacaaaggcagagcttgaggagattgctctcgctgaagctgatgttgcaaggttaaaacagaaggttgcagagcttcacctccaactcaatcaacaacgtcaacaccagtatggctctgtagtggatgcaaatgatcgtcatcaccgcctccctggtcatttctcacagcaaaactttgttcaacaaggatttgatatgaaccttgctttctgcaatcaagagaagcagagaaatgaggagagttcggtggagtcatcacaatggagaaacatcaagcagcatgtgctaccttatggttcttcgaggccactcacacgaaagctttcatttgatgcctcctcaagtgaatcaaggggcacagaaccctcaacaagtatgtcaacagagaacaca

SEQ ID NO: 63898 - DNA, 379 bp, Zea mays
  unsure at all n locations
  Clone ID: LIB3075-050-Q1-K1-G1
ctctccctctccgtcccccaagcaaagaaaagaagctagctagctaggcgtagaacgaatgacgacgcanggcggcaacaggtcgacgacgacgctggtcgccgccgtggccgtagttctggccgtggcggcggcgtcgtccctggccggcgtggcgtccgcggagaaggcgggcgggttcgtggtgacggggcgcgtgtactgcgacccctgccgcgccgggttcgagacgaacgtgtccaggagcgtggccggcgcgacggtggaggtggtgtgccggcacttcggcgcgtccaaggagacgctcaaagcggaggcgacgacggacgacagcgggtggtacaagctggagatcgaccaggaccaccaggaggagatc

SEQ ID NO: 63899 - DNA, 401 bp, Zea mays
  Clone ID: LIB3075-050-Q1-K1-G10
cctccctccctcacacaaataataaggaaaggtcccgcccttttcctccgacatccacaaggggggaggggaaaacacgtacattcacccggcggcaataatggcctcggttccggctccggcgacgacgaccgccgccgtcatcctatgcctatgcgtcgtcctctcctgtgccgcggctgacgacccgaacctccccgactacgtcatccagggccgcgtgtactgcgacacctgccgcgccgggttcgtgaccaacgtcaccgagtacatcgcgggcgccaaggtgaggctggagtgcaagcacttcggcaccggcaagctcgagcgcgccatcgacggggtcaccgacgcgaccggcacctacacgatcgagctcaaggacagccacgaggaggaca

SEQ ID NO: 63900 - DNA, 411 bp, Zea mays
  unsure at all n locations
  Clone ID: LIB3075-050-Q1-K1-G11
tccgcggacgcgaagatcacgtctgtcggacgatggtccgtcttcggtgtagtggtagaaggatctgttgcagtcatagaagcaccaatacaaactagtgccgaactgcaggaggaacacgtacagaatcaggtggaggaagctggttgctgtgccaccgactcctgtggcgcctgcgcgtgctccaatgaggcgcaaccgtgtggcccagaccgatgtggagatgcacttcgtgccccgcagacctgtggtggtgacgttgttacaactcgccaggaggcactccagcctacgctcgtgaggagaagcgtagatggaaccacgaaaggaagcgacagtactgcggcgcattcagcagggaaggaacagcgggtggaagtagtgactaggcgtggngtagatatcgacacg

SEQ ID NO: 63901 - DNA, 412 bp, Zea mays
  Clone ID: LIB3075-050-Q1-K1-G12
gcaccacggccgtgatccgctacaagggctccagcgccccgccgccggccaagctgccggagggccccagcgggtgggcgtggtccatcaaccagtgcaggtccttccgctggaacctgacggccagcgcggcgcggcccaacccgcaggggtcgtaccactacggccagatcaacatcacccgcaccatcaagctcgccatgggccgcggcaaggtcgacggcaaggagaggttcgccttcaacggcgtgtcgcacgtggacccggaaacccccgtcaagctcgccgagtacttcaacgccagcgacggcgtgttcaagtacaacctcatcggggacgtgccgcccttcaacacggcccccaccaagatggcacccaacgtcatcagcgccgagttccgcacgttcatcga

SEQ ID NO: 63902 - DNA, 343 bp, Zea mays
  Clone ID: LIB3075-050-Q1-K1-G2
cggacgcgtgggctacgcgtggataacctggtcatcaccggcaagggaaaccttgacgggcagggcccagccgtgtggagcaagaactcctgcaccaagaagtacgactgcaagatccttcccaactcgctggtgatggacttcgtgaacaacggggaggtgtccggggtcacgctgctcaactccaagttcttccacatgaacatgtaccggtgcaaggacatgctaatcaaggacgtgaccgtgacggcgcccggggacagccccaacacggatggcatccacatgggcgactcatgcgggatcacgatcaccaacaccgtcattggcgtcggcgacgact

SEQ ID NO: 63903 - DNA, 365 bp, Zea mays
  Clone ID: LIB3075-050-Q1-K1-G3
cccacgcgtgcgaattttactaatcaaattcttgttgggatatattcctgcaattcccctgctgctcccaacaaggcaacaacaatctgttccggccgccaaacaaaaccaaaaaaaaaacacactgaacccaataatccgatcccacagaaacttttctctcggtccgttcgatcgatcgctgccgtgtcgtttgccagacaccatcagcacccaaaaccatggcctgcaacctggctcaatgcgccaccgccgccgcggcgaccgtcgcgccccgcacccctcgccctgctgcgtacgcgtccgtctccttctccgcgaggaagccggcgggcggcagcctgcggctgcagcggcaggcgtgc

SEQ ID NO: 63904 - DNA, 413 bp, Zea mays
  Clone ID: LIB3075-050-Q1-K1-G5
aatcttgaagctgcaaagcaaattgcccgtgagttgcgcttgagggatattggtggcattatcattgtggattttatcgatatgtgagatgattcgaacaaaaaactagtatatgaagaaatgaagaaagcagtagaaaaggatcgatcaacagttggtgtttcagaactatcaaagctaggtttgatggaaataactagaaaaagggtccgaccaagcgttactttcatgatcagtgagccatgtacatgctgccatggtactggtcgtgtggaagctcttgacacatcgttttcaaagatcgaacgtgaaatatgtcgacgtcttgctgcctctcgacgaaaatcagaccctgagaaaccaaaatcatggccaaggtttctgcttagagtggatcatgagatgtgcacgta

SEQ ID NO: 63905 - DNA, 398 bp, Zea mays
  Clone ID: LIB3075-050-Q1-K1-G6
aactttcaatcatggcggacgtcgatgtcgaaccggaggttgccgccggcgctcccaagaagaggacgttccgcaagtacagctaccgcggcgtcgacctagatgcgcttctcgacatgtccacggacgacctcgtccagctcttccccgcgcgcgccaggagaaggttccagaggggtctgaagaggaagcccatggcactcatcaagaagctgcgcaaggcgaaaaaggatgctcctgctggtgagaagccagagccagtcaagacacatctccgtaacatgatcattgtccctgagatgattggaagcattgttggggtctacaacggcaagacgttcaaccaggttgagatcaagcctgagatgatcggccactaccttgctgagttctccatc

SEQ ID NO: 63906 - DNA, 194 bp, Zea mays
  Clone ID: LIB3075-050-Q1-K1-G7
gcacgaagctccccggcatcaccggggcgacatacgcatacggagcgatctactgtacctctccctatattatccaaactccagctcatctaattaaacatgggggaccttacaaagaagtggggggattcatacgctgactaacacctttgtacctagaacgatggccaccaccacattgctgaattcattgt

SEQ ID NO: 63907 - DNA, 364 bp, Zea mays
  Clone ID: LIB3075-050-Q1-K1-G8
acgcacaaattgggattcctcggcctaacatgtttccaatggagctcaaacaagtgtctggtgggacacctgagcttgacgggggggcgatagcacagattaagtccggcaacattaaagtatttcctgcaattcgaaatttccaagaatatggtggagagtttacaaatggtaggattgaatcatttgatgttgtgattcttgccacaagttataagagtaatgtttcttattgggtgaaggagaatgaatttttttcacagcaaaatggatttccaaacaaaccatatgaatggaaaggaaaggatggactctatgctcctgggttctcaaggcggggcctactttgggtgactattgatgc

SEQ ID NO: 63908 - DNA, 278 bp, Zea mays
  Clone ID: LIB3075-050-Q1-K1-F4
gtccgcccatgcggcccagaaattagtatcgcaattttttctaccgacaagtatacatttggagcgcctgggtcgtgctctacatgatgctgtccgagaccctacccttttcctgcgccaccgttggggataactttcaggccttgctcccgtataacctgcgcttcctttgccacccctttgctcgcctttttcaccttgtcaacgaccttcttcgccccattctttgcatggacttttggcgcaagctctacgccgagcaagtcctgatgcaccca

SEQ ID NO: 63909 - DNA, 352 bp, Zea mays
  Clone ID: LIB3075-050-Q1-K1-E1
gctccggcaagcccgtggtggtgcacatcacggacatgaactatgagcctatcgcggcgtaccacttcgatttggcaggcacggcgttcggtgccatggccaagaatggcgaggaggagaagctgcgcaaggcgggcatcatcgacatgcagttccgaagggtcaagtgcaagtacggctccaaggtcaccttccaccttgaaaaggggtgcggccccaactacctggcgttgctagtcaagtacgtcgacggcgacggtgacattgtggcggtggacgtcaaggaaaagggctccgacacgtacgagcccctcaagcactcctggggcgccatctggaggaaggacagcga

SEQ ID NO: 63910 - DNA, 406 bp, Zea mays
  unsure at all n locations
  Clone ID: LIB3075-050-Q1-K1-E11
ctctctctctctttcatttctatagccagcaggtagcaggcaggcaaccggccggtatattagtagatcttcgatcgggcatccaagctaataagtcgaggagcagcagtaggtcgaaaatggcgatgaaggcgctagcgctactggtcctcctcaacctgctggttgttggtgtggcgcaagcggtggagttggagatggagttggtgcctgctgatgcaattgcgatgactatggatcatgagccgccgcangagtgcgcgaccccggtgagcgtggatgaagcgtgccgcggcgcgtcngaaacgcacgccggcgtggcctacgaccactgcatggcgtcgctgggcgccgacccgcgcagcaaggaggccggcaacaagaacatgcacgcgctggcggtgct

SEQ ID NO: 63911 - DNA, 442 bp, Zea mays
  unsure at all n locations
  Clone ID: LIB3075-050-Q1-K1-E12
gtcgcgcccgaggtggtggccggcagcgagtacaccgagaaggtggacgtctggagcgccggggtcgtgctctacatgatgctctccgggaccgtgcccttctccggcgccaccgcgggggagatcttccaggccgtgctccgtgggaacctgcgcttccctccgcgcgccttcgccgccgtctcgcccgaggccaaggacctcctccgccgcatgctctgcagggacgtctggcgcangctctccgccgagcaagtcctgaggcacccatggattgtgactcgcggcgtaagtgtgcctggcggtagactggtttagatgctccgccgcatccgatgtgtacatagtggcgtcctccatccaatccaagaggagtagagaaggaccttttgcttgtgatctcttcgctatggttctggcaaatgatcgtgaatttggacac

SEQ ID NO: 63912 - DNA, 361 bp, Zea mays
  Clone ID: LIB3075-050-Q1-K1-E2
ctgggccaacagaccaaagagctatcttaaaaggacattaggttgggatcagtatccccatggacggtggggtgattctcggaacccatcatatggagcacttactgaccaccagttcacaagaccacgaggccgtggtaagaagctccaagaggaatgggctgttccactgaaatctgtggaggacattagtgagcgcttcacaaacttgtgtcaagggaaactcacaagcagcccatggtcagaattggacggtcttcaaccagagacaaagattatcgatgaccagttggtgaatattaaccagaagggtttccttacaattaacagccaacctgctgtaaatggagagaaatccgac

SEQ ID NO: 63913 - DNA, 398 bp, Zea mays
  Clone ID: LIB3075-050-Q1-K1-E3
aggagaatgatgagttcaggatgcgagaagctgacgccatgaagaaaatagaggagctatctgccctgcttgccgaagccatgacaaagaagcatcccgaggaggaagagaagctggtggttgttgatgaggcacacaattctggacgtgaagctatccgttctgtggcagaaaatgaagatacagaagaaactgaccataagaaaccaaagcttgaagctgatgcagtcgatacgaactccaacggagaaccgaagcacgacgagaaagacgacagcaaggtggaagaagaggagctgaagactgagctcagcctacaggagagcgacagagctagctctgagaaggaagcacagtccgaaaacaggagacaagaaacagaaccatccaacgacgag

SEQ ID NO: 63914 - DNA, 411 bp, Zea mays
  Clone ID: LIB3075-050-Q1-K1-E4
gcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctactgcggtggcgggcgccgtgatggcggcggcggctaccgcggtggcggcggctaccgtggtggcggcggccgctaccgtggtggtggcggcggc

SEQ ID NO: 63915 - DNA, 69 bp, Zea mays
  Clone ID: LIB3075-050-Q1-K1-E5
cggacgcgtgggcggacgcgtgggcggacgcgtgggaaaaaaaaaaaaaaaaaaaaaaaaagggggaat

SEQ ID NO: 63916 - DNA, 393 bp, Zea mays
  Clone ID: LIB3075-050-Q1-K1-E7
cagaaatcagctcttggatcaaactcaaggcaaggtcagcttcctaagaaatagcgggcggtagcactctacttaggatcggaggatccataagccatttgccgaaggtttactacaggagttaaagagatgggcgacaagaaggcggtcaccagctgctaattatgggcctgcccacgaccattttagttgctgtcccctggcactaccgggagggtgccatgccaggattcaaccatataaaggatccgatcagtttgcaactgggcagggggactggtatacctatgacgacgctggcttcataccggacagaacaacaggtattgaaatcattgtgaaaaacaataaatggattggaggggtttatgagggagggagggaaaaagcaaa

SEQ ID NO: 63917 - DNA, 395 bp, Zea mays
  unsure at all n locations
  Clone ID: LIB3075-050-Q1-K1-E8
cacccatcgagcccctagcgccggcgcctggccgtatggaggctggtggcgaggagttcgcgatcggcgtggtgctctccgcgaagaccaccctgggggaggagttcgagggccagatcgtcgccttcgatcgaccctccaacctcctcgttatccaggagggcgtggggagggcggagagcggggagcggcggaacgtgagggtgctgaaggcgaactacatccgggagttctctgtgctcagcaagggagacgaccctctcgatcctgccggttgcatgctggaccttaactccatttatgcccgggaggatgctgcactcangcaagcggagattgaagctgagagaattggtgttggtgtcaccccagaagctcaaaatatattcgatgcg

SEQ ID NO: 63918 - DNA, 398 bp, Zea mays
  Clone ID: LIB3075-050-Q1-K1-F1
ccaagacaaaacatggctgtgaatgtgagaaccatgtggtcgtcgatgcgggcacaggttgcgatggttgtggcgttggtgttcttggtgagcggcgcatggtgcggtcctcccaaagtccccccaggcaagaacatcacggccacctatggcaaggactggctggacgctaaagcgacatggtatggcaagccgacaggtgccggtcccgacgataacggtggcggctgcgggtacaaggacgtgaacaagccccccttcaatagcatgggcgcatgcggcaacatccccatcttcaaggatggtctgggttgtgggtcctgcttcgagatcaagtgcgataagcctgtggagtgctccggcaagcccgtggtggtgcacatcacggacatgaacta

SEQ ID NO: 63919 - DNA, 460 bp, Zea mays
  unsure at all n locations
  Clone ID: LIB3075-050-Q1-K1-F10
atcagttatggtgttggctcaactagcccgctcagcccttcattcattttctccctggaacttgccagaagcacacagctaaccgcatcattctatcagcacctggttgttcaaagaagggtaaaaaatccttttgaagatgatcaggttgttggcattacaaactacatcgattttggacttgagttggctgccaaggttgataaagataaagtgagtggggatggcaactcgtttcagttggctgcaagttggcaagctaacaaaaactttctgctgaagggaaagcttggtccttccacgtcctctgtagctctggcattcaaatcatggtggagaccatcctttacatttagtgtaacagctgtgaatgatcattcaaagggcacaacatcgtatggatttggcctccgtgtcgaggaccttanacgagcgagtaaccacgagctgatccaaacta

SEQ ID NO: 63920 - DNA, 417 bp, Zea mays
  Clone ID: LIB3075-050-Q1-K1-F11
ctcagcttcaaggatgttcatcatcctcgctggggcgggaggcgcgtcgagccagggttctgcctcccacgtgggccagtggcccacttctttctccagcattcgagggaggagaggggttcaccagccacgcgaaggaggcgaacttcggctacgcggggccggccaggtgcaggcgctgacagctgccgcgtgcctggcacttggcctgggtggccctgccgtcgcctccgacgttgccttctgccgtttggccagggcatggctatccgtccaccacacgggcgacggtcacgccgtacgtgggtccgccacatccacggcttctcccgcgccgtcggccgtacggggggaccgtccaagatgtcgtacgctgcgggagtggcggcgacgttcttggatggtcttgtcctcgct

SEQ ID NO: 63921 - DNA, 459 bp, Zea mays
  Clone ID: LIB3075-050-Q1-K1-F12
cggacgcgtggggacaaacaacactacactcagcctactttgttcgaatgctgaaatcaccctggggtttctcatgatcatctcgcttttctcgtcgagacgcaatataatccagacatttatgtactttcatcttttgaagttgatgtaccattctcctgtgacatctggttaccaccagagcgtgtgggcaagaataggccgggctgtaaacccgtacatttaccgctatgcgccattcctgaacacacctatttcggcagtccagagatggtggctgaggtaggaaagcatggaccgcagcacagtgaaaatatgcctaaacagctactctgatctcagcgcctcgatcttttagaaggcgtgcttgcacggcgtgttcttttcttgtaaaggttggattctcagttcatgtcttactgagctactgaaggcataacactaggagaatttcttacg

SEQ ID NO: 63922 - DNA, 316 bp, Zea mays
  Clone ID: LIB3075-050-Q1-K1-F2
caaatctcatctcctagctagcaacttgattcttcatatgtatatatattgagcgggccgggcgtgaattattcagtgcatgatgatgatggtcatcagtagtctgctgccgtggttggcagctgctggtgtgggcgctgcccgatgaagatgatgttgtagacgagcgccgcgatggccgcgcccgcgagtgggccgacccaatacacccagtggttcttccagacgccggtgacgacggtcgggccgaaggagacggtggggttcatggaggcgccgttgaatgcgcccccctgctcggacattggggcccttt

SEQ ID NO: 63923 - DNA, 406 bp, Zea mays
  Clone ID: LIB3075-050-Q1-K1-F3
caccggccgtcgagcgagcagtctcccaatttcacccaataactaataacatctcctcgaacgccaggttccttggaccactatatgcaggagcgacgaaatgatccacccgccagccatggagatgaagaaggtcctctgcgccgccctcgtcgccgccgccttggccaccgacgtgctggcctcggtcgcctccgaggcgccctccgaggcgcccgccggcgcggccggtggtgcggctggccctatcgcaagcggcgccgccgccgccgccgtgcccgccgccggggcgctcgtcgccttcttcctcgcctactacctgcactgagcgacgacgcgcggggcggcaacgttgggatgcatcgtgtttgggtcatccgattaattaattggtttttttatttac

SEQ ID NO: 63924 - DNA, 234 bp, Zea mays
  Clone ID: LIB3075-050-Q1-K1-D8
caaaatgttaaatatacatgccattttgcttgttttccactctttggaattcggcatacagggttagaattgcctgctaaacgcgaaacaaaaggattacatatactagaattcagaagtcttagtagtatatatggttagcggagcatgctctctcatgcaatatatataaacttaattagcttgctgctgcaagttcatagcccaccgagccggatgaattgtagggaattg

SEQ ID NO: 63925 - DNA, 382 bp, Zea mays
  Clone ID: LIB3075-050-Q1-K1-C2
gaagatcctgactgaacgcggctactccttcaccaccactgctgagcgggaaattgtcagggacatgaaggagaagctcgcctacattgccctggactacgaccaggagatggagactgccaagaccagctcttctgttgagaagagctacgagctgcctgacggacaggtcatcaccattggtgctgagcgcttccgctgccctgaggtcctcttccagccatccttcattgggatggaagctgctggtatccacgagaccacctacaactccatcatgaagtgcgacgtggatattaggaaggatctgtatggcaacatcgtcctctccggtggtaccactatgttccctggcattgctgacaggatgagcaaggaaatc

SEQ ID NO: 63926 - DNA, 394 bp, Zea mays
  Clone ID: LIB3075-050-Q1-K1-C3
agcagctgctggggccttgcgtactttatcctttaaaaatgatgaaaataaaactcagattgtgcaatgcaatgctttgccaactttgatcttaatgctgcgatctgaagatgctgcaattcactatgaagcagttggtgtcattggaaatttggttcattcatcaccaaagatcaagaaggaggttcttaatgcaggggcactgcaacctgtgattggattattaagctcatgttgtacagaaagccaaagagaggctgctttgttgctagggcaatttgcttcggccgactcggattgcaaggtccatattgtgcaaaggggtgcagtctgtccactaattgaaatgctacagtcggctgatgtccaactccgggagatgtctgcttttgca

SEQ ID NO: 63927 - DNA, 446 bp, Zea mays
  unsure at all n locations
  Clone ID: LIB3075-050-Q1-K1-C4
accaacactgtctggaaaactggagtcaaagtggagacccagaagatgatgctggggacgttgagcccccagctagagccctatgtctacgagggcgaagaagagaccacccctgctggcatttttgcgagaggttcttattctgccaaactaaagtttgttgatgatgatggcaagtgcttcctggagatgagttactactttgagattagaaaggagtggccaggaactcaatgatgtgtggaccagcatggctgactcgtcggagtatgttagagctcatagctaagccaagcacaagatgtggactcatcttcaagaatgattttcattcgctacttcatctttaatcgcattttaatttgttttgaattgtcattgtacgtcgtttatgacatanaactgtttattcatcacatatataattcatgtatcgagatatatat

SEQ ID NO: 63928 - DNA, 453 bp, Zea mays
  unsure at all n locations
  Clone ID: LIB3075-050-Q1-K1-C5
gttatgttgatcatcaaacaccaaaacacttgcagtgattagggcattaaaacaaccaanatagcgcanaacatagtcactgcagggctgaagcgtagaacaatccattgaagaccggaacatgctcccaaatcatcctgctacaaaacttggtacagcaaggtaacaaacaaaggtttcacagtttgatgattttgacaaatgggactttcgctgcaccgcagcaccttacgccttgagcttaccaaagaacctctgcttctcatcggtagtctggaagcgaccgtgcccaaatttggacgatgtgtcgatgaacttgagcttgatctcctccagcgccagccgggaagtctgcttcaggagggactggcggagggtcaccaccctcttctttggacccacacagcattcctcgatcatcangtaggcacccttcacgataccatagtgggg

SEQ ID NO: 63929 - DNA, 402 bp, Zea mays
  Clone ID: LIB3075-050-Q1-K1-C6
gttctgatcgcgagcgccgccctttttttttttttttgacagggtaagtagtaatacactgggtaatactccagttacgacagggcacaggcaaacccccttacactctgttaagcatggcatgagccatgaccatcacacaagcctccctcttgattacgaaaccagaaacgagatgcggcgatggaacgccatcttaagagttattggttggcaagggcaacaacaacaagaacgtgggtaccaataccaacagggcagatcggttactgcggctggacgtagtattaacccatggtggtggggtcggccgcggcggggtgcttcgggatcccgggcgctgctgcccccatggcggcggcggcggggtcggcgtccctgggctcgtcccgcggcacgatg

SEQ ID NO: 63930 - DNA, 226 bp, Zea mays
  Clone ID: LIB3075-050-Q1-K1-C7
gcgcactactggtggattggaagctggtatctataaagatggccagacccgtgaacatactgggggtgcgttaaccctgggagggggggaaataatttgctgctgcaacaagatggatgcaaccactcccaaatactccaagggacggtatgaagaaattgtgaaagaagaatcattctaccttaagaaaggtgggtgcaaccctgataaaaatgccttttttccc

SEQ ID NO: 63931 - DNA, 345 bp, Zea mays
  unsure at all n locations
  Clone ID: LIB3075-050-Q1-K1-C8
gtgggagcggagtaataaccaaacaacggggagagagagagagagggaggaggaggaggaggaggaggccaggaggttttcgttcgctcgttcgccttgcctggggacggggttgccgttggcgccgtanaggtcccagagctcctggacctggccgacgagctggcgcagcgcggccacctcccccatcgccaggccgccggcgccgcaagcgcgcgcgcgccgncggccttctcaccgcgcccctccactgcctctgtcgctcgccccctcctctacctcgtcttccgggtcggggtcgggccttccggtcgcaccctccctttccgcttcgctaaatggaca

SEQ ID NO: 63932 - DNA, 419 bp, Zea mays
  Clone ID: LIB3075-050-Q1-K1-C9
gaagcgccttgagatcacattctctgaggcacctgtctttgtggaccctcatgggcgtgggttgcgtgccctctccagggcccagattgactctgttctggatcttgcacggtgcacaattgtgtccgagctctccaacaaggatttcgactcatatgtcctttctgagtcaagcttgtttatctatcctctgaagattgtcatcaagacctgtggcactaccaagctcctgctcaccattccaagaatccttgagcttgctgaagagctgtctatgccacttgctgctgtgaagtactcccgtgggacgttcatctttcctggcgcacagccagccccccacaggagcttctctgaggaagttgctgcacttaaccgctactttggcggcctgaaatctggtggtaatgcttatgtga

SEQ ID NO: 63933 - DNA, 130 bp, Zea mays
  Clone ID: LIB3075-050-Q1-K1-D1
cggacgcgtgggctgccatttatatatatggcagctactgcattgcaaatgcggaatacaggaggtggtgtttattcatactgatgtcactcaatcttgtgtaatgattggacggcctctttaaagaaat

SEQ ID NO: 63934 - DNA, 350 bp, Zea mays
  Clone ID: LIB3075-050-Q1-K1-D10
tgctgatccgaagagctagcgcgcgatggccaacaacctcctccgtccgctcgcgctcctgctggccgtcctcggctgcgcgctgtgtccccgcgccgatgccaccgcgttcgaggtcggcggcgacgacgggtgggtcgtgccgccggccagcgacggcggcaggtacaaccagtgggcatccaagaaccgcttcctcgtcggcgacgtcgtccacttcaagtacagcgaggactcggtgctggtggtgacggaggccgactacgacagctgccgcgcgtcgcaccccgtcttcttctccaacaacggagacacggaggtgacgctggaccgcccgggccccgtctact

SEQ ID NO: 63935 - DNA, 394 bp, Zea mays
  unsure at all n locations
  Clone ID: LIB3075-050-Q1-K1-D11
gggaaagcaagtttggattccatctctgattcatggacttcttcaaaagaccgtccaacattaagtggtgtggcttcatgggacgttcaagattttcagagatgggcacgagaaatgcctatcggtgaaagagtttcgtgggcgattggaggaatggttctcacagctggccttatttttatcagcaaaagaaagagctacagccatcaccagaagcaagctgctattgctcgcaatatgagattgagaaggctggattctagagccaacccacaacaaacaaagcggagctaggaaggcatangcaacttagtgttactcagaggattcttggacttgtgcttctacttttgtggatcggtataatcaacaactgtgaacaatagattgtact

SEQ ID NO: 63936 - DNA, 329 bp, Zea mays
  Clone ID: LIB3075-050-Q1-K1-D12
gcaagcagcagcagcagttacgacgacgacgacgacgacatccaactcccagaaagcccattcacgtcgtcagccgtgccgatgctgatgtaatgggccgggaaagggaaaccaaggtccacttaattagcttcttttgttacacaggacaggacaggacacaaaaacaccctcttttttgttgtagatataaacaaattaagggagtcacagtacacagagagagttggtgttcttagaatgcaggcacactggtgagttttaaacaagggtgccagaattacttattagctgtgccataataataataataataataagatcgtcgc

SEQ ID NO: 63937 - DNA, 327 bp, Zea mays
  Clone ID: LIB3075-050-Q1-K1-D3
ccagccgccgtcatgtcgaagcgaggtaggggaggttcggctgggaacaagttccgcatgtgactgggtctaccggtggcggccacggtgaactgcgcggacaacacgggcgccaagaacctctacatcatctccgtcaagggcatcaagggccgcctcaaccgcctcccgtccgcctgtgtcggcgacatggtcatggccaccgtaaagaagggaaagcccgacctcaagaagaaagtgatgcccgccgtcatcgtccgccagcgcaagccgtggcgtcgcaaggacggtgtctacatgtacttcgaagataatgctggagtgatt

SEQ ID NO: 63938 - DNA, 355 bp, Zea mays
  Clone ID: LIB3075-050-Q1-K1-D4
gatggacatcgccattggctctggggcgcgggacgagctgttcggcaagggcaacatcccggcgttcggccttgccgacgtgttcgtcttcaccgctggccgcgcatggatcattatgctgccaaagccgcccacgaccagcttccggtccgtctccatgggaggaggccattgatgatcacaactgtaggatgcatggtccactgtggttcacgattcttttacctttgtgaggtggacggccaggtgtttgttgtcaaggccgcttccgaggcctaaaccggtgggcttatttctaggccggatcatgacgaacaatctgattcgctgggttgcaaaggaaaagttttacacg

SEQ ID NO: 63939 - DNA, 344 bp, Zea mays
  Clone ID: LIB3075-050-Q1-K1-D6
cccacgcgtccgatcggtgcacacactgacagcccttgcctgaagctcaagcctgtctccaaggtaaccaaaggaggttaccttgaggttggggttcaaacatatggtggtgggttgtggtacacatggtttgaccgtgatcttactgtagctggtagagtgattatacgggagaagaatgatggcgcggtctcttatgcacacaagcttgtacgggtacaggaaccaattatgcggatacctactttggctattcacctggacaggactatctgctcagaaggtctcaaggttaacaatcagagtcatcttgatccagtgctggctacatgtatcaagaatga

SEQ ID NO: 63940 - DNA, 377 bp, Zea mays
  Clone ID: LIB3075-050-Q1-K1-D7
ctaagatggaagcaaaaaatgcgttcaagtccctgcttgagtcggtaaatgtggagtctgattggacatgggatcagactatgagagtcatcataaatgacaaaagatatggtgctttgaaaactcttggagagagaaagcaagctttcaatgagtacttgaaccagcgcaaaaagtttgaagccgaagaaaaacgtatcaaacagaggaaagcacgtgatgatttccttgcaatgttggaagaaagcaaggagcttacatcatcaacaagatggagcaaagcaatacttatgtttgaagatgatgaaagattcaaagcagttgagcgttcaagggagcgtgaagatttatttgagaactatcttgtggaactgcat

SEQ ID NO: 63941 - DNA, 399 bp, Zea mays
  Clone ID: LIB3075-050-Q1-K1-C12
cggagaagggaggaaggagatcgcgaccagccggagccggaggccgagaggatgaagacgttcgacccgtggccggtcttcttccgccgggagtggaagcgcaactggcccttcctcacggggttcgccatcaccggcttcatcatcaccaagatgacggccaacttcaccgaggaggacctcaagaactccaagttcgtccaggaacacaagaagcgctgaccaaccgggtggagtcgtccgaatcgcctgcggatgaaaaattagccctctatttttcttgtcttttttttttatctagatgcgtgcactctattgtaataatgtaataagaggcaattggattgatccaacagcaaccggcttctgattttgatccgcttcgctgacatatgcatg

SEQ ID NO: 63942 - DNA, 256 bp, Zea mays
  Clone ID: LIB3075-014-Q1-K1-G10
actgaagctctccttcacacgctcagagttttccatggcattcccctacgtttccacgacagtcgacgagagactagaggactcgttgctatccagctttgccgagaactgcaacaatggtttcggaagaaaccgcatcacctacacagacacgtgtaccggtcaagatctgaagaaataccacaacatggatgccatcaatgacctgttagtgtcaggggtagcgtcaaggaaagccaaccacccaattggacaa

SEQ ID NO: 63943 - DNA, 403 bp, Zea mays
  Clone ID: LIB3075-014-Q1-K1-G11
cacacacaaaagcaaaaagcatcatcacattaatggcccgcgcgtgtgtgttcctcgtggtgctcctcctggccgccgtcgcggtggcgccgtttgcgggggctgcgcgtgtggatgtcgtggaaggcaggtccatggcgtccgccgacgcgcctgatgcggcggctgacgcgcccgctcccggtcccgactccgccttattcccggactcggcggtggaagcgccctccaacaacagctcattcgactaggcgcgcacaacgcaattcttgtcatgatctatctagcaaataaaaagatcatatgtctcgtttgattctctggaataactaatagtatatatgctgcgcccggatgatatataaatatgtgcatcaaatgcgtgcggcaaacgcatggaatg

SEQ ID NO: 63944 - DNA, 409 bp, Zea mays
  Clone ID: LIB3075-014-Q1-K1-G12
acacagagcagcatttcgagtaacacagttgttcacgacgatgggatccctcgctaatgacatcatggtcgtgggcgccgtccttgcggcgcttgtcgtcggcgggtcgtgcgggcccccgaaggtgccgcccggccccaacatcaccaccaactacaacggcaagtggctcaccgccagggccacctggtacggtcagcccaacggtgccggcgctcctgacaacggcggtgcgtgcgggatcaagaacgtgaacctgccaccctacagcggcatgacggcgtgcggcaacgtccccatcttcaaggacggcaagggctgtggctcatgctacgaggtgagatgcaaggaaaaacctgagtgctcgggcaatcctgtcacggtgttcatcacagacatgaactacgag

SEQ ID NO: 63945 - DNA, 209 bp, Zea mays
  Clone ID: LIB3075-014-Q1-K1-G2
cgttggttgctatttcgtagatccgcgaagtagagagcacggggaagacaaagtaggcctgaccctcagtcagactctccagctttttgacgaaagaccagactagacacctaagacttacatacgcttcatgagtgcgagcgaagtgttatcactcaacgtgccaggcttagaagatcagtagacgcaggactgaaaaatacgcagat

SEQ ID NO: 63946 - DNA, 391 bp, Zea mays
  Clone ID: LIB3075-014-Q1-K1-G3
tcgggcaaacgcaaaccggaagctcctgtcggacacgctggacgagatcaccggcatgtcccacggcgcaaacggccggcgcttgcttagctccttggggtctcggatttccagcgcccagggagacgacgtcctcgcccgccaccagctgctggacgtgtcgcccgacgacgagaccgataacgctgcccggcgcaaccttttgtccacagagctcgagagcatcgccagcacgtccgccgaggcaaaccgccagcttctcgcggcggaggagctccccgacgagctcgccggtaagcgagagctgctgtcccggacgctcatggggatcgacgaggcggccaccgaggccaagcgccagcttgatgaggcgacgacggagaacaccatg

SEQ ID NO: 63947 - DNA, 345 bp, Zea mays
  unsure at all n locations
  Clone ID: LIB3075-014-Q1-K1-G4
atcatttgtctcttacataagagggatcatcaagaatctcactgctgtgttggagccagagaaagccggtgaattcaaaaagggcgtctaaggtgcaaccaagtttctccttatcaagccgaaagaccttcaattttttggtggtgagagcattaaagaccaagcgttcctggtattcgactattacaaggattgtgccactaattcgacattcctgtatttctctcatggtcttaatgagatcaagtgctagattagttacccatgttgggtactatatatgttctattgttattgccacaactatagctgccctgcctgaactgaactcangatttttttaag

SEQ ID NO: 63948 - DNA, 396 bp, Zea mays
  Clone ID: LIB3075-014-Q1-K1-G5
aattattgtttatcgtggcctgtatttcggactttacgattctatcaagccagttgtcctcactggcagcctccaggacaacttctttgccagttttgctctgggttggctgatcaccaacggtgctggtcttgcatcttaccccattgatactgtccgcagaaggatgatgatgacttctggtgaggctgtcaagtacaagagctccttggacgcattccagcagatccttaagaaggaaggccccaagtccctgttcaagggtgctggtgctaacattcttcgtgccattgctggcgctggtgtgctttctggctacgaccagctccagatcctcttcttcggaaagaagtactgctccggcggtgcttaaatggagaaaaatgatgacgaaca

SEQ ID NO: 63949 - DNA, 385 bp, Zea mays
  Clone ID: LIB3075-014-Q1-K1-G6
tcggtgagcaccatgtggtcgttgatgcttgcacaagttgcgatggttgtggcgttgtccttcttggtgagcggcgcatggtgcggtcctcccaaagtcccccctggcaagaacatcacggccacctatggcaaggactggttagacgctaaagcaacatggtatggcaagccgactggtgccggtcccgacgacaatggtggcggctgcgggtacaaggacgtgaacaagccccccttcaatagcatgggcgcgtgctgcaacatccccatcttcaaggatggtctgggttgtgggtcctgcttcgagatcaagtgcgataagcttgtggagtgctccggcaagcccgtggtggtgcacatcacggatatgaactatgagccta

SEQ ID NO: 63950 - DNA, 437 bp, Zea mays
  Clone ID: LIB3075-014-Q1-K1-G7
tcgtccacgcgtccgatcagattctgattgtccaaaagttgatgaaagaagacctgttgctcgctccttgggacgtaaaaaagcactggcatcctccaagaagcagagccgaagttcaaagaaaccattatctacttttcactctacacccaagaagaaaatgctggacaatgtgtttatctttaatgagaaatgcacacctaaaacagtggatcagggtgaaacaaataaagcgactgagtcacgtggtagcaggtctcctgattctgccaaaaaaagagtaaacaggaaacagacatacctttctccaactgaggatgaagggattaaaagttctgaaacaagttttgcaaaaggatataaatctcacaaatggccttcagatattgatgttcctgataaatctcctgttgagcatatgggtaggaaatcaaatc

SEQ ID NO: 63951 - DNA, 405 bp, Zea mays
  unsure at all n locations
  Clone ID: LIB3075-014-Q1-K1-G8
cttttgtatgaattcgggtcgacccagcgtcgaccaacagcaagaccgtttgcttggaccgaacctttcttcgacgcaaaaagaaccccacccgcgtaccgtgagccgcgatggcgacggtggcgatggacatctcgaagcccacgccggcagcgtccggtgacgaggcagcggcggcggcgaaggggagagcggcggggtggcgaggggctgcggcagtctacctgcacacatccatgacctgcagctccagatccggcagaagacccataacctcaaccgcctcgaggcccaggcatcgacctcaactccgagttagaatgctcaggaagagttgcagttgcttaagagcctggctcatatgtgtgaggtggtgaagtcatgngaaatcaaagttctggtgag

SEQ ID NO: 63952 - DNA, 373 bp, Zea mays
  Clone ID: LIB3075-014-Q1-K1-G9
aatcaatccttcaagcgcaagctgcctcctcctcgtcgtccggtcgtgagaagggatggcgggccgtggcaaggctatcggcgctggcgccgcgaagaaggcaacgtctaggagctccaaggccggactccagttccccgtcggcaggattgccaggttcctcaaggcgggcaagtacgcggagcgcgtcggcgccggcgcccccgtgtacctcgccggcgtcctcgagtacctcgcggctgaagttctcgaacttgccgggaacgccgcgagggacaacaagaagacccgcattgtgccgcgccacattcagcttgctgtgcgcaacgacgaggagctgaccaaactgttgggtggtgccaccatctcgagc

SEQ ID NO: 63953 - DNA, 376 bp, Zea mays
  unsure at all n locations
  Clone ID: LIB3075-014-Q1-K1-H1
tcggaccatggtaattggatcgagattctacgtgtggataacctggtcatcaccggcaagggaaaccttgacgggcagggcccagccgtgtggagcaagaactcctgcaccaagaagtacgactgcaagatccttcccaactcgctggtgatggacttcgtgaacaacggggaggtgtccggggtcacgctgctcaactccaagttcttccacatgaacatgtaccggtgcaaggacatgctgatcaaggacgtgaccgtgacggcgcccggggacagccccaacacggatggcatccacatgggcgactcatccgggatcacgatcaccaacaccgtcattggcgtcggtgacgactgcatctncatcggccccg

SEQ ID NO: 63954 - DNA, 418 bp, Zea mays
  Clone ID: LIB3075-014-Q1-K1-H10
cccacgcgtccgggaagagtcagcaatggaggcgaggattgcaggagtgcccgaagatgaagagtccggcctcctcccccgcccgtccgcagccggccgacggccgtcctcccgcggcccccgcttcccgcctccaccggcagcctgggcgacggtggacggctccctcgggcttccgctggaggacgcggagggccacgcccgccgcttcttcatgtggggtttcgcgtgcctccccttcctctgggccatcaactgctgctacttctggcccgtcctccgctcgtcggtcgcctcctcgcccgccgccttcgcccccatccgtccctgtgagaccgctaccccttctccccgcttcctcgtctcctctcttccttctcgcgcctgagatctgatctttcgtgatgctagtatgtga

SEQ ID NO: 63955 - DNA, 351 bp, Zea mays
  Clone ID: LIB3075-014-Q1-K1-H11
gtccttctcagttacttcgaccccatcatgctggacgagatgaagacacgcaccgtcatgctcgccacgctgctctccgtcaccgacaagaaactcggcgtcctcaactacaccagggccgacgacgggcagatgtacttcggcgctcccggcgccccctgcgtggccaagctcgtgaaggtcgtcgcagcgcggccgtactctgtgtccatcatggagatcagcgagcccattttgccggccgcgttgccctcccccgtcgcggcgcccggccgccgcggcaagggtggtaagcgcaagatcaagccatcagcggcaacccatgaggatttcaacatgatcccgcgcaag

SEQ ID NO: 63956 - DNA, 309 bp, Zea mays
  Clone ID: LIB3075-014-Q1-K1-H12
tgacctcaagaaagtgtcgctcttctcccggactcgcatctacgccgtggcttccatcggcggattcgacctccgcatcccttcccacagcacccaagcagaccacagcaacggctgcaacccctgctggaacgccgtggtacacttccccatcccggctgccgctgacacccgcggcctcgcactccacgtgaggctccgcgcccagcgtctatacctgggcgatcgcgacatcggcgaggtgtttgtgcccatcgacgacctcctggccggcgccgacaagggtggcgatccgaggcccgtgagcta

SEQ ID NO: 63957 - DNA, 413 bp, Zea mays
  Clone ID: LIB3075-014-Q1-K1-H3
cggacgcgtgggggcaagaccatcaccttggaggtggagagctctgacaccattgacaatgtgaaggccaagatccaggacaaggagggcattcccccagaccagcagcgtctgatctttgctggcaagcagctggaggatggtcgcaccctcgcggactacaacatccagaaggagagtacccttcaccttgttctccgcctcaggggtggtatgcacatctttgtgaagaccctgactggaaaaaccataaccctggaggttgagagctcggacaccatcgacaatgtgaaggcgaagatccaggacaaggagggcatccccccggaccagcagcgtctgatcttcgccggcaaacagctggaggatggccgcaccttagcagactacaacatccaaaaggagagcaccct

SEQ ID NO: 63958 - DNA, 361 bp, Zea mays
  Clone ID: LIB3075-014-Q1-K1-H4
gggatttggagtaaaaatgactttgggcggaatggatttgtggtccatattaatacgacaaaagactccaccgattacctatgggacacaacaagttttagagtggattgaaagtactcctcaaaagggatccatgctgtccttaatatcgactccaatggccatggtgttcatgctttcttgaataatgtgctcataagtagtgcatatggtaatggctcacaatcaagattcagcgtcaaattgcccatcaacctgatgactggaaagaatgaacttgcccttctaagtatgactgttggtttacaaaatgcacgattcgcttatgaatggataggagcaagctttacaaatgtgaaca

SEQ ID NO: 63959 - DNA, 408 bp, Zea mays
  Clone ID: LIB3075-014-Q1-K1-G1
tcgggaggctgttcagacagagaaggcaccaccagcactaggcccttattctcaggccatcaaagcaaataatcttgtgtttgtttctggagttcttggcttgaatcccgagaccaggaagtttatctctgaaaatgttgaggagcaaactgagcaggttatgaaaaacatgggcgagatattgaaagctagtggtgctagctattcttcagttgtgaagacaacgatcatgttggctgatctgcaggatttcaataaagtaaacgagatctatggcaaatatttcccggcgccagcacctgcacgatcaacctaccaagtggcggcgctgccactgaatgcccggattgagattgagtgcatcgctgctctctaatcagatcatccaaccactcattaaatcatcaa

SEQ ID NO: 63960 - DNA, 354 bp, Zea mays
  Clone ID: LIB3075-014-Q1-K1-E4
ttggactcccaacaacgggaggtgttacacctgccccagcagcagaggctgaattgaaagccagtgcttgatttttttttctgtgttccctgagatcatatttggtggagtggaattgtatcagccggtcgagagcttagttcccgaatcttttttaatcttaacggaaaatttgtccgtcatccttctgatgagaggaactcattaaacaggcgaaataggtctttttttgcgctgggaaaagtttacgcttgatgcataataatttgtaggacggcaacgctctagagcgcaggttttgttcaccttctgtaccgaggaatgcttaaagttacatttcacattatggtcttt

SEQ ID NO: 63961 - DNA, 326 bp, Zea mays
  Clone ID: LIB3075-014-Q1-K1-E5
gccaattgtggagccagagattcttcttgttggagaccatgggatcgagggagctcttgaggtggcagagaaagtgtggtctgaggtgtttttctacttagccgagaacaatgttctgtttgagggtatcctgctgaagcctatcatggtcacccctggagctgatcacaaggagaaggcttctacagaagccattgcaaagtacacgctaacaatgctcagaaggagagttccttccgatgttcctggaatcatattcctttctggtggacatgccgatgtggacgcttctctgaacctgtatgctatgaaccagtctctgaacc

SEQ ID NO: 63962 - DNA, 411 bp, Zea mays
  Clone ID: LIB3075-014-Q1-K1-E7
actagttctagatcgcgatctagaactagtcgtggtcacgccgagcgactacgcgaagacgcagtcggcgggggcgaagatctcccaacccacattgcgcgcgcgtctacgcccgaggatcgatggttggcggcggggggcgccgcgcggcgctggggcgctggtgcctggtgatcctggccgtggccttcgcgctaggggtctctggccccgccttctactggcgctacaagaagggcttctcctcctcctccccctcgtccaccgcggcggcggtggcttcttccccgtcgtgccctccctgcagctgcgactggccggcgcccctttccctcaagtccatcgccccagggcttgccaacttctcaataacagattgtgggaaaaacaaccctgagcttgccaaagaga

SEQ ID NO: 63963 - DNA, 324 bp, Zea mays
  Clone ID: LIB3075-014-Q1-K1-E8
ctgcttcttctagctcatggcctgtccatgccaggtcgcgctggctgcgtttcatttcatggaagaaagcaaggatggatcacaggttgtcgttctgctaattaatctacatacgtttgccttcaagtactgtgttgtggcattgttacacatcacagtacagtttggtcaaattttttttccacagaggaagtagggattgatttaatcattgatttaatcccacacgcgtgtatctacgtatacagtttgtataacatgaaccacctctgtttgcgattggtctaaaaataaatataatacttatatattgaattgttttgc

SEQ ID NO: 63964 - DNA, 67 bp, Zea mays
  Clone ID: LIB3075-014-Q1-K1-E9
gtctgtatacggatgaacatgtataccttctcaaagggatgctgtattaaaaaaaaaaagggaggag

SEQ ID NO: 63965 - DNA, 377 bp, Zea mays
  Clone ID: LIB3075-014-Q1-K1-F1
tcgcggacgcgtgggtttgccatcgccttatctggaggtcccctagtcagttttttggggaaactttgtgaagctccatacaacaagacactggattggtccaaatggtacatcttctggtctgatgaacgtgctgtggcaaaaaaccatgcagagagtaactataggttaacaaaagaaggattcctcgccaaggtaccgattctgaatggccatgtctactccataaatgacaatgccacagtggaggatgcagcaacagactatgaattcatgatcaggcagctggttaaggtccgcacaataggagtctcagagagaaacgactgtcccaagttcgatctcatccttctcaccatgggctccgatgggcatgt

SEQ ID NO: 63966 - DNA, 366 bp, Zea mays
  Clone ID: LIB3075-014-Q1-K1-F10
cgctcagatctctccgcccgggtccattttcttaccccaaaccttctcccgcctctctggtcgacgccgcccgacgagagggatggcggccttgcgggctccggccgcaacgctcctcgtcctcctcgccctagcggcggccggcggcgtggcggccgacggctccgatcaccggtacaagattcgcgagcccgtcccgctctacgccaacaaggtcggcccatttcacaatcccagtgaaacatatcgatatttcgacctgcctttctgctctcctgacaaagtgaaggagaagagcgaggcccttggggaggttctcaatggggatcggttagttgatgcgccttacaaagctgatttccgtga

SEQ ID NO: 63967 - DNA, 318 bp, Zea mays
  Clone ID: LIB3075-014-Q1-K1-F11
ctcctccccctccggttcgggttcgggtttgttaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaa

SEQ ID NO: 63968 - DNA, 403 bp, Zea mays
  Clone ID: LIB3075-014-Q1-K1-F2
aaaacgagtgagaggggggaaatgctgcgccacgccgtccgccgtctcgtctcccgcaccgtcgcggcgcccaccgtccgccgggcgctcgtcacggcagaggtgcctgcggaggccgccgaggactccacgtttgtggagacgtggaagaaggtcgcccccaacatcgagcccccaacgacgcccctcttcctcatgcagccgcgcccgcccacgccggctaccatccccactaagctcaccgtcaacttcgtcctcccctacaagtccgagatcgccaacaaggaggtggacatggtaattgtaccagctacaactggtcagatgggcgttttgccaggccatgttgccacgattgcagagctcaagcctggtgttctctcagtacatgaggggaacgatg

SEQ ID NO: 63969 - DNA, 386 bp, Zea mays
  Clone ID: LIB3075-014-Q1-K1-F3
tcggccatggctctccgcaccctggcatcgaagaaggtcctatccttcccgttcggcggcgcgggccggccgttggcggcggcggcgtctgcgaggggggtgacgacggtcacactccccgacctctcctacgacttcggcgcgctggaaccggccatctcgggggaatcatgcgcttgcaccaccaaaagcaccacgccacctacgtcgccaactacaacaaggcgctggagcagcttgacactgccgtctccaagggcgacgcctccgctgtcgtccagctgcagggcgccatcaagttcaacggcggcggtcatgtgaaccattcaatcttctggaagaacctcaagcccattagcgaaggtggcggtgagccgcctcatggg

SEQ ID NO: 63970 - DNA, 426 bp, Zea mays
  unsure at all n locations
  Clone ID: LIB3075-014-Q1-K1-F4
cgagaggagaaccagcagcctccaataagagccagccagagaaactaataaaactctcgccgccgccatccgagcgaacaagccaaccgaccccgtccccaaggcaatccgccgccgacgtaccaccaccaccgcaggagcgagatggagatgaagaggatcctcttcgccgtcctcgtcgtcatcgccgcctcggccaccgcagtgctggccttcaccgaggccgccgtcgcgggcgccccaactgcctccgagtcgtccgccgaggctcccgctggcgctggcgctggcgctgccgctggcgccgtcgcctcggggcccttcgccagcagcggcgcgcccgtcctcgccgtcgcgcccgccgcgctcctcttctcccttctcgcctactacctncactaagcgtgtgcgtgcgtacgtacgcgc

SEQ ID NO: 63971 - DNA, 334 bp, Zea mays
  Clone ID: LIB3075-014-Q1-K1-F5
tcggtccgggatcacgctgctcaactccaagttcttccacatgaacatgtacaagtgcaaggacatgctgatcaaggacgtcaatgtgacggcgcccggggacagccccaacacggacggcatccacatgggcgactcgtccggggtcaccatcaccaacaccgtcatcggcgtcggcgacgactgcatctccatcggccccgggacctccaaggtgaacatcaccggcgtgacctgcggccccggccacggcatcagcatcggcagcctagggcggtacaaggacgagaaggacgtcacggatatcaacgtcaaggactgcacgcttaagaag

SEQ ID NO: 63972 - DNA, 396 bp, Zea mays
  unsure at all n locations
  Clone ID: LIB3075-014-Q1-K1-F6
cgaggtgctctccaaccacaccttctactagctctacctgggccagcgcgccaccgcggcgtggaccgacgatggggaggtgctgcagctgctcgacaggttccgggaggagctccgccgggtggagaagcggattacggagaggaacagggacccgcgactcaagaaccggaagggacccgccaaggtgccgtacacgctgctgttcccggacgtcggcggcaaggagaaggggatcaccggcaaagggatacccaacagcgtctccatatgacaattgacaagctcgctcctttttttttattgctttgttgcagaggatctgattatggatgtcggtttaatttcgttgtgagcatcattgtgttaatatgtcntattgcgatgattggtttg

SEQ ID NO: 63973 - DNA, 392 bp, Zea mays
  Clone ID: LIB3075-014-Q1-K1-F7
tcgtcaccaccaccaccaagctcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgctctctcccagcagtccaacctggtgctgtacggcaggatccagtgcaagggcaagtgcaccgagcagaagggcatcacggcgccggccatgaaggtctgccaggaggagtgcgacaaggcgtacgtggtg

SEQ ID NO: 63974 - DNA, 426 bp, Zea mays
  unsure at all n locations
  Clone ID: LIB3075-014-Q1-K1-F8
caacatggagggccttattgcagtgtttgacctgcgtggtggcacatttgatgtgtcaatccttgagatatcaaatggggttttcgaggtcaaggcaaccaatggtgatactttccttggtggtgaggattttgatggtgcactgcttgaatatctggttagcgagttcaagaagtcagacaacattgatctgagcaaggacaagttagcactgcaaaggctcagggaagctgctgagaaggccaaggttgagctttcgtccactatgcagactgaaatcaacctcccatttatcactgctgatgcatctggtgcaaagcacttcaacattaccttgaccagatctaagtttgagtctcttgtgagcaatctcattgagaggactcgcatccctngtgtgaactgcctcaaggatgctggcatctc

SEQ ID NO: 63975 - DNA, 392 bp, Zea mays
  Clone ID: LIB3075-014-Q1-K1-F9
gccatcaccctttcagtctgctaaacatttcatacatactggatatttccaagaaactgaaggcaaggcacgtggttcccccagagaaatttgtggaggcactgaaactgatggagcaccgctatggggcaagagatttcgtgacgagtcaagatacaagtctgctatccgcaggcacatactatctcacgcacgttgactccaagtacagaaggttctacgacgtgaaaggtgacggtgtcgccactgcaatgtccaacggccactgatctttcttctgcccgaagctgcaacaagtcaaataacagaggcaagtgtcctaaacatccttagatgattatatatctattaagaggggaagctcgagttatagattaatctatgcccagctg

SEQ ID NO: 63976 - DNA, 414 bp, Zea mays
  Clone ID: LIB3075-014-Q1-K1-E3
tcgagacagattctgaaggatcattttttgcaggtcctttgtatgatgacatagtatataaagttgaagcttcaaaggatggttaccatctcaaacaaactggcccatacaccttttcttgtcagaagcttggtcagatattagtgcggatttatggtgaaaattcagagcttttacctttagtattattatcattgagtggcgagaaagggtacagaaataactcaattagtagttctggtggaaccttcacctttgacaacttatttcctggaagtttctatctccgaccacttctaaaggaatataaattcaatccgtcagcagtagctattgatcttaattctggagagtctagggaggctgaatttcgtgcaaccagagtggcttacagtgccatgggttctgtaacac

SEQ ID NO: 63977 - DNA, 392 bp, Zea mays
  Clone ID: LIB3075-014-Q1-K1-C7
gctccgtttcgccgcatagccgagaggaagcaggcggcggcgagaatccagtagaacgcgagcagacggcggcgatggcatggcgggcgagcctgtctcggagtgtaaaggagatacgcgtcctcttctgccagtcctcccccgctagcgcccccgcccgggagttcgtgaagaagaactatggtgacatcaaggcccgcaacccctccctccccttccttgtccgcgagtgctccggtgtccagccccagctctgggcgcgctacgatatgggtgtggagagatgcgtgaacttggatggtctgacggaagcacagattgataagaagctggaggaacttgcaatggccggggagtctcttaaaaccaaatagttttggaactcgtatcat

SEQ ID NO: 63978 - DNA, 372 bp, Zea mays
  Clone ID: LIB3075-014-Q1-K1-C8
cagcagcctccaataaaagccagctcattcaaataaaaccgagagacctcagccctcaggcaagccgaccgtcgacgtaccaccgcgccaacccgagagaaagatggagatgatcaagaggatcctcatcgccgcgctcctcgtagtcgccgtctcggccaccgcagtgctggcctccaccgaggccgccgccgtcggcgccccagccgcctccgagtcgtcggcgtccgccgaagcccccgctggcgccgccggcgccggcgccggcaccggcaccgtcgcggtgccctccgccagctgcgccgtgcccgccctcgccgccgatcccgtcgcgctcctcttctacctgcttgcctactacctgcactaatc

SEQ ID NO: 63979 - DNA, 112 bp, Zea mays
  Clone ID: LIB3075-014-Q1-K1-C9
gatggattatagatcctgacatatttatcttttattttgcaagacttccgctgtgtaataaggactctgattatattgtgtcatttatctctattcaccttgtgattttatt

SEQ ID NO: 63980 - DNA, 371 bp, Zea mays
  unsure at all n locations
  Clone ID: LIB3075-014-Q1-K1-D1
tcgcggacgcgtgggtcaccgtgaaggacgtgaacatcaccgcgcccgccgacgttgagaacacggacggcgtccacgtcggaggctcctccaagatcagcatcctcaactcgaccatcggcaccggcgacgactgcgtctcgattgggcccgggtgcaacggcgtcttggtggacagcatcacctgcggccccgggcagggcatcagcgtcggctgcctaggccgctacaaggacgagaaggacgtgagcgacatcacggtgcggaactgcgtgctcaagaacaccaccaacggcgtgcgcatcaagtcgtacgtggacgccgagtccgtgctgacggcctnccatctcaccttcgagaacatcaggatg

SEQ ID NO: 63981 - DNA, 252 bp, Zea mays
  Clone ID: LIB3075-014-Q1-K1-D10
tttttgagcagtaaagttatgctataaattatagtataaatgaaataatttggaacgtgtaagtatgtcaaaatattagctgcaaagctacattatgctagaacccagttaccaaattctaagtcaaaaattccattgttccttaaaaaaaattggaggctcaaaagtagaacaagctccggggttaatttggtccgtgggttaaaagcatttgacaacattattaatccttgacaattttaaaaccttaag

SEQ ID NO: 63982 - DNA, 371 bp, Zea mays
  Clone ID: LIB3075-014-Q1-K1-D12
ctaccctcgtcgtcgtctcactcacccctccttcacgcctccctcaccaaataaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctactgcgacacctgccgcgccgggttcgtgaccaatgtcaccgagtacatcgcgggcgccaaggtgaggctggagtgcaagcacttcggcaccggcaagctcgagcgctccatcgacggtgtgaccgacgcgaacggcacgtacacgatcgagc

SEQ ID NO: 63983 - DNA, 254 bp, Zea mays
  Clone ID: LIB3075-014-Q1-K1-D2
tcgccatgaactcgtccttgacacccttccacaagtattagtttgcttgcatgcgctgttgagctgaaattgtaggttccctgcatagtgtacgccaagttcaagtgattagtgtcacggatacagtttactgtgtacaaagagagagagagagagagagaaatacatggcattttctccatgatactataatataatatgatgagatatgcatactggactttattaagcagagtaaggggtattacagtcct

SEQ ID NO: 63984 - DNA, 419 bp, Zea mays
  unsure at all n locations
  Clone ID: LIB3075-014-Q1-K1-D3
tcgggaaatttcagtgtgcaaccctacagctggattttcagctgcccattcggttcaagctggcttattctgctgaggatgaagccaaaattgaaaggcctgtgatgatacacagggcaatcctaggttcggttgaaaggatgcttgccattcttttggagcattacaatggtaaatggcccttatggctaagccctcgccaggccattgtttgctcggtatcttctggttcagtggaatatgcgaaacaggttcttgccactctacatgaagctggttttcatgttgatattgacgcgagtgacaggacaatacaaaagaaggtacgggaagctcaactggcccaattcaactacattcttgtcgtangtgcacaagatgccgagactggaaatatatgcgttagggtaagagacaat

SEQ ID NO: 63985 - DNA, 430 bp, Zea mays
  unsure at all n locations
  Clone ID: LIB3075-014-Q1-K1-D6
ggcaagaatcatgctttaagaagggtgctatcacaggccacagagataatgcaaccaacaaccatagtttaactctcacaaatggtgccagttgcggctacctagagtgcaggaatggccaacataaactctgaaatacggtcatgactcatgaggggaaacaattgaggtagtgaaaacaggtaactgctggaagaaacggaaacagaaaccaacagctacaccgaatatttctccagtaccacgatacatctaatgcatgcccaaactctgctatcttcaatgttcaacccggcttgaaccacaagcagatactgtcgaatttccgtactgtacttgtatcattcctcacagttcatgtctttatgcgcaccacatacgaacatgnctgaaggtttgacatgtcagcagagacagaacacgaaatttc

SEQ ID NO: 63986 - DNA, 371 bp, Zea mays
  Clone ID: LIB3075-014-Q1-K1-D7
cggacgcgtgggcgagctcctggttgaagggcaggtacttgcgcttcccctgcgtcgtgccggagctgagggagatggaggtgatgggcttggcggtgagcacgggggacgtgtcgccgtcggcgatgcgcgcaatgtagggctcgatgtcggcgtgcgtggcgagcggcacgcaggcgcggaagctggcggcgtcggtgcggcccgcgaggccccggcagcggaggtactcggcgcaggcgttgtctgccaggatccggcgcagcgtgtcgcgctgcacggcggcggcgtcccgcgtgagggactcgaactcggcgatcaccgtctcgccgcagaacgcggcggcctgcgccttcttctccggcatggcg

SEQ ID NO: 63987 - DNA, 435 bp, Zea mays
  unsure at all n locations
  Clone ID: LIB3075-014-Q1-K1-D8
gggcagcagcacacagccccatcccaatcctagtcgatcttcttcccctcctcaaggaagaaaagaagctgaaccatggggaagagaaagtcagctgctaagccacctcctaagaagcggatggacaagcttgacactgtcttttcctgcccattctgcaaccacgggagtagtgttgagtgccgaattgacatgaagaatctgattggcgaagcatcttgtagaatctgtcaggaaaacttcagcacaactgttaatgcactcactgagcctattgatatatatagtgaatggattgatgagtgtgagcgtgtcaacactgttgaaggcgacgatgatgcgtgagcttgccccatgcgatgaaactgttacctacaatcgtaatgtaatgtgctggtattctcgaatgccatagcccatagtcagncatggctt

SEQ ID NO: 63988 - DNA, 412 bp, Zea mays
  Clone ID: LIB3075-014-Q1-K1-D9
cggacgcgtgggcggacgcgtgggcggacgcgtgggggagaaacattctccaatatttcaccgaacgccgtgaatgctgtcacgtggggtgttttccctggcaaggagattatccagcctacggttgtggatcatgcaagttttatggtttggaaggacgaagcatttgaaatctggactcgggggtggggttgcatgttccctgagggtgattcatcgagggagctactagagaaggttcagaagacctactacctggtcagcctcgttgacaacgactacgtccagggggacctgtttgctgccttcaagatctgattatgctctcatggtctgtattgttgtatggttggacccaacaatattcttgcatccccgactacaggtctgatcgccatgaaagcttctgttc

SEQ ID NO: 63989 - DNA, 301 bp, Zea mays
  Clone ID: LIB3075-014-Q1-K1-E1
tcgaagataaagaagaatgagtgtgccaactaaggattaggcgttatgaattggccaggttgactggaggcctccagcagcttcctcctaccgttgttcagaagcagtagttcatgttttttgtgtgccgagctgatgaatatgtttatgttcgtataaacaggatgaacactagctatgttaaggatttgcttataaaaagttacaccgggtcagatgctgttctgttagcgtacattgtctttaaaaactatttgcattctgtatgacaatgtaaacttgtgaacggtagtagtgcttt

SEQ ID NO: 63990 - DNA, 410 bp, Zea mays
  Clone ID: LIB3075-014-Q1-K1-E10
atggctcatggctgccatcgtctaggctcaacatccgaaagacgggccatggtcggttgcctgcctcaccccagcggcggacatctatccgaaaataggccgcacctcgtccgctttgctccttgttcatccttcacctgctgatggcggcagcggcgcggccatccaacgccactcttctcgcgcgccttcgggacggcacggccaagttcgagctgctggatgactctgcgtttgcgcttgcgcacgcgcccccggcctggccccgacttcactgctttgccaggattgccccctcgttgaggggtgggtggtcggcagcgttgaacaaggtggagcattacggggttcagagggttaccggcgatggccggtgcatgtttcgagcgctggctaaaggaatggcaaaa

SEQ ID NO: 63991 - DNA, 337 bp, Zea mays
  Clone ID: LIB3075-014-Q1-K1-E11
gacgtgaacatcaccgcgcccgccgacgttgagaacacggacggcgtccacgtcggaggctcctccaagatcagcatcctcaactcgaccatcggcaccggcgacgactgcgtctcgattgggcccgggtgcaacggcgtcttggtggacagcatcacctgcggccccgggcagggcatcagcgtcggctgcctaggccgctacaaggacgagaaggacgtgagcgacatcacggtgcggaactgcgtgctcaagaacaccaccaacggcgtgcgcatcaagtcgtacgtggacgccgagtccgtgctgacgggcctccatctcaccttcgagaaca

SEQ ID NO: 63992 - DNA, 240 bp, Zea mays
  Clone ID: LIB3075-014-Q1-K1-E12
ggagaaccagcatcctccaataagagcttgtcttagaaactaataaaactctcgccggcgtcgtccgagcgaacaatccaaccgtccccgttcccaaggcaatccgacggcgacgtaccaccaccaccgcaggagcgagatggagatgaagaggatcctcttcgtcgtcctcgtcgtcatcgccgtctcgtgcaccgaagtgctggactacaccgaggccgtcatcgaggtcgccccaac

SEQ ID NO: 63993 - DNA, 449 bp, Zea mays
  unsure at all n locations
  Clone ID: LIB3075-014-Q1-K1-E2
tcgcccacgcgttcgcccacgcgtccgatcaatgtatcaaggtggtttaatcacattgatgcactcctgaggctgagtggagttaccgcagagggcctaggtgttaaggttgagccatctgcagttccttcagcttcaattcttgatgttgctgatggacaggccccagctgctgacgaggatgacgatgatgatgttgacctttttggcgaggagactgaagaggagaagaaggctgctgaagaacgtgctgcggctgccaaggcttctggcaagaagaaagaatctgggaaatcgtcagttttacttgatgtgaagccatgggacgatgagactgacatggccaagctcgaggaagctgttaggagtgtccagatggaaggactgctttggggcgcatncaagcttgtcccaagtggatatggcatcaagaagcttgcaatcatgat

SEQ ID NO: 63994 - DNA, 411 bp, Zea mays
  Clone ID: LIB3075-014-Q1-K1-C6
gtgacgtgaagcaggcagaagctgtgccacttcttccaaagaagattgctccggccaaagagcagaagcctaaggaagccaaaaaggaggccccgaagcctaaggaagctgagaaaccagcagaggaagaggaggctccaaagcctaagccaaagaatccccttgatttgcttcctccgagcaagttgattcttgacgattggaagaggctgtattctaacacgaaaaccaacttccgtgaggttgctattaaaggtttctgggacatgtatgacccagagggctactccctgtggttctgtgactacaagtacaatgacgagaacacagtgtcgtttgtgactatgaacaaggttggtggcttcctgcagcggatggatctgtgccgcaaatacgcctttggcaagatgc

SEQ ID NO: 63995 - DNA, 260 bp, Zea mays
  Clone ID: LIB3075-054-Q1-K1-H7
cgagcggtcgcccttttttttttttcttatatttggatgtttttattgttcccaggttactaggatattattagggggctgaagaaacaagacccaaaaaaaccttgaccagttcttattttcaaccgcaaccactctgtacccaaaaaacgcccatggaacctccgattaaaaaatataaaaattggaaactgtactgcatgctgttccaggaaacccaatgaccaaatggacaaacacaaaattgcagaaacaaaaat

SEQ ID NO: 63996 - DNA, 304 bp, Zea mays
  Clone ID: LIB3075-054-Q1-K1-H8
ccggaatgacccatgcgacccacgcgtacgcatacaatggaactgcagcgcattactaacatatggaggctcttattgtgccgaggctacgatgaaattatgaggcacttgatgaggcatgaattatttcacaacttaggcgacgttagtgagaaaaggcgacgctgatatatatggtcattgtccttggtttgtccgttcgccagatatcaccattatcatatttattggatgttatataagcttctcggattagcatatgtggtaatattctctttcagatggtatgaggtcctgcgagata

SEQ ID NO: 63997 - DNA, 366 bp, Zea mays
  Clone ID: LIB3075-054-Q1-K1-H9
atcaatcatgtctggtcgttcgtggacaataatggcgcctctcctggcgtcgatgctgctcgtcgggctcgccgtgggctccgaggaggaggaggacggcggcggcaaaaagaagccccacgtcaaccacggcaagtttaaggcggagccgtggacggacgggcacgcgacgtactacggcgggcgcgacgggttaactgacaccacggacggcggcgcgtgcggctacaagggcgagctggggaaagactacggcaccctgacggcggccgtgggcccgtcgctgtacaccaacggcaccgggtgcggcgcgtgctatgagctcaagggccccaaaggcaccgtggtggtgacgggcaccaacga

SEQ ID NO: 63998 - DNA, 358 bp, Zea mays
  unsure at all n locations
  Clone ID: LIB3075-055-Q1-K1-A1
caaaggcaatggctgctgagattgaggtcgttgatggtcctaatgatgagggtgaaatgttcacccgccctggtaaactcagcgatcgctttccacagccttatgcaaatgagcaagcagcccgatttgctaatggtggcgcctacccgtcggaccttagtcttatcacaaaggcaaggcacaatggtcagaactatgttttcgctcttcttactggataccgtgatccacctgctggtgttcagattcgtgagggtctgcactacaacccctacttccctggtggtgccatagccatgcccaagatgctcaatgatggagctgttgagtatgangatggtactcctgcaactgaagc

SEQ ID NO: 63999 - DNA, 110 bp, Zea mays
  Clone ID: LIB3075-055-Q1-K1-A12
acgcagcagtctacttatcgataccaccaaacttaacaacagccagcgacgcgaaaataatgagagagccgaatcatgacatcatgggcggcgcactcgtggcatagtcc

SEQ ID NO: 64000 - DNA, 319 bp, Zea mays
  Clone ID: LIB3075-055-Q1-K1-A2
tccacagcaataagcttcatgagataattgctcctgtcaagagatctatgagccaactgactcgataccaagggaggtcaggctggttgcttgcctacattgcttttgtaacatcctggccgctgcttggctccctagctttcatcaccttccggaaaaagtccaggaatccgttgcgagcctaatggatcatacttatattatggtattacaattacatcatgccacatcctctgagctacgaatgccatttttccccgggtcgtcacagctcctgtgtacagtatcatcaccgatcatcatcaaacatttggggccc

SEQ ID NO: 64001 - DNA, 369 bp, Zea mays
  unsure at all n locations
  Clone ID: LIB3075-055-Q1-K1-A3
ctcagccaaccccatcttcatcgacatgaagtactgtcccaacaagttgtgtactgccaacggcgcctccaaggtcaccgtcaaggatgtcaccttcaagaacatcaccggcaccttctccaccccggaggccgatagcctgctctgcactgccaaggtcccatgcaccggcgtcaccatggatgacgtcaacgtcgagtatagcggcaccaacaacaagaccatggctatatgcacgaacgccaagggcagcaccaagggttgcctcaaggagcttgcatgcttctagaccctncatcgactgacccatctctgtagttataatttatctctcgaccttgcattgcccattagatgctattcattggt

SEQ ID NO: 64002 - DNA, 103 bp, Zea mays
  Clone ID: LIB3075-055-Q1-K1-A4
agccgctacagctgcatcagccggcgacgccgattgctaggtccagcactatactatcgggctgcacggttatcgtctttccgataccagctatgctgctgct

SEQ ID NO: 64003 - DNA, 388 bp, Zea mays
  Clone ID: LIB3075-055-Q1-K1-A5
caggtggcttcttgactcattctgtgcccttgtatatgacaggagttgaagtttctccgctttgctcttatgctggagagaatctagaagctatatgcagtggaagaacattccatgcaccaagtgagatttcgttctaggcatagtagttgttgcaagcaatctgaatacaggaagatgagatcaggccaattttgattacaacatgactactcttgcaaatagaatgttgatattagtaaactattgtatgttatgcaaggatcaaatattgtaacgcagcacctgaagttgcctacattctactctagcattaatgtgtatctgcctatcgaatgtagattatgacatgctttagtgtaatatttttttttgaaaacagcatatg

SEQ ID NO: 64004 - DNA, 99 bp, Zea mays
  Clone ID: LIB3075-055-Q1-K1-A6
acggatacggctaaccggatactgcgcataccgtgaagtgacacatgagccaactgattcttagccaaggaccatcgaggagagtgcatgctaacgttg

SEQ ID NO: 64005 - DNA, 383 bp, Zea mays
  unsure at all n locations
  Clone ID: LIB3075-055-Q1-K1-A7
cccgttcgcgttgctctccagcataccgtcactgtcgcagacggcctcgcactcgcactcgccactgatcaaccagaactacccgcttctgaaccagatgcaggtgttccaccacctcggcggcagtcagcagccgtcgttccaccaggacggcagcgcggcggctttcggtgacatcgtctcctctcgcctgccgccactgccaaccgccagaacgcaggcggagctacattcgaaccaattcgacacctncatcagcggcgggctggtggatcagtcgatgctgatcggcgacgaacacctgctgcggcctaacccgagtatggtcaaggtctcctccatgcccgcgctctcctaccgtgagccggatgggtccaggatgc

SEQ ID NO: 64006 - DNA, 330 bp, Zea mays
  Clone ID: LIB3075-055-Q1-K1-A8
ggaggttgaaactgttgatgactatgacgagtattgtcactatgtagccgggctagttggttatggactttccaggctcagttatgctgctgggacagaagatctggctccagattcactatcaaattcaacgggtctctttttacagaaaactaatataattagggattatttggaggacataaatgagataccaaagtcccgcatgttctggcctcgagagatatggagtaaatatgcagataaactcgaggatctcaaatatgacgaaaataccgaacaggcagtacaatgcttgaacgatatagtgacgaatgcactgattcatgc

SEQ ID NO: 64007 - DNA, 409 bp, Zea mays
  Clone ID: LIB3075-055-Q1-K1-A9
gctgacattacatcaaattgggcttgacgttctacggactgatcgcaccatggtattctatgagaacaaagaaaacctttccaaattatgggatattctagccgcgtatgcatggattgacaaagatgttggttactgccaaggaatgagtgatttgtgctcaccaatgatagttctactaaacgatgaagcagatgcattttggtgctttgagaaattgatgcgtatattgcgaggaaatttcagatgcacagatcaatctgtgggagttgccaactaactttaacaccttgcgtctattattcaggttcttgaccctaagctacatgaccacctaaaaactcttggtggaggtgactacctttttgtgttccgatgtttatggttcttttttaggctttagttttat

SEQ ID NO: 64008 - DNA, 254 bp, Zea mays
  Clone ID: LIB3075-055-Q1-K1-B1
acacttatatatatattggtgcttaaagagaatagaagagaagagaagatcgacaagagattggccgtaatggacttctaggagctgcacatactggcctagcagatggtgaagcacgaggagccggagagcgcgagcaagatgcttggctgcatgcttgtagaggaaccggacatccaggcaatgctgcatctcgcctacggcaactgctcacaggtacaccccaagatcagctacgctaaggccaatctgga

SEQ ID NO: 64009 - DNA, 216 bp, Zea mays
  Clone ID: LIB3075-055-Q1-K1-B10
acgcatgcatgcccttcggcatcgtcacgaagttcacgaccctcccttaggctccggcaaacgacatcaagacgtgacagaaaggaagaaagacgcttgcgccagtgctgacgacagcgactccgtcaccgtggcactcgatcgcgaggctctagtgcccgtgcccaccaacgccttctttgctgactacccagccgatggtgccctgctgagggt

SEQ ID NO: 64010 - DNA, 167 bp, Zea mays
  Clone ID: LIB3075-055-Q1-K1-B11
ggctacagaaccatagcacacatgctcacaaggcatcgtgctagcatgaacttcacttgtgctgagatgagggacagtgaacagagttcagaggcgaaaagtgcacctgaggaactggttcaacaggcgctgagtgccggatggagagagggcctaaatttggcatg

SEQ ID NO: 64011 - DNA, 283 bp, Zea mays
  Clone ID: LIB3075-055-Q1-K1-B12
ctactcgcctcctacattgaccaacaactaagcctccgtgaccgccacatctattaggtgcagccatgggtgcctgtgcaacgaagcctaagacgcttgaggggaaagccccagctgaggccaccatctccacacccaaggttgcacctgagaccactgccatccacattgaggttgcggcgaaacaggcagtagttgagaaggtggaggaggacaaggaggaggcactaacagtggcggcgaaacaagagccagcattcaccatcgagcctgaacagattgc

SEQ ID NO: 64012 - DNA, 348 bp, Zea mays
  Clone ID: LIB3075-054-Q1-K1-H4
atccgatccatcttgggcgggcgccgagcgtcgagggccagccaaagcttgccatggcggccgttcggtccgacagggtccaccaccaccaccgccgctccgaggcgtcgtgtccggcaacctccgcggccgtggcggcggcgagggccgatgacgccctgcgccagcgcccgcgggggctcgtgcaggtccgggagcgggaccagggcccgctgtcgacggggcaccagcacctgcaccaccatcaccaccagctgcggcggtcggcggcgttcccaccccgccgaccggggccggggcgccgaccttcttaacgctgcgaaagcgacctcaacatcagggagcacc

SEQ ID NO: 64013 - DNA, 446 bp, Zea mays
  Clone ID: LIB3075-054-Q1-K1-G1
acgagaaacaatccttgcacccctcccctccgtcaccccaccacatccggccagcccaacgaaaatgtcgcgcgccacagctgcggtcctcttctacatcctcgccgtcgctgccctcagcgcggccgaggcaccggcagagtcaccgaaggcaggcagtcctgccaaggcaccggccgagtcaccgaaggcaggcagtcctgcagctcctgccaaggcacccgagtctgctgccacgagaactgcccccgctaaggcacctcaagccgtctccacccccgccgctgccgctgccccatcgtcgtcgtcgtctaggaagtctggtccagctgccgcgccgaccaccgtcggctctacaccgtcttcttccacggacgaggagttgagccctttcgcgtcggcatccaccggcgaaggggcgttccctggcgctgatgggcctgctg

SEQ ID NO: 64014 - DNA, 257 bp, Zea mays
  Clone ID: LIB3075-054-Q1-K1-G10
gcgacgcgtgcgatcggaggctctgacatcatactggtagccaggctggttctgatatgtgttacagtgtcagtggttatttcacgccggattgtggttcatttgctgaacactgagaggggagcgtacgaaccgatgcactacctcatgagagatgaagataatcacatacttaaggagaagcactacgaggctgtacgtcaggtttaaaaacaagtccatgaaggtaaccagacagttgtggtgcttggcacaca

SEQ ID NO: 64015 - DNA, 297 bp, Zea mays
  Clone ID: LIB3075-054-Q1-K1-G11
cgcttacgtacaacaggacacgccaagcattcatcatcacagagcttactgagattatctctggtgcatcagcccttgacggatatgtggatagactatcatcacttgtccctttgtacccatttgcgttcctctcacatgtacgctactattcttccggcggctcacattcaaccctaatcgtttcactaggacttgatacacgtattcttacgcttgattgccgttatgcggacaacgacagttattatgccagagcgctctttgcatattgcaaaaagaatgttctacatctac

SEQ ID NO: 64016 - DNA, 333 bp, Zea mays
  Clone ID: LIB3075-054-Q1-K1-G12
ggcgccatggccaagaagggcgaggaggagaagctgcgcaaggcgggcatcatcgacatgcagttgcgaagggttaagtgcaagtacgagtccaaggtcaccttccaccttgaaaaggggtgcggccccaactacctggcgctgctggtcaagtacgtcgatggcgacggtgacattgtggcagtggacgtcaaggagaagggctctgacacgtacgagcccctaaagcactgctggggcgccatctggaggaaggacagcgacaaaccgcttaaaggacccctcaccgtacgacttactaccgagggaggcaccaagtccgtctacgacgat

SEQ ID NO: 64017 - DNA, 461 bp, Zea mays
  Clone ID: LIB3075-054-Q1-K1-G2
aatggatccaagcccccactctttgctggcatcatagcacttgtgatgagcatcgcaacgatggtccgtctgacccgcagcatgatgcctgggaaggttctcggtgctgccataggtggagctaccctctcagaaggtaaatcaaaagtacaagagcgccagcggtccaagctatcagaagaggctgtggaggaagctgaagacgccgtctctgcaaagcgcctctcggagcttgaggagaaggtcattgcactcctgacaaaacccgcatcaatgcctgctgataaggaggaggttctgcaggctgctgtctcccgcgttagtgcactggaagaggagcttgcagctacaaagaagaccttgcaggagactcttgagcgtcagttggagatcgttgcatacattgagaagaagaagaaaagcaagcgtttctttcgttggtaggagcaaacagcagtgaa

SEQ ID NO: 64018 - DNA, 441 bp, Zea mays
  Clone ID: LIB3075-054-Q1-K1-G3
cggacgcgtgggcggacgcgtgggcgacccccttcctctctccctccgccgccgctgcgcacgcagggaacaagcgacatgggcgtctacacctttgcgtgccgcaacaacggcggcgagtggaccgccaagcagcactccggcgagatcgaggctttcgccgctaccccatacgagctgcagcgccgcctcgtcgctgccgcctccgcggacgactctgcctacggcgtccagtcgtccttctccatggtcacccccagctccgccgtgttccaggtgatcgtcggtgctgtcggtggtggtgcaatgatggtgagcggacgtggcggccggcgtgctgctgcatctggtggtgctgctgccgaggctcccaaggaggagaagaaagaagaggagaatgaagagagcgacgactacatgggattctccctgttcgactag

SEQ ID NO: 64019 - DNA, 359 bp, Zea mays
  Clone ID: LIB3075-054-Q1-K1-G4
tccggcagcccccgagtccgaaatcgttggacggggaaaggaaagcgaaacaagccacgctaagcaagatgcaccgaaaccctcgcgccgtcatccgcgccgccgtctccctcacccgccggccccccgccgttcctgccgcggaggctctccaaaccctgcctaaagcgacgccctcgcctgcgcttggggcgtggcggccagaccaggcggtggggcctttgggtagcgtcagccgccgtcgcgccttctcctcctccgcggcagagtatggcaaggatgtggacgaggtgaaccgcaagttcgcggaagcgcgggaggagatcgaagcggccatggagagcaaggaaactgtctac

SEQ ID NO: 64020 - DNA, 410 bp, Zea mays
  Clone ID: LIB3075-054-Q1-K1-G6
acggtggagcagccccaggacgcggtgaagctcttcaaccgctggaccttcgacgatgtccaggtgaacgatatctcgctgaacgactacctggctgtgactgcggcgaagcacgcgacattcctgccgcactccgcggggcgctactccaagaagcggttccgcaaggcgcagtgcgccatcgtcgagcgcctcaccaactcgctcatgatgcacgggcgcaacaacggcaagaaggtcatggccgtccgcatcatgaagcacaccctggagatcatccacctgctcactgacgccaatcccatccaggtggtcgtggacgccattatcaacagtggaccacgtgaggatgccacccgtattggttcagctggcgttgcgagaaggcaggctgtggatatctaacccct

SEQ ID NO: 64021 - DNA, 295 bp, Zea mays
  Clone ID: LIB3075-054-Q1-K1-G7
atggattctaatcgtgtccaaagactagtttttagggtcttgatggattggggtgagaaagagcatgggatgtacaatattgaccacatggatgtacttcctgaagtcttcaagcctggtcttatgtcaaagaagacccgtcaagaagcaagcaatttattttcatgctaggatgctattctgaaggacgagcctctatggccagaggatatgtggtactgtcctgggtgcaaggaacacaggcaagctagcaagaaactggactcgaggaggttgcctgagatattggtagttc

SEQ ID NO: 64022 - DNA, 277 bp, Zea mays
  Clone ID: LIB3075-054-Q1-K1-G8
cggtgaaggacttcaaccgctggacctttgacggggtccaggtgaacgatatatgggtgaacgactacctgtttgttactgatgagaatgacgcgacattgctgccgcacttcggggagcgctactccatgatgcgggtccccatggcgcagtgtaccatcgtctagcgcctaaccaactctgttatgatgcacgggcgcaacaacgggaagaatgtcatggtcgaccgcatcatgaaacacaccctggagatcatacacctgctcactgacgccaa

SEQ ID NO: 64023 - DNA, 415 bp, Zea mays
  Clone ID: LIB3075-054-Q1-K1-G9
cggacgcgtgggattggtggcactaacatcagaaatgaggccaatcagcttctgaaaggggtcaatctcttagttgcaactccaggcaggcttctggatcatctgcgaaatactaaaagtttcaactacaaacggctacagtgccttataattgatgaagctgatcgcatacttgagcaaaattttgaagaggatatgaaacaaatatttaaacgactccctcaggataggcaaacagttcttttttctgccacacagaatcaaaaggttgttgaatttgcgaattttacgtttgggcaaaatgaagaaagacaaaagaaacttggttatgttggagtcgatgattctaaattaaagcctactgttgagggcttgcagcaaggttacttggtcattcctaagcagaaaagggttc

SEQ ID NO: 64024 - DNA, 258 bp, Zea mays
  Clone ID: LIB3075-054-Q1-K1-H10
ctcggcgccggcgaggccgggactggcattgccgagctcattgctctcgagatgtccaaacatactgggtctccgatcgaagagtgccgcccgaagatctggctgatggactccaagggcctgatcgtggtgtcacggaaggactcgctgcaggcgttcaagaagccatgggcgcacgagcacgagcccgtggcaaccctgctggaggccgtgcagtccctgaagccgacggtgctgatcggcacctcgggcaagggc

SEQ ID NO: 64025 - DNA, 347 bp, Zea mays
  Clone ID: LIB3075-054-Q1-K1-H11
ggtcatccaactcaccttataatttagctgtgtctccatctatactggtattatacaagctcatcataatctaaattgataaaacaaactgttgaaagtatctctgcataaaaagaagttttttggcctgcacaacatctctttgctgtggatgcaagatattgacaggaagatctaggaaggaagcaaatctgatagcttctgagacaactgtagttgatatttatggtacttgttctagatattgaaacaagacataaataagtaacatataattcagtaaaatgtattgccattgtggctttgcgtggaacttagtttgagttcttacttcgatgccatcaagg

SEQ ID NO: 64026 - DNA, 333 bp, Zea mays
  Clone ID: LIB3075-054-Q1-K1-H12
gcgtccgagcaaataaagagggatcggattggaactcgatcggacggaaggtcctgcaggccggctggccgggcgtccatcgaggaaccaagctgctgctggtgctaccggacgacaccaaccatgatacggaggacgacagtgtgcctaggcctgctgcttctactactggcggcgtcgactgcgacggcacatttctcgatcggcgacgtggacgagtacttgaacaggcgcacgcaggaagtccggcacaggaaccacggcggtgcgcacatcaatgacctcatgtccagtgctgcgcgctttcacgccaacgtggatgcacgcgcgaat

SEQ ID NO: 64027 - DNA, 82 bp, Zea mays
  Clone ID: LIB3075-054-Q1-K1-H2
cggacgcgtgggttttttttttttttttttttttttttttttttttgtcttttttttttgttttttttttggtctaaatcgg

SEQ ID NO: 64028 - DNA, 460 bp, Zea mays
  unsure at all n locations
  Clone ID: LIB3075-054-Q1-K1-H3
cccacgcgtccgcggacgcgtgggagatcccatagtgcaactggcagcctgcatgtaccccagcttaacccaatagcagctgatgtacttcgaaaggagcctgaacatgaaaccttcagtaaaatcaatatcacagctgttgagactccttctcctgatgaaattgaggcatacaaagttcttcagaaatgccttgagctgcgtcagaggtacatattcagagaagaagttgctccttgggaaaaagagatcataactgatcctagtactccaaagcctaatccaaatccgttcagttatgaacatcaggcttaaaccgatcaccatttcgaaatggttgatggccgtattcatgtgtaccccaataaagattctaaagaaagactctatccaggtgccgatgcaactaccttctttactgaaatgcactacgtnctttgtggggtggctgctggggata

SEQ ID NO: 64029 - DNA, 291 bp, Zea mays
  Clone ID: LIB3075-054-Q1-K1-F9
cacacattatactccagaaatactgtgtgaacaggtatcttcggatccaagtcggcatcacagtagaccagagtaatacgaaggttgatacagcgccgaaggtgtgagcaggaaagcttcggcgcgacaacaaaaagtgaaaccgacttaaagatgaaaaggctatttagacctcgacagattactatagaattattaccaagtgtaaagggcatgaatgtaattttgtatgggttgtgttccgtgcctataaatatgtgatctagtcctttgtacttgttatgctgactt

SEQ ID NO: 64030 - DNA, 367 bp, Zea mays
  unsure at all n locations
  Clone ID: LIB3075-054-Q1-K1-E12
cggacgcgtgggttgggaataaatagttcgtgaatccctgaagcgtgcatatatatattcctgccgagataaaggtaatggagtcgtcacgcaggttccagccggccgtcatcctgcttctcctgctcattgtgtccaccgatatggcacaggcaagggaatgcgagaagtacagtgagcgatttgttggggcatgcatgatcgcagacaactgcgccaatgtgtgccgcggtgagggcttcttggccggcaggtgcagcaccttccgccgncgctgcatctgcactaggcagtgctaaacaagatcgctcgatcgctcgccatgcatcgacaacctattcttaataacggtcattatctcggtctt

SEQ ID NO: 64031 - DNA, 469 bp, Zea mays
  Clone ID: LIB3075-054-Q1-K1-E2
gaacaaatacctcgctaccaacaatggcctccaggtcctccatcctacttgcaacgtcgatgctggctgcgctgtttgcggttggtttgtgcaccaccccgctcaccttccaggttggcaagggatccaagcctggccacctgatcctcacccccaatgttgcaaccatatccgacgtggagatcaaagagcacgggggcgatgacttctcctttacgctcaaggagggcccgaccggcacctggacgctcgacaccaaggccccgctcaagtaccccctttgcatccgctttgctgtcaagtccggtggctaccgcatcgctgacgacgtcattcccgctgatttcaaagccggcaccacctattagaccacacttaggatgtaatcaagctttgatgatgaattatatttcaaaagagcttacctggtgctcatggtagcaagaacatattttttctatgggtattt

SEQ ID NO: 64032 - DNA, 344 bp, Zea mays
  Clone ID: LIB3075-054-Q1-K1-E3
gtcatggtctacataggtgtttgctctctcgtagggtccatgtcggtcatgagcgtgaaagctcttgtgatagcattgaagctgaccttttcaggaacgaaccagcttatttacccacagacatgggcttttagtctggctgtcatctcatgtatcattacccaaatgaattacttgaacaaggcacttgacacgtttaatacagcagttgtgtcacccatttattataccatgttcacatctttaactatcttggcacgtgtcatcatggtcaagggcactaaatagtgattgagccactgtttcaaattcaccttcaaatggggacttccttggattgcatt

SEQ ID NO: 64033 - DNA, 307 bp, Zea mays
  Clone ID: LIB3075-054-Q1-K1-E4
tcgcggacgcgtgggcaggtacctcttctcactctatatcaaactacagtacacgaataactgcgacgtggtactacttttctatgtttatgaattagactgagttgatataatattaatcttaatgttgtggactttaacatatgtactttaggacatataagaaatattaagctattgctgtaatggagacctgagaatacatctcaagtatcaggactcaggagtcaggagtgacatcgcagcatgggaaccactctttactcttaaggtggtagccaaaagaagaagaaaaaagtcattccga

SEQ ID NO: 64034 - DNA, 459 bp, Zea mays
  Clone ID: LIB3075-054-Q1-K1-E5
cggatgcgcgccacgcgtacgctaaaaggccactaaagaaagtgaggcggaagctataaggaaaatattgggcatcgactctgagaagaagaaagaagagaggaagcagaaggagcgaggagagaaggagcgagctagcagagcacaaaacatggcggcaaactcgatccgctgggtcatggggcccaccggaacagttatttcgattccacacgcagtaggcctccccagcatcttcgactccaagccacacagctatcctcctccacgggagaaatgcgctgggccatcgtgcacgaacgattacaagtacaggcactccaagctgaacctccccctctgcagcctcaagtgctacaaggccgtccaaggaaatgcttgatagggctcacggaacataatggtggggactggggagtttgtgctgactccattggcatgccatctatggctggaaat

SEQ ID NO: 64035 - DNA, 341 bp, Zea mays
  Clone ID: LIB3075-054-Q1-K1-E6
ccgtacaagagcctagaacgtccgcatgcacccacacgtacgcacatacaacagcaagagatgcgggaggctgttgaattacccttgactcatcatgagttgtgcaagcagattggtattgatgctgcaagaggggtgcttatgtatggtactaccggtactggcaagaccatgcttgccaaagcagatgcacatcataccactgctgcttttatcagggtcgaaagttcatagttcgtacaaaagtacttgggtgagggccctagaatggtgcatgacgagtgtcgattggccaaggacaatgccccagcaatcattttcattgatgaggttgatgctat

SEQ ID NO: 64036 - DNA, 309 bp, Zea mays
  Clone ID: LIB3075-054-Q1-K1-E7
ggtcatagctaagcaggtctgacaggatgtcgtggcagacatacgtctatgagcacctgatgtgcgagatcgagggccaccacctgacctccgctgccatagtctggcacgacggcgccgcttgggcccagagcaccgcattcccacagatgaagacagaggagatgaccaacatcatgaatgacttcgacgagcccgggttccttgccccgaccggcctcttcctcggccccaccaagtacatggtcatccaaggcgagcccggcgctgtcatccgcgggaagaagggatctggatgcataactttga

SEQ ID NO: 64037 - DNA, 422 bp, Zea mays
  unsure at all n locations
  Clone ID: LIB3075-054-Q1-K1-E9
cggacgcgtgggcagcaacgcgtgcttggtaggaacccgtgccgaccgactcttcctctgcgggacggtctcgagtttggtcgggagatgggtgacgggagctgctgcgtctgcaaggaggcgccgcccaagtacaagtgcccttcttgtcgcacgccctattgctctgtcacatgctttaaaaagcacaaagaggaatcttgtcaaaagatattgcatcaggaagaaattagcaagtcagcattgcaggaggaagttacactgcacaccacatgcactgcagaatctccaaatacagcgtgccctacaaaagctcttgaagttgaggacctaagctggcttgttgacaacaatagactaaggtccttagcggaactgaaagggatccaagacgctctcanggatcctgaactgcagagaat

SEQ ID NO: 64038 - DNA, 255 bp, Zea mays
  unsure at all n locations
  Clone ID: LIB3075-054-Q1-K1-F10
ctctcttgttggcttttggtttgtaggatatcgctcttgctgatctggctccaacccaccccatcaggctcgggcttgctctcaacttgtcagtgttctactacgagatcctcaacttccctgaccgtgcttgcaagcttgcaaagcaagcctttgatgaggcaatctccgagctagacagcctgagagaggagtcctacagtgacagcactctgatcatgcagctnctgcgtgacaactggacctatggacttt

SEQ ID NO: 64039 - DNA, 349 bp, Zea mays
  unsure at all n locations
  Clone ID: LIB3075-054-Q1-K1-F11
ggcatgtcgcccaaccacgtcacgccgtgggcgtggggtaacgacggcggcatcaagtgcgccatggagacgcagcccatcagcaacaaccggacggggcgactggacatcggcacggattggcgcctgcacggcgtggcgcgcggcgtgctggcgcgctacctccgccgcgtgccggtgcacttcgtcgacatcacggggctgtcggagctgcgcaaggacgcgcacacctncgtgcacacgctgcggcaggggaagctgctcacaccggagcagcaggccgaccccaagacctacgccgactgcatccactggtgcctnccgggactccccgacacctggaaccact

SEQ ID NO: 64040 - DNA, 350 bp, Zea mays
  Clone ID: LIB3075-054-Q1-K1-F12
ggcacaggtggcgatggctatggcgttggcgttcttggtgagcggcgcctggtgcggtcctcccaaggtcccccctggcaagaacatcacagccacctatggcaaggactggctggacgctaaagcgacatggtatggcaagccgacgggtgccggtcccgatgacaacggcggcggctgcgggtacaaggacgtgaacaagccccccttcaatagcatgggcgcgtgcggcaacatccccatcttcaaggatggtctgggttgtgggtcctgctttgagatcaagtgcgataagcctgtggagtgctccggcaagcccgtggtggtgcacattacggacatgaactatg

SEQ ID NO: 64041 - DNA, 392 bp, Zea mays
  Clone ID: LIB3075-054-Q1-K1-F2
cgcatgtgcttctgtaattttcgcaagaagcagtcaactgctccctgatatggcgctaggacattgtagtgaaccccgcacatttgtggagctcgacaacctgccagagcgctagatgtttcgttgagaagatagctcctctagtttggctttcctctcgttcagtcactgctttaaaccaaatttgataccactcgttgaagtcaacaactgggatgtggacatgtgaaaccaaaaaaaaaaaaaaataaaaaaaacaaacaaacaaaaaaataaaaataaataataaaaaacaataaaaaaaaaaaatataacaaaattttatattataaaataaaggtaaaaaccctaacaaaaaaaaaaaaggggggccttttaaaaggatccaattt

SEQ ID NO: 64042 - DNA, 187 bp, Zea mays
  Clone ID: LIB3075-054-Q1-K1-F3
cccacgcgtccggagataatatgtttgggaggtcttttatatctcttgtatgggatttaaaattcattaacgatgattagagttctttagaaaatgctgtatgtaaatctttagggattactgtgttatcgttatatttatttaacatgatcttttggtaaagacttgtgcatatggaactttggtt

SEQ ID NO: 64043 - DNA, 281 bp, Zea mays
  Clone ID: LIB3075-054-Q1-K1-F4
ggtaaatgaatgctcggttacaacgtgctaaatcctttgccaatgctaattctcaacagggagaacatcagtgaccggcatggtattcaggcataggcagtgatgttctccctgttgagaattagcattggtaaatgaatgctcggttacaacgtgctaaatcctttgcatctggccaaatttgtaaataagcactgggtgatgcccatcagtaaacacatgatgctactgctgttaaactaaatgtggcaaatttcataatgctaggtattgttctcggt

SEQ ID NO: 64044 - DNA, 399 bp, Zea mays
  Clone ID: LIB3075-054-Q1-K1-F5
gttcggtccccaggcggcgaggaccctcccgcgccgactcgtccccgcagatcggcgggcggggcagattcagattcgggtccgtggttcgctcggctagcctcgccggggtcccaccgcggcggtcggggagcatggtgggaggggggaggcggggaggagcggccgcggaggaggtgaagctcaacaccggcaacgtgttcgcggcgctcgagtccctcaagaagaagaagaagggcgacaagggcagggcggccgggccgtcctccaggaagaagcacggcgcgggggccgcgcagcagcagcaggagccgccgcagaaggatgtcttctgggctcccgcgccgctcaccaccaagtcctgggcagacgtcggcgacgacgacgaccacgactact

SEQ ID NO: 64045 - DNA, 362 bp, Zea mays
  Clone ID: LIB3075-054-Q1-K1-F6
acgagcaaacctgcagtcatgtgctccatcaccaccaaactcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggggctgtacggcaggatccagtgcaagggcaagtgcaccgagcagaaaggcatcacggc

SEQ ID NO: 64046 - DNA, 411 bp, Zea mays
  Clone ID: LIB3075-054-Q1-K1-F7
attcattacaaactgcttatggccaattcgattctggagacttctcaaaagtcggggaatacatcaacaaaattgtgctggctatatctccaggttgcttaaaggctaagcttctcaaggctaaagcattgctagcactgaaagactactgaagtgttatttcagagaccggattcattctaaaggaagatgaagacaacttggatgcactgctattacgtggtcgtgcctactattaccttgctgatcatgatgtggcctgcaggcactaccagaaagggcttcgtcttgatccagagcatttctaattgaagaaagcgtatttcggcttaaaaaatcttttgaagaagaccaatagtgcataatataatgcttgctagggtaagcttcctgtgtctgctgaggactaca

SEQ ID NO: 64047 - DNA, 289 bp, Zea mays
  Clone ID: LIB3075-017-Q1-K1-H11
ggcgttctatctcggcaacgccgttggttgtcttgccggccgcctagctgtctggggaatcaatcagcttttttgtgagtagctatgcgcggtagttggaaattggaataatgcagctatgcttttttttagggttgcgctcctagttctaataatgtactacgtatattggaagcagaataaatgttagattgtaaaaaaagaaaatccaaaaagaaatacgaagggaaaaattaaatatggacaattaaaatgttaaaatattctggggagaagccatttgaggttg

SEQ ID NO: 64048 - DNA, 383 bp, Zea mays
  unsure at all n locations
  Clone ID: LIB3075-017-Q1-K1-H12
gagcctggtgcaatgcaaaatggtggcagaggcttattcagaaaccttatgagaatggtgatgatagagggttgaaacttgttagagctattcttaggccactaatgctaaggaggaccaaggaaacaaaagacaagattggaaatcccatactggttccacctccagctcgtattgaagttgtagaatgcgaacaaactgaccatgaacgtgatttctatgaagcacttttcaggagatcaaaggtccaatttgacaaatttgtagcacaaggcagtgttctgaacaattacgctaatattctcgagctacttctccggctaagacaatgctgcgatcacccttttctggttatcagccgagctgaccctaanaagtatgct

SEQ ID NO: 64049 - DNA, 444 bp, Zea mays
  Clone ID: LIB3075-017-Q1-K1-H2
cccacgcgtccgcccacgcgtccgcccacgcgtccgcggacgcgtgggctttactcgtgggccaatttatcagttgcaggtactaacggtgccaggctaccagctttgactatgtgatttcattacttgttgtatttagaaaatctaatattatgaaggtcaactttcttattttactgaaagtctaaaacacactacctattaacatattagtgcctgctcaagtgcagaaaaatggtcaaaatcttccttgtgttgtcttagcaatgctttagcactccatatattctattataattaggcagggttggagaagaaaagcgcatcacagggaatatctatgacacttttatactcatgttcttgtgtttcttgtttgcagcctacacaaatctggagtttgaacacacgacaggtgatatgcttatcctttgtggatggact

SEQ ID NO: 64050 - DNA, 413 bp, Zea mays
  unsure at all n locations
  Clone ID: LIB3075-017-Q1-K1-H3
ctggcatcggcgagttccagtgctacgacaggttcatgctgagtagcttgaaggcggctgctgaggccgtgggcaagccggagtggggcaacgcgggtccgggcgactccggcagctacaaggactggccggaggacacgggcttcttccggcgcgagggcgggtggagcacggagtacggggagttcttcatgagctggtactcgcagatgctcctggagcacggcgagcgcatcctgtcggcggcgacgggcgtgttcacgggttcccccggcgtgaagatctcggtgaaggtggccgggatccactggcactacggcacccggtcccacgcggcggagctgacggcggggtactacaacaccccggtcgcacgacgggtacgcgcncatcgcgcgcatgctggcgcgcca

SEQ ID NO: 64051 - DNA, 455 bp, Zea mays
  Clone ID: LIB3075-017-Q1-K1-H4
gcgtcgttctctcttcctggtccaagtgatcttgccaagttacgagcagcgagcagagatcagatcatccatcggcaatgtcgaacatcgggcagtccttccaggccggcaaggctgaggcccagggcgagtaccaggcggagcacgcggcgcagtgcgtcaaggacaccgccgcagccgcggccgacagtgcgcagctgcagcagcaccgtcccaccggcaccgttgagcaggtggcgcagacgggccagggcgtggcggcaggcgtcaaggacacggtggcgggcgcggcggttggcgtcacgaacacggtggcgggcgtggcggcgggcgtcacgaacacggtcacgggcgccgtggcgggcgtcacgaacacggtgaccggcgcggccgctggtgtcaaggacaccgtgaccggctgccactgatcgacgacccaagaatgcctcatgcat

SEQ ID NO: 64052 - DNA, 404 bp, Zea mays
  Clone ID: LIB3075-017-Q1-K1-H5
atcattttagatgcacttagagaaacaggacaaaggggaatcattagccgtggttggggagctcttggaagtttttcagaagttccagttgatgtcttcatcttggaggattgccctcacgattggctcttccctcggtgtgctgcagtggtgcatcatggtggagcaggtactacagcagcagggctgatagctgggtgtcctactactgtagtgccgttttttggagaccagttcttctggggcgagagagttcatgcacgaggagtgggtcctgcacctatatctatcgcagaacttactgtagaagcactatcagatgcaataatattcatgcttgatccagaggtaaaatcacgaacaatggaactggcgatagcaataagcaatgaggatggtgtggc

SEQ ID NO: 64053 - DNA, 449 bp, Zea mays
  Clone ID: LIB3075-017-Q1-K1-H6
cataaatcatagagggtagaaggttgcttatggttcattagtgagttgacttattgtttgttttgctagatggttttcaccgtaatcaataatatggtgttagagcattctaaatttcaagaacatagtaattgtagaagctaaaaaaatagaagtaactaggagctaagttaaaattattgctctctagacctgcatgtccaattttaattatgcagtgaagtaaattatgttttctgtaaaagtgttatatagaaaagttatagctaactcctttatcttgcttgtgctaaaatttcatgaccataggtctgtagtttaaaagttatgattttctcaagtccagtcttggaatctgtttagattttgtacatatttcgaaactgactttgtttgttcaatttaaacatagaatcagttcttataaattataagaagttgtatgtaac

SEQ ID NO: 64054 - DNA, 259 bp, Zea mays
  Clone ID: LIB3075-017-Q1-K1-H7
gagccttgttccttttagcgctcttctgtgtcgtgcatggtgagaaggcaaagtcaaaggacaacgatgcaaaagcgtccgggcccggtgggtccttcgacatcaccaagttgggcgcctccggcaatggcaagacggatagcacgaaggctgtgcatgaggcgtgggcatcagcgtgcggcggcaccgggaagcagacgatcctcatccccaagggcgacttcctcgtcggaccactcaacttcacaggcccatgcaa

SEQ ID NO: 64055 - DNA, 431 bp, Zea mays
  unsure at all n locations
  Clone ID: LIB3075-017-Q1-K1-H8
cccacgcgtccggtgatttgaaataattgggaataaatagttcgtgaatccctgaagcgtgcatatatatattcctgccaagataaaggtaatggagtcgtcacgcaggttccagccggccgtcatcctgcttctcctgctcattgtgtccaccgatatggcacaggcaagggaatgcgagaagtacagtgagcgatttgttggggcatgcatgatcgcagacaactgcgccaatgtgtgccgcggtgagggcttcttggccggcaagtgcagcaccttccgncgtcgctgcatctgcactaggcagtgctaaacaagatcgctcgatcgctcgccatgcatcgacaacctattcttaataacgttcattatctcgttcttaattatgacgaatgtcatgtatgttcttgtgactgtcatgtatattctga

SEQ ID NO: 64056 - DNA, 320 bp, Zea mays
  Clone ID: LIB3075-017-Q1-K1-H9
tgcgtccaaattctacgaggggtttgctttgtcatcaccggcaagagaaaccttggcgggcaggcaccactcgtgtggagcaagaactactgcaccaagaaatacgactgctagcaccttcccaactcgctggggatggacttcgtgaacaacgatgatgcttccgttgtcacgctgctcaactacaatttcttgcacatgaacatgtaccgctacaaggacatactgatcaatgacgtgaccttaacacgaccgcaagacagcccgaacacagataacatccacatagccgactcatgacggatcacgatcactaacac

SEQ ID NO: 64057 - DNA, 325 bp, Zea mays
  Clone ID: LIB3075-018-Q1-K1-A1
cgcgagcccttttttttttttttttctcaagaatatcagcagcaatgtaaccatatacgtagaagcactatatatggttcccacacgcatatattattattactgttcacatcgccgcagttatatataaaaacattactatctactagtgctttattccacataatactagtgctagtatcgcatcatgccctaacttttctttgccaaacattattgtttgcctcctggtcgtggtcctgggttggctccttgatgcgcatccatctactagtatactggaaaactggccactacaagggccgatgctgctcatggaagtata

SEQ ID NO: 64058 - DNA, 350 bp, Zea mays
  Clone ID: LIB3075-018-Q1-K1-A10
cgctcaagtaccccctctgcatccgcttcgctgtcaagtccggtggctaccgcatcggcgacgacgtcatccccgccaatttcaaggccggcaccacctacaagaccaccctcagcatctgattagcctcttatgacgaataatatttcaagagagctcatccggcccatgtgccagcgagctaatatttaattcttcttctttggatatattgaggcaccacacgagccaagaaaaaagttatgctacatgtcccgtctcacgccttgatgcgttaggttgatatgcatgattacatagattaaactacacttttatttaagattttttggggagacatatattgatct

SEQ ID NO: 64059 - DNA, 287 bp, Zea mays
  Clone ID: LIB3075-018-Q1-K1-A11
cctacgcgtctgatcaaggcctccgctaggagcacgatgacggggtccgagatcacactcgatgtgatcgtggactgtgcgagcgtgcggtttcatacaggattggaacggacaggcttgacgcgcgggagcatatctagtcgtgcaggccggcgcgaggctacgagcatcatggagtttctgtggaccatgataacgtgatgcatcgtataagaggacgaggacaggacgtcctgacaggacctgcggatcccatgattctcggaagaggcaccctgaatcgaagc

SEQ ID NO: 64060 - DNA, 267 bp, Zea mays
  Clone ID: LIB3075-018-Q1-K1-A12
ctccaagaagcggttccgcaaggcgcagtgcgccatcgtcgagcgcctcaccaactcgctcatgatgcacgggcgcaacaacggcaagaaggtcatggccgtccgcatcatgaagcacaccctggagatcatccacctgctcactgacgccaatcccatccaggtggtcgtggacgccattatcaacagtggaccacgtgaggatgccacccgtattggttcagctggtgttgtgagaaagcaagctgtggatatctcacccctgag

SEQ ID NO: 64061 - DNA, 329 bp, Zea mays
  unsure at all n locations
  Clone ID: LIB3075-018-Q1-K1-A2
gagcgacagagagagagagagagaccgacgcgccggcagatcccaagttcaccggagagggggaagagggcgaccgaaggcggcgatgggtttcatcatggacttcgcggagaatctgatcctccgtctgatggaggacccggacaagcgcgaccaggttcggcgggagcatgtctacaagatgaaggagcggtgcgagcgcactaaggcggcgtggagcctgcctctgcgcccctacggcttctggaccttcgaccgcttcaactcgcagctctcctgggatccccagatcagccaggccgncggccgtcgggacccctacgacgacc

SEQ ID NO: 64062 - DNA, 339 bp, Zea mays
  Clone ID: LIB3075-018-Q1-K1-A3
aaaaaaaaaaaaaaaaaaaaaaaaaaaaataatttaaaaaaaaaaaaaaaaaaaaaaaaaggagggaaaaaaaaaaaaaaaaaaataaaaaaaaaaaaaaaaaaaataaaaaaaaaaaaaaaaaattaaaaaaaaaaagaagacccttataaacactaccatttacattgagagtatttctacacaatcaattttttatacggacgcactatttaaatatgtagccctaatataatcaactactcattatgaaaaatccaccatttaaactaataattttgctggaaaccttacaacttttaaactttcggtcgtttttaaaaattctgcgaacatata

SEQ ID NO: 64063 - DNA, 386 bp, Zea mays
  Clone ID: LIB3075-018-Q1-K1-A4
gagccatacttcgccggtgtatcagagggcatttgccaccgatgaaccctccgcctccgccagaggcatcaccgtcgaaaccaccatctacatcgccagcagcatcaccatcggaatcaccaccagcagcatcgccaccagaatcgccgtcgacaccaccaccagagtccgtcgactacaccgccgacaccagcagcagcaccaccgaaatcaccgtctgatccaccaccagctacgccaccaaaatcatcatctgatccaccgtcgacaccagcagctacaccaccggcgactccatccccatcatcttaatcacgaaggatatttcaaaagcagtagtagtttagtcaaattagatatgcgttttaggattctagttgatatgc

SEQ ID NO: 64064 - DNA, 415 bp, Zea mays
  Clone ID: LIB3075-017-Q1-K1-H10
gaaaacagccgagcgatctcctcttcctctccctctccgatccattctccagcgcagcgaagtaaacatgtctgaccgggcaaagatgtcgtggcaggcgtacgtggacgagcacctgatgtgcgagatcgagggccaccacctcgcggcggcggccatcgtcggccacgacggtgccgcctgggcgcagagcacggcgttccccgagttcaagaccgaggacatggccaacatcatgaaggacttcgacgagccagggcacctcgcgccgacaggcctgttcctcggacctaccaagtacatggtcatccaaggcgagcctggtgccgtcatccgtggcaagaagggatcaggaggcatcaccgtgaagaagacagggcaggcactcgtcgttggcatctacgacgagccgatg

SEQ ID NO: 64065 - DNA, 406 bp, Zea mays
  Clone ID: LIB3075-017-Q1-K1-F6
gttgactagacttttgatcacaatgcaacaaagaataggggcagcaaaaactgatatggaggatctcatagcacgactaaatcaggaagcagctgttaaagaatatcttactacaaaggttaaggatttggaggttgaattggaagccgcaaagcaaaagggtagagagacactgcaacaagctatcctgactgaaagagagaggattacccagatgcagtgggatatggatgagctccgtaggaagtattctgagatggagtcaaacctgaaggctgaacaaaatgagaaaactcgtgcagagtcagagaaaacaaccgctagtgataaaaatgaaacattacttgaagaattagaaatcaaacgaaaagaagtcgagactttgaacatcatcttgtagaagctg

SEQ ID NO: 64066 - DNA, 371 bp, Zea mays
  Clone ID: LIB3075-017-Q1-K1-F7
ccgagacgccaggatgacggcgcagactgcggaggagctcgccacccagatcgagcagcagaagctcgaggagcagaagaccgaggcagaggaggttgtggtggaggatgaggaggacgacgacgatgaggacgatgaggatgatgatgaacttgacggacaagaaggggatgccagcggcaagtcaaagcaaagcaggagtgagaagaagagccgcaaagccatgctgaagcttggcatgaagcccatcactggtgtcagccgtgtcactgtgaagaaaagcaagaatatactgtttgtcatctcgaagccagatgtgttcaagagcccgaactcagacacatacgtcatattcggcgaagccaagatcg

SEQ ID NO: 64067 - DNA, 379 bp, Zea mays
  Clone ID: LIB3075-017-Q1-K1-F8
gggagatggagagggtgaacgtgctccgaggcatcctagacaacaacgtgttcgccatggtgctcggcagcaccgtggtgttccagttcgtgatcgtccagtgcctgggcagcttcgccaacacgacccctctcagcgtcgcgcagtggggcgcctgcgtcgccatcgggttcgtcggcatgcccgtcgccgtggcggtgaagatggtgccggtggagtaggcgggcctctcgatctctctcggagttgagaaactggaggcaggcaggcgggcagtagttgttggcttgaaatgtctataacagcagtattcttttttttttttgtggtaagaacagaacagaacagaacaggctttatccatctgtgattctactac

SEQ ID NO: 64068 - DNA, 308 bp, Zea mays
  Clone ID: LIB3075-017-Q1-K1-F9
aaaaaaaaaaaaaaaaaaaaaaatttttttaaaacatactaaaaaacataaaagcaggggataaatacaaaaaaaataccgatataacgaaaacacaaatcaatacgactactgcataaaaaaaaaactgatgtgaggacacgcacattattacaaatcgggggcggctgttttaaaagaatacagttttttttccattagctgaaactcaaaaattctttttttagcacgacaaacttatactgttttcgccgacttttctaatcacaggtttttaaaaactgtttatttccctaaatttttaccgt

SEQ ID NO: 64069 - DNA, 375 bp, Zea mays
  Clone ID: LIB3075-017-Q1-K1-G1
ctccagatttgggacacggctggccaagaatcattcagatctattactagatcatactacagaggtgctgctggtgcccttttggtttatgatattactaggagggagaccttcaaccatctcgcaagttggttagaagatgcaaggcagcatgcaaatgctaacatgactgtgatgctgattggaaacaagtgtgatctttctcatagacgtgctgtcagctatgaggaaggtgaacagtttgccaaggagcatggtctggtctttatggaggcatctgctaaaactgcacaaaacgttgaggaggcattcattaagaccgctggtacaatatacaagaaaatccaagatggcatatttgatgtatcaaatgag

SEQ ID NO: 64070 - DNA, 291 bp, Zea mays
  unsure at all n locations
  Clone ID: LIB3075-017-Q1-K1-G10
cggacgcgtgggcgagtagcactttcatatcctgggttcgattcctatcgaaagcgaattttcaggcttggttaaaaaaatcccctcgttgtgccccatccgctcttgggttgcgatgttctgtgcgccaccgagagggcggtcattcctccccggccaagtttttctataaagtaacangaaaaaaaaaaaattttattaaaaaattaacaaagaaaaaaaaggaaaagaactaaatgttgttaaagaaataaaaccaacttttacaaaagttcaaaacttttacttatg

SEQ ID NO: 64071 - DNA, 217 bp, Zea mays
  Clone ID: LIB3075-017-Q1-K1-G12
atgggttatccatgagaatcttgccaaaaaatttggcataaccatcgagccccctgatagtgtaatgaagaaagggggaaaaagacaagagaatgaaactgttgaaaatggaaggaaaaagctcaagacagatgaagaacatgcttatgtgctgattaagtatccaataaatgatctgctagtaaggcccaatgcagatgatccgtctttatttaaa

SEQ ID NO: 64072 - DNA, 424 bp, Zea mays
  Clone ID: LIB3075-017-Q1-K1-G2
cacttgttgaagaagacttactctggcgctgttgtgacaatttttgggctacttataatgattacactgtttgtgcatgagctgcagttttatcttaccacctacacggtgcatcagatgtctgtagatctgaaacgaggagaaactctgccaatccatatcaatatgtcatttccttctttgccatgtgaagtattgagtgtggatgcaattgacatgtctgggaaacatgaagttgatttgcatacaaatatttggaagcttcgcttggataagtatggccatatcatcggtacagagtacttgtctgacctagttgaaaaggggcatgggacacatcatgatcatgaccatgatcatgaccatcacgatgaacaaaagaagcatgaacaaaccttcaacgaagaaagcagaaaaatgatca

SEQ ID NO: 64073 - DNA, 356 bp, Zea mays
  Clone ID: LIB3075-017-Q1-K1-G3
gtgaaaatggaagtcgaggacctgacggccggactggccagcggcaggatatgtgctgtggagaacatcgcccagctggtggctccggaggcagaaggcccggccgatgccacggccacggccacgctggctgcttaacggaccattgtgccattgttgctgtgagagagatgtgcgtcagccaacatgtgtgctattgctttggcttatttgtgttcagaatccacttaaactcggtcgaagtgagctttccgttcggcaacgtctgtactcttacgaatctcgatcgtgtatgtctttaagtattgtgttgtgtttcaaagataaaaaaaggtgacctttgtgtatgatttttt

SEQ ID NO: 64074 - DNA, 437 bp, Zea mays
  unsure at all n locations
  Clone ID: LIB3075-017-Q1-K1-G4
cggacgcgtggggccacggcgatgctagctacactattcgcggttggtttgtgcaccaccccgctcaccttccaggtcggtaagggatccaagcctggccacctgatcctcaccccgaacgttgccaccatatccgacgtggagatcaaagagcatggtggcgatgacttctcctttacgctgaaggagggcccgaccggcacctggacactctacaccaaggccccgctcaagtaccccctttgcatccgctttgctgtcaagtctggtggctaccgcatcgtcgacgacgtcatccccggcgatttcaaggctggcaccacttataagacgacactcagcatctaatcagcatctgaagatgaactatatttcaaaagagctcatctggcgcacgtgttagcaagacaattnttttctttggatattttatggca

SEQ ID NO: 64075 - DNA, 397 bp, Zea mays
  Clone ID: LIB3075-017-Q1-K1-G5
cgacgctaaagtcaaacatgtcaaaagaagagtataaaaatatcgttgtccaagctaaagaacacatcttggctggtgacatttttcaagcagttctaagccagcgcttggagagacggacgttcgcggacccctttgagatctaccgtgcgttgcgcatcgtgaatcctagcccatatatggcctatctacaggcacgaggctgtattctcgtggcatcaagccctgaaattcttacgcgggtacaaaagaggacggtagtcaaccgaccgcttgctggaaccataagaagaggcaaaacaaaggcagaagacaaagttttagaacaattgcttctgagtgatgaaaagcaacgtgctgaacatattatgcttgtagaccttgggcgcaatgatgt

SEQ ID NO: 64076 - DNA, 418 bp, Zea mays
  Clone ID: LIB3075-017-Q1-K1-G6
cgtcgtcgtctcactcaccccgccttcacgcctccctcaccaaataaggtcccgccctgttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctactgcgacacctgccgcgccgggttcgtgaccaatgtcaccgagtacatcgcgggcgccaaggtgaggctggagtgcaagcacttcggcaccggcaagctcgagcgctccatcgacggggtgaccgacgcgaacggcacgtacacgatcgagctcaaggacagccacgaggaggacatctgcgaggtggtcttggtggagagcccgc

SEQ ID NO: 64077 - DNA, 372 bp, Zea mays
  Clone ID: LIB3075-017-Q1-K1-G7
ctcacgtgtcacctcttcacgaggaacttatccccacttcaattcatacccctggatcaccctattcttgtgatgtcccgatggttgaagaggccatagacgccatctgcaagagccacggaacaccaccagatgagaagattgccatcaccaaagctattataaatgtatcgaatggatccaagcccccactctttgctggcatcatagcacttgtgatgagcatcgcaacgatggtccgtctgacccgcagcatgatgcctgggaaggttctcggtgctgccataggtggagctaccctctcagaaggtaaatcaaaagtacaagagcgccagcggtccaagctatcagaagaggctgtggaagaagctg

SEQ ID NO: 64078 - DNA, 432 bp, Zea mays
  unsure at all n locations
  Clone ID: LIB3075-017-Q1-K1-G8
cggacgcgtgggtgcgggatcaagaacgtgaacctgccaccctacagcggcatgacggcgtgcggcaacgtccccatcttcaaggacggcaagggctgcggctcatgctacgaggtgagatgcaaggaaaaacctgagtgctcgggcaatccagtcacggtgtacatcactgacatgaactacgagcctatcgctccctaccacttcgacttgagcggcaaggccttcggctccctggcaaagcccgggctcaacgacaagattcgccactgcggcatcatggacgtcgagttcagaagggtgcgatgcaagtaccccgccgggcagaagatcgtgttccacatcgagaaagggctgcaccncaactacctggccgtgctggtgaagtatgtggcggacgacngcgacatcgtgctgatggaaaatcaggac

SEQ ID NO: 64079 - DNA, 336 bp, Zea mays
  Clone ID: LIB3075-017-Q1-K1-G9
ggcatccaccgacgagtggcgttccctgccgctgatgggcctgctgagggaccggcggctgctgatgcctccggtgctgctacccttggaagcggagctgccatcgctggtgtcgccgctgctgtcgctaccatgatcttctactgagttcaccagctgggaccgtgtcgtcaagggtgggcacgtacttggctgtgcggtaattgctcgtctggtcgggagggaccaataacgcaagtgttgctttgctttgctcacttcgtttgctcttgtaactttatggcgtcaaccgttatataactgaaacgatttgattaattgatactaatgctctct

SEQ ID NO: 64080 - DNA, 395 bp, Zea mays
  unsure at all n locations
  Clone ID: LIB3075-017-Q1-K1-H1
gattccgctctagcgaacgggacgacctttgtgcttggaagggtcatcctaaacatgagtccccagcggaacaactgcttcaagcgctttgttatcaacaacctgtacaggttcctgcagaagaacttcaggtccaacatttccagtctgaagatagctcctagcaaaaccttgcacgttggaatgcaatatgagatttgagtagaggagccttgcaagatatgatggacgtgagattctagaacatgcagacgtgggtagtttagaattagatgttttttgttttgtttttgaaactagcgatctgtttgtaattaggtcagcctcgccatacaaagctaccatggtcataactttggaactatntatttgagtgtggtctttgttgcacaatt

SEQ ID NO: 64081 - DNA, 407 bp, Zea mays
  Clone ID: LIB3075-017-Q1-K1-F4
atttgccaccctcgtctcaccctccctccctcacacaaataataaggaaaggtcccgccctttgtcctccgacatccacaaggggggaggggaaaacacgtacattcacccggcggcaataatggcctcggttccggctccggcgacgacgaccgccgccgtcatcctatgcctatgcgtcgtcctctcctgtgccgcggctgacgacccgaaccttcccgactacgtcatccagggccgcgtgtactgcgacacctgccgcgccgggttcgtgaccaacgtcaccgagtacatcgcgggcgccaaggtgaggctggagtgcaagcacttcggcaccggcaagctcgagcgcgccatcgacggggtcaccgacgcgaccggcacctacacgatcgagctcaaggaca

SEQ ID NO: 64082 - DNA, 425 bp, Zea mays
  Clone ID: LIB3075-017-Q1-K1-E11
gcgccgggtcaggggaggggcggtggatcagatcagcagccgcacgagcattgagcgagatggcttctatgtaggatgcaactggacatcgccgtccactcgtctagctattgatgctgaagtcccgatgcttcatgccaccgcgatggtggctggttgatctccgatatcaagaggagggaagaggcactgaagaatggtgcagatccacatttgtttttgcataattgctgccttagctccaccaattgtatttcatgggaaatcattaacgtaagtttgccactccttttatctaaagtaatcaaagtcattagttattatgggcttgggtaatgtgagtaagcaccattgcatagatagccagtgatgttggctgctggaaaaggagaaatcaatgaattatagattgggatcacagaact

SEQ ID NO: 64083 - DNA, 444 bp, Zea mays
  Clone ID: LIB3075-017-Q1-K1-E12
gtctccggcagcagtggcggcagtgggcgcccgtcccccgcgcagaggctccaccactcgggaggcgccgagaacagcaggtcgtccccgcgctcccccgtggcccggaacgcggccgggaggggaggctccgcctcgcgggacaacacgacgttccgcagcctcgagcgcctcaccatcaccaccagcaggaggaagtgagctgccgaggaccacgccgacgaattctgagagtggaaggcggttactaggccgaggaacttttgcgggatccttgctctctgcagctgaagcaaatcggcaaatagatgatggatggatggttacaaggctgccatgaaaatgcaccctttccccaaaccccagcgtatagtataacgctctccccaaactccaagagggaagacaactccaaagtacaatgcaatcttgattctgtcgatc

SEQ ID NO: 64084 - DNA, 444 bp, Zea mays
  unsure at all n locations
  Clone ID: LIB3075-017-Q1-K1-E2
ccacaatgtatataaagtcgttgaagcaagaaaaggaagcatgcttctggcactagccatgctctttccttttggtttgctcttggctggagttcttgtctggtcctacctttctccttcagatataatgagaacccaaccacatttgctaattattggaactggttttgcatttggatttcttgtgggaagaatgattctggctcacttgtgtgatgaacccaagggtttgaaaacagggatgtgcatgtcccttgcgtattttccatttgcaattgcaaacgcgttgactgcccggcttgatgatggaaatccactcgttgatgagcagctagtgctcctgatgtactgnctatttacagtggctctgtacatgcattttgctacattcagtattcatgagatcaccaatgcactcgggatccactgcttcangatcactag

SEQ ID NO: 64085 - DNA, 360 bp, Zea mays
  Clone ID: LIB3075-017-Q1-K1-E3
aggggatggagccttggagcccgaagaaaaagatgcctggcgatgtgccggagggagccgtgctgatccgggaacacacagcgacgaccaacctgttcagctgcctctggttcaacgaggtgaacctcttcaccccacgcgaccagatcagcttcggctacgtggcgcgcaggctcggcgacgctctcgagctcttcatgttccccaactgcgagtacaactcgctgttcgtcctgcacaggcacacgagggagcactcgtctaaggtcgagtgggccaaaacggtcgacgagatcgtggagaaggggctgagggagagtagaggagggttggggctgtggactccgtaccctgcggacc

SEQ ID NO: 64086 - DNA, 379 bp, Zea mays
  Clone ID: LIB3075-017-Q1-K1-E5
cggacgcgtgggtttttttttttttttttttaacctcgagcagtttcactgacacaaagtttgcagtctcagatacattatatagctaagtaaagatagccatcaaactgctaaaagccagaagaggcgattgtcaacggtataaatagagcatctaaatgcaagtcaaaaggcgtttctcaatgttttggtgagtttgagcaccgtgcttgcaaacagaaattattgaatggcatggccatatcccttctcaaaactatagaaccaaaattggacatagctggccagtatttagttgtcagccacttcaattagggtttgctcgtagtcagcaggggcctcaaatccatggaggttcatcacagttgcggctacattg

SEQ ID NO: 64087 - DNA, 365 bp, Zea mays
  Clone ID: LIB3075-017-Q1-K1-E6
accggcacctcctccaccccggaggccgttagcctgctctgcactgccaaggtcgcatgcaccggcgtcaccatggatgacgtcaacgtcgagtatagcggcaccaacaacaagaccatggctatatgcacgaacgccaagggcagcaccaagggttgcctcaaggagcttgcatgcttctagaccctgcgtcgactgacccatctctctagtgataattcttctctcgtccttgcattgcccattacatgctatccattggtaacgcacaacagtaaaatgacagacatgcgacagctatattatgttcgacggtgtaacaccctgaatttgagggtataaaattttttctctaaataccaacc

SEQ ID NO: 64088 - DNA, 386 bp, Zea mays
  Clone ID: LIB3075-017-Q1-K1-E7
gaaagagagagagagagagagatggatgaggagtacgacgtgatcgtgttggggacggggctcaaggagtgcatcatcagcggcctcctctccgtcgatggcctcaaggtccttcacatggacaggaatgactactacggaggagaatcttcgtccctgaatctaaccaagctctggaacaggttcaagggcaacgacagccctcccgagcacctgggcgtcagcaaagagtacaacgtcgacatggtgcccaagttcatgatggcaaacggcgcgctggtccgcgtcctgatccgcaccagcgtgaccaagtatctcaacttcaaggctgttgacgggagctttgtgtacaacaatggcaagatccacaaagtcccggcaaccga

SEQ ID NO: 64089 - DNA, 445 bp, Zea mays
  Clone ID: LIB3075-017-Q1-K1-E8
aataagatggcgtgtatagacaatgcaatgagagccttgttccttttagcgctcttctgtgtcgtgcatggtgagaaggcaaagtcaaaggacaacgatgcaaaagcgtccgggcccggtgggtccttcgacatcaccaagttgggcgcctacggcaatggcaagacggatagcacgaaggctgtgcaggaggcgtgggcatcagcgtgcggcggcaccgggaagcagacgatcctcatccccaagggcgacttcctcgtcggaccactcaacttcacaggcccatgcaagggcgacgtgaccatccaggtgaatggcaatctgctggcgaccacggacctaagccagtacaaggatcatggtaattggatcgagattctacgcgtggacaaccttgtcatcaccggcaagggaaagctcgacgggcaggggccagccgtgtgga

SEQ ID NO: 64090 - DNA, 276 bp, Zea mays
  Clone ID: LIB3075-017-Q1-K1-E9
gcctagttcatcaactagtacaagtttgaaccatggtttgctggttggttcctttcctgataggggtatagggagggcctcagcagttgagcataaatgtaacctggcaggcacgtcttatggggaaagaactgttgaacacacagaaaatggtcatgtgttatcaaccaggtctgtcaaaggaaatgagggaactaaaaacagaaaagcggacaatgaaatgatctggcaagctgtgcttgaaaatatccaatcaaatacattgagaaaaatgat

SEQ ID NO: 64091 - DNA, 421 bp, Zea mays
  Clone ID: LIB3075-017-Q1-K1-F1
cagaatccacaatttttttgtgatttccagctagacgatgatgggaaaatagttagtattttttggtcacacgcaagcatgcagggggaatacgcagattatggtgatgctgtgacatttgatacaacacacaagacaaatatatatgataaaccactgggcatgtttgttggagctaacagccatctgcagtgtacaatgtttggatttgttttgttgggagatgaaacagtacagacttttgaatgggctttcaattcattcaaaacatgtatgggaggcgagggtccaagagttatgcttacagatcaagatcctgcaatgccaattgctctgagaactgtatttccaaaaacagttcacagactgtgcttatggcatgtacagaacagatttatgccattccttgatgagatatatg

SEQ ID NO: 64092 - DNA, 430 bp, Zea mays
  unsure at all n locations
  Clone ID: LIB3075-017-Q1-K1-F10
cagaacttgacttatatactgaacacccatcatcactacgatcatactggtggaaacttggaattgaaggcaaaatatggtgcaaaggtaattggttctgagaaggataaggacagaatacctggcattgacatcactcttaaggagggtgacacatggatgttcgctggccatcaagttcttgtactggaaactcctgggcatacaacaggtcatgtgtgctattatttcgctggttctggagctatatttacgggtgacaccttgttcaatctatcatgcggaaagctttttgaagggactccacagcagatgtattcctcacttcagaaaattacagctctacctgatgatacaaaagtatactgtgggcatgaatataccttgagtaatgcanagtttgccttgagtgtagaaccgggaaataaag

SEQ ID NO: 64093 - DNA, 401 bp, Zea mays
  Clone ID: LIB3075-017-Q1-K1-F11
ccgaccccgaccccgaccccgattcccgtcggtgcttcgccaccccgatccccacgcgcgcgatggcggagccggctccggctcccccggtgaccgcgccgctggtggggctgctgtacgacgagcggatgtgcgcgcacgcgacgcccaacggggaggaacacccggagaaccccgagcggctgcgctccatctggcgcaagctcaacgccgcgggcgtcgcgtccaggtgtgtggcccttaaggcaaaggaagctgaggacaagtatatagcttctgttcacagcaagaggcatataaagctgatgaaggaaattagctcaacaatatatgatgccagcaggaacaagattgctaggaaattcaattccatttacttgaataagggttcctcggaatct

SEQ ID NO: 64094 - DNA, 317 bp, Zea mays
  Clone ID: LIB3075-017-Q1-K1-F12
gcatcatcttctccgatccatcaacaatcgccgagagcgatcgagagataaataaagatgaagaaaggggcatcatcgtcagccgttctcttcgtgctagccctgacgctagtttgtgccccgctgatagcagaagcaaagaagaagagagtcgccgccgccgccgccgaggagaagaaagtgcaggacaacttctgctcgacgctgtgcgagggcaggaaggggatggacctggtggtgtgcaaggagtcctgcgacctctcacaacgctccaacctggtgctgtacggccggatccagtgcaagggcaagtgcac

SEQ ID NO: 64095 - DNA, 433 bp, Zea mays
  unsure at all n locations
  Clone ID: LIB3075-017-Q1-K1-F2
tttcacggcaattgcagctatcatattcggatcgatattttggaatgttgggatgaaacgagacacaacagaagatttgatgcttgtcatgggatctctttacgcggcatgcctgtttcttggtgtaaataacgcctcatccgtgcagcctgtagtatcaactgagaggactgtctactaccgggaacgtgctgctaaaatgtactcatcgttcccatatgctgcagcacaggaaagctgcttctgtatcttcttttcatgttccttactttcacctacttcacgttctacgggatggtggcggtaggcttgaccccaacacaacaagttgcagcagtagtgtcatctgctttttactccttgtggaatcttctctccgggttcctcatnccccagtctaggatccctggcttgtggatctggttctattaca

SEQ ID NO: 64096 - DNA, 442 bp, Zea mays
  unsure at all n locations
  Clone ID: LIB3075-017-Q1-K1-F3
gaaataattgggaataaatagttcgtgaatccctgaagcgtgcatatatatattcctgccaagataaaggtaatggagtcgtcacgcaggttccagccggccgtcatcctgcttctcctgctcattgtgtccaccgatatggcacaggcaagggaatgcgagaagtacagtgagcgatttgttggggcatgcatgatcgcagacaactgcgccaatgtgtgccgcggtgagggcttcttggccggcaggtgcagcaccttccgccgccgctgcatctgcactaggcagtgctaaacaagatcgctcgatcgctcgccatgcatcgacaacctattcttaataacgttcattatctncgtcttatttatgacgaatgtcatgtatgttctggtgactgtcatgtatattctgatgactgtcatgtatcttggtcatgtatgct

SEQ ID NO: 64097 - DNA, 435 bp, Zea mays
  Clone ID: LIB3075-017-Q1-K1-E10
aaaggtcgaagcgtcgtctctcttggcacggagcctagtgcccggcctcgtgagatccgaaattcagaagcgaggatggcgacgaccgcgactaggcggtggtggaggcggcacgaaggcggcgacgatgacccagacgacctcgtccccatggacacccaagagcaagaagagctggtccggtctctggaggctaagcaggcgcagcaaggccgccgttggaggcgcgtcttcgcggggttcctcctatgttacgcggccttccttgactactccagtttccatcatgcttggtctccctgagagctgcggtaccatgcttacttcatggaagatttgcctgcaccaatggtcataattgcaggattactacagaattgacgcccatcaaagaagtggatgtggaattcttgctatgtgggcatttggtagcca

SEQ ID NO: 64098 - DNA, 356 bp, Zea mays
  Clone ID: LIB3075-054-Q1-K1-C2
aatgctgcaaggcagctacagccctgcgtttcccctgaagcatcagcagaaggacatgaggttagcgcttgctctgggagatgagaacgccgtcgccatgcccgtctcagcagctgccaatgaggcgttcaagaaggcgaggagcctggggctgggagaccaggatttttcggcggtctatgaggttgtgaagggcgcgggtggttctggatctggccagccgtgatagaaggaccatttgtgagttgtgactgtgttagcccatttccatgccgatttgcaacatagcgacgtacgagtacgtgtgtattcaagatttggaaccaggccatacgttgcaaaagataatattaatc

SEQ ID NO: 64099 - DNA, 429 bp, Zea mays
  Clone ID: LIB3075-054-Q1-K1-C3
cggactcgtgggcgaagccccacacacacaaaagcaaaaagcatcatcacaataatggcccgcgcgtgtgtgttcctcgtggtgctactgctggccgccgtcgcggtggtgccgattgcgggggctgcgcgtgtggatgtcgtggagggcacgtccatagcgtccgccgacgcgcctgacgcggcggctgacgcgcccgctcccggtcccgactacgcctcatccacagactcaccgtctgaggcgccctacatgcagcagctcatacgactagccgcgcacaacgcagttattgtcatgatctatctatcaaataaaaagatcatatgactcggttgattctatggaataactaatagtatatatgctgcgcccggatgatatataaagatatgcatcaaacgcgtgagggaaacgcatggaatgtgc

SEQ ID NO: 64100 - DNA, 307 bp, Zea mays
  Clone ID: LIB3075-054-Q1-K1-C6
cggatgcgacccacgcgtacgcttggagatcgtgacgtagaacctagacaggcactcgcaagctgacagaaccaagctcggttggaccgcgtaaacagcaccagcagcgtacagatccatagcagaaccatacaccagttacctgacagccacactttatactacacaccgatgttgatgaccgggtcaggaaccaggaggtgctggacatctgctgtcgctccatctacatcaggctggacacgtacaacaatctgaacagggacatgacgcagaacgcgttaaggctcgccggcttcaaggagct

SEQ ID NO: 64101 - DNA, 454 bp, Zea mays
  Clone ID: LIB3075-054-Q1-K1-C7
ggaggcctctctctccctctccccagccacccccgtagcgagagggagggcggaagaggatgagcgcgtccaggttcataaagtgcgtcacggtcggggacggcgccgtcggcaagacctgcatgctcatctcctacacctccaacaccttccccaccgactatgttccgacagtgtttgataacttcagtgccaacgttgtggttgatggtaacactgtcaacctcggcctctgggacactgcaggtcaagaggattacaacagactgagaccactgagctatcgtggagctgatgtttttcttctggctttctcactgatcagtaaggccagctatgagaatgtttcgaagaagtggatacctgaactgaagcattatgcacctggtgtgccaattattctcgtagggacaaagcttgatcttcgagacgacaagcagttctttgtggacca

SEQ ID NO: 64102 - DNA, 318 bp, Zea mays
  Clone ID: LIB3075-054-Q1-K1-C9
ccgagaagagcatagactccctccacgtcgatggctacgccttcttcggcgtcgggatgggccccgggaagtggtcgccggaggtgaggaagacggcaacctgctggacacggtgagccggcacacgatccaggtgtacccgcggtcatggacggcaatcatgctgacgttcgacaacgcgggcatgtggagcgtgcattccaacatctgggagcggtactacctcggtgagcagttctacatcagcgtcgtcttgccggcgcgatcactgcgcgacgagtacaacatgcccgacaacgcccttcgttgcggcatggt

SEQ ID NO: 64103 - DNA, 505 bp, Zea mays
  Clone ID: LIB3075-054-Q1-K1-D1
tacacggacctgaatctcccggatgcgaccacgcgtacggctgcaatgaagcaactgaagttggagctgattgcccataaatctcacattgacatgttaggtagcaggttggagcaggttactaatgacgtgcattcgcagtataaaaatgagatccaggatttgagggatgtggattctgttgaacaagaggagaaaaaggacattcacaggaagcttcagaatgtggaaaacgagttgaggatcacgaggatgaagcaggcggagcagcaaagggattctgtctcggaccagcacgtggagacgctgaagcataaggtcatgaggctccggaaggagaacgagttcctgaagaggacgctggcgagctctgaagtctgaactggagtgcacatgaaaactgcaactgctttccttcacgccgtagttttatctcataactgaggatgtagaaaaatccactgctccaaatacacatatgaccttcagatgctttaaaactagc

SEQ ID NO: 64104 - DNA, 445 bp, Zea mays
  Clone ID: LIB3075-054-Q1-K1-D11
gggaacatcgtccatccgagctaagtaattaggtcgaaaatgacccgtgccagcagcagtagcagcagccggcgtgtgacgctggtactgctcggtctccgcctgctgcttctggttggtgttgcgcaggcggtagtggagttggtgcctgctgatgataatatcgccgccgccgctgctggcacggcggtggacgatggcgagccgcctcagcagtgcgcgaccccggtgagcgtggaggaggcgtgccgcggcgcgtccgagacgcacgccggcgtggcctacgaccactgcatggcgtcgctgggcgccgacccgcgcagcaaggaggccggcaacaagaacatgcacgggctggcggtgctggccaccaggatggccatcgaccacgccgtcagcaccgagtccaagatcggcgaccttcttcgcgacgcgctggacaacc

SEQ ID NO: 64105 - DNA, 321 bp, Zea mays
  unsure at all n locations
  Clone ID: LIB3075-054-Q1-K1-D12
gaccgacgcgccggcagatcccaagctcaccctagagggggaagagggcgaccgaaggcggcgatgggtttcatcatggacttcgcggagaatctgatcctccgtctgatggaggacccggacaagcgcgaccaggttcggcgggagcatgtctacaagatgaaggagcggtgcgagcgcactaaggcggcgtggagcctccctctgcgcccctacggcttctggaccttcgaccgcttcaactcgcagctctcctgggatccccagatcagccaggccgncggccgtcgggacccctacgacgacctcatcgcacgccac

SEQ ID NO: 64106 - DNA, 339 bp, Zea mays
  Clone ID: LIB3075-054-Q1-K1-D3
tgctcacatctttgcatccttcaatgacactttcattcatatcaccgatttgtctgggagggaaactctggttcggatcaccggtggcatgaaggtgaaggctgaccgtgacgagtcgtcaccttacgctgctatgcttgctgctcaagacgtcgcacagcgctgcaaggagcttggcattactgcactgcacattaagcttcgtgccaccggaggcaacaagaccaagacccccggacctggtgcccagtctgccctcagggcgcttgctcgttctgggatgaaaatcggacgcattgaggatgttaccccggtccccacggacagcactcgcagaaa

SEQ ID NO: 64107 - DNA, 130 bp, Zea mays
  Clone ID: LIB3075-054-Q1-K1-D4
gtcagacatacaatctatctcaaatgacactttcattcatatcaccgaattgtctgggagggaaactgtggttcggatcaccggtggcatgaaggtgtaggctgaccgtgacgagtcaacaccttacgct

SEQ ID NO: 64108 - DNA, 459 bp, Zea mays
  Clone ID: LIB3075-054-Q1-K1-D5
gtcgaggctgagacactgaaccaagtgaagcatctgacaacattgtctttcactgaagtagaggagttaggcaagacatctagtgttgatgcaaggttaccttcaagctctgatactgcagttatcatgtatacaagcggaagtactggtcttcccaagggtgtaatgatcacacatggcaacatggtggccacaactgcagcagtcatgacaatagtcccaaaacttggcatgaatgatgtttatctggcttaccttccattggctcatgtctttgaactagcaggagagactgtcatgctagcttctggtactgccattggatatggttcaacattgactatgactgatacatcgaacaagattaagaaggggacaaaaggagatgtttctgtactgaatcctactcttataatttcagttcctgcaactttggatcgtatcagagatgcagtgttt

SEQ ID NO: 64109 - DNA, 294 bp, Zea mays
  Clone ID: LIB3075-054-Q1-K1-D6
acgcgcatctgcttccagagccccccgccgacgctgcgccctcctctcggtcctgccgtccgacgaggtaaaaggacagcatggagagggtcagcgtgctcaatgatgctctcaagtccatgtacaatgctgaaaagatagggaaacgtcaggtcatgatcaggccgtcatccaacgcgatcatcaaggtcctgaccgtcatgcagcgccatggctacattggtgagttcgagcacgtggatgaccacagagctgtgaagatcgtggtggaactgaatggaacactgaataaat

SEQ ID NO: 64110 - DNA, 475 bp, Zea mays
  Clone ID: LIB3075-054-Q1-K1-D7
ccaagatctatcatcccaacatcgacaagcttggtaggatatgcctcgacattctcaaggacaaatggagcccagcacttcagattcgaacagttcttttgagtatacaggctctactgagtgcgccaaatccagacgaccctctttcggataacattgcaaagcactggaaagccaatgaagtagaagctgtcgaaacagctaaggagtggactcgcctgtatgcgagcggtgcatgagaacgcagtgatgttcttgatgtaataacccatcatacttgagtcctcatctattgccatttgcttgataaaaaataggctggagatatttgccatggaatgaagtctctacatgactatcactctgaattgcttggttggacacctgtggtcggttccctttaccttggggcacctttgacaaatcagtatctgtggtagaacttgctgatactttaatatatttgttacttcat

SEQ ID NO: 64111 - DNA, 430 bp, Zea mays
  Clone ID: LIB3075-054-Q1-K1-D9
ggcaagagaggagggccggcgtcggcgtgcctagctcgatcttgaaccatagctagccagcatggcgcccagcagcagcatagcagtactgctgctcctcgtcgtcgccgtcgtcctctccaacgtcccctcctcgggcgccctggcctcctcgtcgtcgtctctgctgcaccagtcgtctccgtctgagagtgagactgagaccgacagtagcagcggagaatcttcgtcgtcgtcgtcgtcggaggaggaggaggccggcgagaaggagaaggagaaggagcaggagatggagaaggcggtcgcggcggagaaggctgcccagcaggagctgctcaagtacgccaaggggaaagggcatcgtgtcaccgaccaacggcacggcgtggtacaagggcaatcgccgggagttcgtggacgcccacaacga

SEQ ID NO: 64112 - DNA, 274 bp, Zea mays
  Clone ID: LIB3075-054-Q1-K1-E1
gcgaggccggctcacacgacggcatccatgggactgcgactgctgcttgcaactgcgattcgatccatgctgggccatacaacctgttatgcatgttatggatccagatacttatttggtcgttagattttttgttgttatttcgttgttagatttttggttttctttgtttggttgtgaatatgtagaatgcaggatctactatgcatatttgtattttgtttttagcattgagctacttaagattttaaaaaataaatatcgaatttgtcct

SEQ ID NO: 64113 - DNA, 295 bp, Zea mays
  Clone ID: LIB3075-054-Q1-K1-E10
cggacgcgtgggcagcaacgcgtgcttggtaggaacccgtgccgaccgactcttactctgcgggacggtctcgagtttgatcgggagatggctgacgggagctgctgcgtctgcaaggaggcgccgtccaagtacaagtgcccttcttgtcgcacgccctattgctctgtcacatgctgtaaaaagcacagagaggaatcttgtcaaaagatattgcatcatgaagaacttagcaaaggagtattgcacgaggaagttacactgttcaccacatgctctgtagaatcttcagatt

SEQ ID NO: 64114 - DNA, 384 bp, Zea mays
  Clone ID: LIB3075-054-Q1-K1-C12
actcgtctcaccctccctccctcacacaaataataaggaaaggtcccgcccttttcctccgacatgcacaaggggggaggggaaaacacgtacattcacccggcggcaataatggcctcggttccggctccggcgacgacgaccgccgccgtcatcctatgcctatgcgtcgacctctcctgtgccgcggctgacgacccgaacctccccgactacgtcatccagggccgcgtgtactgcgacacctgccgcgccgggttcgtgaccaacgtcaccgagtacatcgcgggcgccaaggtgaggctggagtgcaagcacttcggcaccggcaagctcgagcgcgccatcgacggggtcaccgacgcgaccggcacctacaccatc

SEQ ID NO: 64115 - DNA, 416 bp, Zea mays
  Clone ID: LIB3075-054-Q1-K1-A6
atgttaaatcgttccataaccattttgatagtaatgcttcttctttttgcgaaagaatatagtttgggatatgacgggtctataatgatattatattactctattgatcttttcaaagcaagcatgttcttccattctgaatgttaatcgtgctcatccatttgtattgttggaccatcgtaagtatgtttttccacaaggaaccttttacggtgtttagagtctgattattgtccttataatgcctttcttaataagctgtaccaatggcgcgtctcacattttgtagaactcgtggaaattctcatggagcaaagctctatttgggatctgatgtcgatgactaccaaccccctttatccttggctttacatactttagtccatactattttctaaaacattttactatttgcg

SEQ ID NO: 64116 - DNA, 425 bp, Zea mays
  unsure at all n locations
  Clone ID: LIB3075-054-Q1-K1-A7
cggacgcgtgggcacggacctaagccagtacaaggaccatggtaattggatcgagattctacgtgtggataacctggtcatcaccggcaagggaaaccttgacgggcagggcccagccgtgtggagcaagaactcctgcaccaagaagtacgactgcaagatcctttccaactcgctggtgatggacttcgtgaacaacggggaggtgtccggggtcacgctgctcaactacaagttcttccacatgaacatgtaccggtgcaaggacatgctgatcaaggacgtgaccgtgacggcgcccggggacagccccaacacggatggcatccacatgggcgactcatccgggatcacgatcaccaacaccgtcattggcgtcggtgacgactgcatctncatcgagcccgggacctccaaggtgaaca

SEQ ID NO: 64117 - DNA, 201 bp, Zea mays
  Clone ID: LIB3075-054-Q1-K1-A8
cacgaccggaacgcccggagcgacccacgcgtacgctgacaaaacggcacaaacccaagccgaaacaaagaccaagagccaaggaccgggaaaatacgacaggaaaacaggggcagcacccgagaacgaaaccctcaccggaacaggccaaaccgaagaagcacgaacaccgaaaacaagaaccacagcagaagaaaacaa

SEQ ID NO: 64118 - DNA, 288 bp, Zea mays
  Clone ID: LIB3075-054-Q1-K1-A9
gagagacgcacatctatctgtcaagcgacgccatggcctcgatcagagtcgaaggctaacacctggatggcggcggctgcctgaacggcatgatggaaggcatacttcaagatcatcctcacctccgaccccaagctgccttccatagtgttcagcgtgcacgacgcgagcaccctttaccgcggtgctcaatggcgccgcgaaggatgtcaatgactcgacccataccagcgccatgatcaccaacgatggaattgccatcaacccctgacaaagagtacgcaacgt

SEQ ID NO: 64119 - DNA, 395 bp, Zea mays
  Clone ID: LIB3075-054-Q1-K1-B10
gcggtgcactgtttgcagcatccgatccccaagtcccggaatactgcgagacgctcaagtcggaggactggccagtgggtgcctgcattaactatgactgtagtccgatgaatgcgtctgaagaagcgcacaatcttgagacctcgcagctggtctgggagaagacactggagatggtcggccttccgccggatgccctggagaagctcatcgccggagaatcagttcagtgccgttacggacaacaggatacaactttttagttagcagtttagaggtggtttgttcggttgttatgtcattttgatcctaaatttgcagggaggaaaacacagggaaaggagaaaaagaacttgttgacagctaccaatctttgctctttttctggatgtgtg

SEQ ID NO: 64120 - DNA, 409 bp, Zea mays
  Clone ID: LIB3075-054-Q1-K1-B11
ctctggttctggtttcctctttttatgctacaggtttggttagctaccatatcactcgctatctacaaggttagttttccgcatcgagaaatattatgtgatattgattgtcgagttcttttttctgcttcaaaaaatttagtacttgtattcatagtaacatttgatgcattaatgtatacatttttattttcatatataggtttttgatcatctcggcatgttaaagaagaagaaatgcatctagctgtaaagaaaaggaaggcaaatatcatcttatgcaattatttgtgtgctgtcggcggcgcgctatggctaccggcaaagaactacctgatccccatggacggagctggaacctaatgcctggcaaacacactggtgaacacagtcatgttaatcattggga

SEQ ID NO: 64121 - DNA, 385 bp, Zea mays
  unsure at all n locations
  Clone ID: LIB3075-054-Q1-K1-B2
atcctcgctggggcgggaggcgcgtcgagccagggttctgcctcccacgtgggccagtggcgcacttctttctccagcattcgagggaggagaggggttcaccagccacgcgaaggaggcgaacttcggctacgcggggccggccaggtgcaggcgctgacagctgccgcgtgcctggcacttggcctgggtggccctgccgtcgcctccgacgttgccttctgccgtttggccagggcatggctatccgtccaccacacgggcgacggtcacgccgtacgtgggtccgtcacatncacggcttctcccgcgccgtctggcgtacgtggggaccgtccaagatgtcgtacgctgcgggagtggcggcgacgttcttggatggtct

SEQ ID NO: 64122 - DNA, 303 bp, Zea mays
  Clone ID: LIB3075-054-Q1-K1-B3
ggcgacgccagaacacgacgagaagacagactgggtgaagatcacgccagagctgatgcatcgacttccagctgcgacgagtcgagtgggggagcaagtcaccaaccacacaaaggaggcgaacatttgctactcagggccgtccaggagcatgagcggacagctgacgcgtgcctgacacttggcctgtgtggccctgacgtcgcctacgacgttcacttctgccgcatggccagagcatggctatccgtccaccacacgggctacggtcacgccgtacgtgggtacgccacatacacggct

SEQ ID NO: 64123 - DNA, 408 bp, Zea mays
  Clone ID: LIB3075-054-Q1-K1-B4
tgttgaaacagaacaaagctttgcccgccgtgtcttagctatagtggactatgatgaagatggaactctttccttatcagaatgctcagacttgatgaaagcttttggtaataaattagcagttgcaaagattgaagagcttttccgtcaagcagatacaaatagtgatggcatagttgacatagatgaactggcagccctactggctgctcaacaagaagaagaaccacttataagtaactgccctgtctgtggtgaagatcttggaaaatatgataacataaatgatatgatacatatgacactttgctttgatgagggaactggtgatcagattatgactggagggattctaactgaccaacaagcattttaagggtggatgttcaagctcagtgaatgggcaca

SEQ ID NO: 64124 - DNA, 489 bp, Zea mays
  Clone ID: LIB3075-054-Q1-K1-B5
tacacagagccatgacgtcggatgcgacgcatacgtacgccaggaagacgactcgagtaaaaaaggagcgggcgaacggtggccggacatcgacgacagctatctgcggtgcgagacgcgagaggcagcatgaggcacgagggacaggcgacgccggcgagcgacacccgaaagacttgagcgtagaggctgacgtgactgcacgagacacgagcggtggctctagtgtctactacagaaactgacaaccaccgaacggcgatggtggcggcaaccgaccgcggcaacatccaaagacgatgatcttctccgatctggcgtatctgggacgtccttcgactaagaccacctacgatctggaggcttcagatgcagtagccgaaccggaggccttagggtcgacatccagagactgcctcctatcgaactgtgtttatgtctaccatgatcatgcgcaatgcctactatttacactatttatgcattcta

SEQ ID NO: 64125 - DNA, 456 bp, Zea mays
  Clone ID: LIB3075-054-Q1-K1-B7
cggacgcgtgggcgaacctggagctgtcatccgtggcaagaagggatccgggggcatcactgtgaagaaaacagggcagtcactcatcattggcatctacgacgagcccatgactcccgggcagtgcaacctggtggtggaaaggctgggcgactacctgctcgaacaggggatgtaacaacaaccccttcccctggaatgcatgttgatgatgttgctggttccaacttcgttttcagtaataataacaacaaagcgaagaccctcctacctaccctatttgcttgagcggctcttgtccgcgccacaagatacctattgttgcgctgggaatattcagttacgatgacccgctttagttcagttttttttattgtggggttgggtcgatcatttgagctgtacgtgaatcggatggacaacagactccaattactaagcaaatatttttcttct

SEQ ID NO: 64126 - DNA, 469 bp, Zea mays
  Clone ID: LIB3075-054-Q1-K1-C1
acgagaagcagaagccaccgatcggcgtgccgcgtgcgtgaggcgatcggagcatcccgtcccgaggaggaagacaaccggcgacgcggggggaacatggggaagacgccggtgcggatgaaggcggtcgtgtacgcgctgtcgcccttccagcagaaggtgatgccggggctgtggaaggacatcaccaccaagatccaccacaaggtcaccgagaactggatctccgccacgctcctcctcacccccgtcgtcggcacctaccaatacgccatgtggtacaaggagcatgagaagctttcccacagatattaaatgcgctgtccttttcagacagcactcggaggtttcatgatgggtttcataatccttccatgatgatttaacatttgtttgatcaatttcaggttagcgccttttcatcggtccatatgcatatatggtattcgggtctggcaaacttattttg

SEQ ID NO: 64127 - DNA, 359 bp, Zea mays
  Clone ID: LIB3075-054-Q1-K1-C10
agaagatttgattggtttccccaaatccggtgactccattcctgttgttcttcacgtcgaccccgggaacctcgcagaaggctctagcgaccccgggcgcccggcgctctgagggctgtgctgccggcggcgagatccaggagctgcctgccatggtgaaggacagcgcctactacgacgtcctaggggtcagcgtcgacgcgtcctccgccgagatcaagaaggcgtattacatcaaggcgaagctggtgcatccggacaagaatcccgggaaccctgacgccgcactcaagttccaggaacttggagaggcctatcaagttcttagtgatcctgggaaaaaggaggcttatggatag

SEQ ID NO: 64128 - DNA, 362 bp, Zea mays
  Clone ID: LIB3075-054-Q1-K1-C11
gacgacgatcccttgggcttgggcaggacgacggagagctgggccctctcggtgtccagcctggcccggatggtgccggcgtcgcagctcctgggcaccgggaccaccttgaggaagcgcgcccaccggccgccgtcggcccggcgctccccggtgaccttcagcctgggcgcgccgtcgggctggcgcccgccggtggccttcagcttcttccgccgggcgctgtacacgaccttcagaaacataaggcgcatgcagccgcgcaggcgacgcgctctctggtgcgacgtgcggtctcgccgtctcggcagtgttgccttacctgacacgtcgacgacgagggtgtccggctgcttcgtgct

SEQ ID NO: 64129 - DNA, 114 bp, Zea mays
  Clone ID: LIB3075-053-Q1-K1-G7
gctgctggtatccacgagaccacctacaactccatcatgaagtgcgacgtggatattaagaaagatctgtatggcgacatcgtcctctccggtggtaccactatgttccctggc

SEQ ID NO: 64130 - DNA, 205 bp, Zea mays
  Clone ID: LIB3075-053-Q1-K1-G8
acggagatcaccctgagcgatggcacccgcgtgccctacggcctgctggtctggtccacgggcgtcggcccgtcggagtgtcgtcaggtccctgcaccttcccaagtccccagcctggagggtcggcgtggacgagtggttccgcgtgcccacggggccggacgtgttcgcgctgggcaactgcccgggtttcctgaagggaacc

SEQ ID NO: 64131 - DNA, 343 bp, Zea mays
  Clone ID: LIB3075-053-Q1-K1-G9
gatccatcttgggcgggcgccgcgcgtcgagggccagccaaagcttgccatggcggccgtgcggtccgacagggtccacgaccaccaccgccgctccgaggcgtcgtgtccggcaacctccgcggccgtggcggcggcgagggccgatgacgccctgcgccagcgcccgcgggggctcgtgcaggtccgggagcgggaccagggcccgctgtcgacggggcaccagcacctgcaccaccatcaccaccagctgcggcggtcggcggcgttcccaccccgccggccggggccggggcgccgtcctcctcagcgctgcgaaagcgaccttaacatcatggagcac

SEQ ID NO: 64132 - DNA, 274 bp, Zea mays
  unsure at all n locations
  Clone ID: LIB3075-053-Q1-K1-H1
gccgcgctctcgcagatgatggtggcggagaagcccgcgctggggttccaggcgcacggggacggggacgacgagctggagctggagctagcgtcgccggcgccgtcgccccggaagatgcactcgctggaattcgagcacatcggctcgctcgccgncgtggccgagtcgctcgcgcccgggagcatgtggcagagggcgctcaccagcgtgcgcgtcgtcatctttcatgccaagatcaacgtgcctcttccctttgggccggtcggcatca

SEQ ID NO: 64133 - DNA, 244 bp, Zea mays
  Clone ID: LIB3075-053-Q1-K1-H10
acgcgtttcccgacccgctgtcgctcgctgccaactccaacgcctactgcacctgccctggctacttccgcttcatccacgaggaccttcacccatggcgcgccgctgggggcatcacccgcgccatggtcgaccgcgcgcgcgccaccgtcaactttcgcctcgtcgtcatccggggccgcgcgtacatcgagcgcatcgcgccggcatttcagacgcgcgacctcttcaccatctggggcat

SEQ ID NO: 64134 - DNA, 403 bp, Zea mays
  Clone ID: LIB3075-053-Q1-K1-H11
gcttatattacaacgacgggaaaaaatatttcttcactaccagaacctcagagtcttgaagctgttgtcagttcacttatatgtgaaaagcattcgagattgctgcaaaagcctttggatcttgtttgtaagcgcggaagcatcactcagaaaacatcaaataacgatggtttaacaatcatcccagagtatgattggaagttattctctgaggagtggagtgcgacgcctggaaaaggtatatctgctgaaatcgcttttagcaaggacgctcaagataaaatgcacggttcctctgaagcaatgccgattacggatggaaatttggaccagtctctttatggtgcaaatgacgattttggtgccagagagccctatgtcagaactgatccttgaggttgtg

SEQ ID NO: 64135 - DNA, 409 bp, Zea mays
  Clone ID: LIB3075-053-Q1-K1-H2
gattgccaagagcaatggcctctaggtcatccatcctgctcgtcatggtggtgctagctacgctattcgtggttggttcgtgcaccaccccgctcaccttccaggtcggcaagggctccaagcccggccacttggtcctcacccccaacgttgccaccatctctgacgtggagatcaaggagcacggtggcgacgacttctcctttacgctcaaggagggtccgactggcacttggacgcttgacaccaagaccccgctcaagtaccccctctgcatccgcttcgctgtcaagtccggtggctaccgcatcgccgacgacgtcatccccgccaatttcaaggccggcaccacctacaagaccaccctcagcatctgattagcctcttatgacgaataatatttcaagag

SEQ ID NO: 64136 - DNA, 235 bp, Zea mays
  Clone ID: LIB3075-053-Q1-K1-H3
agttattgagctcatgccaaaattgggacaacactttgttgaagaaatgataaacccaagcatgtatgcaagtcaatggtgttatcacagttttctcatattccttcccatttcatctaactcttagagtttgggatgtgtttctttatgagggtattaaggttgtattccaagttggattggctctattgagactctgtcacgatgatttagtcaaattaccttttgagaaact

SEQ ID NO: 64137 - DNA, 350 bp, Zea mays
  Clone ID: LIB3075-053-Q1-K1-H4
cacccacccacccactcgcttcagccgcctccgccgcgcgtaccaagcaggtggagacaggatgccggctggccacgggctgcgctcgcggacgcgcgacctcttcgcgcgccccttccgcaagaagggctacatcccgctcaccacctaccttcgcacctacaagatcggcgattacgtcgatgtcaaggtgaacggcgccgtccacaaggggatgccgcacaagttctaccacggccgcaccggtcgcgtctggaacgtcaccaagcgcgccatcggcgtcgaggtcaacaagcaggtcaatgggcgcatcatcaggaagcgtatccatgtccgtgtggagcatgtgc

SEQ ID NO: 64138 - DNA, 222 bp, Zea mays
  Clone ID: LIB3075-053-Q1-K1-H6
gccacgcgtacgggcgcttttcctcgtcctcgatccattccagtgccgcttgcaggtaggatcgatctgatccatgcgagcaccacgcccatggcgcgaccaactcaccgacgaccacatcgacgacttcaaggaggccttcagcctcttcgacaaggacggggatggctgcatgacgaccaaggagctgggaactgtgatgcgatcactggcgcaaaaccc

SEQ ID NO: 64139 - DNA, 430 bp, Zea mays
  Clone ID: LIB3075-053-Q1-K1-H8
gccgcagcatggcatcatcggccgcgctcttggtgctagccctcgcgctagtggcggcgaccgccccacaggtagcggaggcaaagaagaagagagcggcggagagcggcgaggcggcggaggcgaagaacatccaggacgacttctgctcgacgctgtgcgagggcaagaaggggacggacctggtcgtgtgcaaggagtcctgcgctctctcccagcagtccaacctggtgctgtacggcaggatccagtgcaagggcaagtgcaccgagcagaagggcatcacggcgccggccatgaaggtctgccaagaggagtgcgacaaggcgtacgttgtgaaggcggccgacgtcaccaaagcctgcaacgtcacctgcgccaaggagaagaacccgcgccttaacgagaactgcaagaagtcctggacccc

SEQ ID NO: 64140 - DNA, 340 bp, Zea mays
  Clone ID: LIB3075-053-Q1-K1-H9
ttcaaggatggtctgggttgtgggtcctgcttcgagatcaagtgcgataagcctgtggagtggtccggcaagcccgtggtggtgcacatcacggacatgaactatgagcctatcgcggcgtaccacttcgatttagcaggcacggcgttcggcgccatggccaagaagggcgatgaggagaagctgcgcaaggcgggcatcatcgacatgcagttccgaagggttaagtgcaagtacgacttcaaggtcaccttccaccttgaaaaggggtgcggtcccaactacctggcactgctggtcaagtacgtccactgcgacggtgacattgttgcactggacg

SEQ ID NO: 64141 - DNA, 396 bp, Zea mays
  Clone ID: LIB3075-054-Q1-K1-A1
aggagaaccagcagcctgcaataagagccagccagagaaactaataaaactctcgccgacgccatccgagcgaacaagccaaccgaccccgtccccaaggcaatccgtcgccgacgtaccaccaccaccgcaggagcgagatggagatgaagaggatcctcttcgccgtcctcgtcgtcatcgccgcctcggccaccgcagtgctggcctccaccgaggtcgccgccgcgggcgccccaactgcctccgagtcgttcgccgaggctcccgctggcgctggcgctggcgctgccgctggcgccgtcgactctgagccctacgacagcagcggagcgcccgccctcatcgacgcacccgcagcgctactgttctacctactcgcctactacattcact

SEQ ID NO: 64142 - DNA, 207 bp, Zea mays
  Clone ID: LIB3075-054-Q1-K1-A12
tcgggcgcatggacatgatcatcaacgacgtcaccctgacagcgcccgtggacagcatccaacacggatggcatccacatgggcgactcatgcgggatcaccatgatcaacaccatcattagcatcagccactacagcctcttcatcggccccacgaccatccacgagaacatcaccgacagtgacctacttgcctagccacggcat

SEQ ID NO: 64143 - DNA, 442 bp, Zea mays
  Clone ID: LIB3075-054-Q1-K1-A2
cactaatccaagacaaaacatggctgtgaatgtgagaaccatgtggtcgtcgatgcgggcacaggttgcgatggttgtggcgttggtgttcttggtgagcggcgcatggtgcggtcctcccaaagtccccccaggcaagaacatcacggccacctatggcaaggactggctggacgctaaagcgacatggtatggcaagccgacgggtgccggtcccgacgataacggtggcggctgcgggtacaaggacgtgaacaagccccccttcaatagcatgggcgcatgcggcaacatccccatcttcaaggatggtctgggttgtgggtcctgcttcgagatcaagtgcgataagcctgtggagtgcttcggcaagcccgtggtggtgcacattacggacatgaactattagcctatcgcggcgtaccacttcgatttaacaagc

SEQ ID NO: 64144 - DNA, 329 bp, Zea mays
  Clone ID: LIB3075-053-Q1-K1-G6
acggtcggaattcgtgatctcaattccgtgctctcgagaaagttcatcccctttcacgggtgtcccgagagccaatccggccacagatcaagccttacaaaaccccacttaccatgataccacctcgaccctaaccggctaatcgacctgagatcgatctcgagtgacgaaattgaccacaggaagtaagatccggcaagatgttcttcttcttcgtaggcggcgtagagcagggggccgggcgggtgctcaaggaagcggcggggcggtgcctccggtgcggcggcgccgcggacctggtggagacagagaagggcctcaagctcttc

SEQ ID NO: 64145 - DNA, 423 bp, Zea mays
  Clone ID: LIB3075-054-Q1-K1-A3
gttcggggtgccgtagggcttaggatcggcggcgatggcggcgaggctggcacagctgcgcgctcaggcggtgcaggcggcggagttcgcctcgaagcacggcggctcctactacaaggagctcatggagaagaacaagcagtacgtcgtgcagccccccaccatcgagaaatgccaggagctctccaagcagctcttctacacccgcctcgcaagcctaccaggtcggtatgagtcattctggaaggagcttgatggtgtcaagcaggtatggaagaacaggaaggacctcaaggttgaggaccttgggattgcgactttatttggagttgagctttatgcatgggtctgcgtaggcgagattgttggcagaggtttcaccttaaccggctataaagtctacgtgatttccagggatttaag

SEQ ID NO: 64146 - DNA, 334 bp, Zea mays
  Clone ID: LIB3075-054-Q1-K1-A4
cagtccgacgtgccggaggtggtggaggccgtcacgcagaagaagctggaactcatggacgagttcatccgcgacaggcacgcggcggactcgcagcataggctcttgccgccggatccggagccgatggcaagcccagagccaggccccgtcgaagaggacaacgacgacatgaacgcgaccaaggcccttccagcgcccgaggagcctgcggcggctgccgcgcaagaggaaagcacagtcgggaaagccgagccagatgcctccctcatcgtggacgacgacccggtcgaggaggaggccgacttcctgaacctcagcgctgacgccatgt

SEQ ID NO: 64147 - DNA, 431 bp, Zea mays
  unsure at all n locations
  Clone ID: LIB3075-017-Q1-K1-C5
agatacaaggcatatttttgtggatatcggtctaggttttcatgtggaatttacttggcaagaagctttacagttcatatctgtaagagaggcaaggttgactaggcaaatagacgaatacacacatctcatcgcaagcataaaagcacagatcaagttggtatgtgaaggtatccgcgaagtgctgcagctgcctgcggagaaagagttatcgcccaggaatacgtggtagaatttggttctcaatggagcagggggtggtgttctgtaaacgtggttccgtttcaactcttgcagttgaaattattgtggtgccgacagtattttagagcagagaatgacgttccccttcgtataacaatctcttcgacgacaccacgtacaactcatactgatttctatgntttcattatgttttcatactgatttgc

SEQ ID NO: 64148 - DNA, 288 bp, Zea mays
  Clone ID: LIB3075-017-Q1-K1-C6
aagagatggcgtgtatagacatttcttttagagccttgttccttttatcgctcgtgggggtcatgcatggtgagaaggcaaagtcaaaggacaacgatgcataagcgtccggacccgttggctccttctatttcattaattttatcgctttttgttttggcatgactgatagcacgaacgctgttcaggatgcgtgcgcattatcgttcttgttatttttgtagcagacgatcctcattcccaatggcgacttcctcgtcggaccactcaacttcacaggcccatgca

SEQ ID NO: 64149 - DNA, 389 bp, Zea mays
  unsure at all n locations
  Clone ID: LIB3075-017-Q1-K1-C8
acttcctgtaggcaccgtttcgtccaggccagggccgtttctagcagcagcaggtagatttctggtgacggtcactggaaaaggcggacatgctgcagggccacaggatgctgtggatcccattgttgcggcatcctctgccatcgtcagccttcagcttcttgttgcccgcgaaattgatcccctccaggctgcagtggtctcggtcacgttcatgaaaggaggtgatgcttacaacgtcattccagagtcagcatccttcggcgggaccttcaggagcttgacaacagaaggcttttcgtatctcatgaagaggatcaaagagatcatagaaggtcatgccgncgtccaccgctgcaccgncgncgtcgacttcatgcangagaagc

SEQ ID NO: 64150 - DNA, 243 bp, Zea mays
  Clone ID: LIB3075-017-Q1-K1-C9
gcggaaagacggcgtacgacaacttgcttatcttcaaggacggcaagggctgcggctcatgctactaggagcgatgcatggaaaaacctgcatgctagggcactgctgtcacggggttcatcacaaacatgaactacgagcctatcgctccctaccacttatgctagagcggaatggcctgtcggatacatggcaaactcgggtatacaacgacaagcttatgcactgcggcattacagacaa

SEQ ID NO: 64151 - DNA, 388 bp, Zea mays
  unsure at all n locations
  Clone ID: LIB3075-017-Q1-K1-D1
aggaggcggtggctgcttcaagtgcggcgagcctggccacatggccagggactgctccagcggcggcggcggctacggcggtggcggcggcggtggtggtggcggctgctacaactgcggccaggccggccacatggccagggactgcccaagcggtggcggcggtggcggagggaggttcggcggcggcgggggtggaggcgaccgctcctgctacaactgcggcgaggccggccacatcgcccgcgactgtcccacgtgaggtgtgtccgcgtccgtccagccagccagatcggatcggatcgctccaccacctgctggtcntgatggcgccgccncttctagatctcgcttaaaaaaacatncccctctcgctgtgtgtccgagt

SEQ ID NO: 64152 - DNA, 391 bp, Zea mays
  Clone ID: LIB3075-017-Q1-K1-D10
cagtcgcgtgtctaggtttcctctctcaccatagcgcccgctctgtcgcccttcgttcacctctccttcctctcctccctgcctgccagggagaggggaagtcagaggcacggagtggcgcagagcagacgcccgtgaaccattgtagctgtccctgtcgtcgtcatcgtcgtcgtcaacgaatccgcacaaggaaaagatggagaagaagccgaccatcctcatgaacaggtacgagctcgggcgcacgctcgggcagggcaccttcgccaaggtgtaccacggccggaacctcgcgtccggcgagagcgtggccatcaaggtcatcgacaaggagaaggtgatgcgcgtcggcatgatcgaccagatcaagcgcgagatctccgtcatg

SEQ ID NO: 64153 - DNA, 387 bp, Zea mays
  Clone ID: LIB3075-017-Q1-K1-D11
caaggagtaccgtggcaagattgaggctgaattgagcaacatttgtgatggtatgctgaagttgatcgactctcaccttgtgccttcctccactgctgcagagtcgaaggtgttttacctcaagatgaagggagattatcacaggtaccttgctgagtttaagactggtgctgagaggaaggaagctgcagagagtacaatgatagcttataaggcagctcaagatattgcgttggcggaactggcatctactcatcccataagacttggacttgcacttaacttctcagttttctattacgagattctgaactctccagacaaagcttgcaaccttgccaggcaggcgtttgatgaggctatttctcagttggatacgcttggcga

SEQ ID NO: 64154 - DNA, 258 bp, Zea mays
  Clone ID: LIB3075-017-Q1-K1-D12
gcgtgtggaactacgtcgtcacggcgcacaagcccaccagcgtcaggcactcctgcgtaggcaactttaccagccccaaccagctgaaccttattatcgcgaaatgtacccggatcgaaatccatttgcttacccctcaaggcctgcagccgatgcttgatgtgcctatatatggaagaattgcaacgattgagctcttacggcctcataatgagactcatgactttcttttcattgctacggagaggtacaaattct

SEQ ID NO: 64155 - DNA, 428 bp, Zea mays
  Clone ID: LIB3075-017-Q1-K1-D2
ggcgtcaaacaggaggactgcaacgagatgccgtggatccagtccgtggccttcatccgcatgggcaagtcggccaccgtgatggacctcctcaaccggacgtccaacatcaaggccttcggcaagtacaagtctgactacgtgaaggaccccatcccgagggacgtgtgggagaagatctacacctggctcgccaagcccggggccggggtcatgatcatggacccctacggcgccaggatcagctccatcccgcaggatgcgacgccgtttccgcaccggcagggcgtgctgttcaacatccagtacgtcagctactggttcggcgagggcgacggtgcggcgccgacgcagtggagcagggacatgtacgcgttcatggagccgtacgtcagcaagaaccctatgcaggcgtacgcccactacag

SEQ ID NO: 64156 - DNA, 396 bp, Zea mays
  Clone ID: LIB3075-017-Q1-K1-D3
cgcaactgcttcctcttgctctgcctgctccgccaatgcccggcatgggtggccctccacctccgatgggcggaatgggcatgcctccgatgggcgggatgggcatgccgccgatgggccctggtccgatgccagcattcgggatgccaccaatgggaagctactgagatgagatgtttttttgttgttgttgcagagagcttagatgatgatttgatatgttcctgtgtaagcagaggcggaaacctcattggagttgtagatggttacattttggaattaatattctttatggtaccaggaaatttttggcgagtgaatgattaggttggttgagcatgagctggtgaaagcttgtaccatttgtatagtgtgatgaaatctttgtagacattt

SEQ ID NO: 64157 - DNA, 421 bp, Zea mays
  Clone ID: LIB3075-017-Q1-K1-D4
agcgcacaagatcaaatacctcgccgccaacaatggcctccaggtcctccatcctgctcgccatggtgatgctggctgcgctattcgttgttggtttgtgcaccacccccctcaccttccaggtcggcaagggatccaagcctggccacctgatcctcacccccaatgttgccaccatatccgacgtggagatcaaagagcacggtggcgatgacttctactttacgctcaaggagggcccgactggcacctggacgctcgacaccaaggccccgctcaagtaccccctttgcatccgctttgctgtcaagtccggcggctaccgcatcgccgacgacgtcatccctgccgatttcaaggccgacaccacctataagaccacactcagcatctaatcaatctctggtgatgaattagattt

SEQ ID NO: 64158 - DNA, 183 bp, Zea mays
  Clone ID: LIB3075-017-Q1-K1-D5
agcacgtgtacaacagtccttgtgtgttaaacgttgtccttgttctggaatgttatccaacccatcaggtgtcctttttgtactttggttagtgtatgcatattgtcatgtgctgtacaaatatattagcattactaactttattacgggtggggcctagcccaaacttgatacagctaggat

SEQ ID NO: 64159 - DNA, 451 bp, Zea mays
  Clone ID: LIB3075-017-Q1-K1-D6
cccacgcgtccgccgtcgcatcccatcccactaccacccatctcgtcgtccgccgattcgatccggttcttccaacccaggggcagtgatggcgacgaagaggagcgtgggcaccctcggcgaggcggatctgaaggtgaagaaggtgttcgtgcgcgccgacctcaacgtcccgctcgacgatgcccagaagatcaccgacgacacccgcattcgcgcctccgtccccaccatcaagttcctcctcgagaagggcgccaaggtcatcctcgccagccacctgggtcgtccaaaaggtgtcaccccaaagtacagcttgaagcctcttgttccacgcttgtctgagctccttggagttgaagtcgtgatggccaatgattgcattggtgaagaagttgagaagttggctgccgctttgccagaaagtggagttctgctcctaaagaatgtt

SEQ ID NO: 64160 - DNA, 390 bp, Zea mays
  Clone ID: LIB3075-017-Q1-K1-D7
cgacaagatggcgtgcacagacaatgcgatgagagccttgttcctcctggtcctcttctgcatcgtgcatggtgagaaggaagagtcaaagggcatcgatgcgaaagcgtccgggcctggtgggttcttcgacatcaccaagttgggcgcctccggcaatggcaagacagacagcacgaaggctgtgcaggaggcatgggcatcggcgtgcggcggcactgggaagcagacaatcctcatacccaagggcgacttccttgtcggacaactcaacttcacaggcccttgcaagggcgacgtgaccatccaggtggatggcaatctgctggcgaccacggacctaagccagtacaaggaacatggtaattggatcgagattctacgcgtgga

SEQ ID NO: 64161 - DNA, 393 bp, Zea mays
  Clone ID: LIB3075-017-Q1-K1-D8
acagagattccttcgatccaaagttccagctatagcccaagtaatgactggttggctcaatgtccttcggcttgcattgagcaacggattccaatggaatgcaatacaatatctcagtcaaaagcttaccttatgatgcattcttcttcagctttctgtgcccctgaacatgatgcctgttctgaaactcaagctccagacttatgttcaggttcagatgttgttttcgaccccagccaatgttatccagttgctagtttttctgatcttgggatctcggatacaccactaacatcaggtttcttgaatgatataacactagcaagtttgttgaatgtcaatttgaaggacctgtcacatctcaaccgacaggaacctaccaatgatacatca

SEQ ID NO: 64162 - DNA, 440 bp, Zea mays
  unsure at all n locations
  Clone ID: LIB3075-017-Q1-K1-D9
gtcacaacacatacaggaaaagcaagcatgaatcatcggaataatggctcggcatgtgtgtcctcgtcagctcctcctggccgccatcgcggtggcaccgttcgcgggcgccgcacgcgtggacgtcgtggagggtaggtccatggcatccgccgatgcaccggaggcggcggccgatgctcccgctcctagccccgactccgcctcatccccagactcatcgtcagaggcgccctccagcagcagctccttcgactagacgcaaaaacctcttcattctctggaataactaacagtatatacgttgcaccctgatgatatagaaacatgtacgtgcatcagtgtatggaatgcgagtggcanacacatggaatgtgcttgcctaaatatgggtgatttctttatttattatatgtctctctcggtggtttttatttttc

SEQ ID NO: 64163 - DNA, 390 bp, Zea mays
  Clone ID: LIB3075-017-Q1-K1-E1
ccttgatgggactattcgagcatgggatttgtttcgctatcgcaacttcaggacatttaccaccccttcacctaggcagtttgtttctttaaccgcagaccagagtggagaagtcatatgtgctggaacacttgattcgtttgagatatttgtttggtcaatgaaaactggtcgattgttggatgtactcagtggtcatgaaggaccagtgcatggtctaatgttttcaccaattaatgctattctggcttcatcatcatgggacaaaactgttcgcctctgggatgtctttgagagcaagggtgcagtggaaacttttcagcactcacacgatgttcttactttagcttatcgacctgatggaaggcagatagcatgcagtactttaga

SEQ ID NO: 64164 - DNA, 385 bp, Zea mays
  Clone ID: LIB3075-017-Q1-K1-C4
gccgaatcatctgtcgctgccgtcaccgttaccgaggtcggggcgccatcttcgttgggaccgctggtcgccgaggaggccgatgccgcgatggaggaggctgcggcggtcgcgaagaggtggcccgggtggcccggtgtcagcgtgttccggctgtgtggtgccagtgctcaaggtcggaagcataatctggcggaagggcgagctcattaagcggcttgtcgaggagaccaaggccagggtccgcatcctcgagggccctgtcggcgccaccgagcgtatcgttttggtctctggaaaagaagatccaggcttggagctaccttcagccatggatgctctcatgagagttttaaagcttgtcactgggatagcacatggtgct

SEQ ID NO: 64165 - DNA, 349 bp, Zea mays
  Clone ID: LIB3075-017-Q1-K1-A7
gtcagccgtttcatctcctgatcagcctgctagcttagtgaggaatgcttctatgcgtgggatgcccataaacggttctttcaggaaagacaactctacagaaagcttcgatttggaatgtcaagagaaacatctggacattgttccgactagctcatcccctgaaaggaagttttcttttagttcttgctcatcaaatgggctccttttgtccaaagagagctctaaacagcaaactagcatccacaaccttgacaagtgtaatggagggcatttgcatgtatcagatgaaacattttctgaagctgctcctaagacacataaatcagcagaggaccatgatgataga

SEQ ID NO: 64166 - DNA, 448 bp, Zea mays
  Clone ID: LIB3075-017-Q1-K1-A8
ccgtttgtctaagatatgcttgcaagatatcagcatatttgaccagatttcatttgaaaaatggtcttaccccttgcccacattgattaaagaggaagttttaccaaagatatgtgatttgcaagacagattcgaccagctcaatgcactaaacattcagctggaaactgaagttgcagtcctcaaggatggcatgaaagagctggatgaagatcttggaacttcgcgatctgagcttcagaaaaaggtttctgaacttgaacagttagatcagaaattttcatctgtgaaggaaaaacttagtattgctgttgcaaaaggtaaaggtttgatagtgcagcgtgacagccttaagcagtctttgctggagaagtctggtgagatcgagaaactcacacaagaactgcagttaaaggaaacattgctgaaagagttggaagccaaactc

SEQ ID NO: 64167 - DNA, 241 bp, Zea mays
  Clone ID: LIB3075-017-Q1-K1-A9
gcgaaccactcgcatctgaggggaagaagtgcacggggactccgattggacaacatggtcttcgcctcgccattagcaatgtcttcccctctgctgctgctcatggaggcggagctggagaaggcacgaggcgaaaccagggagctggaggaggagcggcgcctcatgaccaaacgcctggaccgcttcctgcggaggctggccgaggagaaagcggcgtggaagtcccgggtccgggaca

SEQ ID NO: 64168 - DNA, 383 bp, Zea mays
  Clone ID: LIB3075-017-Q1-K1-B10
caatgccccacgaggaatctgtggcattatcagcggttggttctgcaatcaaagtaaaagctgctgccattgttgtgttcacattctcagggagagctgcgaggttagttgccaagtataggccaacaatgccaattttagcagttatcttcccacgtgaaggatccgatccatcaaagtggcgttcttatggcacaacacaggcaagacaatgtttcgcagtgagaggcgtgtaccctttgatggggagtactgatgaggccgaaactggtgggctaacaaaggaagagtatgggataaaacttgcgatgagctatggtcggtcggttggcatagtgaagcctttcgacaggttgataatctttgaaaagattggtgattct

SEQ ID NO: 64169 - DNA, 444 bp, Zea mays
  Clone ID: LIB3075-017-Q1-K1-B11
cccacgcgtccgctcatttcgccctccctccgccggctagggttactgccaccggcttccacccctccccgactgcccgtgggtggaggaggctggttggcgtgcagggtacctcggcggcggagatggagccggacttctcgaccgtgggcgggcccagctttgagttcgctttcaacgaggccaacttctccgaccgggaattgcggatcgaggtcgtcgcgggggattacgacgcgccggggtccactggcggcggttccggaggaggtggcctcgccgactgggcgcgccatcggaagcgccgacgcgaggagctcttcaaggagaaagaatctacaacctacatgtcagaccaaactaattttaatgaagtcgaagcagaagagtgtgatgcatatgaagaaaatcaagaggaacctgtagcattgatggaaggatctc

SEQ ID NO: 64170 - DNA, 170 bp, Zea mays
  Clone ID: LIB3075-017-Q1-K1-B12
catcgatcacgacaagatggcgtgcacagacaatgcgatgagagccttgttcctgctggtgctcttctgcatcgggcatggtgagaaggaagagtcaaagggcatcgatgcgaaaacgtccgggcctggtgggtccttcgacatcaccaagatgggcgcctccggcaatg

SEQ ID NO: 64171 - DNA, 291 bp, Zea mays
  Clone ID: LIB3075-017-Q1-K1-B2
caatgagccatctcagcttgacatggacctgtacgctcaggggctggctcgctatgccgttagctgccaggataatggcctggtgccaaatgttgtgcctgaaatccttgttgatggcactcatgacattgatcgctggtcttacgttattgagaccgaacatgctgcctgcatacaatgtgctcaacgagcaccatgtgatcctggatggtactctcctggagctccaacatggagacatacaggctccgactctaagtacgtgactcatgacgtgattgctgatgacac

SEQ ID NO: 64172 - DNA, 371 bp, Zea mays
  Clone ID: LIB3075-017-Q1-K1-B3
cggacgcgtggggagccggatctcttggtcggagaacctgcgaggaaggactaaggagtcgaagatgactgcggcggtgctgtccgtgcgcacgacgacgacgtcgctgctagcagcagtcatcctgtgcctctgcatcgtctccctctccccccgcggcgccgctgccgcgcgggtctcccccggcgccagcccgatcgtggccacctgcatgacgggcccgtacccggagctgtgcgtgggggagctgggacagcggctgctggacgtgcagacgtcgatcgcgtccgcggcgcccgaccagcgcgcggccaggatcgcgggcgccccggtgcaggtggacgtcagggcgctggtggccgtggcgcttg

SEQ ID NO: 64173 - DNA, 312 bp, Zea mays
  Clone ID: LIB3075-017-Q1-K1-B4
gctctcttgaatggttagtggcccatgtatttattgattgtttgcttgtacatatatgctccggcatccggaccttagtatggcctaatcctcactatgtatcatacataggaagtgaatgggagccaatataattttgctctagacaattttagcttgctttctgaacccttaggtaagccttcaagatagtgaaaatgttaagtgagtagcttacgagctaaataatggctagatattctcggtaaaaaaaaaaaaaaaaaaaaaaaaacaaacaaaaaaaaaaataaagaaaaaaaaaaaatgacattt

SEQ ID NO: 64174 - DNA, 432 bp, Zea mays
  Clone ID: LIB3075-017-Q1-K1-B5
cggacgcgtgggcggacgcgtggtaattaggttccgtgaagcaacccttgttagggatggtgataagaaaatacgttatgctgttcgcaaagaagtggcactcatgatgcagcgtcggaaggggcaatttgctggaagttccattttggacggagaatctccagctcctggatgtgatcctggttctcagggctcaggcctagattttgcatctcgataatcaatgtgccagaactgtggtactagtgaaaaaatgaccccagcaatgcgtactggtccagcgggtccaaggactttgtgcaatgcttgtggattgatgtgcgcaaacaagggtaccctgataagttgccccatggcaaaagttgaatctcctgcggttgcaactgagcagggaacaagtgacaacaaagcccttgcaacactgaataataa

SEQ ID NO: 64175 - DNA, 404 bp, Zea mays
  Clone ID: LIB3075-017-Q1-K1-B6
ctcgccggcgcggtcgctgcgcgacgagtacaacatgcccgacaacgccctccgctgcggcaaggtcgtggggctgccgctgccgccatcctacgcccccgcgcgctaaagacgacgaaggcgccgttttcacctcgtgttctgaccatccagtctaactaatccattcctgtgctgctcggcgaaataaaatcatcaaaaagaacaaagacgaaggaagcctagggaagggagaagggacgttgggtgggggtgagccaaatgagaacgcacggatatatctattgatgtaatcttgagatgccctctcaaatcactgtaatggggtttaaaaaacaatcattgtaatgggagttatatatacttttatcttaacatttatttacaccagcaagtcctggtgt

SEQ ID NO: 64176 - DNA, 414 bp, Zea mays
  Clone ID: LIB3075-017-Q1-K1-B7
cgttcgttcctcaagtgatcttaatcgtcgagaagttaccagctagcggagatcatcggcaatgtcgaacatggggcaatccttccaggccggcaaggcgcaggcccagggcgagtgccaggcggagcgcgcagcgcagtgcgttagggacggcgccggcgccaccgcctgcgccgtgaccgacaccgccggagccgcggccgacagcgcgcagctgcaggagcaccgcgccgccggcaccgttcagcaggctgctgagcaggtggcgcagacggcggcgggcgcggcggcagccgtcaaggacacggtggcgggcgcggcggcggccgtcaaggacacggtggcgggcgcggcggcaggcgccaatgacgcggtgaccggcggccactgaccgactcacgcgcgtgaaccgga

SEQ ID NO: 64177 - DNA, 325 bp, Zea mays
  Clone ID: LIB3075-017-Q1-K1-B9
cttgctcaaaaaaaaaaaaaaattaatatttaaaaaaaaaacaaaaaaaaaacacggaaggggccaaaaaacaacgtaccgagagccgacaaatggcaacggaggcaaaagaacatctggaaggccacgccggcaacgtactgtgacgaggcatcggcggccgcgaatgggatgagctgctgctggggcgaagtactttggccgtactacctgtaatacatccatgacctgcagctacagatccggcagaagacccataacctcaaccgactcgaggtccaccttaacgacctgaacttcagagttagaatgctcagggatgatt

SEQ ID NO: 64178 - DNA, 380 bp, Zea mays
  Clone ID: LIB3075-017-Q1-K1-C1
catctcttacctgggattgttctattcactatccggtggtggaatccacaaacatttgctgccatgcacccagaaggaagagatgctagagtcacatggccatatgtggaggacaaatcatatctgtggacatggcttttttttgttccgctagctgcttacaccctgtggcaacttatgtatttcctcatagttaatgtcctgcgtcgacagaggttgttaagggaccctgaagtcatgacatcctacagggagctctcgaagaaagcacagaaagcgaacaacatctggtggaggctgagcggactgctgggtgaccggaaccggcaggtcatgtacatactgctccaggcgctgttcacagtggcaacaatggcact

SEQ ID NO: 64179 - DNA, 397 bp, Zea mays
  unsure at all n locations
  Clone ID: LIB3075-017-Q1-K1-C10
ggcacgggcaagaagaagttcgtgcgcatgctcatgagcgccgaggagaagttgccaggcaaggtgcgcgccgtggtcaagttcaacgcggcgctggcgcaccacatcatggccggcgccgacgtgctcgccgtcaccagccgcttcgagccctgcggcctcatccagctgcaggggatgcgatacggaacgccctgcgcctgcgcgtccaccggtggactcgtcgacaccatcatcgaaggcaagaccgggttccacatgggccgcctcagcgtcgactgtaacgtcgtggagccggcggacgtcaagaaggtggccaccacattgcagcgcgccatcaaggtggtcggcacgccggcgtacgaggagatggtgaggaactgcatgatccangatc

SEQ ID NO: 64180 - DNA, 419 bp, Zea mays
  unsure at all n locations
  Clone ID: LIB3075-017-Q1-K1-C2
cgccgtcaccatccgcgccaccatgggcatggcggcgcaggacatgcagaactgcgacgagcagttcaggcagatcggcgagaagaaccccatggagcagttcgacgcgtcgctcgtcgagatgtccgagaactgccgctcgctctccaacatgatctgatcgatctccttctccacggacgacaacagagagccgggcgttttgggccctcgcatcgtttgtcgccgctgctaacgttcgcatgcccatgcccgcgagcgcgctctcgcgcgacaataactgatgagttaagtttgttttgctttgaccatctcacatcgttatttcctgtagagatgcgttaatttggtctcggaaacggngaggcgaattgaggtggaatatttataattcaagaaacacaggtttggttctagaa

SEQ ID NO: 64181 - DNA, 424 bp, Zea mays
  unsure at all n locations
  Clone ID: LIB3075-017-Q1-K1-C3
gtttggcgtttaatttggactggcgaataaaatgcaggcccccctgctgctgctgcacgtccgtcaaatagattggtagggagcccagagggtgatgggaatggcgaaggagcagcacttcgtgcttgttcatggcgaagggcatggggcctggtgctggttcaagctccgctggctcctcgagggcgctggccaccgtgtcacgtgcgttgacctggccggaggcggcgtcgatcctaccgaccccaacaccatccggtccttcaagcagtacgacaagccgctcatagacctcatcttcaacttgccagacggagagaaggtgattctgatcggacatggcgcttganggctgagtgtgatccatgcaatgcatgaaattgntgacaggatcggtcaagcatttttcgtggccgcacaatgc

SEQ ID NO: 64182 - DNA, 339 bp, Zea mays
  Clone ID: LIB3075-017-Q1-K1-A6
caaaatacgtctgcgaatgcaggagccatgtcctcgcggactcctgcacacacggctacggctattgcgtcaacgacttatgccagcggcacatcctgccgctctgccaagaggtcgactggctcaaacatcacaaccacctcttgaaactaatgtatggacactactacgacatcgtcttgcaagtcgacaagtacccgtacagattacaactgcgtgacctgctgatacaatgacgtgaacaagatgaccatccataccatatgcacaggccgcaccatcgatatgttaaactatggtgcaaaccgagcgtcctgctcagatatcacgtgctacaca

SEQ ID NO: 64183 - DNA, 356 bp, Zea mays
  unsure at all n locations
  Clone ID: LIB3075-016-Q1-K1-F12
cgcggcgccgcgcgggagcccccanaaatgccgaggaggaggcagcgtacaccttctgcgctcgctgcgccggcctcccaatcgatcgaggcggcgcagagcagaggaaaaccccgagccgcaaccctcctcaccgcacagcaactcgagtcctcgttctcttccccatcctcctcctcgtcaactccagtcgtcttcagcccttcaccacaatcaggcccacctccgaccaccacatttcttctcatccaaccgccccgtaggatcacagagaagggggatggcgagcggcggggcggtgagggatgtgggctcgcctgcggagctggaggcggccgtggccggggcgcgggcgg

SEQ ID NO: 64184 - DNA, 377 bp, Zea mays
  Clone ID: LIB3075-016-Q1-K1-F9
gaccactctcatggtcatggacacgggcatgaggcatcatcatcgtcatcttcacattaagttgcttactggctgcggacgatgcttggcatgttccaacagctaaagtttgagttaataaattctatcaccctgcatgggactcatgttgtttgcaactggtttagcacgaactggtcttgttactattgtgctaatgtatttgtttcgaagtttcagttaatatgctgtggaaaagaatctggtgcacgttgatgttctttatgatctgttgttcagtacattgctctgcttcgttgctacgttaagaatatatatatactaacatcagaaaaatgtatgtattttatgggcttaatagattcagaactgggaag

SEQ ID NO: 64185 - DNA, 404 bp, Zea mays
  unsure at all n locations
  Clone ID: LIB3075-016-Q1-K1-G10
gcgatggctggagcccgggcactgctcatcgtcctcgcggctgccgtcgcggtcctgggcgcgcggccggcgtctgcaggcgggggagccgcggcggtggcggacatctgcatgaagactccgtcccccgacctgtgcaccaggacggcggggaagcacgccaacaagtacaaggtggtggacgcggtgacggtgctagagatgcaggtggacgcgttcaagaagcgcgtgaaggcggcgcggaggctcgccaaggaggaggtcaagacggccgcgacgcccgaggcgcggagggcgctgaacctctgcaagacctactacctggacgccgncgacaacctcggcgcctgcaagcgcgccatcggcttccgcgacgccgtcaccatccgcgccacgatgagcat

SEQ ID NO: 64186 - DNA, 383 bp, Zea mays
  Clone ID: LIB3075-016-Q1-K1-G11
cggacgcgtggggtcggagcagagagatacttcctcgcctccatcccatcccgccgccgccgtctctacggtcgctaataagcagccgcatccagggatggagatgaagaagatcgcctgcgccgtcctcatcgccgcctcggccaccgtggcgctggccgcggaggcgccggctccgtctcccaccagcggctcctccgcggtcgcacccgccatcgtcggggccgccgtggcctccttcttcgcgtactacattcactgagccgccggacgaggagccggagccggagggaagagaccaaggtggggggagagacttggctgcgctgcgctgctctgctgctcccgcgcattcccgatgcgtgggcgtgctctgattgggc

SEQ ID NO: 64187 - DNA, 384 bp, Zea mays
  unsure at all n locations
  Clone ID: LIB3075-016-Q1-K1-G12
acaatccttgcacccctcccctccgtcttcccaccacatccggccagcccaacgaaaatgtcgcgcgccacagctgcggtcctcttctacatcctcgccgtcgctgccctcagcgcggccgaggcaccggcagagtcaccgaaggcaggcagtcctgccaaggcaccggccgagtcaccgaaggcaggcagtcctgcagctcctgccaaggcacccgagtctgctgccacgagaactgcccccgctaaggcacctcaagccgcctccacccccgccgctgccgctgccccatcgtcgtcgtcgtctaagaagtctggtccagctgccgcgccgaccaccgccgnctgtacaccgtcttcttccacggacgangagttgagccct

SEQ ID NO: 64188 - DNA, 407 bp, Zea mays
  Clone ID: LIB3075-016-Q1-K1-G9
cccacgcgtccgcgcgtgcgctcgccctgtgcctctcgcgtgcggaagctaggcaaacggccggcgccctagctaggtgcccaggccatcgtcggacccttcgccaagccatcgtcggggtctcggggattagcacccgcacccacaagatggccacaccgaacggtccttctgcttctccgatggtgtaccctgtctacctttctggggtatttccccagcaaggcggggatgatcaggctcaacgtccatggatatatgccatacaacagaaccagttagcagcggcgatgggaatgggttgctatgctacaaccacactcattcccctcacttacaatatcccaacagaaagcattggtgctcctgctggtgaagagaatgtacaggatgctaggcagcaaaat

SEQ ID NO: 64189 - DNA, 376 bp, Zea mays
  Clone ID: LIB3075-016-Q1-K1-H10
gcgatgggttatccatgaaaatctttttaatttatttggcataaccatccaaccccgtgatggggtaatgaagaaagggggaaaaaaacaagaaaatgaaacttttgtatatggaaggaaaaagctcaaaacaaatgaagaacatgcttatgtgctgattaagtatccaataaatgatctgctggtgaggcccaatgcagatgatccgtctttatttaaaaaacctcttctggctacaaattttatagtaccaagatgttctgtgggacatctccttattgtatgacacttatgctcgtcttttgggaaggctttgaatatgcctccaatttcgctaacacatctggacaatgcaatttgccacaaagaaaacaat

SEQ ID NO: 64190 - DNA, 412 bp, Zea mays
  Clone ID: LIB3075-016-Q1-K1-H11
cccacgcgtccgcccacgcgtccgcccacgcgtccgcccacgcgtccgcccacgcgtccgctccttcctctcaatggcggcgccccagcaatccgctcccctgtccgggtcggcgcccaagaggctcagggcgatggccacagacgccgctgcagtgccgaatcccccagcctctagtggctgccccgcgatgaaggcggagttcgccaagcacgccgagtacctcaacaccctgaatgacaagagagaaaggcttgtgaaagctagtcgggatattacaatgaacagcaaaaaggtcatctttcaggtccacagaatcacgaaagttaacagggacgaagttctctcgaaggcagaaaatgatcttgctgcagttgttaatcaatacattggcaaactagtaaaagaatta

SEQ ID NO: 64191 - DNA, 383 bp, Zea mays
  unsure at all n locations
  Clone ID: LIB3075-016-Q1-K1-H9
ggccaccatgggtttgcgtgggggaggagaatcggcggctcgctggccaggggagcacgactggaccccggcgaggccaaggttgatgaggacatcactatgactacgactacaccagcagcacctccacatcaagcgccacttccttcattagctgggccaatcactcgggcccgtgccagagatcttaacttcgtcatgctactgaagaatgagggcccagaagaatagacgaccaacccaactgcggcccatagtggacgacctanggatggccgcccctaggggttgcgccccctctctatttatcaaggagctacgcctcatttgttcttggagttttgttttacgttagctntagctactctcgaacacgcgcaaat

SEQ ID NO: 64192 - DNA, 368 bp, Zea mays
  unsure at all n locations
  Clone ID: LIB3075-017-Q1-K1-A1
agcctgctctgcactgccaaggtcccatgcaccggcgtcaccatggatgacgtcaacggcgagtatagcggcaccaacaacaagaccatggctatatgcacgaacgccaagggcagcaccaagggttgcctcaaggagcttgcatgcttctagaccctccgtcgactgacccatctctctagttataatttttctctcgtccttgcattgcatattagttgctatccattggtaacgcacaacagtaaaacgacaaacatccaacagctatattatgttcgacggtgtaacaccctgaattttagggtataaaatttcttctctaaatgcaaaccaaattcaggtgttaaaaaaaaaaaaccaanaac

SEQ ID NO: 64193 - DNA, 278 bp, Zea mays
  Clone ID: LIB3075-017-Q1-K1-A10
gcgagaaacaaggatggcgttaaggttttttgaaaatgatatactgtccaagatcgaagcagcaatgggacccatgggctggaacgttcagaagcgcaactataagctgaagctgcaaggggagaaccctggaacgaaaggtgagctggccatcgcaacagaggttatcgatggtcacgccttgcatgtacatgcgtgagctgcgcaagttcaacagtgacacccttgaataccacaagtgataccacatcatttaacatgggctgaacgacgtgatg

SEQ ID NO: 64194 - DNA, 325 bp, Zea mays
  Clone ID: LIB3075-017-Q1-K1-A11
gtcgccacctcggagcaatcaggtggtgaagctgaggccaccttagaaacaggtggtgaagctgcggccaccttggagcaaacaggtggcgaaaccgaagagccgaccattgtagcacctgctaatgaatatacagtgcaggaggctgctcctcagcagaagtgtgcaaagatacacgacttttgcctagggataccttttggtggacttttactctccatgggccttattggatttctcttctggaggagccctgcgagtcttacctttggtgttgcacctggccttgccatattggccctggctgtacttagcctcaatgtct

SEQ ID NO: 64195 - DNA, 406 bp, Zea mays
  unsure at all n locations
  Clone ID: LIB3075-017-Q1-K1-A2
cggacgcgtgggttttttttttttgggggaaaatctggatcttttatattataaataggtaaattacggcgatgatgaggggcaaatgaggtaggcaacagcgaacctaaccaactgaagaaaaaactctacaaatccacctacacccgcagggctttctcaacttcatcaccaagacatagattagggagggtacacattcatcacccatgttttatttccgacaatcaaatcccaacgagcatagcaccgaccgaactgacacatcgcatgcataatgtgttcatccctctctaggaggggggcaacaccgttctacaactaaaaaacccaaaccaactacaaatccaccgacccagagttgtcagttgacccattattcctncgnctgatcaacattacacac

SEQ ID NO: 64196 - DNA, 379 bp, Zea mays
  unsure at all n locations
  Clone ID: LIB3075-017-Q1-K1-A3
attctacgcgtggataacctggtcatcaccggcaagggaaaccttgacgggcagggcccagccgtgtggagcaagaactcctgcaccaagaagtatgactgcaagatccttcccaactcgctggtgatggacttcgtgaacaacggggaggtgtccggggtcacgctgctcaactccaagttcttccacatgaacatgtaccagtgcaagaacatgctgatcaaggacgtgaccgtgacggcgcccggggacagccccaacacggatggcatccacatgggcgactcatccgggatcaccatcaccaacaccgtcattggcgtcggcgacgactgcatctncatcggccctgggacctncaaggtgaacatcactggcg

SEQ ID NO: 64197 - DNA, 362 bp, Zea mays
  unsure at all n locations
  Clone ID: LIB3075-017-Q1-K1-A4
cggacgcgtgggcccgggtgcaacggcgtcttggtggacagcatcacctgcggccccgggcagggcatcagcgtcggctgcctaggccgctacaaggacgagaaggacgtgagcgacatcacggtgcggaactgcgtgctcaagaacaccaccaacggcgtgcgcatcaagtcgtacgtggacgccgagtccgtgctgacggcctnccatctcaccttcgagaacatcaggatggaggaggtggccaaccccatcgtcatcgaccagtacttctgcccgcagaaggtatgccctggcaagcggagcaactcctcgcatgtctccgtcaaggacgtcacgttccgcaacatcaccggcacgtc

SEQ ID NO: 64198 - DNA, 292 bp, Zea mays
  Clone ID: LIB3075-017-Q1-K1-A5
gcggcgagcgaattagaagatgctggacaagctgtgggacgacgtggtggccgggcctcgcccggagacgggcctcgagaagctccgcaaggccaccaccgcccgcccgctcgtcatcaacaaagacgcggacggcggcagctacaagcgggcgcagtcgatgccgtcgaccccgacgacgccggtgacgccgtcgtcgtcgtcgtcgtcgacgacgccgcgcggcgccggcaacgtgtggcgcagcgtcttccacccggggagcaacctggccaccaagggcatgggcgcc

SEQ ID NO: 64199 - DNA, 405 bp, Zea mays
  Clone ID: LIB3075-056-Q1-K1-C12
caacggcatgccgttctggaacaggcggcgcaacggcgacggcggcggcgaccagctcgttgtcgccttcgagacgtaccagcagctgagccgcgtgtctatccgggccatgacggccatctccgacctggaaacgatccacgaggacgtcgtcaccagcgcgcaccagaagcgagccgcgctcatcgtgctccccttccacaagctccaccagatcgacggccacatggagtcgcttggcgaccagtaccagcacatcaaccagcgcgtgctccaccacgctccctgctccgtaggcatcctcgtcgaccgcggcctcggcggtgtcgctcaggtggccgtcagcgacgtgtcatacaccatcgttgtcatcttcttcggtggccgcgacgaccgcgaggccct

SEQ ID NO: 64200 - DNA, 403 bp, Zea mays
  Clone ID: LIB3075-056-Q1-K1-C2
gctttatccagtggatcaccaatccgatcagaagtggagctattgcgtaaatctgttgaaggcatcgacaaagattcactgttagaactggctctttcatcactcccagaagatgttttagattatggatcagataccatgatggggttgaagcaaaagtttaactccttgaaggaaactatcagacacttcagccttctaccagcaggcggtggtggaatcctggcacatactgttgctcgagttgcttcttcaatcaagattaaaggcgataactctggagatggcattgagtctcttatcaacaaagtagaaaggttgattgtggatggagacttgattacagcggccgatgccttggagcaagggttacatggaactgaagcagaggagatagctaccg

SEQ ID NO: 64201 - DNA, 262 bp, Zea mays
  Clone ID: LIB3075-056-Q1-K1-C3
tcggtcaaagttcctttgtttctttcttgatttgtgcttgcgttgggttcggtgttcgatcggcgcatttgccgcatgggcgtggctgtcaaagttccttagcatctttcttagatatgtgcttgcgatgggttcggtgctccactttctttttatgtgattattaatctcgttttcagatgcatgtacacatgtatgtgcctgcaccatttggtcttgtgaaaacttgatcattgtattccaatctctagtgtagcaacct

SEQ ID NO: 64202 - DNA, 425 bp, Zea mays
  unsure at all n locations
  Clone ID: LIB3075-056-Q1-K1-C4
tcgcccactcgttcgcccactcgttcgctcggttcaacgaacgtcggcggccattcacagccggccggcacctgcccccctgccccacggttcaacgaaagtcggcaggttcttccctccaggcaagataatagtagcacctttgagcactgctgctgaaaatgagctgcgccgaattgccacctgaaaccccagctgtgaacggagaagggtcatctgccgccaccgtcgccgctcctggtgccgggtcgaagccgaaaaagaagatatgctgcgcgtgccctgatacaaagaggctgagggatgagtgcgtcgtcgagcacggtgagcctgcttgcaccaagtggatcgaagctcacaagcgatgcctncgtgctgaggggttcaatgtctgaaacttgtagtctgtcgggctcgcttttcta

SEQ ID NO: 64203 - DNA, 434 bp, Zea mays
  unsure at all n locations
  Clone ID: LIB3075-056-Q1-K1-C5
ggcgtcggagggccagtcgacctctctgctcgcgaaaaatggcggcggcagcggaaggtttggctgcctacagggcggtgctgcgggcggcgcggcggacgttcgcgggcgaccagctgatgctgaaggagtctgcggtggagatccggcgccgctttgaggaccaccgtggtctaaccccgggctccgacgatgcagcgcgtgccctcgccgacgcccgcgaggcggcgcacttcatcacccatatgatagtccaggccacacgcgcaccctccggatccttcgttgtgaagcctgagagtgttcatgctggagctacactggaagttccttccgaggagatcctttcaaagttgaagtangtcactagcattgctgaagtaggtcaccatcttcatgctagtaaaataagaccatgttgcaacgggtgattc

SEQ ID NO: 64204 - DNA, 366 bp, Zea mays
  Clone ID: LIB3075-056-Q1-K1-C6
tcaaggcgtacgaggactccgccttcgtgctcaccgtctccaagatccactacgagaatatcaagatggaggactcagccaaccccatcttcatcgacatgaagtactgccccaacaagttgtgtactgccaacggcgcctccaaggtcaccgtcaaggatgtcaccttcaagaacatcaccggcaccttcttcaccccggaggccgttagcctgctctgcactgccaaggtcccatgcaccggcgtcaccatggatgacgtcaacgtcgagtatagcggcaccaacaacaagaccatggctatattcacgaacgccaagggcagcaccaaaggttgcctcaaggagcttgcatgcctttagaccc

SEQ ID NO: 64205 - DNA, 273 bp, Zea mays
  Clone ID: LIB3075-056-Q1-K1-C9
ggggaggcaaagccgcgtagtgctggacgtcggctgcggcgtggccagcttcggcgggtacctgttcgaccgcgacgcgcttaccatgtccctggcgcccaaggacgagcacgaggcgcaggtgcagttcgcgctggagcgcggcatcccggccatcttcgccgtgatgggcacccagcgcctaccgttcgtcgccaacgtctttgacgtcgtgcactgcgcgcgctgtcgcgtaccgtggcacatctactgctgcatgctcctcctcgagct

SEQ ID NO: 64206 - DNA, 253 bp, Zea mays
  Clone ID: LIB3075-056-Q1-K1-D1
catattcctaagctatcatggtgcaccggtcttccatagccgatgtgcatgtgatgcgcatggatctaagcccaaagaaacccatcatggccagctccagcgactgcggagcctactactactggtcccacgccgatctgcccatgctcggcgttgccttcatgggtgccgacaagctctgcctcaccgtcagatgtcttgccctacccagctacttcgactctgccaagatcgtatacgtaatgcatggctt

SEQ ID NO: 64207 - DNA, 232 bp, Zea mays
  Clone ID: LIB3075-056-Q1-K1-D10
cggacgcgtgggtgtgaatctacatggatcagccaaaaatttaccagcttcatgtgcctgaaagccaaagcattcacctgagctgtggatgttcccacagcatgtcgtgccgactatgcgcacaccattgtgcatacttaatgcatcctacgattcgtggcaagccaagaacgttctaacacctagttcagttgatccgaataagacttgggcccaattgcaagcttgacat

SEQ ID NO: 64208 - DNA, 188 bp, Zea mays
  Clone ID: LIB3075-056-Q1-K1-D11
tcgcaaaaactgtcatcctttttcccaacaattgctcatttttcttttgaagaatctaatatcgaacccagagtattgtcaagggattgagttcgggcatttccgacgatttttcttcttaactctacagggcgtgtgccttatcatggatcttgggccatgaattcccttgctatgttctataaaga

SEQ ID NO: 64209 - DNA, 365 bp, Zea mays
  Clone ID: LIB3075-056-Q1-K1-D12
ggtgaggaagaaagttagatcccgccattaccgtgagaggggtgagcgcatccgaagtcgctccttggctctaccgatgtttggtggctttgggtgatcgccggagggcctggatcgtgttcgagagtggctgggcgcgggagctctctaggctggagcaattgctcgacggagcaattccgtcgccgcagacccgtctctaaccgtggttgagcttctgcgcgcacagttcacggtacttgatacatgttgggaattaggggggtagcagcacgttcactttcacttttacaattacgctgcccaggcgcatccatgattttaatttgaaacctattgtcaaaggaaagtttggttattttttt

SEQ ID NO: 64210 - DNA, 300 bp, Zea mays
  Clone ID: LIB3075-056-Q1-K1-D2
ctagcctagtggttgaggacttccgagtaacacctccaagtcctgggttcgatcccccctcgggagcgaattttcaggcttggttaaaaaaaatcccctcattgtgctccatccgctctcgggttacgatgtcttgtgcgccacccttcggttgggccgttgcagagtggacagttgacaccggcccgttagtgatggggggcagggttcggggattttctcggtcggaaccattgtttcggtctcttcttaatataatactgggaggacggtctttccctccccggccgagtttttttt

SEQ ID NO: 64211 - DNA, 270 bp, Zea mays
  Clone ID: LIB3075-056-Q1-K1-D3
gaaccagcagctcttcaataagagccagccagagaaactagtaaaactctcgacgccggcatccgagcgaacatgccaaccgaccgcgtccccaaggcaatccgtcgccgacgtaccaccaccaccgcaagagcgagatggagatgaagaggatcctcttcgccgtcctcgtcgtcatcgccgcctcggccaccgcagtgctggccttcaccgaggccgtcgtcgcgggcgccccaactgcctccgagtcgtccgcctaggctcccgctg

SEQ ID NO: 64212 - DNA, 202 bp, Zea mays
  Clone ID: LIB3075-056-Q1-K1-D4
tcggaagaagcataacttcatcaagctctatgtgctcagggtgttcatcatggacaactgcgaagagctgatccctgagtggctgagcttcgttaagggtattgatgactctgatgaccttcccctcaatatctctcgtgtgactcttcatcagaacaagatcctgaaggtgatcatttagaaccttgttaagaagtgtgtt

SEQ ID NO: 64213 - DNA, 394 bp, Zea mays
  Clone ID: LIB3075-056-Q1-K1-D5
acgctgctctgacggcttgggactgagcggagtgtgtcatacacttatggactgcttgcttagactgccgtgcctctcttattggatcctgtaggcatgacctatatgcctttctacatgaatgcatgctttgatgactatagggcactattctacacaactactgacggcacgtattgtatggaatctgtgctaatcttatgttacatgtactgcatgcaccagatcatactgatcacatttatagacactgcatcactaatattctatacattctatgagaggcgataatcgaacaattagtgtttcatttaataatagcgtttgactgtctctatgttaaatttggactatagactacattctacactcgcaatctttgattaatgcatat

SEQ ID NO: 64214 - DNA, 438 bp, Zea mays
  Clone ID: LIB3075-056-Q1-K1-D7
ctcgacctcggaccgtgagcgagaacgcatgaggaggccgtcaccatgaagtagagagaggaagagagcaaatcacgtcaccggttgattcgtgatgtcaagtccccggtgggcgatggggggatcaacaatattattcgcacgtggttgtggcctttccaagcggggagatccaccagtgattccccaattgctcgtcggagtactttcaacaccgtgatgtcgcgggtcgtcgtgggccggctccccggaactccatggccgtagtgaggtcacaagtcacctgaagagcaagttggtacctggaatctcaagtctcatgtcaagaacaggttccacatgatgaggcgcatggaggatgttgtgatgagttcgtgagaggtctaggccgtcgtctcccagttaactatgggtgctagatcattttcttcatatgat

SEQ ID NO: 64215 - DNA, 113 bp, Zea mays
  Clone ID: LIB3075-056-Q1-K1-D9
cggacgcgtgggcatataaacaagcgcacactaacaaatatcctttcgccaataaggggcgatagatccttgattgggctcgctacggcaatgcttgctactagtacccgtgg

SEQ ID NO: 64216 - DNA, 406 bp, Zea mays
  unsure at all n locations
  Clone ID: LIB3075-056-Q1-K1-E1
acgattcactggtgtacagtccacgcagcatcgcgagggccacaaccaccggcatccctgtcggcgatcaaggcgtggccgtgctacgtgggccgcttatcgtgggtgcagggccggcgggtctggcatgcgcggcgttgctcaccatgttatacattccctacgtgctcctagagcgcgacgtgtgcgtagcctcaatgtggcaccgtcgcacgtaccgcaggttgtgtctgcacctacccaagcgctactgtgagctcccgctcatgcactttccacgcacctaccccacatatccaacccggcagcagttccttgtctacctcaatgagtacatgcgcgcatntggcatcctgccatttttcagcctcgaggttgtcgctgccgagtacaacggtgaatactg

SEQ ID NO: 64217 - DNA, 328 bp, Zea mays
  Clone ID: LIB3075-056-Q1-K1-C11
gactccgtcctcccacactcctcgcccgacggcgacggcgactgcgtcgacgagaggcaagcgtctccggcgggcggagacacgtgtcgttcggcgacctgagcctcgcggagtggacgtcgttcctggagaggttcgagcagctgctgccagctgcgctcgaggacacgaagtgcgctgtgctagggacgtcgacgttcgcatcgttctgaccgggctacgcactggtcaatcactaccgacaccatttgcatgcatacatgcgtgagtgcgtgcgtgcgtggattcaaaataatacacgtgtgcatggtttcttactagggaccta

SEQ ID NO: 64218 - DNA, 78 bp, Zea mays
  Clone ID: LIB3075-056-Q1-K1-E10
cggacgcgtggggcagtgggagatcgagctcgggtggcatgaggcggacgcccggcacgcctggattctcaaggacgc

SEQ ID NO: 64219 - DNA, 350 bp, Zea mays
  Clone ID: LIB3075-056-Q1-K1-E11
gagcagcatttcgagtaacacagttgagcacgacgatgggatccctcgctaataacatcatggtcgtgggcgccgtgcttgcggcgcttgtcgtcggcgggtcgtgcgggcccccgaaggtgccgcccggcctcaacattaccaccaactacaacggcaagtggctcaccgccagggccacctggtacggtcagcccaacggtgccggcgctcctgacaacggcggtgcgtgcgggatcaagaacgtgaacctgccaccctacagcggcatgactgcttgcggcaacgttcccatctttaaagacggcaagggcttttgctcatgctacgaggtgtgatgcaaggaaaaa

SEQ ID NO: 64220 - DNA, 437 bp, Zea mays
  unsure at all n locations
  Clone ID: LIB3075-056-Q1-K1-A6
ggctggactatccgctccaggaggctgaagttagcatcggggcaaccaggtccactcgtcaggtctgcctagggtacgtcgacgacgacgaggacggggaagaggtgcctcagaactaccggtcgttcggggcggtgggaaatgtatttagaccaaggatcgggaggcggaaccgtcgccagcctcctggagtgcacgtcctgcaccctcagacaagacccggcggctggatggagatggagatgggtgagttcaggaacgaggaagctgaagatggcgaggtgtccgtcagcctcatggagaccaggggcggcaactggaagagaggtcttactgtgcatggcattgagatcagggtcaagaagtaaggatgtgaaggctgtggngatcgggctttgcgcatcaaaacatataaaagtatcttagttagatttggt

SEQ ID NO: 64221 - DNA, 446 bp, Zea mays
  Clone ID: LIB3075-056-Q1-K1-A7
attctgattatgagacgaaaccaaccttaagaaagtactcatcttcttcgaatcaccaggttaaggtgaataataaaatcagttctaatgctaagaggtcatcagctaagccccctaagaagtcatccaagaaaacaaacctctcaagccagaaacttagagctctctcttccatctccactgcaaaaaaccatcatggagaaggtggtcaagcgaaggcaaattggcacaatgacatatttggtggtttaatcggatcagaaggagcagttcctctagtgacatgtgtcccaacgaaggttgtgttcactaggatattggaagcagttggaaggccacctctgtctgccgctcgccgtgttagaatggctagtcctccggtacgagatcctccataggcttcaactgtagtgctacatgcggtttatgtcgccagccatcgacat

SEQ ID NO: 64222 - DNA, 292 bp, Zea mays
  Clone ID: LIB3075-056-Q1-K1-A8
tcgggagaccttcgactgcctccacaggggggatgtttcaaagcgcaaggttgagcatgccctgaagaagatgtgcagggagggctcatattgggggactgttgctggcgtctacgtgggcgtggtgtatggcgtggagagggtccgtgggcgcagtgactgggtaagaagatgttttgaacttgattcattcgactgccagaagaacttcttcttcttctgctgctgcactcgtgacccccctgcagaagaacgcgatggtcggaggctccttgtccggcgcgctggtctt

SEQ ID NO: 64223 - DNA, 431 bp, Zea mays
  Clone ID: LIB3075-056-Q1-K1-A9
cttaagaagacggccaacggcgtccgcatcaaggcgtatgaggacgccgcctccgtgctcaccgcctccaagatccactgtgagaatatcaagatggaggactcgggctaccccatcatcatcgacatgaagtactgccccaacaagttatgcaccgccaatggtgcctccaaggtcaccgtcaaggacgtcaccttcaagaacatcaccggcacctcctccaccccggaggccgtcaacctgctctgctctgccaagatcccatgcaccggcgtcaccatggacgacgtcaacatcaagtacagtggcaccaacaacaagaccatggccgtatgcaagaacgctaagggcagcgccaagggttgcctcaaggagctcgcatgcttctagaaccaccatcgacccatctctctagttatacaatgtgtttg

SEQ ID NO: 64224 - DNA, 237 bp, Zea mays
  Clone ID: LIB3075-056-Q1-K1-B1
ggcaggttgcatttgcatctgagttcctgattgttgtattccagtttcttctgtgagttttgtgggatcgcgaggaggaaggatgtcgtgctgcggaggcaactgctggtgcggcgcctgctgcaagtgcggcgccggctgcggagggtgcaagatgtacccggacatggctgagcaggtgaccaccactacccagactctcatcatgggtgttgcaccgtccaagggcgggttcga

SEQ ID NO: 64225 - DNA, 327 bp, Zea mays
  Clone ID: LIB3075-056-Q1-K1-B10
actgaaaacagccgagcgatctcctctccctctccctctccgatccattctccagcgcagcgaagtaaacatgtctgaccgggcaaagatgtcgtggcaggcgtacgtggacgagcacctgatgtgcgagatcgagggccaccacctcgcggcggcggccatcgtcggccacgacggtgccgcctgggcgcagagcacggcgttccccgagttcaagaccgaggacatggccaacatcatgaaggacttcgacgagccagggcaccttgcgccgacaggcctgttccttggacctaccaagtacatggtcattcaaggcgagcctgg

SEQ ID NO: 64226 - DNA, 215 bp, Zea mays
  Clone ID: LIB3075-056-Q1-K1-B11
catatattcagacatttcatatcggttgcaaacttccattcttagaatctgtcagacgaaaacttctggcaattgagggcgtgccatattgtctacataaagatatgcagcttatcaaggcctttaatcatattaaatctacaaattgccagtctcatatatcaaaacgtattgacatggttgtatatgcttactgaatggccttttggtgccta

SEQ ID NO: 64227 - DNA, 440 bp, Zea mays
  Clone ID: LIB3075-056-Q1-K1-B2
cttgcttcggtgccaaaccctctatttgatcttgccggtatcttgtgtggacaatttaacatccctttctggaagttttgtctagcaactttgattggaaaggctattgttaaagtttgtatccagactacattggtgattactctctgcaataaccaacttcttgatttggtggagaaaaggcttatatgggcatttagcaatgttcctggagtggcatctgtccttccatcttttgtttccaaactgaagatggacaaaaataagtttttatcagcccatgttgctgcatcagcttctacttctgttaagggaaagaagtggaatctgtcattctctttggtctggaataccctggtgtggctcatggttgcaaacttcattatccagatagttacttctacagcacatggttatctcatgacacatcatgagcgaga

SEQ ID NO: 64228 - DNA, 434 bp, Zea mays
  Clone ID: LIB3075-056-Q1-K1-B3
cggactcgtgggcggactcgtgggggatcttgaaaaggctgacatgtggttggggaacctactgctggaacacagcgaggatatatacaggatgaaaggtctgctttctgtcagtggaatgccgcatcgatttgtctttcagggagtccatgacattttccagggatctcctgagagaatgtgggagccaaatgagccgcgcatcaacaagattgtcttcatcggcaggaacctcaataaagaagagctggataaggggttcaaggattgcctactgaagaaatagagtgatttcagaatagtcgggatatagatctccagttttggccttcttcgaatgtagtcagattcacatcaattcatatctgttggagtggattgaagacagtgaagcttgaactaaattctaccccaattcatccgacatatgtaga

SEQ ID NO: 64229 - DNA, 215 bp, Zea mays
  Clone ID: LIB3075-056-Q1-K1-B4
cggactcgtggggacctgcatcggcttgccgcgacaaccagaggtcacaggagataattgactgcatccccggacatctgccatgggaggtaaccccggacggcgtccagcatctcgactgaccaataggacgtgccgggaagacgatcctcgatattcgtacacacggttcctcttggaataagactcacatgcgggaccatcattgacaagct

SEQ ID NO: 64230 - DNA, 375 bp, Zea mays
  Clone ID: LIB3075-056-Q1-K1-B5
cagaaggggaaaatgaggcatgggtgacaccgcggcggaagtgaccgagccacggcgaccgccggtgggatatcttcggccactcacggctgggttcgcgggatggtgccacgtccgaagttatctctccgtgatcgacccgcttcaccagatcactcaagcacatccagttcaacagtgcctcacatctttatccgcgttctgcagatatttacaatgctttgatgttcagcggtctactgaaccgaccacctatcatgcgcactttctcatgtttcttgttaagaacagggtagcgctccttaataaaatttgtctcccaaacaacattcttcaagtttgttatagggttcatggatcaattatgtatagatt

SEQ ID NO: 64231 - DNA, 433 bp, Zea mays
  Clone ID: LIB3075-056-Q1-K1-B6
cggacgcgtgggcaacggcaagaaggtcatggccgtccgcatcatgaagcacaccctggagatcatccacctgctcactgactccaatcccatccaggtggtcgtggacgccattatcaacagtggaccacgtgaggatgccacccgtattggttcagctggtgttgtgagaaggcaggctgtggatatctcacccctgagaagggtgaaccaggccatctacctcctcaccactggtgccagggagagcgctttcaggaacatcaaaaccattgctgagtgccttgcagatgagttgatcaacgctgccaagggctcttccaacagctacgccatcaagaagaaggacgagattgagcgtgttgccaaggccaaccgttgagtggagcttgtatcctggtgcacttgcactagaactacgtttctggcagtc

SEQ ID NO: 64232 - DNA, 400 bp, Zea mays
  Clone ID: LIB3075-056-Q1-K1-B7
attacatatgtgtctgccatgtccaagtgacggggcgctcgctctcaccagatttaatgatagacctctccgatgcctgctggttactcgaacctcaagtatctgccgggtgccggtaacttgcgcccagaagacctaatcagcattgacgccaaggactcaccggactggcgctcgcttgtttccaggtacaggcagatgaggcaactggccatggtgtacatgctgcttggacccgtgcagtttatggatgaagacgaagttgacttgcagatgtaagctttgttttccctgaaccggatcttgtgtatcctaattgaacggagcttgctctgataaatatagtgagaaaagatatgtgtcgctgcttaaaaaaataaaatttgataccttatactat

SEQ ID NO: 64233 - DNA, 432 bp, Zea mays
  Clone ID: LIB3075-056-Q1-K1-B8
cccacgcgtccggccgaactccctaaccctaagtccctaagcgtaggcggcggggggcggcggtgcgaggcaagctgcacagcaacacgggccacgggcgcggcctccgcctccgcctccacgcttctgctgctaggctgcaagggcggcggctcggctcggtgggcggcggacagctggccaggtccagcccagtagtccaggtgacgaggtccgcactccgcaacggttctggcgttctgcagctgaggatagacgagagaggaagtgaggatttatattagtgatttacaaggcaacttgaaagacagcagggttgcatcccacaatgtcagctcccaacagtgatagcaacatgcagcagctagtccctatagcaccaccaggaaaggcttctggtggtgacaggggaaggagctggttgtggcagat

SEQ ID NO: 64234 - DNA, 434 bp, Zea mays
  Clone ID: LIB3075-056-Q1-K1-B9
cgtctagccaaaagcatcgtcgtggtgaaaaagggagtcggggaggtagtgaattaggtcgtcgtcggtgatctccgtcggtgccagattttcgtcctcggtgtttggctgagaggggtcaccatcgtccgtggaagccgttcatggctgtggttggagtcaagtgcctatgtcgcggggtgaattgctcaccagagcagcggatccgcccatcgtcatggttggtctgcgccagcgataatcgacatcgacagacaagcaactgaggacccaggtgctcagtaggtggaaaatactgaccatgagctcgttgaaggtaaattgtgcccttgatcacttctatttacccaataatgttcctgttaatcattatgacctgcataggttaattttgatggtacccaatatgtcaccccagtttggctatccttttc

SEQ ID NO: 64235 - DNA, 303 bp, Zea mays
  Clone ID: LIB3075-056-Q1-K1-C10
gtgacctgcggccctggccacgccggtgatgttcaccttggaggtcccggggccgatggagatgcagccgtcggcgtgacctgcggccctggccacggcattagcatcggcagcctagggcggtacaaggacgagaaggacgtcacggacatcaacgtcaaggatcgcactcttaagaagacgatgttcggcgtccgcatcaaggcgtacgaggactccgacttcgtgctcaccgttttcaagatccactactagaatattaagatggaggacttatccaaccccatcttcatcgacatgaat

SEQ ID NO: 64236 - DNA, 419 bp, Zea mays
  Clone ID: LIB3075-056-Q1-K1-A4
atcgatcacgacaagatggcgtgcacaaacaatgcgatgagagccttgttcctcctgggcctcttctgcatcgtgcatggtgagaaggaagagtcaaagggcatcgatgcgaaagcgtccaggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggtgacttccttgtcggacaactcaacttcacaggcccttgcaagggcgacgtgaccatccaggtggatggcaatctgctggcgaccacggacctaagccagtacaaggaccatggtaattggatcgagattctacgtgtggataacctggtcatcaccggcaa

SEQ ID NO: 64237 - DNA, 152 bp, Zea mays
  Clone ID: LIB3075-055-Q1-K1-G7
ctggaagggccctgccaagaactgggagaacgtgctgctcagcctcggggtcgacgaccgctagccaagggtccgaagccatgagatcgcgcccgttgccaaagataaccgtgcccggccctgaaaaggtcggcctgcaaggcccctgatct

SEQ ID NO: 64238 - DNA, 298 bp, Zea mays
  Clone ID: LIB3075-055-Q1-K1-G8
tgaacatgcaggtggacgcgttcgccaagcgcaccgcgcatgcgcgcaagcacgtcgcgaggtcggtccgcacgattccggcgcagcagacgcaggcgctcacgttctgcgacaccatgtacatgaacacgcaggacaccatcggcgcggcgcagcgggccatcacgttcaaggacaccggcaccgccaagatcatgctgcagctcgccgtacaggacttcgactcgtgcgaccgtctcttcactcatgccggcgtccccaaccccatggggaagtttgacaaggtgctcaatcagat

SEQ ID NO: 64239 - DNA, 349 bp, Zea mays
  Clone ID: LIB3075-055-Q1-K1-G9
tcggccaagcgttcggccacacgttcgcggacgcgtgggctttctcctcgtgccagacaaggcaatcgaagccgagatacgacgatggactccaccggcaccggagcagggggtaaggggaagaagggagcggccgggcgcaaggtcggcgggccaaggaagaagtcggtgtcgaggtccgtgaaggccggtctccagttccccgtcggccgcatcgggcgctacttgaagaagggccgctacgcgcagcgtgtcggcaccggcgcccccgtttacttggccgttgtcctcgaatacctggccgttaaggttctgaagctggccggaaatgctgccagggccaccagga

SEQ ID NO: 64240 - DNA, 66 bp, Zea mays
  Clone ID: LIB3075-055-Q1-K1-H1
cagacgcgtggggcaatactagcatacattacttccatgcggacgcgaaaataaagaagagcacga

SEQ ID NO: 64241 - DNA, 209 bp, Zea mays
  Clone ID: LIB3075-055-Q1-K1-H10
gagacacgttcgaagacattgatcggctactctggaggtgccagtgagcaagctatgaggtcagccgccaagaagagctcgagaggcaatggccaccgcacggaaggatcctaagcaggttgataaagtcaacctgaaacccaacgagtctcacaaaggggtagtacggcatgcaagagtctgtgccgacctctgcggatcgcatatcg

SEQ ID NO: 64242 - DNA, 388 bp, Zea mays
  Clone ID: LIB3075-055-Q1-K1-H11
gcggcggatcacggaggcgaaggaggaggatcagcagcagcaggcggcgccgtggagcggcatcccactcagtgcttgcagccatggctaggggattgaagaagcacttgaagaggctcaatgcgcccaagcattggatgctcgacaagcttggcggagcttttgctcccaagccatcttctggacctcacaagttcagggagtgccttcctttgatcctcatcatcaggaacaggctcaagtatgctctgaactaccgtgaggtcatttctatcctgatgcaacgccatgtacttgttgatgccaaggtcaggactgacacgacctaccctgttgggttatggatgtcatttccatccttaagacattggagaactacaggctgctt

SEQ ID NO: 64243 - DNA, 277 bp, Zea mays
  Clone ID: LIB3075-055-Q1-K1-H12
gagacacatttgaaaccattgataggccatatataacagtccatatatctatatataatgtcagccgtgacaaaggatctggagtcgattcgcatgttacagaaggacattaagctgcttcttatactcaacgtgaccaccaatgaggctcacacagggagagaacgcgatacaaacactgtgcgaatccttgcggcatgcatatcgtcctgaaactgtgccaacgtctacacaactgaaggcttctccggtcataagttcacaatcttacgacctc

SEQ ID NO: 64244 - DNA, 373 bp, Zea mays
  unsure at all n locations
  Clone ID: LIB3075-055-Q1-K1-H2
ccaagaagcgcaagaagaagacgtacaccaagcccaagaagatcaagcacaagcacaagaaggtaaagctcgctgtgctgcagttctacaaggtggacgacgccaccggcaaggtgacccgcctccgcaaggagtgccccaacaccgagtgcggtgcgggtgtcttcatggccaaccacttcgaccgccactactgcggcaagtgcggcctcacctacgtctacaatcagaaggcgtaatcccatgcgccgctttgcttcacccgcctacctatcaagcattcacctgttggttactcgatttgaatatcatttagatctgtttgaggttggaacataaatgcagcagtagtttctggcatattatattcntt

SEQ ID NO: 64245 - DNA, 338 bp, Zea mays
  Clone ID: LIB3075-055-Q1-K1-H3
aggcctacggacggacctcatgggcatagtactcctgtgaagggctctatggtccaacttgactgatgccaaggtaggtcagcgcacggagcctgcctacattgcttcagtaacattctggccgctgcttgtctccctagctttcatcaccttgccgaaaaagtgcgggaatccgttgcgagcctgaatggatcatactaatatcatgtcattacaataacatcaagcaacattctttgagctacgaaggccatttttccacgggtcgtcacagcttcctgtgtacagtatcattcaccgatcatcagcaaacatttggggcgcctggataaactgat

SEQ ID NO: 64246 - DNA, 382 bp, Zea mays
  Clone ID: LIB3075-055-Q1-K1-H4
agcttctgcatgaagtagaagatttcaccaagagaaaatttggcaaggagaacgtggatgaaggtgcacgagatgcgtctgagatcttccggtacatagaccatgtccgaacatatcctaccataatgtttggaggaattgagggctctcaagtctgcactgtggcctttcagcgggtgtgactgaaagctgaggcacacatagttcttggcctgacgtgtcacgttgggtccagaagaaatggataaaaaattttgtgcttcgcctgtgggactgttcctaccgtattaaggaacagtccaaactgtgtcttcttctgttgttagctcatctatccaggatggtcgtgtaattttagatggaccagactatgagacgaatc

SEQ ID NO: 64247 - DNA, 190 bp, Zea mays
  Clone ID: LIB3075-055-Q1-K1-H6
agcttctgcatgaagtataagatttcaccatgagaaattttggcaaggacaacgtcaatgaaggtgcacgagatgcgtctgagatcttacggatcatagaccatgtccgaacatatcctaccataatgtttggaggaattgaagtctctgaagcttgcactgttgccttttagctattgttacttaaagc

SEQ ID NO: 64248 - DNA, 372 bp, Zea mays
  Clone ID: LIB3075-055-Q1-K1-H7
tccacagcaataagcttcatgagataattgctcctgtcaagagatctatgagccaactgactcgataccaagggaggtcagtctggttgctggcctacattgctttttgtaacatccctggccgctgcttgggctccttagcttccatcaaccttccggaaaaggccaaggattccgttccagcttaattgatccatactaatataaggtaataccaataccataatgcacaatcctttgagcttccaaaggcaatttttcccgggtcggcacaagttccggggaccggattaataacggttattaacaaaccttgggggcccctggattaaccggtacctttgaaattggaatggaatttacaccaaatta

SEQ ID NO: 64249 - DNA, 371 bp, Zea mays
  Clone ID: LIB3075-055-Q1-K1-H8
gcgggaggttctagccgtttcctcctcctacagtccactcccactccgcagtgggacggcgccgccgccgccgggttctcgatcgggctactcccttcccttcacttcccttccttacccgccgccgcggcacacggtgcacgtggatgggctgcaaggggtccaagcacgcgctgcacgggggctgtggattggcggcgcgagcgccggagccgcagagtcgctcgggccgactggcgccgcggcactccgtggtcgcgctgcggtcgtccacgctcggaacgctcagcctcgaccgcgccgtggcggccgtcgcggcagcgggcctctctttcgacgctgcagcaacaggaggaggaggaggaggagga

SEQ ID NO: 64250 - DNA, 237 bp, Zea mays
  Clone ID: LIB3075-055-Q1-K1-H9
gagccatatttgaaacagttaagaattcatatataagagtgcatatatatatatataattctgccaagacaaaggtaatggagtcgtcacgcatgttccagccggccatcatcctgcttctcctgctcattgtgaccaccgatgtggcgcatgcggcgagggaatgcgagaaggacagcgagcgattccttggtgcatgcatggcgtctgacaactgcgccaacgtgtgccgcggtg

SEQ ID NO: 64251 - DNA, 415 bp, Zea mays
  unsure at all n locations
  Clone ID: LIB3075-056-Q1-K1-A1
gtaacacataacaggtatttgtttttgtggcagcagagtatgagactcgacaaaatgctttaaatcaagtttccctttgggatggcattatacctgcaaaggagcatgccaagtttttgatccatacaacaaataagtacagatttattgaccagggaagcaatctaaagggcaaggaattcaacttgacaatgcactggcacattatgccaaagactggcaaaatgtttgcagataagatagtcatgacaggctatcagcttcctgagcagtacagatagtcatatagatcatgaacagtatcagaggcctgcaagaagtgatagttgcatagctgatgctgaactttntgatctaatctagttggaacatgtaatcttataagcttgtacttaagctgaaccaggcaaaacta

SEQ ID NO: 64252 - DNA, 277 bp, Zea mays
  Clone ID: LIB3075-056-Q1-K1-A10
tcgcccacgcgtccgcccacgcgtccggcaaacctgcagtcatctcctccatcaccaccgaagtcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggctgatgcgaagaagatccaggacgacttctgctcgacgctgtgcgagggcaagaaggggacgga

SEQ ID NO: 64253 - DNA, 392 bp, Zea mays
  Clone ID: LIB3075-056-Q1-K1-A11
gcaagggcgccgcgcggggtattctgtccgtcgctgaggatagagagttacttgcaccgggggagccgagatgaagccggttgtggggatcgtggtgtcgatcaagatgcagaactcgctggtggttgtagtggaccggctattccacaacaaggtatacaaccgctacgtcaagcgcacctacaagttcatggcacacgacgatgacaacacctgcaacattggcgaccgcgtttggctggatacttctaggcccttgatcatacacacgcactgggttgttgctgaaattctccgcacagcttaggtgtacgtttcaccagctgtaacagctgttcagtgaacgttggagcaaattttaacaagcttgtggtgctaccaaatgatccatt

SEQ ID NO: 64254 - DNA, 303 bp, Zea mays
  Clone ID: LIB3075-056-Q1-K1-A12
cgaataacacaggtcagcgcgacgatggcatccctcgctaataacatcatggtcgggggcgccatccttgctgcgctcggctgcggcgattcgtgcgggccccctaatgtgccacccggccccaacatcatcaccaactacaacggccagtggctcatcgttagggccacctggtactgtcagtccaaccgtgcctgaactcctgacaaccgcttttctatgctggatcaagaacgtgaatctgccaccctacatctttatgactgcatgcggtaacgtgcccatcttcaatgactgctaggg

SEQ ID NO: 64255 - DNA, 432 bp, Zea mays
  Clone ID: LIB3075-056-Q1-K1-A2
gctttctctattcgatggaaaacgcatagggtggtggcgcttgcacgccctggcgactgcttgcggcggcggtgtcctgcgcgcccgctccaaccatcctccggggcaacggcgacgtctgctcgcctacgtgcctagacggtgaggcagcgacatcaggacgcccgtgcgcacgcgtgcctgcacggcggctgtgcgccctcacgccggcttgccgaacggcgtggcggtggtgccatcctgcggggcggcgtggtggtcgcatgcctattcgccgggcggcgtggcggtcgtgcccatgagtcggatccacgtggctgcgcgcacgcgctactgagctgcaaggcgatggcgcccgcacgcaactctggcttggtagtggctgccagcccacaacaccagagaggcggtggtctattcctgcttcgtcgt

SEQ ID NO: 64256 - DNA, 404 bp, Zea mays
  Clone ID: LIB3075-055-Q1-K1-G6
cggacgcgtgggatcggtcaaagacaaaagatgattgctgtgagcatcatgtggtcattagtgcaggtgcaggtgctggcggcgatggcactagcatttctggtaggcggtgcctggtgtggtcctcccaaggttcccccgggtaagaacatcacagccaactatggtagtgattggctagatgccaaggcaacatggtatggcaagccaacaggtgccggcccggacgacaatggtggcggatgtgggtacaaggacgtgaacaaggcccctttcaacagcatgggcgcatgtggcaacgtccacatcttcaaggatggtctaggctgtggatcctgcttcgagatcaagtgcgacaagccagcgtagtgctctggcaagctcgtggtggtgtacattacaga

SEQ ID NO: 64257 - DNA, 194 bp, Zea mays
  Clone ID: LIB3075-056-Q1-K1-A3
ctcgttttgatttggactgatgaaaaagcagtgaaactagcctttatttatggctaactttgcctgttgtatgccgcaaatctactttttttcttggcaacgtctcgtttcgcacgatccaaaaaaaaaaaaaaaaaaaaaaaaaaaaaaaaaaaaaaaaaaaaaaaaaaaaaaaaaaaaaaaaaaatggaaaa

SEQ ID NO: 64258 - DNA, 323 bp, Zea mays
  Clone ID: LIB3075-016-Q1-K1-A9
ggggatcggagcgcgggcgacaagatgccacgcggcggcaagcccgcggcttcgtcgaagccgaacccgttcgactcggactcggactcggagtccagcaataagccggcgaacaagtccggggcgtcgtcgtaccaagcccccgccgacgccaagaagcggtacaaggacgggttccgggactcgggcgggctggaaaaccagtcggtgcaagagctggagcactacgcggcgtacaaggccgaggagacgacggacgcgctcgccggctgcctgcgcattgccgaggacatcaggcaggacgccagcgacacgctgatcac

SEQ ID NO: 64259 - DNA, 306 bp, Zea mays
  unsure at all n locations
  Clone ID: LIB3075-016-Q1-K1-B11
cggacgcgtgggtccacatgaacatgtaccggtgcaaggacatgctgatcaaggacgtgaccgtgacggcgcccggggacagccccaacacggatggcatccacatgggcgactcatccgggatcacgatcaccaacaccgtcattggcgtcggtgacgactgcatctccatcggccccgggacctccaaggtgaacatcaccggcgtgacctgcggccctggccacggcatcagcatcggcagcctanggcggtacaaggacgagaaggacgtcacggacatcaacgtcaaggattgcactctta

SEQ ID NO: 64260 - DNA, 391 bp, Zea mays
  unsure at all n locations
  Clone ID: LIB3075-016-Q1-K1-B12
ggcctgcagcgtcacctgcgccaaggagaagaacccgcgcctcagcgagaactgcaagaggtcctgcacccctcctccttcttgaagcgaagccccttgaaatgaatgaaccatgcatgcatgcatgtatgcatgcgccggggtgacgtggcgttcagctcaggcgctgagcgagtctatacgtacgtcgtcaccggctggccacgcatgcgataaccatctgatatggacggaactatatattgtattcctattaatctggcattttctaagctaattgttttttttccaaatataccgtcgatggaactccaaatgtaatgtcacgcanatgtgtgtttttcatcgattgaatggataataataaaaaggcatgctggcaggtactact

SEQ ID NO: 64261 - DNA, 344 bp, Zea mays
  Clone ID: LIB3075-016-Q1-K1-B9
cgaactgctcaaggacatcggttccggtaacttcggggtggcgcggctgatgcggaacaaggacaccaaggagctcgtcgctatgaagtacatcccgagggggctcaagattgacgagaatgtggcgagggagatcataaaccaccgctcgttgcggcaccccaacatcatccgcttcaaggaggtcgtgctcacgcccacgcacctcgctatcgtcatggagtacgccgccggcggcgagcttttcgacaggatctgcagcgccgggaggttcagcgaggacgaggcgaggtatttcttccagcagcttatctgcggtgtcagctactgccacttcatgcaaa

SEQ ID NO: 64262 - DNA, 302 bp, Zea mays
  Clone ID: LIB3075-016-Q1-K1-C10
gctctctacaaggaggcggcttgcgcggggggcatcgtgcaatggcgcggcggtgcccgtgcaggctgctgctagccgtggcggcggcggccgtgctcgtggccgcggcagcgcaggcgcaggagacgtgctcggggaccgtccccgcgccgccgcgccgcggggcgcgggtgtccgtggccagcttcggcggcgcgggcgacggacggacgctcaacacggcggcgttcgcgcgcgccgtcgccagcatcgagcgccgcgccgcgccgggcggggcggagctctacgtgccgcccggggtg

SEQ ID NO: 64263 - DNA, 390 bp, Zea mays
  Clone ID: LIB3075-016-Q1-K1-C11
gtcgtcattaattcttcgaaggacagggttcccaacatcaagttcaatgttgcgaaaggactacagtcacttgtaccgatcctcgaccaatctgtggtggagaagaccgtgaaaccgtgcctcgttgagctcagcgaggaccctgacgtcgacgtaaggtactacgcaaaccaggcactgcaggcgtgcgaccagatgatggtgtcaagctaactagcctttgtgtcaagtatttagagagttcgatcgatgctccatagtccaattttggattacctgtaatttggcctttagatttgaagagttgtttgtgtctagcctcggtaacagataaaaacgggacggcctgatccccttgttcgtttgtgttaattaatgttgtaattgagc

SEQ ID NO: 64264 - DNA, 356 bp, Zea mays
  Clone ID: LIB3075-016-Q1-K1-C12
cggacgcgtgggcaagaacctactcgccttctacattgaccaacaactaagcctccgtgaccgccacatctattaggtgcagccatgggtgcctgtgcaacgaagcctaagacgcttgaggggaaagccccagctgaggccaccatctccacacccaaggttgcacctgagaccactgccatccacattgaggttgcggcgaaacaggcagtagttgagaaggtggaggaggacaaggaggaggcactaacagtggcggcgaaacaagagccagcagccaccatcgagcctcaacagattgctggtgaggtgaccacttcggaagtggcggtcgtcgttgtcgagcctgagaacaa

SEQ ID NO: 64265 - DNA, 389 bp, Zea mays
  Clone ID: LIB3075-016-Q1-K1-C9
ctgagttcaagaaggttgggagcttccttggtcgcttcaagtcgatacctagcattgttgagcttgacagcttgaaggtttccggtgatgtttggttcggttctggaattgtactgaaggggaaagtgaccatcactgcaaaacctggcgtcaagctagaaatcccagacggagcagtgattgggaataaggatatcagtggccctgaggacctttagataagaatcagcgaatcagcaaggaggctcacttcgccaagtggcggatcatttttcgtgtttttttcctgtatattcaaacaggttccatgatattatggagaatattaattgccagtataatccagaaattttacatgtattttactttgagggaaatgttttacacac

SEQ ID NO: 64266 - DNA, 335 bp, Zea mays
  Clone ID: LIB3075-016-Q1-K1-D10
aaaacatggctgtgaatgtgagaaccatgtggtcgtcgatgcgggcacaggttgcgatggttgtggcgttggtgttcttggtgagcggcgcatggtgcggtcctcccaaagtccccccaggcaagaacatcacggccacctatggcaaggactggctggacgctaaagcgacatggtatggcaagccgacgggtgccggtcccgacgataacggtggcggctgcgggtacaaggacgtgaacaagccccccttcaatagcatgggcgcatgcggcaacatccccatcttcaaggatggtctgggtttggggtcctgcttcgagatcaagtgcgat

SEQ ID NO: 64267 - DNA, 371 bp, Zea mays
  Clone ID: LIB3075-016-Q1-K1-D11
cggacgcgtgggtgcagatcaccgtcgtcttcaaccacttcggcaggggcctggtgcagcggatgccaaggtgccgctggggcttcttccacgttgtcaacaacgactacacgcactggctcatgtacgccattggcggcggcgacgcgccaaccatcatcagccagggcaaccgctacatagcaccaccaaacatcggcgccaaagtgatcaccaagcactacgcggaagaaggcgtgtggaagaactgggtgtggcacacggaggacgacctgttcatgaacggcgccatcttcaatacgtccggcggcgcccccaagcaggtcgacaccaacgagtgggtgaagcccaagccaggaacctacgttaca

SEQ ID NO: 64268 - DNA, 324 bp, Zea mays
  Clone ID: LIB3075-016-Q1-K1-D12
gatcgcgagcggccgctcgcgatctattactagtccagaggtgggctggcttctcctcggcctcttaccaagtcctcttcgggttagggttacttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaac

SEQ ID NO: 64269 - DNA, 261 bp, Zea mays
  Clone ID: LIB3075-016-Q1-K1-D9
aagctggtcctcaccaacatggcggagacaccacacacggacgccgtacgcgtggacatcgaggagggtaggaccatggcatacgacaatacaccgaaagcgcccttcgatgctaccactcctaaccccaactccgcctcatacccatactcatcattagatgcgccctacaacagcagcttctacgactagacacaaaaacctcttcattctctggaataactaacaggatatacgttgcaccctgatgatatacaaaca

SEQ ID NO: 64270 - DNA, 383 bp, Zea mays
  unsure at all n locations
  Clone ID: LIB3075-016-Q1-K1-E10
tcgcgatcaccaacaccgtcattggcgtcggtgacgactgcatctccatcggccccgggacggccaaggtgaacatcaccggcgtgacctgcggccctggccacggcatcagcatcggcagcctagggcggtacaaggacgagaaggacgtcacggacatcaacgtcaaggattgcactcttaagaagacgatgttcggcgtccgcatcaaggcgtacgaggacgccgcctccgtgctcaccgtctccaagatccactacgagaatatcaagatggaggactcagccaaccccatcttcatcgacatgaagtactgccccaacaagttgtgtactgccaacggcgcctncaaggtcaccgtcaaggatgtcaccttcaagaca

SEQ ID NO: 64271 - DNA, 396 bp, Zea mays
  Clone ID: LIB3075-016-Q1-K1-E11
gagagagagagacgcatgcccgccggcgtcgatcgaggagggaggaaccagagacccggcggcggcgacgatggctccgcgcagctcatcggcggcgacgtgcctgtgcctcgctctcgccgcggccacgctggcgctggcccacggtgcgcaaggaggaggaccatcggcatcggcggcggacctggacaaggtcacggccgagaccttcttcgacatcgagatcgacggcaagcctgcaggccggatcgtgctgggactgtttggggacaccgttcctaaaactgcagagaactttcgagcactttgcacaagggagaaaggaattgccaagtccggcaagcctctgtggtacaaggggtcgacgttccacaggatcatgcccggggtcatgat

SEQ ID NO: 64272 - DNA, 382 bp, Zea mays
  unsure at all n locations
  Clone ID: LIB3075-016-Q1-K1-E12
gcaagaccacctangaggcctctctctttctctccccagccacccccgtagcgagagggagggcggaagaggatgagcgcgtccaggttcataaagtgcgtcacggtcggggacggcgccgtcggcaagacctgcatgctcatctcctacacctccaacaccttccccaccgactatgttccgacagtgtttgataacttcagtgccaacgttgtggttgatggtaacactgtcaacctcggcctctgggacactgcaggtcaagaggattacaacagactgagaccactgagctatcgtggagctgatgtttttcttctggctttctcactgatcagtaaggccagctatgagaatgtttcgaaaaagtggatacctgaac

SEQ ID NO: 64273 - DNA, 393 bp, Zea mays
  Clone ID: LIB3075-016-Q1-K1-E9
gcgaccgagccgcggatttcacccctgtctttccttctccccgtgtccaggccctggtgcccgcgcgttcccgtgcggcaactggccgccgccgccgcactacgccaggtgcccaattcctcgtcgggtcctccgccggcgacgagcacccaccagaaaactggagtggactctacatgtcaagacagtatggcgccaggaagcaaggcggagaggaaagcagcactagacgctggcgcatggatgttcaatgtcgtcacatccgttggtatcatcatggtcaacaaagccttaatggcgacgcatggttttagtttcgctacaacgttgaccggacttcatttcgcgatgacgaccttgatgacattagtaatgaaatggctgggatatatt

SEQ ID NO: 64274 - DNA, 391 bp, Zea mays
  Clone ID: LIB3075-016-Q1-K1-F10
cggacgcgtgggtttttctaaaattggatcttcgatgctatttttcaaatggtatagagctaattttcccaactcagaactgaagcacgcttctacttcctttctcggctctcacaaccatttcccctcccctcgcttccaactattggaactgaagcatataggctctgaggagaagcaagactgaataaggtcaatatcttgggctaacaaggctgctattgttggctctgaggagaagcatcatattctcccatgattactcttggtgggttgtctgcatctcattttgctctgagaaagaaaattttctctctggttcacttgaccgtactgttctcttatgggatcaacgggctgaaaaatcacaggtttgaccatataatatata

SEQ ID NO: 64275 - DNA, 445 bp, Zea mays
  unsure at all n locations
  Clone ID: LIB3075-016-Q1-K1-A12
ccggcccgacccacgccgacggaagnnncagatgttccattcgncccttcggacaggccttgggaaaccatattcagcgggtcgtctcatgttctcccgcctctcacaaaactatgctctgcattcttgtcatcgctgctggagaaacggcctgttgcaaacgagtgagccgccctagaacattgtcctctcatacaacggtaggtatactcgccagttgcagaatggaaatgcggaaggaaatccgtccgtgacgatgcatatgcccacttgaagagttcagagatgctgggtgatgccatctgaggttggttatggttatacagatatcacacggcccacgaggatcattttgcagcgatactcgacggccaacctactgatcgcagcaattttgttttcttctccgcttgacatgtaatcctgacaagtaaactagaaaatc

SEQ ID NO: 64276 - DNA, 421 bp, Zea mays
  Clone ID: LIB3075-015-Q1-K1-G6
cggactcgtggggacaaagtatacattttatagtttaggtttgataatggatccaaaatatgttagcctatgcatcttcgtattacttgtattgcatggagatactactttggcagaaacttgcagggagtttgctaaatggcatccattctgctttagtgcaatgtgcaaggcaaattgctttatagaaggaaaaagctccgatggttcctatgcaaagggatatagatgtgattcacatggatttcattctatgtgtatttgccttttgtgtaaaagttagttatcttaagacaagcggggatatattctatgttcatatccgtcatttagggtgttgttcaaataattttatgggataataattaactagtttgtttacttctagatatatgtaatactacttaaataatccttattt

SEQ ID NO: 64277 - DNA, 313 bp, Zea mays
  Clone ID: LIB3075-015-Q1-K1-G7
ctcactgacgcgcgctcgacgcgggtttctgtctgcgccgacttgctccgagctacggaagacgagctctaggtgatgtacgaggtgctgaagcagccgaccgacggcgccacggccgacaccctcggctcgtccttcgcgatcaatgtcgtacctgctcgtacgacctcgtagcgccgtcatagactgtccgatcggacagagcagctactagcagccgtatgccgacggcgacacctaggaggaagacgatgaggagtggaagctcatgcgcatgctcaccgaatgacgacgtgatcaagagctatccgct

SEQ ID NO: 64278 - DNA, 385 bp, Zea mays
  Clone ID: LIB3075-015-Q1-K1-G8
accacgcgtccgtccacgcgtgcgcaacatcaacaacaagacgggcttcaccaagcggaccgactacggcaagggcgagcgagaggcgcagtggtccacggcacacaggacgctgcacggtctcaaccaggccaccgtcagctgcgacctcttcggtgacaaccagggctaccgcgagctgtcagagctcgccgagcatgcagccaatcgcgccgagggggccaggctcagggagctgcacacgctgaaaggacacgtcgagtacgtcggctagctcaagggcctatgcattgacaccattcagcagagctacaccgcgtatactcgactcagaagactagctgatatgttgtgcaaacttattcaatgcacacacatctatata

SEQ ID NO: 64279 - DNA, 160 bp, Zea mays
  Clone ID: LIB3075-015-Q1-K1-G9
gtcctgggtcgcatttatcaaggataagttccaccacattttgttgctcttttccagcgatgggtattcttaaaggtggtacccacttttggtattaaaaattttttgaaaaaaaaggtcctgaagaataaacattttggtcttattgccttggttttat

SEQ ID NO: 64280 - DNA, 428 bp, Zea mays
  Clone ID: LIB3075-015-Q1-K1-H1
gagaggaggaggggaggtgcgccaccggtaagcggaaacctcgggtgtcgtcgaccaacctcgtcgatccggttgcgacgcggtgtgctagaataactaccgaccatggtggaggaggagatcaccgagggcttgaagaacctcaccgtcaccggagacgcggcggcttcgggcggagaagggcagaggaggggcggcggcatcagcagcaaccgcatccaggtgtccaacaccaagaagcccctcttcttctacgtaaacctcgccaagaggtatatgcagcagcacggcgatgtggagctatccgctcttggaatggccatagcgacagttgtgaccgtggcagaaattctgaagaataatggatttgctggtgaaaagaagatcaggacatctactgttgacataaacgacgaatcacgagggcg

SEQ ID NO: 64281 - DNA, 262 bp, Zea mays
  Clone ID: LIB3075-015-Q1-K1-H10
aaaaaatatttttatttttttttttttttttaaaaattttttatatttcttttttttctctggaaaaaaaaaaaaataattttaaaaagcgcttcacaaaacaaaatgtaaaaaaaaaaaaaccttatttaagaaaacccttgaacacccaccattggtacatcaaaaaaaaaaaaattttttacgacccccccttaataaaaaaatttatttttaaaaaataatccccccctttttaaatattttaaaaaaaaaaaaatat

SEQ ID NO: 64282 - DNA, 176 bp, Zea mays
  Clone ID: LIB3075-015-Q1-K1-H11
cccacgcgtccgcagcatggtcgccgtcgtcctggctgccatcgccacaataccgctgggggaggaagccattccggggccactgccggaccattgaaccaccgcaaaaaattccaaggccacattggacgccaaaacccggaaggctttcaacggcttgttggccgccgttccgg

SEQ ID NO: 64283 - DNA, 417 bp, Zea mays
  Clone ID: LIB3075-015-Q1-K1-H12
cggacgcgtgggcggacgcgtgggtgctacacaaaataaaggtggtttgagggaaagcgtgtgggtaactcggcttttgccaaaagcatcagtagaattgatggaggcaacaccatgcaatgtagagaatgctgttagtccacaggctgtgggtgacaagttgtgttgtccacctcttcagaattttaatttggagaaggaactaaataatatacaatacttcactggaagaggaagcagcgatggtgtaacaagtagtaaatgtccagcaacgcctccagaggaacctaagcaatctgaaacaatggcttctgtttttgcaaagagattggatgcacttagacatgcaaacacctctgcagtaagcttggctatcgcgtgtgagcatggaagtcccaaactgagaaaccacaaaac

SEQ ID NO: 64284 - DNA, 436 bp, Zea mays
  unsure at all n locations
  Clone ID: LIB3075-015-Q1-K1-H2
aagagatcatgcaactttataaagaggaaaagaatatgttgtatgcacagttcaaaaagctgacatgtcgtgttagttttactatggatgcatggacatctatacaaaacaaatcgtacttatgtgtcacagcacattggattgatgataattggaacatgcaaaaaaggattatcaattttatgcatgtagaagacagccatgatgggataaaattgagtgatattttttttgtaaatgtgctcaattggaaccttgataagaaaatgtttgctctttctttggataatgctgtggcaaacaaggttgcagttgatatagtgatagataatgctaaagacttgctcatatgtggtggaaagttctttcatgttagatgtgcaaatcatatattgaacctttgtgctaaagatggcttancagtaatgagaaatgc

SEQ ID NO: 64285 - DNA, 436 bp, Zea mays
  Clone ID: LIB3075-015-Q1-K1-H4
gagcaaccgtccccgctcacgccgtctgttgccgcggagatcgacttggtggggcgcatgccaggcctgcgccacccgtccgtgctgtctgccatgacccgcgccgtcgccgacgtctcctcggcgcgcgactcgatccgcctcctgggcccccggcccgaccacgagcaagtcgacgccttccgcgaacttctccgcttggccgatgctgggaagaaggcagacgccaacgcggacgtgaagacgaaggatctcgacgaggagaagctggccaagtgccgggaggtggtgcggctggaggaggaccacgaggcgtacggcgccctgctgcgcgacgcggatgggaagctggagcacgtgtaccagatggcgatgcacgtgagggacatcaagaaggcggtcggcggtgatggcaaaggggaagaggggttccggg

SEQ ID NO: 64286 - DNA, 141 bp, Zea mays
  unsure at all n locations
  Clone ID: LIB3075-015-Q1-K1-H5
tcgcggactcgtgggcggactcgtgggttctgtgccaacgttgtacntgatagcaacggtgtggttcttttacctacgcgtggtgctacacaaaatacataccatccacattaacgacatcaaccactgctggaacaacct

SEQ ID NO: 64287 - DNA, 436 bp, Zea mays
  unsure at all n locations
  Clone ID: LIB3075-015-Q1-K1-H6
gctggttttgcatatttgaatcttcaggaagcatgtccaccattatattcaattattgggctcagggagcatattaagaaacggccaccattggctacctctgagaaagttcaacaatttgtgagggcacgggggagagaatcaatggttgcaggattttatcacgaaggctatgaagatccattgcttatgctgatgagaaggagaactgttcatgctggactagttgtgaagggtgaggaaggtgcgctttccttgacaaccaaggaaagatcagcccatgcatcaaaaggactccctgttaaccactgttcanggtttcggacaccaagcggcataaatttctctgagactgatggtattcctagagaaagcttcanggtcattgtgaatgcccaggaacttggttntgaatccactgaaactccaagaactg

SEQ ID NO: 64288 - DNA, 432 bp, Zea mays
  Clone ID: LIB3075-015-Q1-K1-H7
agcgccttcgccaccggcggctacgcgtgtcatccaacgcgtgacgcagtggaaccttgacttcactaaacacagcgagcagggtgacaggtaccgtgaattggcacatcgggttgatgatgcccttggattcatgggtgcagctgggctaacagtggaccagcctttgacgacgatgatcgagttctggacctcacatgagtgcctcctcctaccttacgagcaagccttaacccggcaagactccaccaccggtcttttctacgactgctccgcccacatgctctgggtcggcgagcgcacccggcagcttgatggcgcccatgtggagttcctgagggggatcgccaacccccttggcatcaaggtgagcgacaagatggagcccggcgagctggtgaagctgatcgacatactgaacccgacgaacaa

SEQ ID NO: 64289 - DNA, 431 bp, Zea mays
  Clone ID: LIB3075-015-Q1-K1-H8
tttgaagcttggtaaggatgggattcttctacatattgatcttgctaaaggaaatcgccgtcttggtggttctgctcttgcacaagcatttgatcaaattggaaatgactgcccggacattgatgatgttctgtacttgaagaaggtatttgaggctattcaagaattgctcagtcaacgtcttatttcagcaggccatgacataagtgatggtggccttattgttagtgttcttgagatggcatttgctggtaactgtggttttaagcttgacatagacttagaagataggagccttattgaaggactttttgcagaggagcttggcctcattattgaagtacactcgaaatatctcaacattgtgaagcaaaagcttgaaatagcaggcatttctgctaatgttattggagacgttactagctcaccag

SEQ ID NO: 64290 - DNA, 346 bp, Zea mays
  Clone ID: LIB3075-016-Q1-K1-A10
cggagccaccggggagcgggagggcatgtttctgttcggagattcatatcgccgaagggtgttcttcaagtacgagaagaggattaggacgcgcagccctccagagaagatctttgagtacttcgcatccgtccacagcccagagggtgagatgtacatgttacctaccgacctgatgagggcgggtgttcctgttttcccctcatctgagtccaaaaatgtcagggaagggagattgaaaggggagcgccaccctggcgagctacaatgtgctccatctgagtttttcatgctattcgatacaaatggtgatggtgtcatctccttttctgagtatatcttcttt

SEQ ID NO: 64291 - DNA, 429 bp, Zea mays
  Clone ID: LIB3075-016-Q1-K1-A11
cccacgcgtccgctgacctgctcataattaagcttccgttccaaaggcttgtcagggagattgcccacgatttcaagactgatcttcgtttccagagccatgcggtgcttgcgctgcaggaggctgcggaggcgtacctggtgggtctattcgaggacactaatctgtgcgccatccatgccaagcgcgtgaccatcatgcccaaggacattcagctggctaggaggatccgtggtgaaagggcctagattctctgtttacggctactgggagtggctccgtagtatggtttgcatctgttcgatgcttgcttttgtggaagtttacatttgtgggtgttcgaattcgtaatattcatccgtagtggacaagtggtaggaagtgctccatctgactattgtttaaatttataattgaggtcattagtgt

SEQ ID NO: 64292 - DNA, 383 bp, Zea mays
  Clone ID: LIB3075-015-Q1-K1-G5
cttaaagctgcgccaggttccggggctggcagttgaagcatagctaggaaacagctttccctctcttaattcgttgtgttcgtggtgacataatctgtgtgcggaccgaatttagaataaagtacaggcgtccgtctgatcaaataagcaccggtgttggtgctctatagatgaatatatccggtgattttcggcatgggaggcattggcacatttttgtctgagttctggcggtagcaagaccggagtaataaccatcaggcgtttctatgttggttacgtgccgcacgcatgccgggcgtgcggaggatttatgccctgagaggctgagactatctccctcgtcccttattttaaacagtatcattatacaattccgcgtt

SEQ ID NO: 64293 - DNA, 331 bp, Zea mays
  Clone ID: LIB3075-015-Q1-K1-E8
tcgcccacgcgtccgcggacgcgtgggtcctcagcacaggatccgcatcacgctctcctccaagagcgtcaagaacctcgagaaagtctgcggcgatctggtgaagggcgccaagggtaaggagctcaaggtcaagggccccgtgcggatgcctaccaaggtgctccacataaccaccaggaagtctccctgtggcgaaggtcccaacacctgggatcgcttggagatgaggattcacaagagggtgatcgatctcgtcagtccaccagacgttgtcaagcagataacctaattcaccatggaaccaggggtcaaggttgaggtgactatc

SEQ ID NO: 64294 - DNA, 221 bp, Zea mays
  Clone ID: LIB3075-015-Q1-K1-E9
cggacgcgtgggtgaagttgaagcactcttcaggactgcaattgagaacaacgagcaacatgaactggaagttgcatcttctcgagctgtggctgaagaagacgcctccaataacagcaaggacatagctcagggcgttgaaaatctgttggaagatgcacggaattcaagttcaagagtggtctcaacggggaggctcacttcggtgagctacagatgct

SEQ ID NO: 64295 - DNA, 276 bp, Zea mays
  Clone ID: LIB3075-015-Q1-K1-F1
ttcataccacccacgccataactctagaatcgctttttcaaaccaaccgaccgattaacccaccacctcctcacctcatcttcgctctcttcctcgtacaaagccttgtcctttcatcttgagtcattggactcactttcacgcatccatgaacggcatcaaccccaacctcggattcctgtcgtactgcaacatgtatagctactcgatgtgcatggccaccgtcatatcgtctatcttcttctcgttcctcgaacgctactccttcatccacct

SEQ ID NO: 64296 - DNA, 425 bp, Zea mays
  Clone ID: LIB3075-015-Q1-K1-F10
gaagctgcaggggtccaagcaagggtggtaggggcagctcgcgatcgacgccgagatcgtcgaggtgacaccggcctttcacgtcgtcgaggtgaagaagtcggcaggcgacacgctggagtatgagatgttctgcagcaagggcctaagaccttcactcagcgacatctgctggagcagccgatctgaggagaacatggctccttcagtggttcagccatcacaattggagccatcctcttagaccgtctccgacagtttactcacccctcttagtcgattgttatttaagtgcagtctcttcggagatgcaattacagtccatcctctctttcttttcccctttctcaaagagctaggaccttgctcgactgagcatcaggctgtagggctctttgtgatcatcttttgccagttttcttctt

SEQ ID NO: 64297 - DNA, 63 bp, Zea mays
  Clone ID: LIB3075-015-Q1-K1-F11
cggacgcgtgggtttttttttttttttttttttttttttttttttttttttttttgtggggtt

SEQ ID NO: 64298 - DNA, 365 bp, Zea mays
  unsure at all n locations
  Clone ID: LIB3075-015-Q1-K1-F12
cgccgccgaggccccggcgcccgctcccaccagcgcctcctcggctgcgttcccggccgtcggcgccgtgctgagcgcctccgtgctctccttcttcgcctactacctgcagtaaaattaaaggaggatcggagggagaggctgctggctgccattgcctgtattcggttggatcccgtttatatatatatatatatatttaagtactttaatttgggtctgaacatgtcgattgatccattcattttatttgctttgccatttctcccctttctgttaatttcgatatgtaaagaggggagaatgggagacactattcgtttggacatgacaatcggaaattaatcaatacccatttgttngtt

SEQ ID NO: 64299 - DNA, 406 bp, Zea mays
  Clone ID: LIB3075-015-Q1-K1-F2
caaggacgtgaccgtgacggcgcccggtgacagccccaacacggatggcatccacatgggcgactcatccgggatcacgatcaccaacaccgtcattggcgtcggtgacgactgcatctccatcggccccgggacctccaaggtgaacatcaccggcgtgacctgcggccctggccacggcatcagcatcggcagcctatggcggtacaaggacgagaaggacgtcacggacatcaacgtcaaggattgcactcttaagaagacgatgttcggcgtccgcatcaaggcgtacgaggacgccgtcttcgtgctcaccgtcttcaagatccactacgagaatatcaagatggaggactcagccaaccccatcttcatcgacatgaagtactgccccaacaagttgtgt

SEQ ID NO: 64300 - DNA, 208 bp, Zea mays
  Clone ID: LIB3075-015-Q1-K1-F3
tcggaagtcatgccctttctgatcccttcttctctttgacctcgcttggcatgaacttaggggggtcatgctgaatatccataaccaacagacgttatcttcttcaccacacgtgtgcgatctcgaaattgccagagacatcaaaggaaaacatgaatatgttgatcttgaatcctaccagcagcttcagaatgccaagagcaggtca

SEQ ID NO: 64301 - DNA, 437 bp, Zea mays
  Clone ID: LIB3075-015-Q1-K1-F4
cggacgcgtgggcggactcgtgggcgaggctgctgtctcacggctgcggctgcggcggttcgggctccagactccagggatggccgccggtgcgggaggcggcgaactggaggcgctggagggcgtgcgctccatcgtgctcaagccgtcggagtcgctcgacgagtcgcgtttcacgaggatcgccggcgccgacttcaacgacccggccatcggactccaggggctgctcgcctcgctcgcgtccaccgggttccaggcattcaacctcggcgacgccatcgacgtcgtcaaccagatgttagactggaggttgtcgcatgagaagcccagcgaggattgtgatgaagctgaacttgaccctaaatatagagcatctgtgaagtgcaagatatttctgggcttcacctcgaacctcgtgtcttctggcatccggg

SEQ ID NO: 64302 - DNA, 425 bp, Zea mays
  unsure at all n locations
  Clone ID: LIB3075-015-Q1-K1-F5
caccggccgtcgagcgagcagtctcccaattccacccaataactaataacatctgctcgaacgccaggttccttggaccactatatccaggagcgacgaagtgatccacccgccagccatggagatgaagaaggtcctctgcgccgccctcgtcgccgccgcctcggccaccgtcgtgctggcctcggtcgcctccgaggcgccctccgaggcgcccgccggcgcggccggtggtgcggctggccctagcgcaagcggcgccgccgtcgtcgtcgtgcccgccgtcggggcgctcgtcgcctccttcctcgcctactacctncactgagcgacgacgcgcggtgcggcaacgttgggatgcatcgtgtttggttcatccgattaattaattggtttttttatttacgtggtttgcgattggttaa

SEQ ID NO: 64303 - DNA, 367 bp, Zea mays
  Clone ID: LIB3075-015-Q1-K1-F6
gctctgccaagatcccatgcaccggcgtcaccatggacgacgtcaacatcaagtacagtggcaccaacaacaagaccatggccgtatgcaagaacgctaagggcagcgccaagggttgcctcaaggagctcgcatgcttctagaaccaccatcgacccatctctctagttatacaatgtgtttggttgttggatgctgagagattggttctcagctcagatgcaagctgcgcctagcctgtgtaggtttgtgctggtacattgagagctcttatttatttgctttgattgcaattaaccaggatgaccatagcccttgtttggtttgctgtttttataagttgcatgaacacaacttctgtttggtt

SEQ ID NO: 64304 - DNA, 237 bp, Zea mays
  Clone ID: LIB3075-015-Q1-K1-F7
cgggccgacccactcgtccggctctaccaagatcccattcacctttgttttccatggacgacttcaacatcaactggaggggctccaacaacaagaccatggccgtatgcaataacgctaatggcaactccaaagtttacctcaatgaactcgcatgcttttaaaaccaccatcgacccatctctctagatatacaatgtgttttgttgattagatgctaatagattctttctcaaa

SEQ ID NO: 64305 - DNA, 433 bp, Zea mays
  Clone ID: LIB3075-015-Q1-K1-F8
gaaattcggcagcaggcattagaggctatttatatgatcgtattgcaggatggtggccgaaggtccttttggtcagttaatggcccacgaattctgcaggttggttatgaagatgaaaaggacccgaaagtgatggaagcatatgaacttattggttccctgcttgttgggaagggtgaagatgtacaagataacaagaaggaacaaggagagaagcctcaatgagccccgccgctgataaaaacggtgctgtatttttgtttgtctagaaaacatccctcgccgtgtgcaatagcaatagtatgatatcccaacttgtcaactgttgcaactgcaagagctctgcagtgttgcttttgtaattgacgaatgtatctggaaaatttgcacgtattggccgtcttttccttgggtttgagctctctgacaattc

SEQ ID NO: 64306 - DNA, 285 bp, Zea mays
  unsure at all n locations
  Clone ID: LIB3075-015-Q1-K1-F9
ccaaaatgatatggcttgtctattctaatgtcaactgttgcaacacaaattactcttgggatagacttctgacaaatagcttggcactgtttctgaattaggcctaggtgcttacatcaattttctcttgttgaatccggctttaattcatgactagagactttagagtattatcagtccttgttgaggttcagcctttgctgacaccaatgtaattaacatctaaaaatattctttgaatcagcttgtgattcatcagcaagacgttagttgtcatgtacaana

SEQ ID NO: 64307 - DNA, 159 bp, Zea mays
  Clone ID: LIB3075-015-Q1-K1-G11
ccagattcatgtacgacaagttcgtattttatctaccaccaacgattggctttgagtcgctgtcaaaaacaacgtatctagaacaccgatctgtacgtctacaactctgggatactgcaagacaagatacgtttaggactcctattccaagctacatca

SEQ ID NO: 64308 - DNA, 237 bp, Zea mays
  unsure at all n locations
  Clone ID: LIB3075-015-Q1-K1-G12
cggacgcgtggtcgcgagcggcctccctttttttttttttttttttttntttnaggaagggtttttttttatcccccctttcttacaaagggggcttccatgacccaccatataactgggaagcataactttcccttgattgaagtgaaattagtaaaaaattaaaattaaccctttgtgcgattacttcatgtttacccatggaacataaatttcatgataccttctttttttttg

SEQ ID NO: 64309 - DNA, 330 bp, Zea mays
  Clone ID: LIB3075-015-Q1-K1-G3
cgccgtgactcgcgccgccgcgggcccgttctgctccgacgtgctccgcgcgatgcagcgcgagcccgaggtgatgtacgaggtgctgaagcagaggaccgactgcgccacggtcgtcgacctcgcccgggccttcggcgcaatgccgtacctggtgttcgaccccgaggccgccgtgatgtccggcggcgagagcagcgactcggagcggtcggccgccggcgccgtcgaggaggaagacgatgaggagtgggagttcatgcgcgggctcaccgtctgatgacgtgcccgtccgtccgccccgggtgaaacaaggcgagttcgtcgcca

SEQ ID NO: 64310 - DNA, 438 bp, Zea mays
  Clone ID: LIB3075-015-Q1-K1-G4
gactagtagtaggacccttggaggagcagtcgcgtcacggacatgcggacacagcgggatccagcaccaagagcctaggaaggccaggggcaggggtcctcgccctcgccgcaatggagctgctggccaaggcgcccgtgctgggctgcgccgggaagatgcagaggcagcggcaacgggggtccgcgctgggcaggtggatttgccgtgccgtggcgccgccgagggtgcggctcagggacggccgccacctggcgtacgccgagtccggggccagcaaggaggacgcgaggttcaaggtcgtcttctcccacggcttcaccggctcccgcctcgacaccgttcgtccggcgccggaagttgcggaggagctgggcgtgtacatggtgggtttcgaccgcgccgggtacgggcagagcgaccccaacctcaccggtc

SEQ ID NO: 64311 - DNA, 404 bp, Zea mays
  Clone ID: LIB3075-015-Q1-K1-E7
cggacgcgtgggcggacgcgtgggcgatgacatcccacccacgcgagaggtctgaaacccaagggcaaaccaaccgaccgattaacccaccaccgcctcgcctcgtctccgctctcttcctcggacaaagccggggccgttcggcgggaggcaggggacgcacgggcaggcagccatgaacggcatcaaccccaacggcgggttcctgtcgtacgggaacatggagagctacgcgatgtgggtggcgaccggcgtggcgtcggccttcttcgcgtccctcgagcgctgctcctgcatccacctccacaccgcggaggacgacggcgtcgaggaggaggaggacctcgaggaggcccgccgctccttctcccgcccgatccctgagtactactacgaccggtccg

SEQ ID NO: 64312 - DNA, 192 bp, Zea mays
  Clone ID: LIB3075-055-Q1-K1-E8
caagagcgggcagtacttcgaggtcaccgtcttcaagtccgtgcagtccgacgtggaggtggagttcgcgatcggcgacctaagcaaggctgagcggttcaaccccaggtggctgaccgacctgcaggcgctgtgcatgaagcggtgcgcccgggagacgggcgaggtggggccgttcgttctgtgggtgct

SEQ ID NO: 64313 - DNA, 301 bp, Zea mays
  Clone ID: LIB3075-055-Q1-K1-E9
acgctcgagaagttttgggaggacatttgatacagctggtttagaggtcgcgactcctatcctagtgcagacagacgatgggcataaacacaggagaggaagccatggtgatatcatctttttgacaagcctgggagaggtgacatcgtactcttctgggctgctcggccacgatgcggtgtggagattgcaagtatcatcaggtgcgacatggtacaaccttccatctccattcgtgaatgatggagatcatattggtgcctaccttgaaggccttttctttacgtgcctatgacctgat

SEQ ID NO: 64314 - DNA, 177 bp, Zea mays
  Clone ID: LIB3075-055-Q1-K1-F10
cggacgcgtgggcggacgcgtgggcctgcattcatctcctccaccaccaccaccaagctgaacaacagccatctcgcgaaaataatgaagagccgcagcctggcatcatcggccgagctcttggtgctagccctcgcgctagtggcggccaccggctcacaggtagcagctgcaaag

SEQ ID NO: 64315 - DNA, 75 bp, Zea mays
  Clone ID: LIB3075-055-Q1-K1-F11
cagcagggaacatcgtgcatccgagctaattcattaggtcaaaaatgacccgtgcaaggggatttacctcaagcc

SEQ ID NO: 64316 - DNA, 223 bp, Zea mays
  Clone ID: LIB3075-055-Q1-K1-F12
gcttatatatattattataagctacaaagatcataagaacaaatgatatttaactatttatcaataatttagctatcaccatttgagagtttcgtaaatatatgtactagtctatttgcataaattataagagatggatatgctagataacaaatactaggctagcttatgtatcaacgcactcattatataattgacatatgctagtacatgtctcattttt

SEQ ID NO: 64317 - DNA, 309 bp, Zea mays
  Clone ID: LIB3075-055-Q1-K1-F2
caaatcactgtaatggggtttaagagggcatctcaagattccatcaatagatatatccgtgcgttctcattcggctcacgcgcacccaacgtcccttctccctgtcctaggcttccttcgactttgctctttttgacgattttatttcgtcgagcagcacaggcatggattagttagactggatggtcagaacacgaggtgaaaacggtgccttcgtcgcctttagcgcgcgacggcgtttgatggcttacgcttctgcatcatgaccttccaatagtacacgccctttatcgtctcttttaactcgtc

SEQ ID NO: 64318 - DNA, 393 bp, Zea mays
  Clone ID: LIB3075-055-Q1-K1-F4
gaccctgggaccggggctcagatcggatcgcatcagatcgaaggcgtccagaattttccatcgggcgtcgccggtatggtgatccgcaggggttcttcgtacgccgtcgcggcacttctcgcgctcgcctctgtcgccgccgtcgccggcgaggtattcttccaggagaagttcgaagatggctgggaaagtcggtgggtcaagtccgagtggaaaaaggacgataacatggctggtgaatggaaccacacctcggggaaatggaatggagatgcagaggacaaaggtattcaaacctccgaggactacaggttctatgccatttcagctgaataccctgaattcagcaacaaggataagaccctggtgctgcagttctttgggaagcacgag

SEQ ID NO: 64319 - DNA, 313 bp, Zea mays
  unsure at all n locations
  Clone ID: LIB3075-055-Q1-K1-F5
acgctaccctggcgtcaagcgcattaccatgaagccccagactgaccgctgggtgttccccgagaccaacactggcatcattgtccttgctgagggtcgcctgatgaaccttgggtgtgctactggccattctagctttgtcatgtcctgctcattcactaaccaggtcattngccaacttgaactgtggaaggagaagagctctggcaagtatgagaagaaggtgtatgtgctccccaagcaccttgatgagaaagttgctgctctccacttgggcaagctcggtgccaagctgaccaagctcaccaagtct

SEQ ID NO: 64320 - DNA, 305 bp, Zea mays
  Clone ID: LIB3075-055-Q1-K1-F6
cggacgcgtgggttgtcgatgaccttgtctctgttgacactctcatcgaggaccatctctgcgctgagccagtgagcgaatacgtccagagctgcgacattgtcgccttcaacaagatctaaatttgcttgtgatggtggcaatggtggttggtgggcactgtaccagcctaatttataattttgcatgagcatcatcaagagtctttctaagttatcatttgtagtcattgacatagaacgcactttctatatctgtgtaatatcatcaacggatctatatcttgttagcaccatttttagcta

SEQ ID NO: 64321 - DNA, 148 bp, Zea mays
  Clone ID: LIB3075-055-Q1-K1-F7
aaaaaatcaaggctacacaccaacttactttctaggtctcaaattaaatggcctactcgggctcctgcttgctgctggcgtggatagcggtggcggcactctttgtcgaaggctcgtgtggcggcgcgctcaccttcacgatcggcaa

SEQ ID NO: 64322 - DNA, 421 bp, Zea mays
  Clone ID: LIB3075-055-Q1-K1-F8
actagcttcatgcaaccagctgtttcaagattggaatctgcgttggctgccactgagattagaacacctagaatgtccggtcatctccaatgttgatgcgcagccccactcagatcctaacaccatcaagcagattttagctcagcaggtaacctctccggtgcaatgggaaaccactgttaagaatcttatgggcaaggggcttgagaaaagttatgaactcggacctggaaaggttatagcaggtattctcaagaggatcaacaaaggcactagcattgagaacatcggggcttaaacgtctgggatctgaagaactcttgatggaaccaagttacacagcagaagattgaaacatgccattattggggaccatgttttcacttagaggtaccggttttttaccttagtgggtggaatt

SEQ ID NO: 64323 - DNA, 254 bp, Zea mays
  Clone ID: LIB3075-055-Q1-K1-F9
aaatccccaaagcctccgacccccttcctctctccctccgccgccgctgcgcacgcagggaacaagcgacatgggcgtctacacctttgtgtgccgcaacaacggcggcgagtggaccgccaagcagcactccggcgagatcgaggcttccgccgctaccccatacgagctgcagcgccgcctcgtcgctgccgcctccgcggccgactctgcctacggcgtccagtcgtcctttttcatggtcactcccagct

SEQ ID NO: 64324 - DNA, 214 bp, Zea mays
  Clone ID: LIB3075-055-Q1-K1-G1
ctcaaggcggcgcgccccgagtggagcctcgccgcgatgcgctccgcgatcatgaccacggcgcgcacccaggacaacacgggagcgcccatgcgcgaccacgatggcaaggaggccaacgccttcgcctacggcgcctgcaacgtgcaccccaaccgcgccgtcgacccgggcctcgtgtacgacgccaggcccgactactactttacattcc

SEQ ID NO: 64325 - DNA, 254 bp, Zea mays
  Clone ID: LIB3075-055-Q1-K1-G10
caaccgacaacacacggagaaggggaagggcggcgagggaagggctccgcgtcacgtgcgtactgtagctgctactctatggaacactccatccatcagcgctgacctccgcattgctctagataccatgcagtacatcgagtctgccgccaagatcaaaggccggagaaggaggacgaaagggtagggagtcagctatgggatgctcttcatgctggcgagtggcagatgacgacaaccttggcaggaggaag

SEQ ID NO: 64326 - DNA, 197 bp, Zea mays
  Clone ID: LIB3075-055-Q1-K1-G11
gcggcgcagcacggaggcgaatgaggaggaccagcagcagcaggcagcgccaaggagcggcatcccactcaatgcttgcagccatggctagggggttgaagaagcacttgaagaggctcaatgcgcccaagcattgcatgctcgacaagctaggcggagcttttactcccaaggcatcttctggacctgacaaatgc

SEQ ID NO: 64327 - DNA, 133 bp, Zea mays
  Clone ID: LIB3075-055-Q1-K1-G12
gagacgcgttcgaagacacatacggggactcttggtctttcgtgtggtccgactactgcgaatcgaagccgagatacgacggtgggcttcaccggcaccggatcaaggggtaaggggaagaagggagcagcct

SEQ ID NO: 64328 - DNA, 431 bp, Zea mays
  Clone ID: LIB3075-055-Q1-K1-G2
tccctcgattagtaataacaggaaaaccatccgccggaggccggagggcagattctccaccaccgcctccaccccgccctcacgacgcgaatctgcggcgaacccccctctcgtattccttctcgccgccctgccccgagcgcaccgtttagaggccgccaggctccggcacccccgcccgcccgggctcgcctggggtcgggatgccctgctgcccgccgtcgctgctcggagtcggcccacggctgcgctccttcctccgcgactacgacgcgctccagtccctcgccctcgtactcatctaccttcagattggttgtgcactgatcggatcacttggggcattgttcaatggggttcttgtgatcaacctggtgattggtctattcgctggtgttgcaattgagagcagtagccagagacttggtcgg

SEQ ID NO: 64329 - DNA, 406 bp, Zea mays
  Clone ID: LIB3075-055-Q1-K1-G3
ggatgagtacggaggagaacaagtttacaacttcgacgatatgggacaatatctttgcaactacgacgacatgggacaaagggtgatagtgtcacacaattcttcacctgaactcgatgcattcattaaaaaaatacaaaaatatcaagaacaaggaaacccactatcagcttaaggcagacctgatcgagcacttgtggcaaaaccattctgaggtatataaaattgattaatgtgctatttatttattttaatctactttatgtaataagaacaaagttgggcagtaaacatggttactgtttatttccaattcaattgcctgcaatcaatgtgtggagttaccgtgtcacaaaagggggggataatttaataattaaatttttaagtttttaaggaattttcc

SEQ ID NO: 64330 - DNA, 395 bp, Zea mays
  Clone ID: LIB3075-055-Q1-K1-G4
gacgatgctcatcggtgctgaccccacgcacgtcggcgaccgctgcatcagggtcacaatccaccactgcttctttgacggcacgcggcagaggcacccccgcctccgcttcggaaaggttcacctctacaacaactacacgcgcagctggggcatctacgccgtctgcgcaggcgtagaggcccagatcgtgtcccagtgcaacatctacgaggcaggtggagggcccccaaagaagacaactgtattcaagtacatgccggagaaggccggcgaccgagaggacgtggtggcagggtcgatcagctcggaaggggacgccttcctcaatggcgcgctgccctgcctgatcgataaccctgggtctgtcttcaggccagaggagtactaccagc

SEQ ID NO: 64331 - DNA, 362 bp, Zea mays
  Clone ID: LIB3075-055-Q1-K1-E6
aaacatcatggggcaagcctcacggctcgtcctcctcgccgtcgtggcgctgctgtccgtcggcctactgccgcaggcgctgggtaagggtaggggaggcaggggacacggtggcgccgtcaacccgcaggtcgccggcatctgctctcgcaccccgttcccggaggtgtgcacgttcaccgtcgggcggcacgcgtccaagtacccggtcatcgacaacctggccgtgctgaacatgcaggtggacgcgttcgccaagcgcaccgcgcaagcgcgcaagcacgttgcgaggtcggcccgcaccatcccgccgcagcagacgcaagcgctcacgttctgcgacaccatgtacatgaacacgc

SEQ ID NO: 64332 - DNA, 400 bp, Zea mays
  Clone ID: LIB3075-055-Q1-K1-G5
cggacgcgtgggcggacgcgtgggcggacgcgtgggcacgacctgtggggttcagatcggatcggaagcttccataagtgtccatcgggcttcgccgctcgccggtatggcgatccgcaaggggtcttcgtacgccgtcgcggcacttctcgcgctcgcctctgtcgccgccgtcgcaggggaggtcttcttccaggagaagttcgaagatggctgggaaagtcggtgggtcaagtccaagtggaagaaggttgagaacatggctggtgaatggaaccacacttggggaaaatggaatggaaatgccaaggccaaaggttttcaaacctccgaggattacaggttctatgccatttcagccgaataccctgagttcagcaacaaggataagaccctggtg

SEQ ID NO: 64333 - DNA, 431 bp, Zea mays
  unsure at all n locations
  Clone ID: LIB3075-055-Q1-K1-D11
cccacgcgtccggtgaacttcaacggatgtacaaattttcaagaattggtgtgcgaatctggggatagcggttctgtggatatgccagttgactcttgtccacctagttcaccaatcaagaatgaagagatcagtgagcaacctggccgtctgcttgaagttctcaattgtactgggtgccctaatattaagaaagttgttattcctttgatagcaaacttttcacatgtgtccaaaattaatcttaatctttcaaccaacttgaaggaagtggattngacatgctccaatcttttaacgttaaacttgagcaattgtagctcacttgaggtgctgaagcttgattgcccaagattgaccaacctccaacttttggcatgcaccatgttgcaagaggaagaattagaatctgcaatatccctttggtgggc

SEQ ID NO: 64334 - DNA, 356 bp, Zea mays
  unsure at all n locations
  Clone ID: LIB3075-055-Q1-K1-D12
gacaaggaggacagcgacatattcaagtgctacgacagctgctccgacgacgtggaggaggccgtcgcccacctcaacggcctcgtccgggagcccaccgacgccaagttcctcgagctcaagtcgtggctctcctccacgctcggcggcacctncacctgcgaggacgcctgcaaggacctgcccaagaccagcgacaaggacgacgtcgtcaacttcagcctcgacttcgagaagctgcagcgcgtcacgctcgacctcatcaccgaggcgtccggcaccatgtccgcaggcatcgccctgccacccttcaacgccggagcgccctnctacggcgcggcggcgccttccggggg

SEQ ID NO: 64335 - DNA, 398 bp, Zea mays
  Clone ID: LIB3075-055-Q1-K1-D3
gatggattgagtaactccagtcaaatgaaattcaaagatattaattatgtgaggaaaaacttttggaggtcaatgcatgaagactcagaacaggagaatgctgattcagaatttaaggccactgtttcacaggttcttactaatcaccaggaggataaggtgctcgacaacactgaagttcctcaggcatcaatctatagaaacttgtggattgaagcagaagcttcagcttgtaaactcaaatacgagcttcaacatgctctcctgaagctcgagacagcaaaaggcctcaacgacacaataaaagcccctgactcattggaagacagtaaaggctctaactcatacattttcagtaacaaaccacagaaccatgggaaaggaaccggtacatgcgc

SEQ ID NO: 64336 - DNA, 203 bp, Zea mays
  Clone ID: LIB3075-055-Q1-K1-D4
ttggcaactcctcataactgatgcaaggtcaacacaccgtttgactcacaatgtcagtgtcaggctccatgttcccagtggtagcgacctcatggtgactgaagtcacgttcgtgctgcatctaagcgtactctcatcgattcacaccatcatactattgaagattaccatcaggtacttcgactacacgattctacttgcta

SEQ ID NO: 64337 - DNA, 345 bp, Zea mays
  Clone ID: LIB3075-055-Q1-K1-D5
gcggagcgcctgcagccaaacgaacttcaacgctatcaatcatgtctggaataggggtcggaggtcaatgcatggggacacagattaggagaatgccgatctatgcccaaacggcactgtctgacagggctttagatgtcactagacgcctaacttacctggtagcgctcaactttattgggcattcatctatatgatcctcgtctattgtaacactatacaacatgtaggtcaacaccaacatcactctaacagccgttcatggagccagcgacatcactgaggctgagcgacactttgctatccgaggattcattaccagtcagcttcagcactatcttatac

SEQ ID NO: 64338 - DNA, 193 bp, Zea mays
  Clone ID: LIB3075-055-Q1-K1-D6
gcaatgtcttgttttcatgccgctgagggcaagcctgccaacttacctcctgaggatgaggctaagtttaaggctgaagacaacctctttcgaggtgcagtgattagcgcactggatactaaattccagaaaagctatatcatccttcccacagggaaagagctgtgggatgcacttgtcggaaagtttggag

SEQ ID NO: 64339 - DNA, 273 bp, Zea mays
  Clone ID: LIB3075-055-Q1-K1-D7
acatgcctgtgtatgtgcgatccatgtggtcgccgatgcgggcacatgctgcgatggctgtagcgttggtgatgcgtgattgagcggctcaatggtgcgtgctctacaggagtcttactaagcacgagcatcacaaccagctatagctcggactggctgtacactcatgcgactttgtatgccaagccgacggatgccagtctcgacgttagccgctgctgttgtagcttcaaggtcctgaacaagccctcgttccatagcatgtgctcatgc

SEQ ID NO: 64340 - DNA, 320 bp, Zea mays
  Clone ID: LIB3075-055-Q1-K1-D8
ggcttctcctccccctcttaccaagtcctcttcgggttagggttacttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtcttgcggcttcggcttcgttaccttcttcttcgagaacttcatgctcgacgctatcgagaacatgaaccgcaaggagctcgacggccgtaacatcaccgttaaccaggccc

SEQ ID NO: 64341 - DNA, 348 bp, Zea mays
  Clone ID: LIB3075-055-Q1-K1-D9
cttcgcagccagttgcaagttgctcgagcagaggctgaacatgccattcaacttaggcaacggtttggtggtgccgttgtcgcaaatggcacaggatctagttctagtccgctgctgatgtctcctcagttacagtcgctgaatccagcaccctcactcgcccctccaatcggtgcagccggagatgagcccaagagaacggcagcagcaatggctgacaagctggcatctctgtcagcgccggtgcatgtcctgagctccatcttctcatctttcgtctgcacacactgcgcttcggtatctttcatggaccggggaatttcctccaaaggcccacctttccgggga

SEQ ID NO: 64342 - DNA, 372 bp, Zea mays
  Clone ID: LIB3075-055-Q1-K1-E1
caaaccttgttggcctctttattgtgatgtaaccgatataaaaaccttatttgtgggttcaataaacatatcatgtagttcaattattgtggagattaaagtttttggctaatgttcactattctttgttgcaatatgttgtgtgtttgcttatctacaaggaaaatatgataggcatattacatgcccataaatgcgtagttgaagactatgtgtttgctcattttcatgcaactagaatggttcatactcatgaggattctcatgcacgggatcacctcatatgcgacaattaaatagattattcagttagtaaattacacataatcttttgatatgttagtcatttttactaaattgtgaatagtgcta

SEQ ID NO: 64343 - DNA, 360 bp, Zea mays
  Clone ID: LIB3075-055-Q1-K1-E10
cggacgcgtgggctcgtggtgtcatcgtggggtggcgcggcgacttctgggaattgcctcggcgaggattgggcgtgaggtcacgaggatttgaagaatcaccctggttactggaatctcaagtgccagccttacacttcacatgaactcccacctttggtgagttcatgcatattattccccacaacttgttgagtgatgaacatgtgtgagctcacccttgctatatcacacccccccataagagaagaacaggtggttcaagaggagccacacatttaggagtttgattcagtctaggtggcgtctcccacttgactttctggcgccaaggatggattttagatccctttatatttt

SEQ ID NO: 64344 - DNA, 387 bp, Zea mays
  Clone ID: LIB3075-055-Q1-K1-E11
ctggcgctagtcacaagccgatcaagggcaagctcatacgttgccactcccgaaggaacataaccctgcttattccacactgacatgtcacccttgcttatcgcacactctcactagtgcaacaagagctttgtttatatcgatgtgcattccatcataaagggcacagtcgatgatcttggtagcatggaactaggctggtacaccattgtcgctcactaacactgcaggaagcgtctgagcgattatctcagattgcatgtactgactgccatacatacacctggagctgcattaccttggctcacgacaggccctgataacccgtatgcatccctacttaagtttgccgtgctcttgacggaacctctgaggctgaacaaaccc

SEQ ID NO: 64345 - DNA, 376 bp, Zea mays
  Clone ID: LIB3075-055-Q1-K1-E2
caggaggagcgcgccatggagcggtgcatcctgccgctgctccgccgcgccacgctggtgcagacgttcggccagcgcaaccacgtgtgcctgcaggacggctccatcaccgtgccgccctacgccgacccgcgcatgatgcaggctcacctcatcagccccggcacgccgcgctccatcttcgactacttcaggggcctcttctacgacatgggcaacgaccccgagggcggctactacgccaggggcgctcgcgcgtcggtgtgggagaacttcaaggacaacccgctgttcgacatctcgacggagcacccgtcgacgtactacgaggacatgcagcgcgccatcttctgcctgtgcccgctggggtgggcgc

SEQ ID NO: 64346 - DNA, 337 bp, Zea mays
  Clone ID: LIB3075-055-Q1-K1-E3
gcgaccgggtgaacgagacggcacccagatcacctatgtaaaagccagtgcattcggatgtcacggagagacctatggccgcaaggcactggcgtcacagcaacaggaccatgcgctccaaccaatgcaggctattgatcatatgatgaaggcactcatcatcacacatcgtatgtccgtcggcatgatatctgaccttatgggcctcagaggacccatcgtcgctgatgctgaagttggtgctcaacactcacagtgttatgcagattggtttgcacatgttccaggacttaacgatctcacaccatactcttcagaacatgcccctaggcttgct

SEQ ID NO: 64347 - DNA, 348 bp, Zea mays
  Clone ID: LIB3075-055-Q1-K1-E4
gggttgtgtaggctgtgacgttttttagtgaggtaccttgctgagttcaagtctggtgcagagaggaaggatgctgcggagagcaccatgaatgcctacaaagctgctcaggacattgctcttgcagatctggctccaacccaccccatcaggcttggccttgctctcaacttctcagtgttctactacgagatcctgaactcccctgatcgcgcctgcaaccttgcaaaacaggccttcgatgaggcgatctctgagctagacagcctgggagaggagtcctacaaggacagcactctgatcatgcagcttctgcgcgacaacttgaccctatggactttcgacacc

SEQ ID NO: 64348 - DNA, 359 bp, Zea mays
  Clone ID: LIB3075-055-Q1-K1-D10
agcagcagtaggtcgaaaatggcgatgaggtcgctagcgctactggtcctcctcagcctgctggttgttggtgtggcgcaggcggtggagttggagatggagttggtgcctgctgatgcaattgcgatgactatggatcatgagccgccgcaggagtgcgcgaccccggtgagcgtggaggaggcgtgccgcggcgcgtcggagacgcacgccggcgtggcctacgaccactgcatggcgtcgctgggcgccgacccgcgcagcaaggaggccggcaacaagaacatgcacgcgctggcggtgctggccaccaggatggccatcgaccacgccgtcagcaccgagttcaagatcgacga

SEQ ID NO: 64349 - DNA, 354 bp, Zea mays
  Clone ID: LIB3075-055-Q1-K1-E5
cacaccttgttggcctctttattgtgatgtaaccgatataaaaaccttatttgtgggttcaataaacatatcatgtagttcaattattgtggagattaacgtttttggctaatgttcactattctttgttgcaatatgatgtgtgtttgcttatctacaaggaaaatatgataggcatattacatgcccataaatgcgtagatgaagactatgtgtttgctcattttcatgcaactagaatggttcatactcattaggattctcatgcaccgtatcacctcatatgcgacacttacattgattattcaattagttaattacacataattttttgatatgatagggattcctact

SEQ ID NO: 64350 - DNA, 349 bp, Zea mays
  Clone ID: LIB3075-055-Q1-K1-B4
cccgaccacctagctgtattcccaaaacgttttcccctggaaagagaaaaacggagattgcttgcccccttttcccttacgcatcgtcgaaaccctagccccgcctcgccgacggcacgccggatcggtcggcgccatgtccaaggccagggtctacgcctgcatcaacgtgctgcgacacaacgcgtactcggattacgaggcgctcacccgagaacggggcgagcaagatgactatgaagttgtcacgaacgtcacgagaggaaaatacagtgaagtatttgaaggcattaatggtaacaataatgagacatgcatcatcaagatccttaagcctgtgaagaaaaag

SEQ ID NO: 64351 - DNA, 395 bp, Zea mays
  Clone ID: LIB3075-055-Q1-K1-B5
acgcgaatcggcacgacgcatcggcatcgcctccgacgatcttgagacaaacaaaacccaccgctgcggcaactccgccttccgccgacccggggatcgcctgacaacaggcagcgaaaaggggcgcagggtttgcccgccaagatggaggacgtggacgtctcgcggcagctgaagcagatgacggacttgatccgccaggaggccgtcgagaaggccgccgagatcgaggccgccggcgccgaggagttccaaatagaaaagttgcagctggtggaagctgaaaagaagaagatcaggcaggaatatgacaggaaagagaagcaagttggcatcaagaagaaaattgattactcgatgcagctcaatgctttcagaattaaaggccttcaagc

SEQ ID NO: 64352 - DNA, 256 bp, Zea mays
  Clone ID: LIB3075-055-Q1-K1-B6
aaggccatgacgacgtcctagtcttggctcttccttgctattcaagctactgcgctacgcgccgtcgtcatcgtcgtacaaccgactcgggctgggctcggtgcaccgaccttcgcctcactgcgcccgcatgcacatgcagccggcgaagggcactaaaccacactcggcaacctgtcgcgtagcctgactctgcgtatgctcagccagtactctgcgacttgtggcagacgaggttgcgcccgagctgcacgca

SEQ ID NO: 64353 - DNA, 180 bp, Zea mays
  Clone ID: LIB3075-055-Q1-K1-B7
cccacgcgtccgattgacgatcgggaaatgatggacggagagggacaggcggaggcgtctcggtcgccgatacgagcgatccatcgacccatcggcagcggcagcggcagcggagcgggtggtggtctgcactgcactgcagccgcaagcggcggcgcagtgcggaaggagtaggtgcgt

SEQ ID NO: 64354 - DNA, 145 bp, Zea mays
  Clone ID: LIB3075-055-Q1-K1-B8
gggtaaaaatgattaaacaaacttttttaatccaggcctttaaacaccaaatacaaagaaattcataagtatttaaaccttttgaaaataaaattgaaaccgttttcataattaaaggggataacatcaacaaatttttcctaaa

SEQ ID NO: 64355 - DNA, 296 bp, Zea mays
  Clone ID: LIB3075-055-Q1-K1-B9
ggcgcacgcttgctgactacaacatccagaaggagagcaccctccaccttgtgctccggctcaggggaggcatgcagatctttgtgaaaaccctgaccggcaagactatcaccctcgaggtggagtcctctgacaccattgacaacgtcaaggccaagatccaggacaaggagggcatcccttcagaccagcagcggctcatctttgctgggaagcagcttgaggacgggcgcacgcttgccgactacaacattcagaaggagagcacccttcacttggtgctgcgccttaaggga

SEQ ID NO: 64356 - DNA, 417 bp, Zea mays
  Clone ID: LIB3075-055-Q1-K1-C1
ctgtggcaagaatgctggtctcagcagcagttcactcaagctccacttgcagaaggcacacaagaagatatcctctgggagcgtagacagtgcaatgactctggagatacaaaaagcattagaggcaatcaaagctggctggggcggcagtgacagcccagtgcataaatcacaatcacacatagaaggattttgacgtttaatcttacgttcctacggtgctattaatatatcaacaaggctggtagtcggcgaccgctttaagagtgaagcctcagctctagacttcatgacacttgtaagtagcacatttttggaacatttggtttttattctataggtcatgagcttggattgacaagaaccatccatagagggaatgtaagttctggtataaaattgtgcgaatcttttttt

SEQ ID NO: 64357 - DNA, 212 bp, Zea mays
  Clone ID: LIB3075-055-Q1-K1-C10
aagaagaatagcagccgaccctattgccgccgctggtaatgcccgcgcatggggttctctggctttggtcggctgcttcggttgcatcgtctggagccttgtgatttcacgccggtgcgaactcattgccgcgcctggagagagatgcgattgagggagactgcggatgcttttgtgcgactgaagttgtgcttgcacagtggcgacatgcg

SEQ ID NO: 64358 - DNA, 411 bp, Zea mays
  Clone ID: LIB3075-055-Q1-K1-C11
gcgatgtcggcaatcaccccgacgacagctacaaccggagtgcgctcccgatcgtcgacgcccttacggtaaagaatgtccagggccagaacgtcagggaggctgggctgatcaagggcatccccaactcggccttctcccggatctgcctgtcgaacgtcaagttcactggtggcgcacctgtctggccgtggaagtgcgaggctgtcagcggtggcgctctcgacgtgcagccgtcaccatgcacagaactgacttcaacgtcttggaccagcttctgtacaaattcgctttgatgctttggcagctagcttaacctgttgtaatcctccggatttaccaagatggattccggtgccttaaagcttgggcacccaaggatttatcttcccgaaaattaatttggtttta

SEQ ID NO: 64359 - DNA, 196 bp, Zea mays
  Clone ID: LIB3075-055-Q1-K1-C12
ctaacgactatcattaccctttttttattgaaatatgttgggccgttaagggcctttcaaattattaagtggtgggggtccattttggcacttgggctagggttcatgccttgaaattaatttggttttctacactgctgagatgtgcaagcgttttacccagggggtgcactttacgggtttttttgggttggac

SEQ ID NO: 64360 - DNA, 312 bp, Zea mays
  Clone ID: LIB3075-055-Q1-K1-C2
gtcgtactggcctgcgcgtgcctgcgcaggagacgtcgtggccatggatgaaaggcgcgggcacacggcgatcgccgctgacatacagggcatcgtgtcgactctgattgataaaaccatagactcgcaggctgagttgctacgacaattatcagacttcactcaatgccatcatagcatgaaagtgacgctagtgatgctgaccagcagcgagtgaatatagctgccgaggcaatatcgtaccgacctactactctgcatctacagcatctggaacgcgtccaggattcaagggttgatccttctgctatg

SEQ ID NO: 64361 - DNA, 344 bp, Zea mays
  Clone ID: LIB3075-055-Q1-K1-C3
ggcaggctttcgacggcgtggtggccgccgctacggcagagaagcggtcccaggcggtggaggccgtgctgcagcagcagctgaacatggacgtgtccctgtccaaggcgacgtcttccggggacgagaacaactacgtgagcgtggccgccgcctacgagaaggccgcgggcgccgtcatcgcggcgacgccggacaacaagctccgcgctatggcgttcgcgttcgacggcgcggaggcgccttacccgggccggtgccacgtcgtcgacaagcccttctgagagacctacgccaagacggagaacgccttcagcggaaccattgcctacggggacacgccc

SEQ ID NO: 64362 - DNA, 258 bp, Zea mays
  Clone ID: LIB3075-055-Q1-K1-C4
ccatcaagtacaagtaggcaaattcgtcaacttagtgtgtcccatgttgtttttcttagtcgtccgctgctgtaggctttccggcggcggtcgtttgtgtggttggcatccgtggccatgcctgtgcgtgcgtggccgcgcttgtcgtgtgcgtctgtcgtcgcgttggcgtcgtctcttcgtgctccccgtgtgttgttgtaaaacaagaagatgttttctggtgtctttggcggaataacagatcgtccgaacgac

SEQ ID NO: 64363 - DNA, 388 bp, Zea mays
  Clone ID: LIB3075-055-Q1-K1-C5
gacggcatgcactccagcgcgtggcggcaagcgccctttatgtacctcttgcgcatcgtacagaagacagaaaggcaaagctacaggcactattttcacaaatgcgtactgttgcaatgctgccttcagtcggtcctcgcatgcccatgtttacacctggtgtccctggagttggtcagcagctgatctatggtcagccaccatcagcctacatcaaccctcaggctggatttgctttccagcaacctctgatgcctggtatgaggcctggtggtccaatgccgaactttatgatgcctatggttcatcaaggacagcaaccacagcgtcctgcttgtagacttgctggtggaatgcatcatcccatgccaatgcttggtcagcaaca

SEQ ID NO: 64364 - DNA, 319 bp, Zea mays
  Clone ID: LIB3075-055-Q1-K1-C6
atcttgacccacaacagcaagggcatcaactaccagatcctttccaacccagagttccttgcggagggcactgccattgaggacctgttcaagcctgacagagtgcttatcggtggccgggagacccctgagggcaggaaggccgtccaggctctcaaggatgtgtacgctcactgggttcccgaggacaggatccttaccaccaacctgtggtctgctgagctcttcaagctcgctggcaacgcgttcctggcacagaagatcttctctgtgaacgccatcttcgccctctgcgaggccaccggcgcgaatgtgactg

SEQ ID NO: 64365 - DNA, 374 bp, Zea mays
  Clone ID: LIB3075-055-Q1-K1-C7
acgccacctacgtcgccaactacaacaaggcgctggagcagcttgacactgccgtctccaagggcgacgcctccgctgtcgtccagctgcagggcgccatcaagttcaacggcggcggtcatgtgaaccattcaatcttctggaagaacctcaagcccattagcgaacgtggcggcgagccgcctcatgggaaacttggctgggccatcgatgaggattttggttcgtttgaggcactcgtaaagaagatgaatgcacaaggcgctgctttacaagggtctggatgggtgtggttagctctggataaagtggcaaaaaaggcttcagttgaaaccacagcttatcaggatcctgtggtgactaaaggtgcaagc

SEQ ID NO: 64366 - DNA, 421 bp, Zea mays
  Clone ID: LIB3075-055-Q1-K1-C8
cacaagtccaagctcctgaagatatcagtttcctggaaaccattgatactgctgaacccctcgcaaggattgcacctgctgactcgtcttctaagcatggtgaagttgacctatcacaggagtttgcattaaccccattagcaatgaactaccagggcagtgatcatgattctgtgcactcccctgggggcgtctcatcgcccgataaagtctccacaaactcgcgagctttagttccagttccagctgcagatcccaatgcaggagctatagttccagcgaataagtctaagaggtcaccagagcatgggcaacgcagaatcaggcgcccgttctctgttgctgaagtagaagcacttgtgctcgcaatcgaaaagcttggaaccggaaggtggcgagatgttaaactttgcgcgtttga

SEQ ID NO: 64367 - DNA, 428 bp, Zea mays
  Clone ID: LIB3075-055-Q1-K1-C9
tcgccccgccgctcctcagccatcctctccatctcggtgtcacacactccgcatacgcacctacgagagtcgagtgacagcgagcgagcgagcgagcgaagccatggctcttcgcaccctggcatcgaagaacgccctatccttcgcgctcggctgcgcggcccggccgtcggcggcgtccgcgaggggggtgacgactgtcgcgctccccgacctcttctacgacttctgcgcgctgtgaccggccatctcgggggagatcatgcgcctgcaacaccagaagcaccaagccacctacggttgcaactaccacaaggggcctgaacagcttgacccttccctcggcaagggccaacgcttcgctgtcgtccagcttcagggcgccatcaagttcaacggctggggtcatgtgaaccatttaatctttt

SEQ ID NO: 64368 - DNA, 392 bp, Zea mays
  Clone ID: LIB3075-055-Q1-K1-D1
cggacgcgtgggtttcaagaccgtactggtagtttcacggagtgttctatagcagattcagagccacagttcgaaaacttgcagcttgaggacgaggactggttagtcaagccaccactgtccgcaggagcatatgctgccaatttcaatgatgaagaatggctggtcacaccactgaagcgctcccgtgtcatgaatggtattgaccatgaggatgaagagtggttagttaaggcgacgaaactgtctggtgccaaggatgctgatcttgaagctgaagagtggttagtcaagtcagggcagcctaacgatgctttggattcggacttccgcttcatacacgaattttctgaacaaggtgctgcagaacccttgcacatctatgtcagtga

SEQ ID NO: 64369 - DNA, 381 bp, Zea mays
  Clone ID: LIB3075-055-Q1-K1-B3
aagggtgataaagttgtgcacgagaagaaggttcttgaagtgtttgtggagaaaggcatgcaaaatgggcagaagatcacattccctggtgaagctgatgaagcgcctgacactgtcactggagatatcatctttgttctccagcagaaggagcatcccaagttcaagagaaagggcgatgacctcttctacgagcacaccctgaccttgactgaatctctgtgtggcttccagtttgttgtgactcacttggataacaggcagctgctgatcaaatcaaatccgggcgaagttgtgaagcctgattctttcaaggcgatcaacgacgaatgcatgcccatgtaccaaaggccgttcatgaagggcaagctgtacattcac

SEQ ID NO: 64370 - DNA, 270 bp, Zea mays
  Clone ID: LIB3075-015-Q1-K1-D11
cggacgcgtgggcggacgcgtgggtgccatatttgaaacagttaagaattcatatataagagtgcatatatatatatataattctgccaagacaaaggtaatggagtcgtcacgcatgttccagccggccatcatcctgcttctcctgctcattgtgaccaccgatgtggcgcatgcggcgagggaatgcgagaaggacagcgagcgattccttggggcatgcatggcgtcggacaactgcgccaacgtgtgccgcggtgagggcttctc

SEQ ID NO: 64371 - DNA, 433 bp, Zea mays
  Clone ID: LIB3075-015-Q1-K1-D2
cgagaaccccgagaagagcatagactccctccacgtcgatggctacgccttcttcggcgtcgggatgggccccgggaagtggtcgccggaggtgaggaagacgtacaacctgctggacacggtgagccggcacacgatccaggtgtacccgcggtcatggacggcaatcatgctgacgttcgacaacgcgggcatgtggagcgtgcattccaacatctgggagcggtactacctcggggagcagttctacatcagcgtcgtctcgccggcgcgatcactgcgcgacgagtacaacatgcccgacaacgcccttcgctgcggcaaggtcgtggggctgccgctgccgtcgtcctacgcccccgcgcgctaagacgacgaaagcctcgttttcttctcgtggtctgaccatccaatccaaactcaaaagaacaaa

SEQ ID NO: 64372 - DNA, 419 bp, Zea mays
  Clone ID: LIB3075-015-Q1-K1-D3
ttcagactttcaacagaagtggatttcatcagattcagctggatatggaatttctcaagacctctcttaaggaatttgtggatgatgaagcagccattagctttttactcaaagaggtgaacaatgctgcccatgagagatgtcttgacccaatccctcttgagccccccatattagataagctcataaatgcaaaactagcaaaaattaaagagagaaacccaaatatgcggtagctatgcacagattggtgtcgtttactagaattcagttctgtccatttgaatgcactattcagagttgtgtgtgcaacttcatagagtttagggcacatagcatggatgaaaatctggagtcagactcagatttgaataacactccccaaattgtatactggtatacttaatttggggtggtcg

SEQ ID NO: 64373 - DNA, 260 bp, Zea mays
  Clone ID: LIB3075-015-Q1-K1-D4
tcagctggatatggaatttctcaaggccgctcttaaggaattcgcggatgatgaagcagccattagctttttactcaaagaggtgaacaatgctgcccatgatagatgtcttgacccaatccctcttgagccccccatattagataagctcataaatgcataacttgcataaatttaagagagaaacccatatatgcggcatctattcacagatggttgtcttttactaaaattcagttctgtccattttaatgcactat

SEQ ID NO: 64374 - DNA, 400 bp, Zea mays
  Clone ID: LIB3075-015-Q1-K1-D5
attgcccattgccattccttccttcctccacagagaaatccgatccgcggagatttgacccaaccagatcatatcacacacgtaatcccatcccattccgcccgcaacagcagcaccaccggtgggaagaagaagatgaagaaggccacttcgctctccgagctgggcttcgacgccggcgactcgtcgtcgggcttcttccgccctgtgtccggcgactcgtcgacgccgacgtcgcagcaccaccggcggaggctgaccaaggtgtcggtcatcggcgcggtcaacgtggggatggccatcgcgcagaccatcctgacgcgcgacctggccgacgagatcgcgctggtggacgcggtcccggacaagctccgcggggagatgctggacctgcagcacg

SEQ ID NO: 64375 - DNA, 226 bp, Zea mays
  Clone ID: LIB3075-015-Q1-K1-D6
tctgtttcgaattgtagctctactactcttttttggatagatacgccttcttcgacgggaggataggacatcataagtggtaggccgacgcgaggaagacctacaacctgatggacaccgtcagccggcacaagaaccaaatgtacgcgacttcattgaccgaaatcatgctgaacttcgacaacgcggtcatgtggatcttgcattccaacatctgggaaccgta

SEQ ID NO: 64376 - DNA, 432 bp, Zea mays
  Clone ID: LIB3075-015-Q1-K1-D7
attccgtgattcagaagttgggtactgccagggtctaaactatgtagctgcactcttgttgcttgtgatgaagacagaggaggatgcattttggatgcttgctgtactccttgagaatgtacttgtcagtgattgctatactgacactctttctggatgtcatgtcgagcagagggtgttcaaagatctcctggctaagaagtgtccaaggattgctgctcaccttgaagcaatggggtttgatgtttcacttgttgctacagaatggtttttgtgcctcttctcaaagagcctgccttcagagacaacacttcgggtatgggatatattattcaatgaaggagccaatgttttgttccgtgttgctctcgcaattttcaagatgcgagaagatgatctactgcgcatgcaacatatcggtgatgtgattga

SEQ ID NO: 64377 - DNA, 276 bp, Zea mays
  Clone ID: LIB3075-015-Q1-K1-D9
cggacgcgtgggcaaattttgtaaagcctatgtgcttctccgttgtatttctactcgtcgtattttcccatggaaaactcacgggaaactttatctagcttagctctagtttggaaactcaaatcccttcgtggatggaaggggtttgagggacaaattagtttattttcatcttaatcccttctaatccccgggtgatttgagtttacaaactagcctttagagtaaagatttaccacattggcaatgaaagatgatggcctgggaactaggtgg

SEQ ID NO: 64378 - DNA, 400 bp, Zea mays
  unsure at all n locations
  Clone ID: LIB3075-015-Q1-K1-E1
ctggtgtgggcatccgtgtcttggcagctcgcttctctcggagttgtgggcttggtttttgaggtatcggcgttgttctcgaatgtggtcagcacttttgctctaccaattgtccctctttttggtgtgatggcctttcatgacaagatgaatggagtcaaggtcatagctatgctgatatcgatatggggttttggctcgtatctctgtcaaaactatctcgatgctaagaaagctggaagtgcatatggggattcctagtgtctacaattttcttgtgatagattgctctttatcggtttagtttggttcttgcgagatgataagtgtttattacttatgttaatttaagtatgttttgtgaaagtgctttcagctgtggttgttangtggtgtgagt

SEQ ID NO: 64379 - DNA, 420 bp, Zea mays
  Clone ID: LIB3075-015-Q1-K1-E10
ccggacgtaaggcggcgatggtggtggttaagaacaagaaggtggtgctaaggaggcgcgtcaccgggttccccacggaagaagacatggagatcacggtggacactatcgagctgggtgtgccagcggggctgacggccgtgctgatcaagaacctctacctgtcctgcgacccctggatgcgcggtcgcatgagcaagcatgaagacggcgccaccgtgccagcctcggactttgtcatcggagaggccatggtgaatttcggtgtgggcaaggtggtcggctcgacgcaccctgagttcaccgccggtgatcttgtctgggggctgagtgggtgggaggagtacaccctcgtcacccagccggaatcgctgcacaagatcaaacacaccgagctgccgctcttctactacacgggag

SEQ ID NO: 64380 - DNA, 159 bp, Zea mays
  Clone ID: LIB3075-015-Q1-K1-E11
cgacccacgcgtacgtcaaccttaacgcgcccaccgacttttgttatacaacaacaacgtccacctaaggaggtagggcaacatcatcatcacggactaaaacatcgagaccaccgacgacactatctatcattgtctcccatccaacctcactcttcg

SEQ ID NO: 64381 - DNA, 425 bp, Zea mays
  Clone ID: LIB3075-015-Q1-K1-E12
ggaggaggtggccaaccccatcgtcatctaccagtacttctgcccgcagaaggtatgcgctggcaagcggagcaactcctcgcatgtctccgtcaaggacgtcacgttccgcaacatcaccggcacgtcgtccacgcccgaggccatcagcctgctctgctcggagacgcagccatgcagcggcgtctccctcatcgatgtcaacgtggagtacgccggcaagaacaacaaaaccatggccgtctgcagcaacgccaagggcaccgccaagggaagcatcgaggcactggcttgcctggtctgatgatgaccttccttttgcatgcatgcatggtatctcatccttgatgatgatctagctcactagttctttttaatttccgcttcattcgcttttccaaattcgattgtgtttcagccaagtt

SEQ ID NO: 64382 - DNA, 293 bp, Zea mays
  Clone ID: LIB3075-015-Q1-K1-E2
cttccaaccggttgaagatggcaccggttgcctttattccttaaaagcgctggagagtttaaaggattggtccaaggcctctggcacgcttgccgtataattcacctgcgcaagttttgggcgctttagaaaagccagcgcgtgcccctggtgtgggaaagttttaaaatgtggtaaagttcacatttagagaggtcgacacatctacgggagactctgatgatgatggtgaggatgaataccacctgttagaggtcttaaaagtttgatcagctgattatctgctgagggtt

SEQ ID NO: 64383 - DNA, 426 bp, Zea mays
  unsure at all n locations
  Clone ID: LIB3075-015-Q1-K1-E3
catcaacaggcttgtaccggagcacatttgacggcagaacggtgtcaactttgggcatatcgggagctaggagggcaggcggctgccatggtctagtttttggtcttggtaccccatgtgcagggccggttgcaggtgaaggtgatattgctgcaccatctgggagaggaggggctcagcagtacctgagagagctgaaactatgtaaattatctgaccgcgaaggagtacggccagtgttaagccagtaaactggcgcatgttggtccagagtagttaaggtaagaatgtagcaggtggagactggtaaatgcctagggtcgtttttagttgttaccagtattttgtaatgtaatgttcgtcggtactttccagcagtagtgtagctgctcctgttttgttcgcccgccatgatgtanatgatca

SEQ ID NO: 64384 - DNA, 271 bp, Zea mays
  Clone ID: LIB3075-015-Q1-K1-E4
cagagctcctgactgttcctctctcccttctcacgggcgggctccgtctgttccgtccatccaccgccccggtcgtctcccggccagatccctctcctgcaagggtttctttagcgacgtggtcgggagaaagatgaatggcgggtttcctctccagggtcctcctgctggcttttggctatccctatccggcctatgaatgctacagaaccgttgacctgaccaaaccccgatttgagcagttcatatttggtggtcagtattgaattta

SEQ ID NO: 64385 - DNA, 433 bp, Zea mays
  Clone ID: LIB3075-015-Q1-K1-E5
atcgccttcgtctccaccgaggccgagaccgacaagcctgagatcgagctcaagcccgggatcgacctgcttggccctgtagaggagaccttcttcgacatctacgacagatatgaacccgtcaacaaccctgacgacgactgctgtttcctcacaaatagctatgactccaccacccattttgagacgacggtcaaggatgtgctcgccttgtacaacaagatcactggaaaggagcttgatctctcagtcgatttgaacgcggctagtgctactgagcaagaagctgcttgaacaccccggcggcctctttttttgcagctctacacaatagctatttcttcgattgtttttttaaaatgttccatagatggataagtttattgatgaaatccattattgcatgcattttggagttccgtctttgtcacat

SEQ ID NO: 64386 - DNA, 418 bp, Zea mays
  Clone ID: LIB3075-015-Q1-K1-E6
gcggcgaggagagccggcggccacaggatggagaaatggcttccgcacacaacgctctccgggtgtttttcatcctagccgtggtatgtgccgtatgcacagcgaaaaggacaggagccaacaaggaagaatcggcggcagcccccggtggcgctgctggaggcagcggcgggacgttcgacatctccaagctcggcgcgaccagcgacggcaagacggactgcacaaaggcagtccaggacgcgtggacgtcagcgtgcgaagcgaccggaagcgccacggtggtgatccccaagggcgactacctggtcggccctctaaacttcactgggccatgcaaggggagcaacatcgccatccagctggatggcaacctgctgggatcaaacgacctgaacaagtacacggagagctggat

SEQ ID NO: 64387 - DNA, 230 bp, Zea mays
  Clone ID: LIB3075-015-Q1-K1-D10
cccacgcgtccgcccacgcgtccggttctagatcgcgagcggctgccctttttttttttgtttaacatacataccaagcgatacgccatcatgcatcaagaccagcccaggtatatgagtgcatcccagatcctatgaaactagcgtcaacaacgagcccacaacgacagaaccaatcgttaggtactttcgcaagacactgaaaagagggaacattccgacagtgaaca

SEQ ID NO: 64388 - DNA, 401 bp, Zea mays
  Clone ID: LIB3075-015-Q1-K1-B4
cagcattctattcagggtgcatggtcgtgtctctagaatatgatcacacggcaagcatcgagtgccttggcgacccaatgaaacccttgtacaagggcggcattgtccagaacagcgagttcaacagcggactgatgggctggtcgacacaccggaacgtcaaggccggcgtgagcagatcgccgtccggcaacaagtttgcagtggtgcatggggcgggaagctacgtgagcagcagcggcaagctcctaccgtcccacagcgtgtaccagagaatccagatgcagagcgacaggcactactcgctatcagcatggctgcaggtgtcgaacggcacgtcggcacatgtgagggcggtgatcaagtcccccaacggcgaacgcgtcatcgctggtgccatc

SEQ ID NO: 64389 - DNA, 380 bp, Zea mays
  Clone ID: LIB3075-015-Q1-K1-B5
atcacaataagatggcgtgtatagacaatgcaatgagagccttgttccttttagcgctcttctgtgtcgtgcatggtgagaaggcaaagtcaaaggacaacgatgcaaaagcgtccgggcccggtgggtccttcgacatcaccaagttgggcgccttcggcaatggcaagacggatagcacgaaggctgtgcaggaggcgtgggcatcagcgtgcggcggcaccgggaagcagacgatcctcatccccaagggcgacttcctcgtcggaccactcaacttcacaggcccatgcaagggcgacgtgaccatccatgtgaatggcaatctgctggcgaccacggacctaagccagtacaaggatcatgggtaatggatcgag

SEQ ID NO: 64390 - DNA, 430 bp, Zea mays
  Clone ID: LIB3075-015-Q1-K1-B6
gagaagtcagcaacctatgatgagatcaaggctgcggtcaaggccgaggcagaaggtagcctcaagggcatcctgggttacgttgaggaggaccttgtttccaccgatttccagggtgacagcaggtctagcatctttgatgctaaggctggcattgccttgaacggcaacttcgtgaagctcgtgtcctggtacgacatcgagtggggatccagaacccgcgtggtcaacctgatccgccacatgaccagcaccaactaaaatgaagacctaagggcctggtaatccaaccaagtgtgctctttcccccccgaaaaaagatgcttccaagattaaatttttttcattggaattgcttaaacctaggttgggggtatcctagtggttggttgagcattaatggctcatatttggtcaggtctatgtgtcc

SEQ ID NO: 64391 - DNA, 423 bp, Zea mays
  Clone ID: LIB3075-015-Q1-K1-B7
cggacgcgtgggcgacagcagcggcgggcgacggggaacggggaacccctgtactgtatttcgtcgacctttgccatggcgtcgatgatgagttctcgcgcgggcgcggcggcggccggaggaggagaacaccgccgtcagcacgtcaccgtggcgtgcggtgggctgacgcggccgagtaccaggcccgtgccgggcgcagctggcccacggtccgggacgccgaggccgcggggacctgctgcagctgcgggcggctcttcgtcttcgtcgccgacggggcgcgcggtgccggagtgcaactggtggggcgctgccgcgcggcagcaggcgacgccgaggcggtcgaggagcggcagggccgcggtcgcgcgcgtgcccacgggcaaggggaaccgcgagctggtgagacgggcgctcacg

SEQ ID NO: 64392 - DNA, 425 bp, Zea mays
  unsure at all n locations
  Clone ID: LIB3075-015-Q1-K1-B8
agacgcggtctcaaagtttctgttgctggcattccaaagactattgacaatgacatccctgtaattgacaagtcatttggtttcgacacagcagtcgaggaggctcaacgtgcaataaatgctgctcatgtggaagctgtaagtgctgagaatggtataggtcttgtcaagctaatgggtcggcacagtggttttattgcacattatgctactctggctagcagggacgtggattgttgcttgatcccagaatcaccattctatttggaaggcgaaggcggactttttagatacatagaaaaacgtttgaaggacaatggtcatatggttatcgttgttgctganggtgctggacagaaacttattgctgaaaccatgcagtcaattgngaaagatgcttcangcaacgagctgcttcttgatgt

SEQ ID NO: 64393 - DNA, 414 bp, Zea mays
  Clone ID: LIB3075-015-Q1-K1-B9
tgtatttctacgatttgaaatatagtttgtttgtgacgggagcgagtaattctcagactcctcatgtgcacagtcactttttcctcataatacatccaggtggggttcctcccccagttcactctataaaaaaactatcacacctacggtcacaaggtttcgtataaatacagttaggttgggacgggagcgagtaattctcagactcctcatgtgcacagtcactttttcctcataatacatccaggtggggttcctcccccagttcactctataaaaaaactatcacacctacggtcacaaggcttctaccccgtcgatatatatatacaaatggattgcataaaagaaattatcgagggcgagaacactctgccgtatcagtcttgataactctggtgttgtaagaaccac

SEQ ID NO: 64394 - DNA, 285 bp, Zea mays
  Clone ID: LIB3075-015-Q1-K1-C1
gtacttgaccaagaagtacttgaagaagcacaaggtgcgagattggctccgtgtgattgcagccaacaaggaccacagcgtctatgagctgcggtacttcaacattgctgagaacgaaggcgaggaagaagattagactgcattgcacttatatctcagttttgaactcattgaatttggtacctgtacccgtagttttgcaaatgcccccatgttatgctctggtgaattttggatggtttatttatttgaaaagtctatgcatttggctgctcctatatgaac

SEQ ID NO: 64395 - DNA, 216 bp, Zea mays
  Clone ID: LIB3075-015-Q1-K1-C10
gtttgagctggacgtgctgttggaatctgttagtgttacaattaagcgtgttgaggagttggtggtaagtatggaaggcaactcactgaaacctgatagctctatccacctcgatgaacatttgactagtttgaatatgaggtgcattgagtggctatatggtgaccatggacttgatgttgtggatgttctttcaaaaaaatgctggtgtgacat

SEQ ID NO: 64396 - DNA, 350 bp, Zea mays
  Clone ID: LIB3075-015-Q1-K1-C2
gatccccccacaccttgagacctgcgttgtcacccacccatcaaggttggggccgccagcagagttcagccgttcctgttcctgataaaacgagagaaggatggcagtgtctcagggagctgtcctattcttgcttctcctactcgtcgcagcagaggtgggaaccatcgatgccaaaatgggagtagccatgcccatgcatgccttgataatggagaaagcgaaacagcacgagaaggagaagaaggaggagaaaagcacggagaaggaagagagtcaatgcttatcgccgagtctccagttcgagggcttctgcttcaacagcgacagatgctcctaggtgtgcatga

SEQ ID NO: 64397 - DNA, 430 bp, Zea mays
  Clone ID: LIB3075-015-Q1-K1-C3
ggaaaatgctgcgccacgccgcccgccgtctcgtttcccgcgccgtcgctccgcccaccgcgcgccgggcgctcgccacggcggaggtgcccgcggaggccgtcgaggactccacgttcgtcgaggcctggaaaaaggtcgcccccaacatcgagcccccagcgacgcccctctccctcatgcagccgcgcccgcccacgccagctaccatccctaccaagctcaccgtcaacttcgtcctcccctacaagtccgagatcgccaacaaggaggttgacatggtaattgtaccagctacaactggtcagatgggtgttttgccaggccatgttgccacaattgcagagctcaagcctggtgttctctcagtacatgaaggaaacgatgtgagcaagtactttgtgagcagtgggtttgctttcgtccatgc

SEQ ID NO: 64398 - DNA, 333 bp, Zea mays
  Clone ID: LIB3075-015-Q1-K1-C4
accagagctcctgactgttcctctctccctccttacgggcgggctccgtctgttccgtgcatgcaccgccccggtcgtctcccggccagatccctctcctgcaaggtttctttgcgagtggcctgagaagatgatgggcggattcctctacaaggtcctactgctggcttttggctatgcctatcctgcctatgaatgctacaagaccgttgaactgaactaaccacagattgagcagctcatattttggcgtcagtattggatcttagttgccctgttgacagttttggagagattcggagattttacaatatcatggctaccgttttactc

SEQ ID NO: 64399 - DNA, 436 bp, Zea mays
  Clone ID: LIB3075-015-Q1-K1-C5
atgtaatgctttaatttactgcattctacgtcgttttttcccttcttcttctatgtgtttctttttatgtggcagcaatagtattattcaatctcttatgagctgcagctacgtacaaaaagaaacaaatagaagaagaagggaaaaaacgcgacaagaacctgggccccgaggcctcccgcccagggaaacccgccaacgactacacccgcggctgcaacccgatcaccggctgtcgcggctgatcatatctctctggtcgatgtgcgcgcaatgtcaatgtcgcacgcgcgtgcaggtaccaggcctcagcgtgtggtgccgcgtgtgtgtatatattacacacatgcattatacattggtcgtcgatcgttactgtatgcatggcaactgatgcttcttgcctcgcatatctgacgtgtatactgatgtatgt

SEQ ID NO: 64400 - DNA, 405 bp, Zea mays
  Clone ID: LIB3075-015-Q1-K1-C7
gaaacaatccttgcacccctcccctccgtcaccccaccacattcggccagcccaacgaaaatgtcgcgcgccacagctgcggtcctcttctacatcctcgccgtcgctgccctcagcgcggccgaggcaccggcagagtcaccgaaggcaggcagtcctgccaaggcaccggccgagtcaccgaaggcaggcagtcctgcagctcctgccaaggcacccgagtctgctgccacgagaactgcccccgctaaggcacctcaagccggctacacccccgccgatgacgctgccccatcgtcgtcgtcgtctaggaagtctggtccagctgccgcgccgaccaccgtcgcctctacaccgtcttcttccacggacgaggagttgagcccttcgccgtcggcatccacc

SEQ ID NO: 64401 - DNA, 137 bp, Zea mays
  Clone ID: LIB3075-015-Q1-K1-C8
acggaaccatatgaaagatatgggagtgttgtttggtaagggtggtttctacgggaacgtttgtaggataacaccaccgttgtgcttcaccaaagaggattccgacttcttcattgaagtgatggacattgcgctat

SEQ ID NO: 64402 - DNA, 116 bp, Zea mays
  unsure at all n locations
  Clone ID: LIB3075-015-Q1-K1-C9
ntccgcaattccagnccgcaagtggtccgtttagtatgnttgtgcattacgtgaaagggaaaaatccctgataccagagccaatctactgggtctctttagttcagattttattat

SEQ ID NO: 64403 - DNA, 409 bp, Zea mays
  Clone ID: LIB3075-015-Q1-K1-D1
cggactcgtgggcggacgcgtgggctgtaatcgctgtcatggggcatgttggcctcacaccgcaagctattagtgttctcggtggatttaggcctcaagggaagacggttgacagtgctataaaggttgtggagacagcacttgccttgcaggaggctggatgcttctcggttgtgttggagtgtgtgcctgctccagtggcagcagctgcaacatcagcattgaaaatcccaaccattggcattggggctggaccattctgtagtggccaggtcttggtgtaccatgacttgttagggatgctgcaacacccacatcatgccaaggtcacaccaaagttctgtaaacaatttggtaacgtgggcgatgttatcaacaaggcgctatcagagtacaagcaagaagtgga

SEQ ID NO: 64404 - DNA, 437 bp, Zea mays
  Clone ID: LIB3075-015-Q1-K1-B3
gatgaaagaccatgcaatggttttcaagaagctttagctcgatacagagagattgtacctcatcttcgcctttcgggtcctacgtcattcgccccaataattgacatggccacaaccattgtggagcaaagtggtggccaataccatgttttagtaattattgctgacgggcaggtcacaagaagtgtagatactgaatttggtcagttaagcacccaggagcaaatgacagttgatgctattgtacaagcaagccaattcccattgtctataattcttgttggagttggagatggtccatgggatatgatgaaggaatttgatgacaatataccagctaggtcttttgacaatttccagtttgtcaacttcactgcgatcatgtcaaaaaagataagtcaaagcaaaaaggagacagagttcgccctttcagcact

SEQ ID NO: 64405 - DNA, 433 bp, Zea mays
  Clone ID: LIB3075-014-Q1-K1-H6
gaacatcgtccatccgagctaagtaattaggtcgaaaatgacccgtgccagcagcagtagcagcagccggcgtgtgacgctggtactgctcggtctccgcctgctgcttctggttggtgttgcgcaggcggtagtggagttggtgcctgctgatgataatatcgccgccgccgctgctggcacggcggtggacgatggcgagccgcctcagcagtgcgcgaccccggtgagcgtggaggaggcgtgccgcggcgcgtccgagacgcacgccggcgtggcctacgaccactgcatggcgtcgctgggcgccgacccgcgcagcatggaggccggcaacaagaacatgcacgggctggcggtgctggccaccaggatggccatcgaccacgccgtcagcaccgagtccaagatcgacgacctcgcggagcttgaa

SEQ ID NO: 64406 - DNA, 463 bp, Zea mays
  unsure at all n locations
  Clone ID: LIB3075-014-Q1-K1-H8
tcgtgtggacgtgcaagggagcgtgttcgagcttcttacggcgtgtcgcacggtcgaccccgagacccgccgtcaagtctcgtccgagtaccttcatacaccacgcgacggggctgttcacagtatcgactatcatgcgcgcgatcgtgcgcgctccttccaagtctcgcgtcccaccaagtatggctccccatacgtcattccgcgtccgatgttctcgctaccttcatcgatggtggtctatcgatgaactccgcgatgaagagcatcagacagccatcgcactatcgacgagctacgtccttcttcacacgtcaggcatgggcccgcggcataatggacgtccagctgtcccggaagcacgtacataccttctggacacggttagccgtctcacgatccaggtgtaccctangtcgtggacggcagtgatgatgacgttcgacaacgtcggcatgttgag

SEQ ID NO: 64407 - DNA, 322 bp, Zea mays
  Clone ID: LIB3075-014-Q1-K1-H9
aataaggcctaagaagataacccagtgcttcttcgaacagacgagttgtccgacgttccggtccaagtaccatgtatctcaagtacaggggaacgagcatttattatgttttctccagggttgaaagtgcagttgcgtgcagagaatgaatgcctaggcatgcagccactcgctctcggtcggtcgctccagtcctgctggcttcgcttatcttccccttttatttctcgtgatgacatggaatagtctatcctcgtctagctaatcaggtcgcggaaggaagcgcccagctctcgggcacgggcccgacgtcatatatgac

SEQ ID NO: 64408 - DNA, 296 bp, Zea mays
  Clone ID: LIB3075-015-Q1-K1-A1
atcgcgagcggccgtgcttgctcgcccgtgtcccgattcccacttacaacatgaaactgatcccatccatcttgatcgctaaacatgatcgagtcaatgaacttgtcgcaatccattgggtctgacttgctttaccaaatcagcatgcagagacttaggcactatacgttatacatcgtataacactatcaaaagtaactgtgtccgggccctaatggtggcgcgttcggctaagcagacatactcagtgctcgaggtgatgcaacttgaccaggtgctaaacccaagatatctga

SEQ ID NO: 64409 - DNA, 283 bp, Zea mays
  Clone ID: LIB3075-015-Q1-K1-A10
atccaggaccatgcggccaggctccgtttcgcgctggccacactcggcggcggcactaccgttcgctggtcggcgcggcggaagccgcggctgctcaacgggtaaaggagaaagaggcggaggcgtctgaggccgcgcggggccccgcggacctggaggaccgggtggcgcggctgagggcggaggcggcggcgtggcatgccaaggacgcagcggatcagtccacagccgcggcgctccacgcgcagctgcagaaagcggcggcggcgcatgcgaggggcaa

SEQ ID NO: 64410 - DNA, 421 bp, Zea mays
  Clone ID: LIB3075-015-Q1-K1-A11
gcaacatcctcaaaacgctgaagaagctcaagccggaactctgcgccgacgccatgggcacgctcatctaccagtccgacatgcgcgcgcaggatcccgtcggtggctgctaccgcctcgtcctcagtctggagcgccagctcgagatcgatactgccgagctcaccgccgtgctccaccacttggcgttctgccgccaggctaccacgacaaccaccgtgatggcaccgcaacagcaaggcggtggcatggctgacctcgacgtcacgtcctccaaccagccgcttctccccaacgagcagcaagaagtcgttgacgcactctacgtgaatcacgaagctcacaccgccatccttcaaaccgacgaggtcgtccaccgccacggtggaggccacagccccaccgatgatcatcacggtga

SEQ ID NO: 64411 - DNA, 81 bp, Zea mays
  Clone ID: LIB3075-015-Q1-K1-A12
ccgtccgattcccgtcgaccacgcgtcgtacatattaattcaatatctacttataagcattccgaacctgaaaatcagggg

SEQ ID NO: 64412 - DNA, 367 bp, Zea mays
  Clone ID: LIB3075-015-Q1-K1-A2
aaggcacctgtttttggaaagcctcctcgctggtttagttatgctgaactggaacttgcaactggtggtttctcacaagcaaacttcttagctgaaggtggatttgggtctgttcatcgaggtgtccttcctgatggccaggctattgctgttaagcaacacaagcttgctagttcccagggtgatgttgagttctgctcagaggtggaagttcttagttgtgcacaacatcgaaatgttgtaatgctgataggtttttgcgttgaggacaaaaggcgtttattggtttacgagtacatctgcaatagatctttggattcacatctctatggtcataatcgagaaacattggagtggactgcacgac

SEQ ID NO: 64413 - DNA, 409 bp, Zea mays
  unsure at all n locations
  Clone ID: LIB3075-015-Q1-K1-A3
gacttacttgaatactcttcaacagctcataataaagagtggtcttatagatcatattggaatcgaacctttgatgatggaagctcttgagaagattgagaaggatattaagaaaccacttttaaggagtgacaagaagaacatggccacccttatggcagagtttgacaagattaacacaaagcttggcattcggaaggaggatcttcctaagatcgagaaagaacttgaattggagattgccaaaagtgagctgactgaacttaagaaggaatgtgttgaggcaatggagactcaactcaagagggaggagttccaagatgaggagatgcctgatgtcaggaaactggacattcgaaactttctgtangcctgatcgacgataacctttgaggcattgcaaatcacc

SEQ ID NO: 64414 - DNA, 180 bp, Zea mays
  Clone ID: LIB3075-015-Q1-K1-A4
tcgcatcgatcacgacaagatggcgtgcacaaacaatgcgatgagagccttgttcctgctggtcctcttctgcatcgtgcatggtgagaaagaagagtcaaagggcatcgatgcgaaagcgttcaggcctggtgggtacttcgacattaccaagttgtgcgccttcggcaatggcaagac

SEQ ID NO: 64415 - DNA, 437 bp, Zea mays
  Clone ID: LIB3075-015-Q1-K1-A5
cagcaatgtcaggtttgctttttttcattctctccacacttcaacttaaatcactaaagttctgttagtggattaaccatgaagaatactatagacatcgaatgaatgtttttattttccatgtcattcaaacttatttcagtgctggagtgttttttccagccaaagtaattatttatccttgaatgtagtgttatctgctgtcagtggcttgaaagttgggctaccaaatacctcacaaggtgatttctttggggttaaaatttctcgtatcttatagcatggagtttatttttaataaattatggcttactttgtgttttcattaaacgttctttgcagatgctgttgtgatgatttcaattgcacttcttgtagtattgtttagtgtacagaggtatgccactagcaaagtggggtttgcaattggcccttct

SEQ ID NO: 64416 - DNA, 391 bp, Zea mays
  Clone ID: LIB3075-015-Q1-K1-A6
ataaacgagcgtgcaagcgctgctgggctggtgtcagtcacctgagcaaggaagagagatggccacgctgcctcgcgagggcgccgcggcggcggactccgaccagcttttggtagaagcacatggctctacacgaacgctgattttgaataggccaaagcagctcaatgcactctcctctgaaatgattaaaggtctcctatggtatttcacagcttttgagaaagatgatggagtcagattgttgattatgaaggggaatagaagagtattttgctctggaggtgatattgctcaatgtgcccggtgtttatataatggaaactggaaatgggtcgatgatttcttccaaaatgaatatttgctaaattacatcattgcgacttacata

SEQ ID NO: 64417 - DNA, 433 bp, Zea mays
  unsure at all n locations
  Clone ID: LIB3075-015-Q1-K1-A7
cttcgatctcttccacttcggccacgcccgcgccctcgagcaggccaagatgctgttccccaacacctatcttctcgtcggatgctgcaacgacgagctaacctaccgctacaagggcaagaccgtcatgacccaggaagagcgatacgaatccctgcggcactgcaagtgggttgatgaggtcattcctgatgcaccgtgggttctcacacaggagtttattgataagcatcagattgactatgttgctcatgatgcgctgccttatgctgatactagcggaacagcaaatgatgtctatgaatttgttaaaaagattggaaaattcaaggaaacaaaaaggacagacggggtttctacttcagatctcataatgaggatcttgaaggactataaccagtatgtcatgaggaatttagcacggngctactcg

SEQ ID NO: 64418 - DNA, 398 bp, Zea mays
  Clone ID: LIB3075-015-Q1-K1-A9
aagttccactccttccatcctgtctccactattctgagctacctcagcaaggctcctcttgtacctcctggcacaccagtggtgaatgctctagccaagcagagggccatgctggaaaacatcttgcgggcctgcattggccttgcccctgagaacaacatgatgcttgagcacaagtgaagagtttcacgtcccttaattaactaccgcaagataggatgaatggaaaaggagggatcaagcgaaggtgtgggaataatcagtgactcctctgagcccaacgaagaaatgtcaggaggctacaggaaggagaagtgtaaggagagaagaaccagcatggatatatcctcttttcgaaagctatctatctattcttttttggaaaattgactcgtttt

SEQ ID NO: 64419 - DNA, 336 bp, Zea mays
  Clone ID: LIB3075-015-Q1-K1-B10
gttcgcattgaaagtgatgtgtatgtgacggctcaaggatgccggaacctcacaaactgccctcgagaaacctgggagatcgaggctgtaatggctggcgcaccatggcctctgccggcttcaagttctatggtggtagcagcagagaatagcaatgacatatctaaagtgtcgtaattttctctatgctcaatccatatcccgagttgaaacaaattcgatctggattcttatattcaataaatagtgaggctgaggcgcaaaacattgttggattgatgactggaaaacatttcatacgctcacttattttgtaagctctctgttatgtgtttg

SEQ ID NO: 64420 - DNA, 395 bp, Zea mays
  Clone ID: LIB3075-015-Q1-K1-B11
caaatacggattggaggatgatacggtggactttatcgggcatgcgctagcacttcaccgggacgacagctaccttgacgagcctgcaatcgacactgtcaagaggatgaagctctatgcagaatcactcgcacgctttcaaggagggtccccttacatctaccctctatacggtctgggagagctccctcaggcctttgcccgcctgagcgctgtttacggtggcacgtacatgctgaacaagccagaatgcaaggtcgagtttgatgagagtggaaaagcgtatggagtcacttctgaaggggagaccgccaagtgcaagaagatcgtctgccatccttcgtatttgccagacaaggtgaagaaggttggaagggtggcccgcgcgatatgca

SEQ ID NO: 64421 - DNA, 409 bp, Zea mays
  Clone ID: LIB3075-015-Q1-K1-B12
gagaaagtgaaggcacttttgaatacggtaactactataaagaagtggacgatttacgtgatgtgatcctacatttcaaaaaacacaaacgtgacacccatgctattgctggccacagtaagggtgggaatgtggttatcctctatgcatccatatatcatgatatatctaaagttgttaacctgtctggaaggtttaagctggaacgtggtattgaagatcgttttggaaatgattacatggaaaagattgatcagcatggtttcattgatgtggaagacaaaacaggacgtatcatctaccgtgtgaccaaacaaagtctgatggaccgtcttaagacagatatgcactctgcatgcttgtctattgacccaaactgcaagggtgtgactgtacatggtgctaatga

SEQ ID NO: 64422 - DNA, 184 bp, Zea mays
  Clone ID: LIB3075-015-Q1-K1-B2
tcggcaagaagcagctatagctgaatccagaagtagtcccctgacaattgagagttggaaagtaaggcggtcagagatagcaaccaaagtcaccttctacatgatcccagctctgcttctcgtctccaagaacagcatgagtacctcccttctggtcggcgccgtgttccatcaagtgtacatg

SEQ ID NO: 64423 - DNA, 393 bp, Zea mays
  Clone ID: LIB3075-014-Q1-K1-H5
tcgcgctcccttctcgccctccgacggctggttggcagccggcgccggcgccgccaaacgctaggtgctgaggccttcgccagtgtcttcgacggcgacgagcacgtaccagcatcatgtcggaaagaggtcgcctggcaggacgattgattgataaccgcagcagagggtaccatgtagtccctctagttgaggatcccagaggccatcctgaagtcctcgtggatggggatcggaggggctactctgacattcgtggggttcagcaacgtcggggctaccctgacacccatctgcttgaggaacctaggggctaccctggtgttcgtgtggtcgaccataggggctatcctggcagtcgtggggttgatgaacgcatggcctatcctgagc

SEQ ID NO: 64424 - DNA, 357 bp, Zea mays
  Clone ID: LIB3075-019-Q1-K1-G7
acgcggacgcgtaggcggacacgggggcggttcgggttgtctgcttttacacctactgctggtgccagggccgggaaggcgtagcggaagtggcacgcatggggctcggcggagacggatcggcggacacacgccagctcagtaataatgaaaatgtgcggttcatttatggagttgccagttctcctggtaaaagagcatcgatggaggacttctatgacgcaagaatagacgacgtttatggagagaaaattggaatgttcggtgaatatgatggtcatggaagagtccgagcagctgagtatgttaagcaggatcttttcagcaatttaatgaaacacccaaagttcatcactg

SEQ ID NO: 64425 - DNA, 211 bp, Zea mays
  Clone ID: LIB3075-019-Q1-K1-G8
aagactcagcatccttagcacacactttcattttgagatggcaatgctatggtcacaggtgcggacttaccttatcaggatcaggagtctgtgcaattctaccctacagacatccatggttctgaaatcctgagcactgaacgttctggtggtgaaagtggtatcctcagaaatagcgaatgtgaacagaacacggaacgatcctgctttt

SEQ ID NO: 64426 - DNA, 434 bp, Zea mays
  Clone ID: LIB3075-019-Q1-K1-H1
gcagcatccatcgcgtgcgtacattaatctaagcgatcttcatccagccttctgctctgctccctcgaaatggaggcgacgagcaaggcgatggcttcaggcctcctcgttctgctgcttctcatcaacacaggctttgtcctgcccgtccattccgaggactgctgggccgacacccgcgtcatctgcaccaagacgcacaactgccgggacgacacttgcgcggggcgcggcatgccggacggccgctgccactgggagttccccaacctggtgcccttctgccagtgcctgcgccccaactgccactagtccgggcgcctcggattggctcacttcgccggcgatgatggatggtgcccaactgcgactgcccagtctgctccaattcgtgttggttaaggcataatatataaactgccaaattcacatgt

SEQ ID NO: 64427 - DNA, 390 bp, Zea mays
  Clone ID: LIB3075-019-Q1-K1-H10
atttggcattcaatgctcatgagtattttgtggatgctgtaattcccccaccaccacacgataaatcttggagtcgtgtggtggataccaacctggaatcaccaaaggatattgtcccagaaggggtgccattcacaggttcagggtacaggattgctccctactcttccatcttgcttaaagcaaagccttataatggcggaggcaagtcattctcaagtaagcacgaataatggtgttgtgatccctaacttttcaagctcttagccaactgtactgcaagtatagcaaactttggtatgtgaagtcggaccaacccttgcggaaatcaacggaagccatggtttgctaaaggtatactcatggagaattggagatatggcaaacaca

SEQ ID NO: 64428 - DNA, 398 bp, Zea mays
  Clone ID: LIB3075-019-Q1-K1-H12
ggcgcacaggatatggagaggcaggcgctcaatgttttccggatgaggcttcttggtgcagaggtcagggcggtacattctgggacagcaaccctgaaggatgcaacttcagaggctatccgtgactgggtcacaaatgtggagaccacacactatatcttgggctctgttgccggtccgcacccgtacccgatgatggtgagggagttccataaggttattggcaaggaaacccggaggcaggccatggacaagtggggtggcaagccggacgtattggttgcctgcgtcggcggcggatcaaacgccatgggcttattccatgagtttgttgaggatcaagatgtgaggctggttggagtggaagcaactggccatggcgtaaacaccgacaagca

SEQ ID NO: 64429 - DNA, 351 bp, Zea mays
  Clone ID: LIB3075-019-Q1-K1-H2
gaaaacagccgagcgatctcctctccctctccctctccgatccattctccagcgcagcgaagtaaacatgtctgaccgggcaaagatgtcgtggcaggcgtacgtggacgagcacctgatgtgcgagatcgagggccaccacctcgcggcggcggccatcgtcggccacgacggtgccgcctgggcgcagagcacggcgttccccgagttcaagaccgaggacatggccaacatcatgaaggacttcgacgagccagggcacctcgcgccgacaggcctgttcctcggacctaccaagtacatggtcatccaaggcgagcctggtgccgtcatccgtggcaagaagggatc

SEQ ID NO: 64430 - DNA, 399 bp, Zea mays
  unsure at all n locations
  Clone ID: LIB3075-019-Q1-K1-H4
ggcgcctcctctaatttgatgggcattccgtttccttctcaacttcaacgccaacaacagttgatgctactatggttggaaatcgggcatggttcggagggcttttcagcggctcaggcaaaaggcgacaagtcagtgcagagaagatagtgcttgatctaacccctgtacaggaacagagactgcaaagtctgaaggaaaggctaaatgtaccttacgacgaaactcggacggatcatcaagattcgcttagggctctatggaatgcctcctttcccgatacagagctcactagcttagtttcggaacagtggaaagacatggggtggcagggcgtcaacccagcaactgatttcaggggcttgggatttgnttcgcttgagaaaccttttgtttttg

SEQ ID NO: 64431 - DNA, 429 bp, Zea mays
  Clone ID: LIB3075-019-Q1-K1-H5
atttgaaataatcgggaataaatagttcgtgaatccctgaagcgtgcatatatatattcctgccaagataaaggtaatggagtcgtcacgcaggttccagccggccgtcatcctgcttctcctgctcattgcgtccaccgatatggcacaggcaagggaatgcgagaagtacagtgagcgatttgttggggcatgcatgatcgcagacaactgcgccaatgtgtgccgcggtgagggcttcttggccggcaggtgcagcaccttccgccgccgctgcatctgcactaggcagagctaaacaagatcgctcgatcgctcgccatgcatcgacaacctattcttaataacgttcattatctcgttcttatttatgacgaatgtcatgtatgttctggtgactgtcatgtatattctgatgactgtcatgta

SEQ ID NO: 64432 - DNA, 437 bp, Zea mays
  Clone ID: LIB3075-019-Q1-K1-H6
gaaaatggcccttagggttattgctgatagcttatctgaggaagaaatcgcggggttaaaagaaatgttcaaaatgattgacagtgacaacagtggtcatatcacattggaggaactaaaaactggcttgcagagagttggtgctaatttgatggattcggaaatcaatgctctaatggaagctgcagatatcgacaacagtggcacaattgattacggggagttcattgctgcaactttgcatataaacaaagttgaaaaggaggataagctctttgctgctttctcatactttgacaaagacggcagtggttacataactcaagatgagctccaaaaggcatgtgaggagtttggcttaggggatacccgacttgaggacattattggggacatcgatcaagacaatgatggacgaatcgactacaatgagttcg

SEQ ID NO: 64433 - DNA, 397 bp, Zea mays
  Clone ID: LIB3075-019-Q1-K1-H7
cggattggcatttcgaggcagacgtacgcgtgcgaataccggacgacgagcgagcagtctatttattacacccattaactaataacagctaactggaaaccttactcctcggaccactatattcaggagctacgaaatgatccactcgccagccatggagacgaacaaagtaatctgcgccgatgtagtcgtcgccgtctataccaccgacacgctggccatagtcgatttcgaggcgccctcttaggcgccctgatgcgcatccggagattcggttggccctagaacaagcggtgccgtcgccgacgacgtggccgccggctgagcgcttgtaagcttattactgggctactacctacactgagcgactacacgcggggcggcaacgtcgggatgc

SEQ ID NO: 64434 - DNA, 229 bp, Zea mays
  Clone ID: LIB3075-019-Q1-K1-H9
cgcagcagccgtaattcgaccgacctttttttcggtcgtcctccatatcgtctacgctggctgtcgctactatttttaggaatcaagatgagccgcggtgagcagtgcagatggtgatcaaagttctcagaagtatagtgtatggaagaggtgagctgatcaaaccagcagtcacaccaactgcatgtgctgcatctgttgagagaccatctgatgtaaagactgatgc

SEQ ID NO: 64435 - DNA, 415 bp, Zea mays
  Clone ID: LIB3075-020-Q1-K1-A1
cgcacatgaagatcctgctgaaatggatgacagggagaaatgtcgtgaagctgacctgcgtgcgcgtgggcaacgcgaagaagttcctctactccccgtccactgaaagcagcagcagcagcgccggcgcatcaccgtcatccacatcggcctcgcagtgacggtcagtcgctgttaagccctggtgggggttcttgatgttgctttgtggatcgatggaggttgcctctggtcattcggatcccatgtttaaccttgatgacgaacattggaaaaagcattttgttttatggactggaatagtctgcaaaccatcacgatagcaatattgttctgctgctcctcagctgaggatgctgccctgtcctgaactcctgattttgcttttgatctactatgtgatgatttgctcttc

SEQ ID NO: 64436 - DNA, 169 bp, Zea mays
  Clone ID: LIB3075-020-Q1-K1-A10
cgattctcaagttgataaatgatggctggatgctggttttcgtgctccaagcctgctgcttctggcagggaaaaaaagacctgcccttgttgcagcgttgttgtttagaatgacctatatttgactggtattctgttacggtggctttgcaaagctgtttgtttggttt

SEQ ID NO: 64437 - DNA, 430 bp, Zea mays
  Clone ID: LIB3075-020-Q1-K1-A12
aaaaaaaacagcagaatacgtagagtcgactacgacagcgtccggcgaggaggcggaggcgaaggtgaggaagaagctcggcacccggttccccgcggctcgaatcaaaaagataatgcaagcagatgaggatgttggaaagattgcactagcagttcctgttttagtttcgaggtctcttgaattgtttttacaagatttaattgaccgtacttatgaaattactcttcaaagtggagcaaagacactgaattccttccacctgaagcaatgtgtgaagaggtacagttcttttgatttcctaactgaagttgtcagcaaggtaccagatcttggtggcgctgattcctgtggagatgaaagaggattacctagaggaagaaagtcaaatggcgtgacccagagaatgatgaatcaagatctagtaaaa

SEQ ID NO: 64438 - DNA, 301 bp, Zea mays
  Clone ID: LIB3075-020-Q1-K1-A2
cggacgcgtgggcggacgcgtgggttttcaccattagtagctctgtaaattattcggatggaatgtatggaaatgtgcatgtggtccaactgcattttcctgttccttttctgtggcgtcttttttggcagaacgcgaaatgcggcgcgcgtagcgccaccgattgtagagttgctattcctactgccggagtactccatgtgtgttggatatcttgttggcatattaaataaatgcttggacaaaataaaatgattttttgcccattaaaaaaaaaaataatattaaaaaacataaaatg

SEQ ID NO: 64439 - DNA, 424 bp, Zea mays
  Clone ID: LIB3075-020-Q1-K1-A3
cggacgcgtggggtttcaaaggttgcttcctacgagtttacaactttaacatgtattcctggagttatcatgtataagggtgctaaaatccagcttctacatctcccagggatcatcgaaggtgctaaagatggaaagggcagaggaagacaggttatcagcacagctaggacatgcaatgttattttgattgttcttgatgccataaaaccaataactcacaagcgtcttattgagaaggagcttgaaaggatttggcattaggttgaacaaaacaccacccaatttgcctttcagaagaaaggacaagggtggaatcaacttcacataaacagtgacgaacacacattttgaccttgatacagtaaaagcaatctgtagcgagtacaggatacataatgctgatgtctccctgagatatgat

SEQ ID NO: 64440 - DNA, 260 bp, Zea mays
  unsure at all n locations
  Clone ID: LIB3075-019-Q1-K1-G6
caaataattattntgattgcgatccacgtggaaccttctctaaatggcttatccagaggaggtccattatggatggaaatacacgttgatgtagaactttttcaaaaaaagaaaaataaaataaaaaataaaaataaaaaaataaaaataaaaactaaaacaaaataaaaaaataaaaaaataaaaaaaaaaaacaaaaaaaataaaaaaaaaataaaaaaaaataaaaaaaaataaaaaaagaaaaagaaaagaggggg

SEQ ID NO: 64441 - DNA, 337 bp, Zea mays
  Clone ID: LIB3075-019-Q1-K1-E5
gcttataccatccgttcccaagggctcctggttagtgcgacagagtgttggaagcaccccttgtctgttgggaaaggctgttgattgtagttacgttcgaggtcctgcatacttggaggtggacgttgacattggatcttcggcggtagcaaatggagtattgggtcttgcttttggtgtggtgacaacattagtagttgatatggccttactaatacaggccaacacatatgaggagctaccggagcaagtgataggcgcatctcgactggcttatggtgaaccggccacatgagtagttcctgatcttaacaacacattaaatgacagtagcaac

SEQ ID NO: 64442 - DNA, 410 bp, Zea mays
  Clone ID: LIB3075-019-Q1-K1-E7
gcaaatggctgacggcgaggacatccatccccttgtttgtgacaatggaactggcatggtcaaggctggttttgctggtgacgatgcgccaagggctgttttcccaagcattgttggacgcccacgtcacactggcgtgatggttggcatggggcagaaggatgcgtatgttggcgatgaggctcagtccaagaggggtatcctgactttgaagtacccgatcgaacatggcattgtcaacaactgggatgatatggagaagatctggcaccacaccttctataacgaactccgtgttgcgcctgaagagcaccctgtgctgctgaccgaagccccactcaacccaaaggctaacagggagaagatgacccaaatcatgtttgagactttcaatgttcctgccatgtatg

SEQ ID NO: 64443 - DNA, 178 bp, Zea mays
  Clone ID: LIB3075-019-Q1-K1-E8
cagacgcgtgggcatttgtgtttttgttttaaaaacttgtggttaaaccactgtgctcgtaaatatatgaggtacttttgtcccttaatcatttcaccccaatataccatggccagaatgttctttgaacataacttgtttcttgggtggcatgggtttacaaaatttccatagcaaa

SEQ ID NO: 64444 - DNA, 321 bp, Zea mays
  Clone ID: LIB3075-019-Q1-K1-E9
caacagtgaacatcaagctcctgattttttcaacataatgttagaatggccaaagggagactgagatggacatgactaggattaagatgatgcgatgcacaaggccaactacgctagtaaaatctgtcactcctgcaacccaaactgctaagcacaagtgacagcagggaatggtaaataccatattggagtatacacacttcgaccaattgcacaacgcgaggaaatcacttctgattacaactgtgtaactgacatcaaacaagagcatgaagcattactctgactttgtggaaatcaagtatgccatcacagccattt

SEQ ID NO: 64445 - DNA, 389 bp, Zea mays
  Clone ID: LIB3075-019-Q1-K1-F1
gaagatatggagaaacgactcctggggcgcaatcagggaagggttgatgataacattgagactatcaaaaaaaggttcaaaacctttgttgactcaactctgcctgtcattgagcattacaactcaaaggacaaggttaaaaagattgatgctgcaaaaccaatccccgaggtgtttgaagacgtcaaagccatttttgccccatattctctaaaggctgaatagagcaatctaagggacatgataaaggtgatacatggtgtctaggcaccacataaacatatctgtgattatgatggaccctttaatatagaacaaaagttttggctcatttgagctaccagcgtaccagtaggcaattcgatttgttaccagcaacaagtgatctg

SEQ ID NO: 64446 - DNA, 328 bp, Zea mays
  Clone ID: LIB3075-019-Q1-K1-F11
cggacgcgtgggcggacgcgtgggagctcgacgctgaccttgtctacttctggcagaagtaccgcaaattggctgatagctcgcatgcgaaaaatgaggctcggaaggaactgcttgaagtgatggcccacaggtctcatgttgacagcagcgttgagctcattggaagccttctctttggctccgaggacggtccaagggttctgaaagccgtccgtgcacctggtgaacctctggttgatgattggagctgcctcaagtccatagttcgcacttttgaggcgcgatgcgggtccttggcgcagtatgggatgaagcacatgcgatc

SEQ ID NO: 64447 - DNA, 244 bp, Zea mays
  unsure at all n locations
  Clone ID: LIB3075-019-Q1-K1-F5
tcgtcgcgtggaaaagcaatttagcaagagacagctatgctgtatgacgataccccttggactgtgagtcgagtggatgtagcttctnnttactgtctggacacgttcacaggtgatcgaacgaaggcttgatcgattgcagtggacctgtacaagcagtgcttaagggaacccagtcattccagatgcttttcaggtnnagggcagcatttctggcacttgtcacaggtgatcgtataaagaa

SEQ ID NO: 64448 - DNA, 421 bp, Zea mays
  unsure at all n locations
  Clone ID: LIB3075-019-Q1-K1-F6
aaccagcagcctccaataagagccagccttagaaactaataaaactctcgccgccgccgtccgagcgaacaagccaaccgaccccgtccccaaggcaatccgccgccgacgtaccaccaccaccgcaggagcgagatggagatgaagaggatcctcttcgccgtcctcgtcgtcatcgccgcctcggccaccgcagtgctggcctccaccgaggccgccgccgcgggcgccccaactgcctccgagtcgtccgccgaggctcccgctggcgctggcgctggcgctgccgctggcgccgacgcctcggggccctccgtcagcagcggcgcgcccgccctcgccgccgcgcccgacgagctcctcttctccctcctcgcctactacctncactaagcgtgtgcgtgcgtacgtacgcgcgcat

SEQ ID NO: 64449 - DNA, 394 bp, Zea mays
  Clone ID: LIB3075-019-Q1-K1-F8
tctctctctcctctctcggccttcttcgcgtgtttccctctttttcttaggccgccctctacacttctcgacataaccatcgagagggcggtcgagagaaacgagagcggcagacaccatggggagctcgaggaccatcgttgcgtcccccctgctcctcctcgccctcctcctcctggctttcgcggccaccgccgaggcccgcgttgtccccgagctgtttggcgaggaccaattccagcggacatgcaaccaggtgcacttcaggaagatgtgccagagcttgacgaggctcccgagggtgacaacgccgcgcgaactgctgctagcgtcgatgcgcgtcgcggcggagaaggccagggaggccaagagccgggtggacgagttcgcggcg

SEQ ID NO: 64450 - DNA, 251 bp, Zea mays
  Clone ID: LIB3075-019-Q1-K1-F9
ggcctacggctcgacttcgacgagtggctctgagcacgtgtcgtgcacgttcccgggctcggcctcagcctcatgtgtactctctaaagagctcgccgcgcatcgcgatcagcacaggaacgagatggaccggctgatccatgaacatgcggacaggctccggcgcgcgctggccgacactcgtcggcggcactaccgatcgctggtcggcgcggctgacgcggctgctgctcaacgggtaaaggagaagg

SEQ ID NO: 64451 - DNA, 364 bp, Zea mays
  unsure at all n locations
  Clone ID: LIB3075-019-Q1-K1-G1
ggaggatccgatccgaagcgagaggactgaatcctgcggccgggagggacgcgggaccacgacgagcgtcgtcgtcggtgccaagcaacggcagttgtccctgtccagagcacaggcaagatggttaacgcgatcaaggggctgttcatctcctgcgacgtacctatggcgcagttcatcgtcaacctgaacgcgtcgatgccgccgtcggagaggttcatcgtgcacatgctcgaccctaccaacatgttcgtgcaacctcacgtggcgcacatgatcaggagcaagatcggngagttcagggaccagaacagctactagaagccgcagtagtggaggatctaccgagttctacactcctacc

SEQ ID NO: 64452 - DNA, 255 bp, Zea mays
  Clone ID: LIB3075-019-Q1-K1-G10
acagccgacgcgtagggaactagatcgcgctgctctcgaccctataatatacaaggagctggccgtatggatggtttacgctttggacgcaaggttggtcagccagtggaaaatggtggactggtcgaatacttctttggcaaggatgggaatgaacatttacactatgataagttctctagatttttgaagaaattgcttgatgagatggcccgctagaagttaagcccctacaaggggaaatattccacacca

SEQ ID NO: 64453 - DNA, 315 bp, Zea mays
  Clone ID: LIB3075-019-Q1-K1-G11
cgacgcgtacgcgaacacgtcatcgatttgatcttagactatgtctacgtctattgcggcgccttcttcggcgtcgggatgcgcccatcgaagtggacgcagacggtcaagaagacgtacaacctgctgcacaccacgagccagcacaccgatccaggtgtacacggggacattgacgacaatcatgctcacgttcgactactccggcatgtggaacgtgcattacaacatctagctgcggtactacctctgcgtgcacttctacatgagcgtgatctcactggggcaatcactgaacgtctagtacaacatgct

SEQ ID NO: 64454 - DNA, 309 bp, Zea mays
  Clone ID: LIB3075-019-Q1-K1-G12
gtgtaattagaggagacccctcatggcacaccatgccagactcggagctggcggggaagattgtttaaaccattcaacacaaagcatttaaaggaacctcaatggaatcactggacaaagacttcattggatatgctaagattgaccatagtctcgcaaaattctggactatcttttagcaataacatgaagattccaattgtcaaattgaacatatggaacttaagcattgaattcaaaaactgggccttgaatcgaccgatcaggatatcaaagatgtgtttcaagcatttgacatatattaacaca

SEQ ID NO: 64455 - DNA, 440 bp, Zea mays
  Clone ID: LIB3075-019-Q1-K1-G2
cgatcagctgcactgcaccttcgtcgtctccgaagaacgtcgatcgtactcgtacaccatgaaggcagtcgtcgcggcgacgatgcttctgctggtgctggtggccgcggcgacggtggcgagcgcagaccaccgtgatgacgacggccaccaccaccagcgccaccgcggccagagctggcaccgccacagcggcggcggccgagatggccgccggtcgacccctctggcggggctgacgcagtgcgtgacaagctgcgggtctggggtcacctcctgcatgctggactgctaccagccgctggtcgacctggaccccgtggagctgcccgtctgcctcctcaagtgcaccaacgacgccatggtctgcgccaccggcttgcccgtcaccgggaacgtctagcttgctataactagcccatcattatatatatatatct

SEQ ID NO: 64456 - DNA, 396 bp, Zea mays
  Clone ID: LIB3075-019-Q1-K1-E4
cgtcaacaacagacagtacagaggtaaattggaaaaaacatctgtgttaaaagcagtatgctctgggtttgaggagacaactgaacctgatgtctgtttgcgcgaagatatcgagacaaatgaatgtttggagaacaatggtggttgctggttagacaaggctaccaatgtttctgcgtgcaaggataccttccgtggtcgtgtctgcgaatgccctattgtgaatggtgtgaagtttatcggtgatgggtacaaccactgtgaagcttctggccttggtaggtgccagatcaacaatgggggctgctggaatgagactaggaacgggaagagtgtgtctgcctgctcaaaccaagaagctaaaggctgcaagtgcccagcaagtttcaagggcga

SEQ ID NO: 64457 - DNA, 433 bp, Zea mays
  Clone ID: LIB3075-019-Q1-K1-G3
cggacgcgtgggcggacgcgtgggcggtgcgggcggcctccttttccacctcctgctggtgccagggccgggagggcgtcgcggaggtggcgcgcatggggctcgccggggacgggtcggcggacaccgcccacctcagtaataatgaaaatgggcggttcatttatggagttgcgagttctcctggtaaaagagcatcgatggaggacttctatgaggcaagaatagacgacgttgatggagagaaaattggaatgttcggtgtatatgatggtcatggaggagtccgagcagctgagtatgttaagcagcaccttttcagcaatttaatcaaacacccaaagttcatcactgataccaaggctgctatcgccgaaacttacaaccttacagattcaggatttctgaaagctgatagctgtcaaactcgaga

SEQ ID NO: 64458 - DNA, 370 bp, Zea mays
  Clone ID: LIB3075-019-Q1-K1-G4
tcgggcgcgtgggcggacgctgggcggtgtgggttgcctcctttcacctactgtggggcagggccgggagggcgtggcgaacgtggcgcgcatggggctcgccgcggacgggtcggcggacaccgcccacctcagtaataatgaaaatgggcggttcatttatggagttgcgagttctgctggtaaaagagcatcgatggaggacttctatgaggcaagaatagacgacgtttatggagagaaaattggaatgttcggcgtatatgatcgtgatggaggattgcgagcagctgagtcatgtgaagcagcagcttttcaggaagttaatcaaacacgccaaagaagatcactgatgccaaagctggtatag

SEQ ID NO: 64459 - DNA, 414 bp, Zea mays
  Clone ID: LIB3075-019-Q1-K1-C5
agcaaatcggtctgccctggtttaccccgtcgtgaagcagaaacctatctgctgccattaccgtgctgcgcgccgtcgcggtgaggcttggccacaaccgtggaactgtctccatatggcgtaggcggcgtaccgagcttcgcctgatggatttgcagtccagtgggcccataatttctcgccggaccgcgagcagcaacaacctctactcgccggccatgacctctacgcactccaagctctcctccgaggaccgtcatcttcgtgcatgtagtcgagtaaggtcacgaggatctgaagaatcaccctggtatctggaatctcaagtgctaggagaagagcaggtggttcacgaggagccgcctaacactgaggagttcgatctgatctaggtggcgtttcccagtcgacatt

SEQ ID NO: 64460 - DNA, 344 bp, Zea mays
  Clone ID: LIB3075-019-Q1-K1-C7
tcgaccacgctatcaagcccacatggactcggggatcacccggagtggctgcggtcccggtgccgccacggtacagacctgtggctctgtgccgacgtttgggacaggctccggcgaggtgctagacttcgacgcacaccaccggttcaccatctacatcaccgacagcgatggggaactgcagcacataccggcgtgctctatcaacatcagtgagtacacgccgcgtgaggaccctatgctatggcgccggttctaccgcaacatgctaatgcataaggagcaccactggtctggcatggactagcaattccggtgcctcattacagcaccttctggggaca

SEQ ID NO: 64461 - DNA, 196 bp, Zea mays
  Clone ID: LIB3075-019-Q1-K1-C8
caaggggtcccatggccacacggcgtcactcatggtatgaacgtcaaccgtcgcagtcattagcggcatcctaacaacaacgacccatggcgtatcatgcatcgaactgccaagtggcagcacccaaggggttgcactcaagtgagacttgcgatgcccttctagactcctcgcaatcgatctgagccgcatctct

SEQ ID NO: 64462 - DNA, 268 bp, Zea mays
  Clone ID: LIB3075-019-Q1-K1-C9
cagaacgccacaattaatgacacatcctttcgcgaccatgtgctcaatcatatagtgggggcatgatcgcgggctccatccttgatactctcatcgccgccctttcctacatgcccccgaaagtaccacccttcacaaaacatcaccaccaacaacaacggcaagtatctcaccactaagcccaccatgaaccgtcagactaaccataccgtcgctcttgacaaccaccctcacctgggtatcaagaacgggaacctgccaccctaca

SEQ ID NO: 64463 - DNA, 358 bp, Zea mays
  unsure at all n locations
  Clone ID: LIB3075-019-Q1-K1-D1
gttggacaagacgatatccgacatcgagatgcgcctggctgcggctagagccgcccaggcgatgagccagggcatgtcaccgggcgactcggactcggagggcgaccagggaaccgcgcggcgtaggatgtcttttgtcatgggcgttttcaccactcttgctaaccggaagcggagagattcaataaggcagacgtggatgccacagggtgatcagttgcgaagattggaagacaagggcgttgttatccgttttgttgttggacgcagtgcanatccaaacctggaaaatgaggtcgaccatgcaattgatatggaggatgaagaatacggtgatattttgagaatttatcatgtg

SEQ ID NO: 64464 - DNA, 341 bp, Zea mays
  Clone ID: LIB3075-019-Q1-K1-D10
gccgccgctacggccgagaagcggtcctttgcggtggaggccgtgctgcagcagcaggggaacatggacgtgtccctgtccaaggcgacgtcttccggggacgagaacaactacgtgagcgtggccgccgcctacgagaaggccgcgggcgccgtcatcgtggcgacgccggacaacaagctccgcgctatggcgttcgcgttcgacggcgcggtggcgccggacccggaccggtgccccgccgtcgacaagcccttctgcgagacctacgccaagacggagaaggccttcagcggaaccatcgacttcggtgacacgcgcaagagcaagctggtgatcac

SEQ ID NO: 64465 - DNA, 270 bp, Zea mays
  Clone ID: LIB3075-019-Q1-K1-D11
tcgaaagaaaaaacacacataaaagaaagttcttaaaaacagaaaccaggacctataaagcggggggaatcgaagaaattttacccactgtctatttcctgctgactacgatttcacgtttaaacaccgggacgagaagacttgccggcgaccataacttgcaacgaagcggctcaaaaaaggcatttacctttgacgatttcggcaccgatggataccgcggtttcggcgaaggtcgacaagcttcaaagctcggtcaagctctccatt

SEQ ID NO: 64466 - DNA, 387 bp, Zea mays
  unsure at all n locations
  Clone ID: LIB3075-019-Q1-K1-D2
cagagagatacccgatcgccaccgccgtccggactcccctcaaaggcggccacagcacagcgagcatgggagaccggcatcagcatgggcctggcagcggcgtggaggacccggcgacgctgctgcggcgggtgcagacccgcgcgcccaactcgacgcaggtggtggggttcctgacgctgctcgtctctggcgccgtgctgctgctgctgacgggggtgacgctgacgggcgccgcggtggcgctcgtcttcctgggccccatcgcgctgctcaccagccccatctgggtgcccgtcgccgtcgagatctccgncatcgtcgccgccgcgctcttcggctgcgccttcggcggcgtcgtgctccccgtgggcacctggatgtacc

SEQ ID NO: 64467 - DNA, 416 bp, Zea mays
  Clone ID: LIB3075-019-Q1-K1-D4
agaataataaacatcatggggcaagccttacggctcgtcctcctcgccgtcgtggcgctgctgtccgccggcctcctcccgcaggcgctgggtaagggtaggggaggcaggggacacggtggcgccgtcaacccgcaggtcgccggcatctgctctcgcaccccgttcccggaggtgtgcacgtccaccgacgggcggcacgcgtacaagtacccggtcatcgacaacctggccgtgctgaacatgcaggtggacgcgttcgccaagcgcaccgcgcaggcgcgcaagcacgtcgcgaggtcggcccgcaccatcccgccgcagcagacgcaggcgctcacgttctgcgacaccatgtacatgaacacgcaggacaccatcggcgcagcgcagcgggccattacgttcaaggacac

SEQ ID NO: 64468 - DNA, 223 bp, Zea mays
  Clone ID: LIB3075-019-Q1-K1-D5
cttttattaaataaaaaataaatggatattaggagtgtgacaaacaacaatacaatatgtgtgttgattgtggtatagagcaatatataatgatacactggcaagtggtacaacgggtgagtgaatgggtaaaccatgtggtagattaaactgtatcgcctggcattacatatgactttcgctagatagggtggtaattaagagggatgttaagattgaagtt

SEQ ID NO: 64469 - DNA, 428 bp, Zea mays
  Clone ID: LIB3075-019-Q1-K1-D6
cccacgcgtccgccaaaagcttgtggggaaaatggttaaatggttaaaggtcggaggccatattttctttagagaatcatgttttcaccaatctggagattccaaaaggaaggtgaacccaacacactatcgagaaccaaggttttataccaaggtatttaaagagggccattcatttgatcaagatggaggttcgcttgaactttctctagtgacctgtaaatgcattggggcttatgtcaaaaacaagaagaatcaaaaccagatatgctggttatgggaaaaggtaaaatcaacagaagacagagattttcaaagattcctggacaacgtgcaatacaaaacaagtgggatattacgttatgagcgtgtctttggtgaacgttttgtgagcactggtggaatcgagactacaaaggaatttgtgg

SEQ ID NO: 64470 - DNA, 338 bp, Zea mays
  Clone ID: LIB3075-019-Q1-K1-D9
tcgaaaatttagaagatcatagaattatatttagaataccaatccctcagcgaagagcgcagcgttgaaacccacagctgagttctacgactcagatgcagtcaataaaaacccgaatagcccaaaagattaggagacatgtcgatgcagcttaagaagtgtggatataggcatggaacacgtgctcatgcaatacgccaacggttccgacaaactatgagcttgaggccatttcacgtcctttcataaacctcggctaatgcctgcgcgcgcagggtatctatggttccttttttctagcatgaatttacgtgaagtgtctgcacatgtagagggag

SEQ ID NO: 64471 - DNA, 420 bp, Zea mays
  Clone ID: LIB3075-019-Q1-K1-E1
gtcgtgggggttctccggagggcgcgagaaggagcggatcggcgtgggcaagcagccggagatgcctcgctccggcggcggatccaccgccatgtccaagagcaagctctctgacgcagaatcagaaactgacagcgaagaatcagatgtgagtggttctgatggggaagatacttcgtggatttcatggttctgtagcttaaagggcaatgaatttttctgtgaggttgatgatgactacatacaagatgatttcaacctctgtgggctaagcaaccaagttccatattatgactatgcacttgatctgatattagatgttgaatcttcccatggtgatatgttgacagaagagcaaaatgaacttattgaatcagctgctgagatgctctatggattgattcatgttcggtatattat

SEQ ID NO: 64472 - DNA, 115 bp, Zea mays
  Clone ID: LIB3075-019-Q1-K1-E10
agtagaggtcctggagagggtcacaactatagtctcatatattgtttattgaggatgccatcgccttggtttgagatctgtaagcagttcttttatccacaaacaagttggtact

SEQ ID NO: 64473 - DNA, 303 bp, Zea mays
  Clone ID: LIB3075-019-Q1-K1-E11
gacaatctacggctaacctagggttcccttcccgtccggatccgtcgatggtgagaggagggcgtggtggcatggccggcggctgatgggagtaaatcgcggccggagtgcatcatctcgtccaacccgtaccacaagtgcactgactactgcctccgcaggatcgccgaggccagccagggccttacctacaagctcctcaactcgtggaaccgcccgcccagagcaccgtaccgtccaccggaactgcataaacccctgcaacccttaccacgagtgctccgactactgctacaagcgcat

SEQ ID NO: 64474 - DNA, 419 bp, Zea mays
  Clone ID: LIB3075-019-Q1-K1-E2
cggacgcgtggggcaaccccaactacctggccgtgctggtgaagtatgtggcggacgacggcgacatcgtgctgatggaaatccaggacaagttgtcggctgagtggaagcccatgaagctctcttggggcgccatctggaggatggacactgccaaggcgctcaagggccccttctccatccgcctcaccagcgagtccggcaagaaggtcatcgccaaagacgtcatcccggcgaactggagacccgatgccgtctacacttccaacgtccaattctactagactttgaattcccttcgattcatccggcacagcgggctatggaccttcagcagcaagctaattaagttggcagcatgcaccgctaaccttatatactactgagacttccaaattctagtatatgtaatccttttg

SEQ ID NO: 64475 - DNA, 393 bp, Zea mays
  Clone ID: LIB3075-019-Q1-K1-E3
caaattttacccctacagtgcgtaattctgcacagaagaagaacagtagtaaaacaggtgtaattgttggggttgtggttggtgcagcagttttaggagtactagcacttgctggaatctgtatgttgaggcagaaaaggagaaaactattattggagcaacaagagctttacagtattgttggaagacccaatgtatttgtttatggtgagctaaggaccgctactgaaaattttagttccaataaccttcttggtgaaggaggatatgggtcagtttataagggtaaattagctgatggaaaggtggtggctgtaaaacagttatctgaaacatctcatcagggaaaacagcaatttgcagccgaaatagaaactatttctcgagtgcaac

SEQ ID NO: 64476 - DNA, 428 bp, Zea mays
  Clone ID: LIB3075-019-Q1-K1-C4
ccagacccttcaggagatgtacaaccagtggccgtttttcagggtgacgatagacctggtcgagatggtgttcgccaagggtgatcctggcatcgcggcgctgtacgacaagcttctggtttcagaggacctgtggccattaggggcgcgtctcagagccaactacgaagaaacaaagcagcttctcctgcaggtcgctgggcacaaggaccttctggagggcgacccgtacctgaagcagaggctgcgcatccgtgactcgtacaccacggcgctgaacgtttgccaggcctacacgctgaagcgcatcagggaccctggcttccaggtgaagccgcggccccacctgtcgaaggacatcatggacatgggcaagccggcgtccgagctcgtgaagctgaacaccaccagcgagtacgccccggggc

SEQ ID NO: 64477 - DNA, 257 bp, Zea mays
  Clone ID: LIB3075-019-Q1-K1-B1
ggcaatcgagagtgagaacctaaactatgtgggatgtaataactttatgattatgttgggtcaaaacacctggcctgtaatagataattaggtgaacttgttcttattatgctactactcgtttcattatgccgtgaatcctctttatgctaagctttatgtatattgttactgtatcatttgggatctactattcaaaaaataataaaaagggcaaaaaagatcaataaaatggatatcaagctgagtgtccatga

SEQ ID NO: 64478 - DNA, 325 bp, Zea mays
  Clone ID: LIB3075-019-Q1-K1-B10
acctacatgaggaaggcggcggcgatggtgactcatcggacccggcagggggttacgtgcacgcggcggcgctggtgagcccgtccatcctctacaccaaggacgtgctcatcgggcagagcccgaccccggcgttcgacagcccgccgccggagacggtggccaacaaggcaggcggggggccctgttggagagagctcctggagccgggtgtcaggcgcgcgctcttctgtggcgtcatgattcagatcctgcagcagttgtctggcatcaatggtgtgatgtactacacgccccagatccttgaccaggccggtgtgagcgt

SEQ ID NO: 64479 - DNA, 163 bp, Zea mays
  Clone ID: LIB3075-019-Q1-K1-B11
aagacaaaatatgcggttcctgtaaactgagaagttcgtgcaagtttgtgaaccaggaagtggccaggcataatagagtgattctatcagatacgatgagaattatctacttgtttgtactggacgcttgcccacaagagctcgagattaccggttaattaaa

SEQ ID NO: 64480 - DNA, 398 bp, Zea mays
  Clone ID: LIB3075-019-Q1-K1-B2
cggacgcgtgggctgctcgccaaacaaccctgacggtggcatccgacatgccgtcgtcaagtccaaatccagcaaggcgatctatgacttcgcctactactggccgcagtacacgcccatcaccgaggcggctgcccatgatgtcatgctgttcaccttctccaaatgctccggccatgccggtactaggctggggtgggcactggtgaaggacactgaggtggccaagaagatgaccaagttcatggagctcaccacgattggcgtgtccaaggactctcagcttcgtgccgctaagattcttggggcgatctgtaacggctatgagcagctgccatcccccgcgggccaaacaagaagccacctcttccattttgctcgggagaaaatggcggcac

SEQ ID NO: 64481 - DNA, 427 bp, Zea mays
  Clone ID: LIB3075-019-Q1-K1-B3
cggacgcgtgggagagaatctttcaaagatggcgtccaagaagatggtcctcgccgtggcggcactgctgctagtcacgctcgcactgcaggtcgcccctcctgcgatcgccatggactgcaaggccgggtgtgccgagatcaagaactccccactcggcataagcatcgaggagtgtctgaagaggtgcgaggggatcgccactgagcagggacctagggacccttacaaggataacaaacttgatatcccataaacacttatgacttgctgatatatttgtgcctatccaatcatttgtgatagatcaatgcatctttgtgttaaaaatagatagatcaatacatctgtatatatgctcactccgttcttttttatttgtcggcgtttagttcagaaatgaactagcggacgacaaatattagag

SEQ ID NO: 64482 - DNA, 344 bp, Zea mays
  Clone ID: LIB3075-019-Q1-K1-B4
atcgccaaagacgtcatcccggcgaactgtagacccgatgccgtctacacttgcaacgggcaattctactagactttgaattcccttcgattcatccggcacagcgggctatggaccttcagcagcaagctaattaagttggcagcatgcaccgctaaccttatatactactgagacttccaaattctagtatatgtaatccttttgttcgggttcatgatcgaattccaaagagtggaaaacaagcaaaaggttaaatatacatgccatttttggaggcatttttttcatgagggcatgtttcgatatatggaccactaaatatacatatcatttactttcct

SEQ ID NO: 64483 - DNA, 426 bp, Zea mays
  Clone ID: LIB3075-019-Q1-K1-B5
gcgattcattccgcgcgacgcaaaaccctagcccatccaccgatccttgtcatggcggccaccaccagccaggcgagcctcctcctgcagaagcagctcagagatctcgccaagcacccggtggatgggttctcggctgggctggtcgacgatagtaacgtattcgagtggcaggtcaccatcatcggcccgcccgataccctatatgatggagggtacttcaatgcaataatgagcttcccagaaaattacccaaacagcccgccatcagtcagatttacctctgaaatgtggcatccaaatgtttattcagatgggctggtgtgtatctctattcttcatccacctggtgaagatccaagtggttatgagctcgcaagtgagcgttggacacctgtgcatacagttgaaagcatagttctgagc

SEQ ID NO: 64484 - DNA, 422 bp, Zea mays
  unsure at all n locations
  Clone ID: LIB3075-019-Q1-K1-B6
atgaattcatgcagaagctaccgtccttcgacgaggactgggccaggcaacgcagtgatgctgaggctgcaggcgaagtcctgcgttacgttggagcgttggatgcggtgaacaggagcggacaggtggagctacgcaggtacaggagggaccacccgttcgcgcagctctccggctccgacaacatcatcgccttcaccacgtccaggtacaaggagcagccgctgatcgtgcggggtccgggtgccggcgcggaggtgacagccggtggcgtcttctgcgacattctgcggctggcgtcttacctcggtgctccttcttgagcttcgagctacaggtgccagtttcaggaagcagtcggagacacactgccatgcatgatgcctnccctacgtgtttgggctatgctcacatgttgtaat

SEQ ID NO: 64485 - DNA, 422 bp, Zea mays
  unsure at all n locations
  Clone ID: LIB3075-019-Q1-K1-B7
gttcctgataaatctcaagcaagtgttcctactgtgagggatggtggtatcttcaagttccttggtggtccaaaaccaggagatgttgagtacaacttgtcttctgctattcactgctatggtgcagccaagggagcattgttcgcatttcctgtgcattcagtagaaacttccatggttcttaagaaaagaggctggggatttaatgaactgggccgttgtagacttgagaatagaaatctggttagcgccgagattgcttttgcggatgctattaaagcatttgaagaggtgtttgaccacacaaatgttatactgatcaactgtaacttangtcatggtaggagagctttagcagaggaatgtgtatccaggattgatgaatttcagaaacatgatcttcctgaaggcacatatatgca

SEQ ID NO: 64486 - DNA, 428 bp, Zea mays
  Clone ID: LIB3075-019-Q1-K1-B8
ggagttgctcttagggttggtcttgtgcatgtgggcaggtcttgctgttcccactaaatttctctcggtgcttccacattctgatgagaataggatcgtctcgctcccggctaacctggatttcatgatcttcaaccaccgtggaagagtgctgccgtcagactcagacctgaaactccgtacatagacatgtcgtcccagaatccagatcttttttctttattttccctgctgtaacctgtagggatgaaaacggtcggaaacggtatttattcggtaatcagttttttagtcgtttttctttgattgcgaataaataggatatataatctacaatacaaatttgtattcttgtttttaacatccagcttgtaaagattcataaaaggtaaaccttaaattcaaaaaaaaaaaaaaagggcggccgc

SEQ ID NO: 64487 - DNA, 432 bp, Zea mays
  Clone ID: LIB3075-019-Q1-K1-B9
ccaccaccgcccatggaagaagaactggtgtagccgcaactcgccgccatgggactcgtcgggtccagggccgccaagacaccacgctcggacttcgtatctgaactgcactcggttaaggttctacgatcccacctggctggcgtacttctccctcgaccgatcccctcaagcagcatgctgtcgttctccccaacaccatcgcgctcaccttgtcatggtctcacgctccctggttgacgcctcctgccgcatctccctggagtgtgcgcaccgcctatgctggtcaggttgtgagtccccgcgtcgaagcacacgtcctctccgctccacgtccacagtccagcggtgcttggccacgttctcttcctgctgatgctcgcgcacgacggatgttcgacggtttgcgcagccaagtctatgtgccatcat

SEQ ID NO: 64488 - DNA, 430 bp, Zea mays
  Clone ID: LIB3075-019-Q1-K1-C1
gacatttccgagttggaatgacctgtttgacatgtacaacctgacagaagcaaaaaatgcttctgcagtagttgatctccagcgtctagagatacttgccggaagctacttctgtgttgctggagcgctcattggcatcataaatcctgggaggatgactttgtttggtacccttttgattatctggggtatggtgaaagaagcactatttgggaagccagtgaacagtgatctgactcaatcaactcatgtctacccaaccattttgattgcacttatctgtgcattcatgtcgataacttacaacgtaaagaagacagcaagaagtagtactcctgtttctatcgctaagccactgataagttctgccaagtcaaaactgaagtagacttacaagtttaatccttgtaactcttttgaaatatttatt

SEQ ID NO: 64489 - DNA, 301 bp, Zea mays
  Clone ID: LIB3075-019-Q1-K1-C10
gcgtgagatcgaggagaagaaggcaagcttgcagagaaagagagagagagagagagatggatgaggagtacgacgtgatcgtgttggggacggggctcaaggagtgcatcatcagcggcctcctctccgtcgatggcctcaaggtccttaacatggacaggaatgactactacggaggagaatcttcgtccctgaatctaaccaagctctggaacaggttcaagggcaacgacagccttcccgagcacctgggcgtcagcaaagagtacaacgtcgacatggtgcccaagttcatgatggc

SEQ ID NO: 64490 - DNA, 291 bp, Zea mays
  Clone ID: LIB3075-019-Q1-K1-C11
tcgaggtttgctggctaccttcctcctcatcttattaagtgcggagaatgaatatttagccaggggaggtttaaaccatgaatgggacgttactgattgtgaatgctttgactgcatcctgtagcaacctgatagctcttggccattaggcgccatacccatcatatggcaatacatactgatttgagttccaaaatgcacttgaaaaacttacaagctacatattctacaagagctatcatatgatagattatgatctaccacaacgaatcattgcatacttctataaag

SEQ ID NO: 64491 - DNA, 365 bp, Zea mays
  Clone ID: LIB3075-019-Q1-K1-C12
ctccggcgagcacaacgaccacattgattcacgaagcagccaaagaagagacgggtgcgcgtgccaaggcaccagctgctgcagccaccgaggggcctgctgcgggagcgcccatgacatggccggatggcggacctgagttcgtcaagatggtcatcaagaaccccttctttaaaagcgcaccttcatctggtagcgaagacggcctacccattgaccccactccagaaggcagcatgaactaaattaaataccaattacgagaccgaccagatatgcatggagcatgcaagaatgttgtcgaacgaatatatgctatgaatggttacatgtactggctacatttagttcaacttaaattctct

SEQ ID NO: 64492 - DNA, 428 bp, Zea mays
  Clone ID: LIB3075-019-Q1-K1-C2
attgttggacgcgttcccctcctgcacgcaacctcatctcgtcctccagatccaggatggccgtcctccttgagaccttgcctccccgagtgctctcggtgagctactttgtttcgatttatcaggaaatccgtttgcttcatgttgtgcaggctcatatctgattgctggattcggcaaacccgcgttggatcctgtatcgatctggagaaatcgcgaagtcgtcgtcgttcggttcggagcggatctgaggcgacgatagatggaggcggcggcatctctcggtctgcagtcctgctccacctcgatggatgatgtctctgcgctgataattattggatcaatttcgataattattagtagatctatgagatatgccgcctggaagaggcgaagtaagctgcagcatgtaaaaaagagaaaaaaga

SEQ ID NO: 64493 - DNA, 299 bp, Zea mays
  Clone ID: LIB3075-019-Q1-K1-A9
ccgacgcaatcgcctccaacgcctgtttttagtcagctcaccatcaacacctataggggggcaccaccggctccagtgagctcaccaccttctatggcgcaatgacctccaccacctgctccagtcagctcactatcagcacctgagacatcacctccttcagcgcctccagttagctcagcaccacctgctgtgaaatactcttgaccacctactacaggcaactaaccgtcaccacctgataaagtacctcctgcactagcttcaatggttttaccatcgtgtaccatgaaataccc

SEQ ID NO: 64494 - DNA, 397 bp, Zea mays
  Clone ID: LIB3075-019-Q1-K1-C3
ctctaatcaattcttagagttgtatactcattggcctagatgctcatttgaaactgccagctataacttacaatatccaatacatgtaagaaaaggcaagtattggatattgtaagttatagctggcagtttcaaatacttgccttttcttacatgtatttttcttacaggtcttcattgaagtagcccttctaactgatgtgtcactcttgatcaacaagattttgaatgcttttgtaacttgtttcaaaccatgcttgttcctttgatagccattagtcaagatgtatccttaatgggagtgaatagacccactcatcttataacctacaaactcttttggagcagagcgctccagtattatcgcggagctgaagcacttgagtgataatatttt

SEQ ID NO: 64495 - DNA, 345 bp, Zea mays
  Clone ID: LIB3075-018-Q1-K1-H3
gaccatatcttggagccgcaggcgtcatttaataggaagggagggagagacaaacgggcgggttacccgagagagagaaagaggagctcatgccctatccgctgattaccgcccaggggagttccctcctagagagagaaccaaggtgttggccgccttcgtcgtgcaccttcggcgtttcccggactcgtacagtccgtgtgccgagcccaacatggagcgctgaacatgctcgttgcgtcatcgtgcgactggaactctactcgttgtcgaagacaatccctgaatttgtcatggggatccagcttaaaaacctttccactcccccaggacattacctgcgtt

SEQ ID NO: 64496 - DNA, 413 bp, Zea mays
  Clone ID: LIB3075-018-Q1-K1-H4
cggtccctccctcggtccctcccggtctcgcagttcctccccgtcgtcttccaccgcagatcgccgaagcaagcaggcgagctcgggaccagatccactgcgggcagctggagcggaagggccatggggacgccgccgcctttccaggagtccggccactgcgacgtctgccgctgcaccttcaacaccttccgccgccgtcatcactgccgcagctgcggacggacgctctgtcacgagcattcttcgtactacatggctctcccgcagtatgggatatatacagacgtcagagtctgctacggttgcttcaacaaatccttcagccaaggacacgctgataatccggtgtcagctggtagcatttctggagcagctgactctttttcagggctgagtttgggtaaggagga

SEQ ID NO: 64497 - DNA, 438 bp, Zea mays
  unsure at all n locations
  Clone ID: LIB3075-018-Q1-K1-H6
ggcggaggcgacgacggacgccggcgggtggtacaggatggagatcagcggtgaccaccaggacgagatctgcgaggtgctgctgctcaagagccccgaggcggactgcgccgagatcgagcgcacccgcgaccgctgccgcgtcccgctcacccgcaacgacggcatcaggcagagcggcatccgatacgccaaccccatcgccttcttccgcaaggagcctctcagcaactgtggcgagctccttcgcgcttacgacctcttcaacgagacgtccgagaattcctaagcgtcattttgttnttcttttttaatttcctctgccatagcacatttgttcgactgatcgacgttatattagcagacgtgcagctatcctaaaaataaaaataattttcatctccaatgttttagtagctaccatattaatatatatta

SEQ ID NO: 64498 - DNA, 323 bp, Zea mays
  Clone ID: LIB3075-018-Q1-K1-H7
gatacggcctccattatttataaagaggatatagaataaaaaaaagagacgtccttggcgtggtgtcctcgtcctcgtgcccatctctgtcccaatcaaactgatcgatccgtcgcctgcagggccacagcagccgcggcgaggtcgtccgtcggattcggaagctcagttattactgaaaagataatacagtacctatggcttctctggacgccgtgcgaggagacctcgccctgctgattctgtacctgaacaaggccgaggcgcgggacaagatctgccgagcgatccagtacgggtccaagttcatcagcaacggcgag

SEQ ID NO: 64499 - DNA, 310 bp, Zea mays
  Clone ID: LIB3075-018-Q1-K1-H8
gtgagagactgagggcctattctttccttctcaaactcaaattcttcctggaatgcaggaaagccctgcctcccctgtactgattctgaaagtggacttccatctgcacgtcggttgatctattctactttgctgagttggactacattacctccatgtcgagactgcgagctctgtggcaagctttctttaacgccacaaagagagctctcgtatggacttcagatcatctaattccgacaagtgaaagatgtatcttcaatttcaacacagaagatgagctgacaaagcggcatttgtactcagattc

SEQ ID NO: 64500 - DNA, 350 bp, Zea mays
  Clone ID: LIB3075-019-Q1-K1-A1
ccaagacgcgtgcagtctttttgagcctatctacgatgagaccgatggggctgatggggatgtctccgtggaggtgtctcctaggttggcaaatgacactcaaggaactgttgaggcggcaaagtggttacacaaagtggtcaaccgccccaatgtctacataaagatccctgctaccgccgaatgtgttccttccatccgggaagttatcgctaatggcattagcgtcaacgtcacgcttattttctctattgcgacatacgaggctgtgattgatgcttaccttgatgggctagaggctttcgggcttgagcgacttatctcgagttaccagtgtcgcatccttcttt

SEQ ID NO: 64501 - DNA, 256 bp, Zea mays
  Clone ID: LIB3075-019-Q1-K1-A10
tcggccagaagagcacgatcttggccatctcctgttccccggacacctagagggtcaggagggggatgctgtacgcgagctccaaggaccggttcaagagggagctggagggcatccagctggagctgcatgccaccgaccccagcgagatgagcatggacattgtcagggcgcgagctctctgaagaggaagacgcgcatgcgctcgcgcgatcggcatgcatgccccggaacgacagaagctgcttgtcttgca

SEQ ID NO: 64502 - DNA, 313 bp, Zea mays
  Clone ID: LIB3075-019-Q1-K1-A12
tcgcggacgcgtgggcagccaagaggttcagtctatggcaaatttgatgacatcgtactactgtcagatggagaaactgtatacatgggacctgcaaaagaagaacctctaacatacttctcatcattagggtaccagtgtccagatcatatgaaccctgccgagttcttggctgatctcatttccattgattatggctcaactgaaagtgtacagtcatcacagaaaaggatcgaggatctcattgaggcgttttctaacaaatctgtggtcactgaaggtaacaatctaattgcaattgcagacgatcctg

SEQ ID NO: 64503 - DNA, 325 bp, Zea mays
  Clone ID: LIB3075-019-Q1-K1-A2
gaccatagaggtcagcatgggctcgacgcatggtcaggtggaacataggcataagattgccaagatgaaagacgggtacagcaatgcgcctgacttggaggacctgttcttaatgctcaatgtgggttcagcttgcacttggacactgtacaccagggtccggatacagtacgaagctcacatccgctatgactccacatgtagccgataacagtatctggatcatgatagccgctccgacttccatgactaccataactacgtgatgaatacaaagatatggtgatactgctaagcatgaggacacatggactggccagtccac

SEQ ID NO: 64504 - DNA, 287 bp, Zea mays
  Clone ID: LIB3075-019-Q1-K1-A3
agatcacccacatgtacaaagggaagaccgtcatgaccgaggacgagcgctacgaatcgcttcggcattgcaagtgggtcgacgaggtcataccagacgctccatgggtgatcaaccaggagttcatcgacaagcacaacatcgactacgtcgctcacgacgcgctcccatatgctgacacgagtggagctgccaacgatgtctacgaattcgtgaaatccattgggaagttcaaggagacgaagcgcaccgagggcatctcgacgtcggacatcatcatgaggatc

SEQ ID NO: 64505 - DNA, 415 bp, Zea mays
  Clone ID: LIB3075-019-Q1-K1-A4
ccgccaatggtgcctccaaggtcaccgtcaaggacgtcaccttcaagaacatcaccggcgacctcctccaccccggaggccgtcaacctgctctgctctgccaagatcccatgcaccggcgtcaccatggacgacgtcaacatcaagtacagtggcaccaacaacaagaccatggccgtatgcaagaacgctaagggcagcgccaagggttgcctcaaggagctcgcatgcttctagaaccaccatcgacccatctctctagttatacaatgtgtttggttgttggatgctgagagattggttctcagctcagatgcaagctgcgcctagcctgtgtaggtttgtgctggtacattgagagctcttatttatttgctttgattgcaattaaccaggatgaccatagccccttgtt

SEQ ID NO: 64506 - DNA, 358 bp, Zea mays
  Clone ID: LIB3075-019-Q1-K1-A5
aatatctcccctcccttccctcttctggtctccgccccgctccttgcctccgagcccgaattcctccttcggatctcgcattcagcgcagcgcaggtgtgaaggaagggggacgcggaggaagatggggctcgcgttcgggaagctcttcagccggctcttcgccaagaaggagatgcggatcctcatggtcggcctcgacgccgccggtaaaaccaccatcctctacaagctcaagctcggcgagatcgtcaccaccatccccaccatcggtttcaatgttgaaactgttgagtacaagaacattagcttcactgtctggcatgtcggcggtcaggacaagatcagacctcttggag
